United States Patent 11,078,247 (RNA ENCODING A THERAPEUTIC PROTEIN) - sequence listing, part 13

SEQ ID NO: 24628 - RNA, 747 nt, Artificial Sequence
  TIMM21__Homo_sapiens__NP_054896
augaucugcaccuuccugagagccgugcaguacaccgagaagcugcacagaagcagcgccaagagacugcugcugcccuacaucgugcugaacaaggccugccugaagaccgagcccagccugagaugcggccugcaguaccagaagaagacccugagacccagaugcauccugggcgugacccagaagaccaucuggacccagggccccagccccagaaaggccaaggaggacggcagcaagcaggugagcgugcacagaagccagagaggcggcaccgccgugcccaccagccagaaggugaaggaggccggcagagacuucaccuaccugaucguggugcuguucggcaucagcaucaccggcggccuguucuacaccaucuucaaggagcuguucagcagcagcagccccagcaagaucuacggcagagcccuggagaagugcagaagccaccccgaggugaucggcguguucggcgagagcgugaagggcuacggcgaggugaccagaagaggcagaagacagcacgugagauucaccgaguacgugaaggacggccugaagcacaccugcgugaaguucuacaucgagggcagcgagcccggcaagcagggcaccguguacgcccaggugaaggagaaccccggcagcggcgaguacgacuucagauacaucuucguggagaucgagagcuaccccagaagaaccaucaucaucgaggacaacagaagccaggacgacuaa

SEQ ID NO: 24629 - RNA, 585 nt, Artificial Sequence
  TIMM22__Homo_sapiens__NP_037469
auggccgccgccgcccccaacgccggcggcagcgcccccgagaccgccggcagcgccgaggccccccugcaguacagccugcugcugcaguaccuggugggcgacaagagacagcccagacugcuggagcccggcagccugggcggcauccccagccccgccaagagcgaggagcagaagaugaucgagaaggccauggagagcugcgccuucaaggccgcccuggccugcgugggcggcuucgugcugggcggcgccuucggcguguucaccgccggcaucgacaccaacgugggcuucgaccccaaggaccccuacagaacccccaccgccaaggaggugcugaaggacaugggccagagaggcaugagcuacgccaagaacuucgccaucgugggcgccauguucagcugcaccgagugccugaucgagagcuacagaggcaccagcgacuggaagaacagcgugaucagcggcugcaucaccggcggcgccaucggcuucagagccggccugaaggccggcgccaucggcugcggcggcuucgccgccuucagcgccgccaucgacuacuaccugagauaa

SEQ ID NO: 24630 - RNA, 630 nt, Artificial Sequence
  TIMM23__Homo_sapiens__NP_006318
auggagggcggcggcggcagcggcaacaagaccaccggcggccuggccggcuucuucggcgccggcggcgccggcuacagccacgccgaccuggccggcgugccccugaccggcaugaacccccugagccccuaccugaacguggaccccagauaccuggugcaggacaccgacgaguucauccugcccaccggcgccaacaagaccagaggcagauucgagcuggccuucuucaccaucggcggcugcugcaugaccggcgccgccuucggcgccaugaacggccugagacugggccugaaggagacccagaacauggccuggagcaagcccagaaacgugcagauccugaacauggugaccagacagggcgcccugugggccaacacccugggcagccuggcccugcuguacagcgccuucggcgugaucaucgagaagaccagaggcgccgaggacgaccugaacaccguggccgccggcaccaugaccggcaugcuguacaagugcaccggcggccugagaggcaucgccagaggcggccugaccggccugacccugaccagccuguacgcccuguacaacaacugggagcacaugaagggcagccugcugcagcagagccuguaa

SEQ ID NO: 24631 - RNA, 1359 nt, Artificial Sequence
  TIMM44__Homo_sapiens__NP_006342
auggccgccgccgcccugagaagcggcuggugcagaugccccagaagaugccugggcagcggcauccaguuccugagcagccacaaccugccccacggcagcaccuaccagaugagaagacccggcggcgagcugccccugagcaagagcuacagcagcggcaacagaaagggcuuccugagcggccugcuggacaacgugaagcaggagcuggccaagaacaaggagaugaaggagagcaucaagaaguucagagacgaggccagaagacuggaggagagcgacgugcugcaggaggccagaagaaaguacaagaccaucgagagcgagaccgugagaaccagcgaggugcugagaaagaagcugggcgagcugaccggcaccgugaaggagagccugcacgaggugagcaagagcgaccugggcagaaagaucaaggagggcguggaggaggccgccaagaccgccaagcagagcgccgagagcgugagcaagggcggcgagaagcugggcagaaccgccgccuucagagcccugagccagggcguggagagcgugaagaaggagaucgacgacagcgugcugggccagaccggccccuacagaagaccccagagacugagaaagagaaccgaguucgccggcgacaaguucaaggaggagaagguguucgagcccaacgaggaggcccugggcguggugcugcacaaggacagcaagugguaccagcaguggaaggacuucaaggagaacaacgugguguucaacagauucuucgagaugaagaugaaguacgacgagagcgacaacgccuucaucagagccagcagagcccugaccgacaaggugaccgaccugcugggcggccuguucagcaagaccgagaugagcgaggugcugaccgagauccugagaguggaccccgccuucgacaaggacagauuccugaagcagugcgagaacgacaucauccccaacgugcuggaggccaugaucagcggcgagcuggacauccugaaggacuggugcuacgaggccaccuacagccagcuggcccaccccauccagcaggccaaggcccugggccugcaguuccacagcagaauccuggacaucgacaacguggaccuggccaugggcaagaugauggagcagggccccgugcugaucaucaccuuccaggcccagcuggugaugguggugagaaaccccaagggcgaggugguggagggcgaccccgacaaggugcugagaaugcuguacgugugggcccugugcagagaccaggacgagcugaaccccuacgccgccuggagacugcuggacaucagcgccagcagcaccgagcagauccuguaa

SEQ ID NO: 24632 - RNA, 1371 nt, Artificial Sequence
  TIMM50__Homo_sapiens__NP_001001563
auggccagcgcccugagccugggcaacaagugcgaccccuuccugagaugcgugcugugcagaggcggcggcgcccugcagggccccagaggcagaggccccgacgacuucgagagccagcugagcccccccggcagcgccagaagacuggugagaagcaagagagccugcggcaacccccccgacgccuucggccugagcagagccagcgugcaccccccccugcccagagugagcaucggcugcagcagcggccccggcagagccaagagagagagagugggcggcgccgccuggagacagagaaagauggccgccagcgccgccguguucagcagacugagaagcggccugagacugggcagcagaggccugugcaccagacuggccaccccccccagaagagcccccgaccaggccgccgagaucggcagcagaggcagcaccaaggcccagggcccccagcagcagcccggcagcgagggccccagcuacgccaagaagguggcccuguggcuggccggccugcugggcgccggcggcaccgugagcgugguguacaucuucggcaacaaccccguggacgagaacggcgccaagauccccgacgaguucgacaacgaccccauccuggugcagcagcugagaagaaccuacaaguacuucaaggacuacagacagaugaucaucgagcccaccagccccugccugcugcccgacccccugcaggagcccuacuaccagccccccuacacccuggugcuggagcugaccggcgugcugcugcaccccgaguggagccuggccaccggcuggagauucaagaagagacccggcaucgagacccuguuccagcagcuggccccccuguacgagaucgugaucuucaccagcgagaccggcaugaccgccuucccccugaucgacagcguggacccccacggcuucaucagcuacagacuguucagagacgccaccagauacauggacggccaccacgugaaggacaucagcugccugaacagagaccccgccagagugguggugguggacugcaagaaggaggccuucagacugcagcccuacaacggcguggcccugagacccugggacggcaacagcgacgacagagugcugcuggaccugagcgccuuccugaagaccaucgcccugaacggcguggaggacgugagaaccgugcuggagcacuacgcccuggaggacgacccccuggccgccuucaagcagagacagagcagacuggagcaggaggagcagcagagacuggccgagcugagcaagagcaacaagcagaaccuguuccugggcagccugaccagcagacuguggcccagaagcaagcagcccuaa

SEQ ID NO: 24633 - RNA, 294 nt, Artificial Sequence
  TIMM8A__Homo_sapiens__NP_004076
auggacagcagcagcagcagcagcgccgccggccugggcgccguggacccccagcugcagcacuucaucgagguggagacccagaagcagagauuccagcagcuggugcaccagaugaccgagcugugcugggagaagugcauggacaagcccggccccaagcuggacagcagagccgaggccugcuucgugaacugcguggagagauucaucgacaccagccaguucauccugaacagacuggagcagacccagaagagcaagcccguguucagcgagagccugagcgacuaa

SEQ ID NO: 24634 - RNA, 297 nt, Artificial Sequence
  TIMM8B__Homo_sapiens__NP_036591
augagaaagcacagcugcagaaagguggccagccugagaagaaccauggccgagcugggcgaggccgacgaggccgagcugcagagacugguggccgccgagcagcagaaggcccaguucaccgcccaggugcaccacuucauggagcugugcugggacaagugcguggagaagcccggcaacagacuggacagcagaaccgagaacugccugagcagcugcguggacagauucaucgacaccacccuggccaucaccagcagauucgcccagaucgugcagaagggcggccaguaa

SEQ ID NO: 24635 - RNA, 858 nt, Artificial Sequence
  TIMMDC1__Homo_sapiens__NP_057673
auggaggugcccccccccgcccccagaagcuuccugugcagagcccugugccuguuccccagaguguucgccgccgaggccgugaccgccgacagcgaggugcuggaggagagacagaagagacugcccuacgugcccgagcccuacuaccccgagagcggcugggacagacugagagagcuguucggcaaggacgagcagcagagaaucagcaaggaccuggccaacaucugcaagaccgccgccaccgccggcaucaucggcuggguguacggcggcauccccgccuucauccacgccaagcagcaguacaucgagcagagccaggccgagaucuaccacaacagauucgacgccgugcagagcgcccacagagccgccaccagaggcuucaucagauacggcuggagauggggcuggagaaccgccguguucgugaccaucuucaacaccgugaacaccagccugaacguguacagaaacaaggacgcccugagccacuucgugaucgccggcgccgugaccggcagccuguucagaaucaacgugggccugagaggccugguggccggcggcaucaucggcgcccugcugggcacccccgugggcggccugcugauggccuuccagaaguacagcggcgagaccgugcaggagagaaagcagaaggacagaaaggcccugcacgagcugaagcuggaggaguggaagggcagacugcaggugaccgagcaccugcccgagaagaucgagagcagccugcaggaggacgagcccgagaacgacgccaagaagaucgaggcccugcugaaccugcccagaaaccccagcgugaucgacaagcaggacaaggacuaa

SEQ ID NO: 24636 - RNA, 624 nt, Artificial Sequence
  TIMP1__Homo_sapiens__NP_003245
auggcccccuucgagccccuggccagcggcauccugcugcugcuguggcugaucgcccccagcagagccugcaccugcgugcccccccacccccagaccgccuucugcaacagcgaccuggugaucagagccaaguucgugggcacccccgaggugaaccagaccacccuguaccagagauacgagaucaagaugaccaagauguacaagggcuuccaggcccugggcgacgccgccgacaucagauucguguacacccccgccauggagagcgugugcggcuacuuccacagaagccacaacagaagcgaggaguuccugaucgccggcaagcugcaggacggccugcugcacaucaccaccugcagcuucguggcccccuggaacagccugagccuggcccagagaagaggcuucaccaagaccuacaccgugggcugcgaggagugcaccguguuccccugccugagcauccccugcaagcugcagagcggcacccacugccuguggaccgaccagcugcugcagggcagcgagaagggcuuccagagcagacaccuggccugccugcccagagagcccggccugugcaccuggcagagccugagaagccagaucgccuaa

SEQ ID NO: 24637 - RNA, 663 nt, Artificial Sequence
  TIMP2__Homo_sapiens__NP_003246
augggcgccgccgccagaacccugagacuggcccugggccugcugcugcuggccacccugcugagacccgccgacgccugcagcugcagccccgugcacccccagcaggccuucugcaacgccgacguggugaucagagccaaggccgugagcgagaaggagguggacagcggcaacgacaucuacggcaaccccaucaagagaauccaguacgagaucaagcagaucaagauguucaagggccccgagaaggacaucgaguucaucuacaccgcccccagcagcgccgugugcggcgugagccuggacgugggcggcaagaaggaguaccugaucgccggcaaggccgagggcgacggcaagaugcacaucacccugugcgacuucaucgugcccugggacacccugagcaccacccagaagaagagccugaaccacagauaccagaugggcugcgagugcaagaucaccagaugccccaugauccccugcuacaucagcagccccgacgagugccuguggauggacugggugaccgagaagaacaucaacggccaccaggccaaguucuucgccugcaucaagagaagcgacggcagcugcgccugguacagaggcgccgccccccccaagcaggaguuccuggacaucgaggaccccuaa

SEQ ID NO: 24638 - RNA, 636 nt, Artificial Sequence
  TIMP3__Homo_sapiens__NP_000353
augacccccuggcugggccugaucgugcugcugggcagcuggagccugggcgacuggggcgccgaggccugcaccugcagccccagccacccccaggacgccuucugcaacagcgacaucgugaucagagccaagguggugggcaagaagcuggugaaggagggccccuucggcacccugguguacaccaucaagcagaugaagauguacagaggcuucaccaagaugccccacgugcaguacauccacaccgaggccagcgagagccugugcggccugaagcuggaggugaacaaguaccaguaccugcugaccggcagaguguacgacggcaagauguacaccggccugugcaacuucguggagagaugggaccagcugacccugagccagagaaagggccugaacuacagauaccaccugggcugcaacugcaagaucaagagcugcuacuaccugcccugcuucgugaccagcaagaacgagugccuguggaccgacaugcugagcaacuucggcuaccccggcuaccagagcaagcacuacgccugcaucagacagaagggcggcuacugcagcugguacagaggcugggccccccccgacaagagcaucaucaacgccaccgaccccuaa

SEQ ID NO: 24639 - RNA, 675 nt, Artificial Sequence
  TIMP4__Homo_sapiens__NP_003247
augcccggcagccccagacccgcccccagcugggugcugcugcugagacugcuggcccugcugagaccccccggccugggcgaggccugcagcugcgcccccgcccacccccagcagcacaucugccacagcgcccuggugaucagagccaagaucagcagcgagaagguggugcccgccagcgccgaccccgccgacaccgagaagaugcugagauacgagaucaagcagaucaagauguucaagggcuucgagaaggugaaggacgugcaguacaucuacacccccuucgacagcagccugugcggcgugaagcuggaggccaacagccagaagcaguaccugcugaccggccaggugcugagcgacggcaagguguucauccaccugugcaacuacaucgagcccugggaggaccugagccuggugcagagagagagccugaaccaccacuaccaccugaacugcggcugccagaucaccaccugcuacaccgugcccugcaccaucagcgcccccaacgagugccuguggaccgacuggcugcuggagagaaagcuguacggcuaccaggcccagcacuacgugugcaugaagcacguggacggcaccugcagcugguacagaggccaccugccccugagaaaggaguucguggacaucgugcagcccuaa

SEQ ID NO: 24640 - RNA, 1431 nt, Artificial Sequence
  TINAG__Homo_sapiens__NP_055279
auguggaccggcuacaagauccugaucuucagcuaccugaccaccgagaucuggauggagaagcaguaccugagccagagagagguggaccuggaggccuacuucaccagaaaccacaccgugcugcagggcaccagauucaagagagccaucuuccagggccaguacugcagaaacuucggcugcugcgaggacagagacgacggcugcgugaccgaguucuacgccgccaacgcccugugcuacugcgacaaguucugcgacagagagaacagcgacugcugccccgacuacaagagcuucugcagagaggagaaggaguggcccccccacacccagcccugguaccccgagggcugcuucaaggacggccagcacuacgaggagggcagcgugaucaaggagaacugcaacagcugcaccugcagcggccagcaguggaagugcagccagcacgugugccuggugagaagcgagcugaucgagcaggugaacaagggcgacuacggcuggaccgcccagaacuacagccaguucuggggcaugacccuggaggacggcuucaaguucagacugggcacccugccccccagccccaugcugcugagcaugaacgagaugaccgccagccugcccgccaccaccgaccugcccgaguucuucguggccagcuacaaguggcccggcuggacccacggcccccuggaccagaagaacugcgccgccagcugggccuucagcaccgccagcguggccgccgacagaaucgccauccagagcaagggcagauacaccgccaaccugagcccccagaaccugaucagcugcugcgccaagaacagacacggcugcaacagcggcagcaucgacagagccuggugguaccugagaaagagaggccuggugagccacgccugcuacccccuguucaaggaccagaacgccaccaacaacggcugcgccauggccagcagaagcgacggcagaggcaagagacacgccaccaagcccugccccaacaacguggagaagagcaacagaaucuaccagugcagcccccccuacagagugagcagcaacgagaccgagaucaugaaggagaucaugcagaacggccccgugcaggccaucaugcaggugagagaggacuucuuccacuacaagaccggcaucuacagacacgugaccagcaccaacaaggagagcgagaaguacagaaagcugcagacccacgccgugaagcugaccggcuggggcacccugagaggcgcccagggccagaaggagaaguucuggaucgccgccaacagcuggggcaagagcuggggcgagaacggcuacuucagaauccugagaggcgugaacgagagcgacaucgagaagcugaucaucgccgccuggggccagcugaccagcagcgacgagcccuaa

SEQ ID NO: 24641 - RNA, 1356 nt, Artificial Sequence
  TINF2__Homo_sapiens__NP_001092744
auggccaccccccugguggccggccccgccgcccugagauucgccgccgccgccagcuggcagguggugagaggcagaugcguggagcacuuccccagagugcuggaguuccugagaagccugagagccguggcccccggccuggugagauacagacaccacgagagacugugcaugggccugaaggccaagguggugguggagcugauccugcagggcagacccugggcccaggugcugaaggcccugaaccaccacuuccccgagagcggccccaucgugagagaccccaaggccaccaagcaggaccugagaaagauccuggaggcccaggagaccuucuaccagcaggugaagcagcugagcgaggcccccguggaccuggccagcaagcugcaggagcuggagcaggaguacggcgagcccuuccuggccgccauggagaagcugcuguucgaguaccugugccagcuggagaaggcccugcccaccccccaggcccagcagcugcaggacgugcugagcuggaugcagcccggcgugagcaucaccagcagccuggccuggagacaguacggcguggacaugggcuggcugcugcccgagugcagcgugaccgacagcgugaaccuggccgagcccauggagcagaaccccccccagcagcagagacuggcccugcacaacccccugcccaaggccaagcccggcacccaccugccccagggccccagcagcagaacccaccccgagccccuggccggcagacacuucaaccuggccccccugggcagaagaagagugcagagccagugggccagcaccagaggcggccacaaggagagacccaccgugaugcuguuccccuucagaaaccugggcagccccacccaggugaucagcaagcccgagagcaaggaggagcacgccaucuacaccgccgaccuggccaugggcaccagagccgccagcaccggcaagagcaagagccccugccagacccugggcggcagagcccugaaggagaaccccguggaccugcccgccaccgagcagaaggagaacugccuggacugcuacauggacccccugagacugagccugcugccccccagagccagaaagcccgugugcccccccagccugugcagcagcgugaucaccaucggcgaccuggugcuggacagcgacgaggaggagaacggccagggcgagggcaaggagagccuggagaacuaccagaagaccaaguucgacacccugauccccacccugugcgaguaccugccccccagcggccacggcgccauccccgugagcagcugcgacugcagagacagcagcagaccccuguaa

SEQ ID NO: 24642 - RNA, 1974 nt, Artificial Sequence
  TIPARP__Homo_sapiens__NP_001171646
auggagauggagaccaccgagcccgagcccgacugcguggugcagccccccagcccccccgacgacuucagcugccagaugagacugagcgagaagaucaccccccugaagaccugcuucaagaagaaggaccagaagagacugggcaccggcacccugagaagccugagacccauccugaacacccugcuggagagcggcagccuggacggcguguucagaagcagaaaccagagcaccgacgagaacagccugcacgagcccaugaugaagaaggccauggagaucaacagcagcugcccccccgccgagaacaacaugagcgugcugauccccgacagaaccaacgugggcgaccagauccccgaggcccaccccagcaccgaggcccccgagagaguggugcccauccaggaccacagcuuccccagcgagacccugagcggcaccguggccgacagcacccccgcccacuuccagaccgaccugcugcaccccgugagcagcgacgugcccaccagccccgacugccuggacaaggugaucgacuacgugcccggcaucuuccaggagaacagcuucaccauccaguacauccuggacaccagcgacaagcugagcaccgagcuguuccaggacaagagcgaggaggccagccuggaccugguguucgagcuggugaaccagcugcaguaccacacccaccaggagaacggcaucgagaucugcauggacuuccugcagggcaccugcaucuacggcagagacugccugaagcaccacaccgugcugcccuaccacuggcagaucaagagaaccaccacccagaaguggcagagcguguucaacgacagccaggagcaccuggagagauucuacugcaaccccgagaacgacagaaugagaaugaaguacggcggccaggaguucugggccgaccugaacgccaugaacguguacgagaccaccgaguucgaccagcugagaagacugagcaccccccccagcagcaacgugaacagcaucuaccacaccguguggaaguucuucugcagagaccacuucggcuggagagaguaccccgagagcgugaucagacugaucgaggaggccaacagcagaggccugaaggaggugagauucaugauguggaacaaccacuacauccugcacaacagcuucuucagaagagagaucaagagaagaccccuguucagaagcugcuucauccugcugcccuaccugcagacccugggcggcgugcccacccaggccccccccccccuggaggccaccagcagcagccagaucaucugccccgacggcgugaccagcgccaacuucuaccccgagaccuggguguacaugcaccccagccaggacuucauccaggugcccgugagcgccgaggacaagagcuacagaaucaucuacaaccuguuccacaagaccgugcccgaguucaaguacagaauccugcagauccugagagugcagaaccaguuccugugggagaaguacaagagaaagaaggaguacaugaacagaaagauguucggcagagacagaaucaucaacgagagacaccuguuccacggcaccagccaggacgugguggacggcaucugcaagcacaacuucgaccccagagugugcggcaagcacgccaccauguucggccagggcagcuacuucgccaagaaggccagcuacagccacaacuucagcaagaagagcagcaagggcgugcacuucauguuccuggccaaggugcugaccggcagauacaccaugggcagccacggcaugagaagacccccccccgugaaccccggcagcgugaccagcgaccuguacgacagcugcguggacaacuucuucgagccccagaucuucgugaucuucaacgacgaccagagcuaccccuacuucgugauccaguacgaggaggugagcaacaccgugagcaucuaa

SEQ ID NO: 24643 - RNA, 603 nt, Artificial Sequence
  TIPIN__Homo_sapiens__NP_001276915
augcugaucagacacauggagcacugggcccacagacuguuccccaagcugcaguucgaggacuucaucgacagaguggaguaccugggcagcaagaaggaggugcagaccugccugaagagaaucagacuggaccugcccauccugcacgaggacuucgugagcaacaacgacgagguggccgagaacaacgagcacgacgugaccagcaccgagcuggaccccuuccugaccaaccugagcgagagcgagauguucgccagcgagcugagcagaagccugaccgaggagcagcagcagagaaucgagagaaacaagcagcuggcccuggagagaagacaggccaagcugcugagcaacagccagacccugggcaacgacaugcugaugaacacccccagagcccacaccguggaggaggugaacaccgacgaggaccagaaggaggagagcaacggccugaacgaggacauccuggacaaccccugcaacgacgccaucgccaacacccugaacgaggaggagacccugcuggaccagagcuucaagaacgugcagcagcagcuggacgccaccagcagaaacaucaccgaggccagauaa

SEQ ID NO: 24644 - RNA, 537 nt, Artificial Sequence
  TIPRL__Homo_sapiens__NP_001026970
augaugauccacggcuuccagagcagccacagagacuucugcuucggccccuggaagcugaccgccagcaagacccacaucaugaagagcgccgacguggagaagcuggccgacgagcugcacaugcccagccugcccgagaugauguucggcgacaacgugcugagaauccagcacggcagcggcuucggcaucgaguucaacgccaccgacgcccugagaugcgugaacaacuaccagggcaugcugaagguggccugcgccgaggaguggcaggagagcagaaccgagggcgagcacagcaaggaggugaucaagcccuacgacuggaccuacaccaccgacuacaagggcacccugcugggcgagagccugaagcugaagguggugcccaccaccgaccacaucgacaccgagaagcugaaggccagagagcagaucaaguucuucgaggaggugcugcuguucgaggacgagcugcacgaccacggcgugagcagccugagcgugaagauccccggcggcggccaccuguaa

SEQ ID NO: 24645 - RNA, 1035 nt, Artificial Sequence
  TIRAP__Homo_sapiens__XP_005271456
augcagaagcccggcuggcagggccugggcccccaguggacccagggccugcccagacccgccagccccgccgccggccugugccccagagugagcagaguguggaccggccccggcggcgugggcggcgccgugagaagagccgcccugcccgagagcggcgccugcgcccugcuguuccccgccgagcccgcccagagcgcccagcccagcagccagcugggccccagagccggcuggcugcugcacgaggugaagaccggcagcccccccagcagccccuucaccaacgccuggagccacggcgccagcuucgacccccacgccauggccagcagcaccagccugcccgcccccggcagcagacccaagaagccccugggcaagauggccgacugguucagacagacccugcugaagaagcccaagaagagacccaacagccccgagagcaccagcagcgacgccagccagcccaccagccaggacagcccccugccccccagccugagcagcgugaccagccccagccugccccccacccacgccagcgacagcggcagcagcagauggagcaaggacuacgacgugugcgugugccacagcgaggaggaccugguggccgcccaggaccuggugagcuaccuggagggcagcaccgccagccugagaugcuuccugcagcugagagacgccacccccggcggcgccaucgugagcgagcugugccaggcccugagcagcagccacugcagagugcugcugaucacccccggcuuccugcaggaccccuggugcaaguaccagaugcugcaggcccugaccgaggcccccggcgccgagggcugcaccaucccccugcugagcggccugagcagagccgccuacccccccgagcugagauucauguacuacguggacggcagaggccccgacggcggcuucagacaggugaaggaggccgugaugagaugcaagcugcugcaggagggcgagggcgagagagacagcgccaccgugagcgaccugcuguaa

SEQ ID NO: 24646 - RNA, 5247 nt, Artificial Sequence
  TJP1__Homo_sapiens__NP_003248
augagcgccagagccgccgccgccaagagcaccgccauggaggagaccgccaucugggagcagcacaccgugacccugcacagagcccccggcuucggcuucggcaucgccaucagcggcggcagagacaacccccacuuccagagcggcgagaccagcaucgugaucagcgacgugcugaagggcggccccgccgagggccagcugcaggagaacgacagaguggccauggugaacggcgugagcauggacaacguggagcacgccuucgccgugcagcagcugagaaagagcggcaagaacgccaagaucaccaucagaagaaagaagaaggugcagauccccgugagcagacccgaccccgagcccgugagcgacaacgaggaggacagcuacgacgaggagauccacgaccccagaagcggcagaagcggcguggugaacagaagaagcgagaagaucuggcccagagacagaagcgccagcagagagagaagccugagccccagaagcgacagaagaagcguggccagcagccagcccgccaagcccaccaaggugacccuggugaagagcagaaagaacgaggaguacggccugagacuggccagccacaucuucgugaaggagaucagccaggacagccuggccgccagagacggcaacauccaggagggcgacguggugcugaagaucaacggcaccgugaccgagaacaugagccugaccgacgccaagacccugaucgagagaagcaagggcaagcugaagaugguggugcagagagacgagagagccacccugcugaacgugcccgaccugagcgacagcauccacagcgccaacgccagcgagagagacgacaucagcgagauccagagccuggccagcgaccacagcggcagaagccacgacagaccccccagaagaagcagaagcagaagccccgaccagagaagcgagcccagcgaccacagcagacacagcccccagcagcccagcaacggcagccugagaagcagagacgaggagagaaucagcaagcccggcgccgugagcacccccgugaagcacgccgacgaccacacccccaagaccguggaggaggugaccguggagagaaacgagaagcagacccccagccugcccgagcccaagcccguguacgcccaggugggccagcccgacguggaccugcccgugagccccagcgacggcgugcugcccaacagcacccacgaggacggcauccugagacccagcaugaagcuggugaaguucagaaagggcgacagcgugggccugagacuggccggcggcaacgacgugggcaucuucguggccggcgugcuggaggacagccccgccgccaaggagggccuggaggagggcgaccagauccugagagugaacaacguggacuucaccaacaucaucagagaggaggccgugcuguuccugcuggaccugcccaagggcgaggaggugaccauccuggcccagaagaagaaggacguguacagaagaaucguggagagcgacgugggcgacagcuucuacaucagaacccacuucgaguacgagaaggagagccccuacggccugagcuucaacaagggcgagguguucagagugguggacacccuguacaacggcaagcugggcagcuggcuggccaucagaaucggcaagaaccacaaggagguggagagaggcaucauccccaacaagaacagagccgagcagcuggccagcgugcaguacacccugcccaagaccgccggcggcgacagagccgacuucuggagauucagaggccugagaagcagcaagagaaaccugagaaagagcagagaggaccugagcgcccagcccgugcagaccaaguuccccgccuacgagagaguggugcugagagaggccggcuuccugagacccgugaccaucuucggccccaucgccgacguggccagagagaagcuggccagagaggagcccgacaucuaccagaucgccaagagcgagcccagagacgccggcaccgaccagagaagcagcggcaucaucagacugcacaccaucaagcagaucaucgaccaggacaagcacgcccugcuggacgugacccccaacgccguggacagacugaacuacgcccagugguaccccaucgugguguuccugaaccccgacagcaagcagggcgugaagaccaugagaaugagacugugccccgagagcagaaagagcgccagaaagcuguacgagagaagccacaagcugagaaagaacaaccaccaccuguucaccaccaccaucaaccugaacagcaugaacgacggcugguacggcgcccugaaggaggccauccagcagcagcagaaccagcuggugugggugagcgagggcaaggccgacggcgccaccagcgacgaccuggaccugcacgacgacagacugagcuaccugagcgcccccggcagcgaguacagcauguacagcaccgacagcagacacaccagcgacuacgaggacaccgacaccgagggcggcgccuacaccgaccaggagcuggacgagacccugaacgacgaggugggcaccccccccgagagcgccaucaccagaagcagcgagcccgugagagaggacagcagcggcaugcaccacgagaaccagaccuacccccccuacagcccccaggcccagccccagcccauccacagaaucgacagccccggcuucaagcccgccagccagcagaaggccgaggccagcagccccgugcccuaccugagccccgagaccaaccccgccagcagcaccagcgccgugaaccacaacgugaaccugaccaacgugagacuggaggagcccacccccgcccccagcaccagcuacagcccccaggccgacagccugagaacccccagcaccgaggccgcccacaucaugcugagagaccaggagcccagccugagcagccacguggaccccaccaagguguacagaaaggaccccuaccccgaggagaugaugagacagaaccacgugcugaagcagcccgccgugagccaccccggccacagacccgacaaggagcccaaccugaccuacgagccccagcugcccuacguggagaagcaggccagcagagaccuggagcagcccaccuacagauacgagagcagcagcuacaccgaccaguucagcagaaacuacgagcacagacugagauacgaggacagagugcccauguacgaggagcaguggagcuacuacgacgacaagcagcccuaccccagcagaccccccuucgacaaccagcacagccaggaccuggacagcagacagcaccccgaggagagcagcgagagaggcuacuuccccagauucgaggagcccgccccccugagcuacgacagcagacccagauacgagcaggcccccagagccagcgcccugagacacgaggagcagcccgcccccggcuacgacacccacggcagacugagacccgaggcccagccccaccccagcgccggccccaagcccgccgagagcaagcaguacuucgagcaguacagcagaagcuacgagcaggugcccccccagggcuucaccagcagagccggccacuucgagccccugcacggcgccgccgccgugcccccccugauccccagcagccagcacaagcccgaggcccugcccagcaacaccaagccccugccccccccccccacccagaccgaggaggaggaggaccccgccaugaagccccagagcgugcugaccagagugaagauguucgagaacaagagaagcgccagccuggagaccaagaaggacgugaacgacaccggcagcuucaagccccccgagguggccagcaagcccagcggcgcccccaucaucggccccaagcccaccagccagaaccaguucagcgagcacgacaagacccuguacagaauccccgagccccagaagccccagcugaagccccccgaggacaucgugagaagcaaccacuacgaccccgaggaggacgaggaguacuacagaaagcagcugagcuacuucgacagaagaagcuucgagaacaagccccccgcccacaucgccgccagccaccugagcgagcccgccaagcccgcccacagccagaaccagagcaacuucagcagcuacagcagcaagggcaagccccccgaggccgacggcguggacagaagcuucggcgagaagagauacgagcccauccaggccaccccccccccccccccccugcccagccaguacgcccagcccagccagcccgugaccagcgccagccugcacauccacagcaagggcgcccacggcgagggcaacagcgugagccuggacuuccagaacagccuggugagcaagcccgaccccccccccagccagaacaagcccgccaccuucagaccccccaacagagaggacaccgcccaggccgccuucuacccccagaagagcuuccccgacaaggcccccgugaacggcaccgagcagacccagaagaccgugacccccgccuacaacagauucacccccaagcccuacaccagcagcgccagacccuucgagagaaaguucgagagccccaaguucaaccacaaccugcugcccagcgagaccgcccacaagcccgaccugagcagcaagacccccaccagccccaagacccuggugaagagccacagccuggcccagccccccgaguucgacagcggcguggagaccuucagcauccacgccgagaagcccaaguaccagaucaacaacaucagcaccgugcccaaggccauccccgugagccccagcgccguggaggaggacgaggacgaggacggccacaccgugguggccaccgccagaggcaucuucaacagcaacggcggcgugcugagcagcaucgagaccggcgugagcaucaucaucccccagggcgccauccccgagggcguggagcaggagaucuacuucaaggugugcagagacaacagcauccugcccccccuggacaaggagaagggcgagacccugcugagcccccuggugaugugcggcccccacggccugaaguuccugaagcccguggagcugagacugccccacugcgaccccaagaccuggcagaacaagugccugcccggcgaccccaacuaccuggugggcgccaacugcgugagcgugcugaucgaccacuucuaa

SEQ ID NO: 24647 - RNA, 3063 nt, Artificial Sequence
  TJP2__Homo_sapiens__NP_001163885
auggaggagcugaucugggagcaguacaccgugacccugcagaaggacagcaagagaggcuucggcaucgccgugagcggcggcagagacaacccccacuucgagaacggcgagaccagcaucgugaucagcgacgugcugcccggcggccccgccgacggccugcugcaggagaacgacagaguggugauggugaacggcacccccauggaggacgugcugcacagcuucgccgugcagcagcugagaaagagcggcaagguggccgccaucguggugaagagacccagaaaggugcagguggccgcccugcaggccagccccccccuggaccaggacgacagagccuucgaggugauggacgaguucgacggcagaagcuucagaagcggcuacagcgagagaagcagacugaacagccacggcggcagaagcagaagcugggaggacagccccgagagaggcagaccccacgagagagccagaagcagagagagagaccugagcagagacagaagcagaggcagaagccuggagagaggccuggaccaggaccacgccagaaccagagacagaagcagaggcagaagccuggagagaggccuggaccacgacuucggccccagcagagacagagacagagacagaagcagaggcagaagcaucgaccaggacuacgagagagccuaccacagagccuacgaccccgacuacgagagagccuacagccccgaguacagaagaggcgccagacacgacgccagaagcagaggccccagaagcagaagcagagagcacccccacagcagaagccccagccccgagcccagaggcagacccggccccaucggcgugcugcugaugaagagcagagccaacgaggaguacggccugagacugggcagccagaucuucgugaaggagaugaccagaaccggccuggccaccaaggacggcaaccugcacgagggcgacaucauccugaagaucaacggcaccgugaccgagaacaugagccugaccgacgccagaaagcugaucgagaagagcagaggcaagcugcagcugguggugcugagagacagccagcagacccugaucaacauccccagccugaacgacagcgacagcgagaucgaggacaucagcgagaucgagagcaacagaagcuucagccccgaggagagaagacaccaguacagcgacuacgacuaccacagcagcagcgagaagcugaaggagagacccagcagcagagaggacacccccagcagacugagcagaaugggcgccacccccacccccuucaagagcaccggcgacaucgccggcaccguggugcccgagaccaacaaggagcccagauaccaggaggacccccccgccccccagcccaaggccgcccccagaaccuuccugagacccagccccgaggacgaggccaucuacggccccaacaccaagauggugagauucaagaagggcgacagcgugggccugagacuggccggcggcaacgacgugggcaucuucguggccggcauccaggagggcaccagcgccgagcaggagggccugcaggagggcgaccagauccugaaggugaacacccaggacuucagaggccuggugagagaggacgccgugcuguaccugcuggagauccccaagggcgagauggugaccauccuggcccagagcagagccgacguguacagagacauccuggccugcggcagaggcgacagcuucuucaucagaagccacuucgagugcgagaaggagaccccccagagccuggccuucaccagaggcgagguguucagagugguggacacccuguacgacggcaagcugggcaacuggcuggccgugagaaucggcaacgagcuggagaagggccugauccccaacaagagcagagccgagcagauggccagcgugcagaacgcccagagagacaacgccggcgacagagccgacuucuggagaaugagaggccagagaagcggcgugaagaagaaccugagaaagagcagagaggaccugaccgccguggugagcgugagcaccaaguuccccgccuacgagagagugcugcugagagaggccggcuucaagagacccguggugcuguucggccccaucgccgacaucgccauggagaagcuggccaacgagcugcccgacugguuccagaccgccaagaccgagcccaaggacgccggcagcgagaagagcaccggcguggugagacugaacaccgugagacagaucaucgagcaggacaagcacgcccugcuggacgugacccccaaggccguggaccugcugaacuacacccagugguuccccaucgugaucuucuucaaccccgacagcagacagggcgugaagaccaugagacagagacugaaccccaccagcaacaagagcagcagaaagcuguucgaccaggccaacaagcugaagaagaccugcgcccaccuguucaccgccaccaucaaccugaacagcgccaacgacagcugguucggcagccugaaggacaccauccagcaccagcagggcgaggccgugugggugagcgagggcaagauggagggcauggacgacgaccccgaggacagaaugagcuaccugaccgccaugggcgccgacuaccugagcugcgacagcagacugaucagcgacuucgaggacaccgacggcgagggcggcgccuacaccgacaacgagcuggacgagcccgccgaggagccccuggugagcagcaucaccagaagcagcgagcccgugcagcacgaggagaucgagaucgcccagaagcaccccgacaucuacgccgugcccaucaagacccacaagcccgaccccggcaccccccagcacaccagcagcagaccccccgagccccagaaggcccccagcagacccuaccaggacaccagaggcagcuacggcagcgacgccgaggaggaggaguacagacagcagcugagcgagcacagcaagagaggcuacuacggccagagcgccagauacagagacaccgagcuguaa

SEQ ID NO: 24648 - RNA, 2760 nt, Artificial Sequence
  TJP3__Homo_sapiens__NP_001254489
auggaggagcugaccaucugggagcagcacaccgccacccugagcaaggaccccagaagaggcuucggcaucgccaucagcggcggcagagacagacccggcggcagcaugguggugagcgacguggugcccggcggccccgccgagggcagacugcagaccggcgaccacaucgugauggugaacggcgugagcauggagaacgccaccagcgccuucgccauccagauccugaagaccugcaccaagauggccaacaucaccgugaagagacccagaagaauccaccugcccgccaccaaggccagccccagcagccccggcagacaggacagcgacgaggacgacggcccccagagaguggaggagguggaccagggcagaggcuacgacggcgacagcagcagcggcagcggcagaagcugggacgagagaagcagaagacccagacccggcagaagaggcagagccggcagccacggcagaagaagccccggcggcggcagcgaggccaacggccuggcccuggugagcggcuucaagagacugcccagacaggacgugcagaugaagcccgugaagagcgugcuggugaagagaagagacagcgaggaguucggcgugaagcugggcagccagaucuucaucaagcacaucaccgacagcggccuggccgccagacacagaggccugcaggagggcgaccugauccugcagaucaacggcgugagcagccagaaccugagccugaacgacaccagaagacugaucgagaagagcgagggcaagcugagccugcuggugcugagagacagaggccaguuccuggugaacaucccccccgccgugagcgacagcgacagcagcccccuggaggacaucagcgaccuggccagcgagcugagccaggccccccccagccacaucccccccccccccagacacgcccagagaagccccgaggccagccagaccgacagccccguggagagccccagacugagaagagagagcagcguggacagcagaaccaucagcgagcccgacgagcagagaagcgagcugcccagagagagcagcuacgacaucuacagagugcccagcagccagagcauggaggacagaggcuacagccccgacaccagaguggugagauuccugaagggcaagagcaucggccugagacuggccggcggcaacgacgugggcaucuucgugagcggcgugcaggccggcagccccgccgacggccagggcauccaggagggcgaccagauccugcaggugaacgacgugcccuuccagaaccugaccagagaggaggccgugcaguuccugcugggccugccccccggcgaggagauggagcuggugacccagagaaagcaggacaucuucuggaagauggugcagagcagagugggcgacagcuucuacaucagaacccacuucgagcuggagcccagcccccccagcggccugggcuucaccagaggcgacguguuccacgugcuggacacccugcaccccggccccggccagagccacgccagaggcggccacuggcuggccgugagaaugggcagagaccugagagagcaggagagaggcaucauccccaaccagagcagagccgagcagcuggccagccuggaggccgcccagagagccgugggcgugggccccggcagcagcgccggcagcaacgccagagccgaguucuggagacugagaggccugagaagaggcgccaagaagaccacccagagaagcagagaggaccugagcgcccugaccagacagggcagauacccccccuacgagagaguggugcugagagaggccagcuucaagagacccguggugauccugggccccguggccgacaucgccaugcagaagcugaccgccgagaugcccgaccaguucgagaucgccgagaccgugagcagaaccgacagccccagcaagaucaucaagcuggacaccgugagagugaucgccgagaaggacaagcacgcccugcuggacgugacccccagcgccaucgagagacugaacuacgugcaguacuaccccaucgugguguucuucauccccgagagcagacccgcccugaaggcccugagacaguggcuggcccccgccagcagaagaagcaccagaagacuguacgcccaggcccagaagcugagaaagcacagcagccaccuguucaccgccaccaucccccugaacggcaccagcgacaccugguaccaggagcugaaggccaucaucagagagcagcagaccagacccaucuggaccgccgaggaccagcuggacggcagccuggaggacaaccuggaccugccccaccacggccuggccgacagcagcgccgaccugagcugcgacagcagagugaacagcgacuacgagaccgacggcgagggcggcgccuacaccgacggcgagggcuacaccgacggcgagggcggccccuacaccgacguggacgacgagccccccgcccccgcccuggccagaagcagcgagcccgugcaggccgacgagagccagagccccagagacagaggcagaaucagcgcccaccagggcgcccagguggacagcagacacccccagggccaguggagacaggacagcaugagaaccuacgagagagaggcccugaagaagaaguucaugagagugcacgacgccgagagcagcgacgaggacggcuacgacuggggccccgccaccgaccuguaa

SEQ ID NO: 24649 - RNA, 705 nt, Artificial Sequence
  TK1__Homo_sapiens__NP_003249
augagcugcaucaaccugcccaccgugcugcccggcagccccagcaagaccagaggccagauccaggugauccugggccccauguucagcggcaagagcaccgagcugaugagaagagugagaagauuccagaucgcccaguacaagugccuggugaucaaguacgccaaggacaccagauacagcagcagcuucugcacccacgacagaaacaccauggaggcccugcccgccugccugcugagagacguggcccaggaggcccugggcguggccgugaucggcaucgacgagggccaguucuuccccgacaucguggaguucugcgaggccauggccaacgccggcaagaccgugaucguggccgcccuggacggcaccuuccagagaaagcccuucggcgccauccugaaccuggugccccuggccgagagcguggugaagcugaccgccgugugcauggagugcuucagagaggccgccuacaccaagagacugggcaccgagaaggagguggaggugaucggcggcgccgacaaguaccacagcgugugcagacugugcuacuucaagaaggccagcggccagcccgccggccccgacaacaaggagaacugccccgugcccggcaagcccggcgaggccguggccgccagaaagcuguucgccccccagcagauccugcagugcagccccgccaacuaa

SEQ ID NO: 24650 - RNA, 705 nt, Artificial Sequence
  TK2__Homo_sapiens__NP_001166114
augggcgccuucugccagagacccagcagcgacaaggagcaggagaaggagaagaagagcgugaucugcguggagggcaacaucgccagcggcaagaccaccugccuggaguucuucagcaacgccaccgacguggaggugcugaccgagcccgugagcaaguggagaaacgugagaggccacaacccccugggccugauguaccacgacgccagcagauggggccugacccugcagaccuacgugcagcugaccaugcuggacagacacaccagaccccaggugagcagcgugagacugauggagagaagcauccacagcgccagauacaucuucguggagaaccuguacagaagcggcaagaugcccgagguggacuacguggugcugagcgagugguucgacuggauccugagaaacauggacgugagcguggaccugaucguguaccugagaaccaaccccgagaccugcuaccagagacugaagaagagaugcagagaggaggagaaggugaucccccuggaguaccuggaggccauccaccaccugcacgaggaguggcugaucaagggcagccuguuccccauggccgcccccgugcuggugaucgaggccgaccaccacauggagagaaugcuggagcuguucgagcagaacagagacagaauccugacccccgagaacagaaagcacugccccuaa

SEQ ID NO: 24651 - RNA, 1872 nt, Artificial Sequence
  TKT__Homo_sapiens__NP_001128527
auggagagcuaccacaagcccgaccagcagaagcugcaggcccugaaggacaccgccaacagacugagaaucagcagcauccaggccaccaccgccgccggcagcggccaccccaccagcugcugcagcgccgccgagaucauggccgugcuguucuuccacaccaugagauacaagagccaggaccccagaaacccccacaacgacagauucgugcugagcaagggccacgccgcccccauccuguacgccgugugggccgaggccggcuuccuggccgaggccgagcugcugaaccugagaaagaucagcagcgaccuggacggccaccccgugcccaagcaggccuucaccgacguggccaccggcagccugggccagggccugggcgccgccugcggcauggccuacaccggcaaguacuucgacaaggccagcuacagaguguacugccugcugggcgacggcgagcugagcgagggcagcgugugggaggccauggccuucgccagcaucuacaagcuggacaaccugguggccauccuggacaucaacagacugggccagagcgaccccgccccccugcagcaccagauggacaucuaccagaagagaugcgaggccuucggcuggcacgccaucaucguggacggccacagcguggaggagcugugcaaggccuucggccaggccaagcaccagcccaccgccaucaucgccaagaccuucaagggcagaggcaucaccggcguggaggacaaggagagcuggcacggcaagccccugcccaagaacauggccgagcagaucauccaggagaucuacagccagauccagagcaagaagaagauccuggccacccccccccaggaggacgcccccagcguggacaucgccaacaucagaaugcccagccugcccagcuacaaggugggcgacaagaucgccaccagaaaggccuacggccaggcccuggccaagcugggccacgccagcgacagaaucaucgcccuggacggcgacaccaagaacagcaccuucagcgagaucuucaagaaggagcaccccgacagauucaucgagugcuacaucgccgagcagaacauggugagcaucgccgugggcugcgccaccagaaacagaaccgugcccuucugcagcaccuucgccgccuucuucaccagagccuucgaccagaucagaauggccgccaucagcgagagcaacaucaaccugugcggcagccacugcggcgugagcaucggcgaggacggccccagccagauggcccuggaggaccuggccauguucagaagcgugcccaccagcaccguguucuaccccagcgacggcguggccaccgagaaggccguggagcuggccgccaacaccaagggcaucugcuucaucagaaccagcagacccgagaacgccaucaucuacaacaacaacgaggacuuccaggugggccaggccaagguggugcugaagagcaaggacgaccaggugaccgugaucggcgccggcgugacccugcacgaggcccuggccgccgccgagcugcugaagaaggagaagaucaacaucagagugcuggaccccuucaccaucaagccccuggacagaaagcugauccuggacagcgccagagccaccaagggcagaauccugaccguggaggaccacuacuacgagggcggcaucggcgaggccgugagcagcgccguggugggcgagcccggcaucaccgugacccaccuggccgugaacagagugcccagaagcggcaagcccgccgagcugcugaagauguucggcaucgacagagacgccaucgcccaggccgugagaggccugaucaccaaggccuaa

SEQ ID NO: 24652 - RNA, 1773 nt, Artificial Sequence
  TKTL1__Homo_sapiens__NP_001139405
auggccgacgccgaggccagagccgaguuccccgaggaggccagacccgacagaggcacccugcaggugcugcaggacauggccagcagacugagaauccacagcaucagagccaccugcagcaccagcagcggcagcagcagcgagaucaugagcgugcuguucuucuacaucaugagauacaagcagagcgaccccgagaaccccgacaacgacagauucgugcuggccaagagacugagcuucguggacguggccaccggcuggcugggccagggccugggcguggccugcggcauggccuacaccggcaaguacuucgacagagccagcuacagaguguucugccugaugagcgacggcgagagcagcgagggcagcgugugggaggccauggccuucgccagcuacuacagccuggacaaccugguggccaucuucgacgugaacagacugggccacagcggcgcccugcccgccgagcacugcaucaacaucuaccagagaagaugcgaggccuucggcuggaacaccuacgugguggacggcagagacguggaggcccugugccagguguucuggcaggccagccaggugaagcacaagcccaccgccgugguggccaagaccuucaagggcagaggcacccccagcaucgaggacgccgagagcuggcacgccaagcccaugcccagagagagagccgacgccaucaucaagcugaucgagagccagauccagaccagcagaaaccuggacccccagccccccaucgaggacagccccgaggugaacaucaccgacgugagaaugaccagcccccccgacuacagagugggcgacaagaucgccaccagaaaggccugcggccuggcccuggccaagcugggcuacgccaacaacagagugguggugcuggacggcgacaccagauacagcaccuucagcgagaucuucaacaaggaguaccccgagagauucaucgagugcuucauggccgagcagaacauggugagcguggcccugggcugcgccagcagaggcagaaccaucgccuucgccagcaccuucgccgccuuccugaccagagccuucgaccacaucagaaucggcggccuggccgagagcaacaucaacaucaucggcagccacugcggcgugagcgugggcgacgacggcgccagccagauggcccuggaggacaucgccauguucagaaccauccccaagugcaccaucuucuaccccaccgacgccgugagcaccgagcacgccguggcccuggccgccaacgccaagggcaugugcuucaucagaaccaccagacccgagaccauggugaucuacaccccccaggagagauucgagaucggccaggccaaggugcugagacacugcgugagcgacaaggugaccgugaucggcgccggcaucaccguguacgaggcccuggccgccgccgacgagcugagcaagcaggacaucuucaucagagugaucgaccuguucaccaucaagccccuggacguggccaccaucgugagcagcgccaaggccaccgagggcagaaucaucaccguggaggaccacuacccccagggcggcaucggcgaggccgugugcgccgccgugagcauggaccccgacauccaggugcacagccuggccgugagcggcgugccccagagcggcaagagcgaggagcugcuggacauguacggcaucagcgccagacacaucaucguggccgugaagugcaugcugcugaacuaa

SEQ ID NO: 24653 - RNA, 1881 nt, Artificial Sequence
  TKTL2__Homo_sapiens__NP_115512
augauggccaacgacgccaagcccgacgugaagaccgugcaggugcugagagacaccgccaacagacugagaauccacagcaucagagccaccugcgccagcggcagcggccagcugaccagcugcugcagcgccgccgagguggugagcgugcuguucuuccacaccaugaaguacaagcagaccgaccccgagcaccccgacaacgacagauucauccugagcagaggccacgccgcccccauccuguacgccgccuggguggaggugggcgacaucagcgagagcgaccugcugaaccugagaaagcugcacagcgaccuggagagacaccccacccccagacugcccuucguggacguggccaccggcagccugggccagggccugggcaccgccugcggcauggccuacaccggcaaguaccuggacaaggccagcuacagaguguucugccugaugggcgacggcgagagcagcgagggcagcgugugggaggccuucgccuucgccagccacuacaaccuggacaaccugguggccguguucgacgugaacagacugggccagagcggccccgccccccuggagcacggcgccgacaucuaccagaacugcugcgaggccuucggcuggaacaccuaccugguggacggccacgacguggaggcccugugccaggccuucuggcaggccagccaggugaagaacaagcccaccgccaucguggccaagaccuucaagggcagaggcauccccaacaucgaggacgccgagaacuggcacggcaagcccgugcccaaggagagagccgacgccaucgugaagcugaucgagagccagauccagaccaacgagaaccugauccccaagagccccguggaggacagcccccagaucagcaucaccgacaucaagaugaccagcccccccgccuacaaggugggcgacaagaucgccacccagaagaccuacggccuggcccuggccaagcugggcagagccaacgagagagugaucgugcugagcggcgacaccaugaacagcaccuucagcgagaucuucagaaaggagcaccccgagagauucaucgagugcaucaucgccgagcagaacauggugagcguggcccugggcugcgccaccagaggcagaaccaucgccuucgccggcgccuucgccgccuucuucaccagagccuucgaccagcugagaaugggcgccaucagccaggccaacaucaaccugaucggcagccacugcggcgugagcaccggcgaggacggcgugagccagauggcccuggaggaccuggccauguucagaagcauccccaacugcaccguguucuaccccagcgacgccaucagcaccgagcacgccaucuaccuggccgccaacaccaagggcaugugcuucaucagaaccagccagcccgagaccgccgugaucuacaccccccaggagaacuucgagaucggccaggccaagguggugagacacggcgugaacgacaaggugaccgugaucggcgccggcgugacccugcacgaggcccuggaggccgccgaccaccugagccagcagggcaucagcgugagagugaucgaccccuucaccaucaagccccuggacgccgccaccaucaucagcagcgccaaggccaccggcggcagagugaucaccguggaggaccacuacagagagggcggcaucggcgaggccgugugcgccgccgugagcagagagcccgacauccuggugcaccagcuggccgugagcggcgugccccagagaggcaagaccagcgagcugcuggacauguucggcaucagcaccagacacaucaucgccgccgugacccugacccugaugaaguaa

SEQ ID NO: 24654 - RNA, 1485 nt, Artificial Sequence
  TLDC1__Homo_sapiens__XP_005256131
augcugcccggcaacagagagggcgccgcccuggagagaagccccugggccgccggccccgacagaaccgcccccggcagccccgccggcgaguucugccagaucagcggccagaugggcaacagcagaagcagagugggcagaagcuucugcagccaguuccugcccgaggagcaggccgagaucgaccagcuguucgacgcccugagcagcgacaagaacagccccaacgugagcagcaagagcuucagccugaaggcccugcagaaccacgugggcgaggcccugccccccgagauggugaccagacuguacgacggcaugagaagaguggaccugaccggcaaggccaagggccccagcgagaacgugagccaggagcaguucaccgccagcaugagccaccugcugaagggcaacagcgaggagaagagccugaugaucaugaagaugaucagcgccaccgagggccccgugaaggccagagaggugcagaaguucaccgaggaccuggugggcagcguggugcacgugcugagccacagacaggagcugagaggcuggaccggcaaggaggcccccggccccaaccccagagugcaggugcuggccgcccagcugcugagcgacaugaagcugcaggacggcaagagacugcugggcccccaguggcuggacuacgacugcgacagagccgugaucgaggacuggguguucagagugccccacguggccaucuuccugagcguggugaucugcaagggcuuccugauccugugcagcagccuggaccugaccacccuggugcccgagagacagguggaccagggcagaggcuucgagagcauccuggacgugcugagcgugauguacaucaacgcccagcugcccagagagcagagacacagauggugccugcuguucagcagcgagcugcacggccacagcuucagccagcugugcggccacaucacccacagaggccccugcguggccgugcuggaggaccacgacaagcacguguucggcggcuucgccagcugcagcugggaggugaagccccaguuccagggcgacaacagaugcuuccuguucagcaucugccccagcauggccguguacacccacaccggcuacaacgaccacuacauguaccugaaccacggccagcagaccauccccaacggccugggcaugggcggccagcacaacuacuucggccuguggguggacguggacuucggcaagggccacagcagagccaagcccaccugcaccaccuacaacagcccccagcugagcgcccaggagaacuuccaguucgacaagauggaggugugggccgugggcgaccccagcgaggagcagcuggccaagggcaacaagagcauccuggacgccgaccccgaggcccaggcccugcuggagaucagcggccacagcagacacagcgagggccugagagaggugcccgacgacgaguaa

SEQ ID NO: 24655 - RNA, 2343 nt, Artificial Sequence
  TLE1__Homo_sapiens__NP_001290032
auguucccccagagcagacaccccaccccccaccaggccgccggccagcccuucaaguucaccauccccgagagccuggacagaaucaaggaggaguuccaguuccugcaggcccaguaccacagccugaagcuggagugcgagaagcuggccagcgagaagaccgagaugcagagacacuacgugauguacuacgagaugagcuacggccugaacaucgagaugcacaagcagaccgagaucgccaagagacugaacaccaucugcgcccaggugauccccuuccugagccaggagcaccagcagcagguggcccaggccguggagagagccaagcaggugaccauggccgagcugaacgccaucaucggcgugagaggccugcccggccugccccccacccagcagcagcugcaggcccagcaccugagccacggccacggcccccccgugccccugaccccccaccccagcggccugcagccccccggcauccccccccugggcggcagcgccggccugcuggcccugagcagcgcccugagcggccagagccaccuggccaucaaggacgacaagaagcaccacgacgccgagcaccacagagacagagagcccggcaccagcaacagccugcuggugcccgacagccugagaggcaccgacaagagaagaaacggccccgaguucagcaacgacaucaagaagagaaagguggacgacaaggacagcagccacuacgacagcgacggcgacaagagcgacgacaaccuggugguggacgugagcaacgaggaccccagcagccccagagccagccccgcccacagccccagagagaacggcaucgacaagaacagacugcugaagaaggacgccagcagcagccccgccagcaccgccagcagcgccagcagcaccagccugaagagcaaggagaugagccugcacgagaaggccagcacccccgugcugaagagcagcacccccacccccagaagcgacaugcccacccccggcaccagcgccacccccggccugagacccggccugggcaagccccccgccaucgacccccuggugaaccaggccgccgccggccugagaaccccccuggccgugcccggccccuaccccgcccccuucggcauggugccccacgccggcaugaacggcgagcugaccagccccggcgccgccuacgccagccugcacaacaugagcccccagaugagcgccgccgccgccgccgccgccgugguggccuacggcagaagccccauggugggcuucgacccccccccccacaugagagugcccaccaucccccccaaccuggccggcauccccggcggcaagcccgccuacagcuuccacgugaccgccgacggccagaugcagcccgugcccuucccccccgacgcccugaucggccccggcauccccagacacgccagacagaucaacacccugaaccacggcgagguggugugcgccgugaccaucagcaaccccaccagacacguguacaccggcggcaagggcugcgugaaggugugggacaucagccaccccggcaacaagagccccgugagccagcuggacugccugaacagagacaacuacaucagaagcugcaagcugcugcccgacggcugcacccugaucgugggcggcgaggccagcacccugagcaucugggaccuggccgcccccacccccagaaucaaggccgagcugaccagcagcgcccccgccugcuacgcccuggccaucagccccgacagcaaggugugcuucagcugcugcagcgacggcaacaucgccgugugggaccugcacaaccagacccuggugagacaguuccagggccacaccgacggcgccagcugcaucgacaucagcaacgacggcaccaagcuguggaccggcggccuggacaacaccgugagaagcugggaccugagagagggcagacagcugcagcagcacgacuucaccagccagaucuucagccugggcuacugccccaccggcgaguggcuggccgugggcauggagagcagcaacguggaggugcugcacgugaacaagcccgacaaguaccagcugcaccugcacgagagcugcgugcugagccugaaguucgccuacugcggcaagugguucgugagcaccggcaaggacaaccugcugaacgccuggagaacccccuacggcgccagcaucuuccagagcaaggagagcagcagcgugcugagcugcgacaucagcguggacgacaaguacaucgugaccggcagcggcgacaagaaggccaccguguacgaggugaucuacuaa

SEQ ID NO: 24656 - RNA, 2121 nt, Artificial Sequence
  TLE2__Homo_sapiens__NP_001138233
auggugcagagcagacugaccgccaccagcgccagccaggacagccccgccagcggccugcagaccccccugcagagcggccagcccuucaaguucagcauccuggagaucugcgacagaaucaaggaggaguuccaguuccugcaggcccaguaccacagccugaagcuggagugcgagaagcuggccagcgagaagaccgagaugcagagacacuacgugauguacuacgagaugagcuacggccugaacaucgagaugcacaagcaggccgagaucgugaagagacugagcggcaucugcgcccagaucauccccuuccugacccaggagcaccagcagcaggugcugcaggccguggagagagccaagcaggugaccgugggcgagcugaacagccugaucggccagcagcagcugcagccccugagccaccacgccccccccgugccccugacccccagacccgccggccuggugggcggcagcgccaccggccugcuggcccugagcggcgcccuggccgcccaggcccagcuggccgccgccgugaaggaggacagagccggcguggaggccgagggcagcagaguggagagagcccccagcagaagcgccagccccagcccccccgagagccugguggaggaggagagacccagcggccccggcggcggcggcaagcagagagccgacgagaaggagcccagcggccccuacgagagcgacgaggacaagagcgacuacaaccuggugguggacgaggaccagcccagcgagccccccagccccgccaccacccccugcggcaaggugcccaucugcauccccgccagaagagaccugguggacagccccgccagccuggccagcagccugggcagcccccugcccagagccaaggagcugauccugaacgaccugcccgccagcacccccgccagcaagagcugcgacagcagccccccccaggacgccagcacccccggccccagcagcgccagccaccugugccagcuggccgccaagcccgcccccagcaccgacagcguggcccugagaagcccccugacccugagcagccccuucaccaccagcuucagccugggcagccacagcacccugaacggcgaccugagcgugcccagcagcuacgugagccugcaccugagcccccaggugagcagcagcgugguguacggcagaagccccgugauggccuucgagagccacccccaccugagaggcagcagcgugagcagcagccugcccagcauccccggcggcaagcccgccuacagcuuccacgugagcgccgacggccagaugcagcccgugcccuuccccagcgacgcccuggugggcgccggcauccccagacacgccagacagcugcacacccuggcccacggcgagguggugugcgccgugaccaucagcggcagcacccagcacguguacaccggcggcaagggcugcgugaaggugugggacgugggccagcccggcgccaagacccccguggcccagcuggacugccugaacagagacaacuacaucagaagcugcaagcugcugcccgacggcagaagccugaucgugggcggcgaggccagcacccugagcaucugggaccuggccgcccccacccccagaaucaaggccgagcugaccagcagcgcccccgccugcuacgcccuggccgugagccccgacgccaaggugugcuucagcugcugcagcgacggcaacaucguggugugggaccugcagaaccagaccauggugagacaguuccagggccacaccgacggcgccagcugcaucgacaucagcgacuacggcaccagacuguggaccggcggccuggacaacaccgugagaugcugggaccugagagagggcagacagcugcagcagcacgacuucagcagccagaucuucagccugggccacugccccaaccaggacuggcuggccgugggcauggagagcagcaacguggagauccugcacgugagaaagcccgagaaguaccagcugcaccugcacgagagcugcgugcugagccugaaguucgccagcugcgugcagggcguggugcugagccccgagcuguaa

SEQ ID NO: 24657 - RNA, 2310 nt, Artificial Sequence
  TLE3__Homo_sapiens__NP_001098662
auguacccccagggcagacaccccgccccccaccagcccggccagcccggcuucaaguucaccguggccgagagcugcgacagaaucaaggacgaguuccaguuccugcaggcccaguaccacagccugaagguggaguacgacaagcuggccaacgagaagaccgagaugcagagacacuacgugauguacuacgagaugagcuacggccugaacaucgagaugcacaagcagaccgagaucgccaagagacugaacaccauccuggcccagaucaugcccuuccugagccaggagcaccagcagcagguggcccaggccguggagagagccaagcaggugaccaugaccgagcugaacgccaucaucggccagcagcagcugcaggcccagcaccugagccacgccacccacggcccccccgugcagcugcccccccaccccagcggccugcagccccccggcaucccccccgugaccggcagcagcagcggccugcuggcccugggcgcccugggcagccaggcccaccugaccgugaaggacgagaagaaccaccacgagcuggaccacagagagagagagagcagcgccaacaacagcgugagccccagcgagagccugagagccagcgagaagcacagaggcagcgccgacuacagcauggaggccaagaagagaaaggccgaggagaaggacagccugagcagauacgacagcgacggcgacaagagcgacgaccuggugguggacgugagcaacgaggaccccgccacccccagagugagccccgcccacagcccccccgagaacggccuggacaaggccagaagccugaagaaggacgcccccaccagccccgccagcguggccagcagcagcagcacccccagcagcaagaccaaggaccugggccacaacgacaagagcagcacccccggccugaagagcaacacccccacccccagaaacgacgcccccacccccggcaccagcaccacccccggccugagaagcaugcccggcaagccccccggcauggaccccaucgccagcgcccugagaacccccaucagcaucaccagcagcuacgccgcccccuucgccaugaugagccaccacgagaugaacggcagccugaccagccccggcgccuacgccggccugcacaacauccccccccagaugagcgccgccgccgccgccgccgccgccgccuacggcagaagccccauggugagcuucggcgccgugggcuucgacccccacccccccaugagagccaccggccugcccagcagccuggccagcauccccggcggcaagcccgccuacagcuuccacgugagcgccgacggccagaugcagcccgugcccuucccccacgacgcccuggccggccccggcauccccagacacgccagacagaucaacacccugagccacggcgagguggugugcgccgugaccaucagcaaccccaccagacacguguacaccggcggcaagggcugcgugaagaucugggacaucagccagcccggcagcaagagccccaucagccagcuggacugccugaacagagacaacuacaucagaagcugcaagcugcugcccgacggcagaacccugaucgugggcggcgaggccagcacccugaccaucugggaccuggccagccccacccccagaaucaaggccgagcugaccagcagcgcccccgccugcuacgcccuggccaucagccccgacgccaaggugugcuucagcugcugcagcgacggcaacaucgccgugugggaccugcacaaccagacccuggugagacaguuccagggccacaccgacggcgccagcugcaucgacaucagccacgacggcaccaagcuguggaccggcggccuggacaacaccgugagaagcugggaccugagagagggcagacagcugcagcagcacgacuucaccagccagaucuucagccugggcuacugccccaccggcgaguggcuggccgugggcauggagagcagcaacguggaggugcugcaccacaccaagcccgacaaguaccagcugcaccugcacgagagcugcgugcugagccugaaguucgccuacugcggcaagugguucgugagcaccggcaaggacaaccugcugaacgccuggagaacccccuacggcgccagcaucuuccagagcaaggagagcagcagcgugcugagcugcgacaucagcgccgacgacaaguacaucgugaccggcagcggcgacaagaaggccaccguguacgaggugaucuacuaa

SEQ ID NO: 24658 - RNA, 2418 nt, Artificial Sequence
  TLE4__Homo_sapiens__NP_001269677
augaucagagaccugagcaagauguacccccagaccagacaccccgccccccaccagcccgcccagcccuucaaguucaccaucagcgagagcugcgacagaaucaaggaggaguuccaguuccugcaggcccaguaccacagccugaagcuggagugcgagaagcuggccagcgagaagaccgagaugcagagacacuacgugauguacuacgagaugagcuacggccugaacaucgagaugcacaagcaggccgagaucgugaagagacugaacgccaucugcgcccaggugauccccuuccugagccaggagcaccagcagcagguggugcaggccguggagagagccaagcaggugaccauggccgagcugaacgccaucaucggccagcagcugcaggcccagcaccugagccacggccacggccugcccgugccccugaccccccaccccagcggccugcagccccccgccaucccccccaucggcagcagcgccggccugcuggcccugagcagcgcccugggcggccagagccaccugcccaucaaggacgagaagaagcaccacgacaacgaccaccagagagacagagacagcaucaagagcagcagcgugagccccagcgccagcuucagaggcgccgagaagcacagaaacagcgccgacuacagcagcgagagcaagaagcagaagaccgaggagaaggagaucgccgccagauacgacagcgacggcgagaagagcgacgacaaccuggugguggacgugagcaacgaggaccccagcagccccagaggcagccccgcccacagccccagagagaacggccuggacaagaccagacugcugaagaaggacgcccccaucagccccgccagcaucgccagcagcagcagcacccccagcagcaagagcaaggagcugagccugaagagagacaugggcaagcugagcgagaccagacugagcgaggacgagcagugcacccugggccugcagagaugguucugcagacugugguucaugaacgagaagagcaccacccccgugagcaagagcaacacccccacccccagaaccgacgcccccacccccggcagcaacagcacccccggccugagacccgugcccggcaagccccccggcguggacccccuggccagcagccugagaacccccauggccgugcccugccccuaccccacccccuucggcaucgugccccacgccggcaugaacggcgagcugaccagccccggcgccgccuacgccggccugcacaacaucagcccccagaugagcgccgccgccgccgccgccgccgccgccgccgccuacggcagaagccccguggugggcuucgacccccaccaccacaugagagugcccgccaucccccccaaccugaccggcauccccggcggcaagcccgccuacagcuuccacgugagcgccgacggccagaugcagcccgugcccuucccccccgacgcccugaucggccccggcauccccagacacgccagacagaucaacacccugaaccacggcgagguggugugcgccgugaccaucagcaaccccaccagacacguguacaccggcggcaagggcugcgugaaggugugggacaucagccaccccggcaacaagagccccgugagccagcuggacugccugaacagagacaacuacaucagaagcugcagacugcugcccgacggcagaacccugaucgugggcggcgaggccagcacccugagcaucugggaccuggccgcccccacccccagaaucaaggccgagcugaccagcagcgcccccgccugcuacgcccuggccaucagccccgacagcaaggugugcuucagcugcugcagcgacggcaacaucgccgugugggaccugcacaaccagacccuggugagacaguuccagggccacaccgacggcgccagcugcaucgacaucagcaacgacggcaccaagcuguggaccggcggccuggacaacaccgugagaagcugggaccugagagagggcagacagcugcagcagcacgacuucaccagccagaucuucagccugggcuacugccccaccggcgaguggcuggccgugggcauggagaacagcaacguggaggugcugcacgugaccaagcccgacaaguaccagcugcaccugcacgagagcugcgugcugagccugaaguucgcccacugcggcaagugguucgugagcaccggcaaggacaaccugcugaacgccuggagaacccccuacggcgccagcaucuuccagagcaaggagagcagcagcgugcugagcugcgacaucagcguggacgacaaguacaucgugaccggcagcggcgacaagaaggccaccguguacgaggugaucuacuaa

SEQ ID NO: 24659 - RNA, 1719 nt, Artificial Sequence
  TLE6__Homo_sapiens__NP_001137458
augaccagcagagaccagcccagacccaagggcccccccaagagcaccagccccugccccggcaucagcaacagcgagagcagccccacccugaacuaccagggcauccugaacagacugaagcaguuccccagauucagcccccacuucgccgccgagcuggagagcaucuacuacagccugcacaagauccagcaggacguggccgagcaccacaagcagaucggcaacgugcugcagaucguggagagcugcagccagcugcagggcuuccagagcgaggaggugagccccgccgagcccgccagccccggcaccccccagcaggugaaggacaagacccugcaggagagcagcuucgaggacaucauggccaccagaagcagcgacuggcugagaagaccccugggcgaggacaaccagcccgagacccagcuguucugggacaaggagcccugguucuggcacgacacccugaccgagcagcuguggagaaucuucgccggcgugcacgacgagaaggccaagcccagagacagacagcaggcccccggccugggccaggagagcaaggcccccggcagcugcgaccccggcaccgaccccugccccgaggacgccagcacccccagaccccccgaggccagcagcagcccccccgagggcagccaggacagaaacaccagcuggggcguggugcaggagccccccggcagagccagcagauuccugcagagcaucagcugggaccccgaggacuucgaggacgccuggaagagacccgacgcccugcccggccagagcaagagacuggccgugcccugcaagcuggagaagaugagaauccuggcccacggcgagcuggugcuggccaccgccaucagcagcuucaccagacacguguucaccugcggcagaagaggcaucaagguguggagccugaccggccagguggccgaggacagauuccccgagagccaccugcccauccagacccccggcgccuuccugagaaccugccugcugagcagcaacagcagaagccugcugaccggcggcuacaaccuggccagcgugagcgugugggaccuggccgcccccagccugcacgugaaggagcagcugcccugcgccggccugaacugccaggcccuggacgccaaccuggacgccaaccuggccuucgccagcuucaccagcggcguggugagaaucugggaccugagagaccagagcguggugagagaccugaagggcuaccccgacggcgugaagagcaucguggugaagggcuacaacaucuggaccggcggccccgacgccugccugagaugcugggaccagagaaccaucaugaagccccuggaguaccaguucaagagccagaucaugagccugagccacagcccccaggaggacugggugcugcugggcauggccaacggccagcaguggcugcagagcaccagcggcagccagagacacauggugggccagaaggacagcgugauccugagcgugaaguucagccccuucggccaguggugggccagcgugggcauggacgacuuccugggcguguacagcaugcccgccggcaccaagguguucgaggugcccgagaugagccccgugaccugcugcgacgugagcagcaacaacagacugguggugaccggcagcggcgagcacgccagcguguaccagaucaccuacuaa

SEQ ID NO: 24660 - RNA, 2157 nt, Artificial Sequence
  TLK1__Homo_sapiens__NP_001130026
auggacgagcugcacagccuggaccccagaagacaggagcugcuggaggccagauucaccggcguggccagcggcagcaccggcagcaccggcagcugcagcgugggcgccaaggccagcaccaacaacgagagcagcaaccacagcuucggcagccugggcagccugagcgacaaggagagcgagacccccgagaagaagcagagcgagagcagcagaggcagaaagagaaaggccgagaaccagaacgagagcagccagggcaagagcaucggcggcagaggccacaagaucagcgacuacuucgaguaccagggcggcaacggcagcagccccgugagaggcaucccccccgccaucagaagcccccagaacagccacagccacagcacccccagcagcagcgugagacccaacagccccagccccaccgcccuggccuucggcgaccaccccaucgugcagcccaagcagcugagcuucaagaucauccagaccgaccugaccaugcugaagcuggccgcccuggagagcaacaagauccaggaccuggagaagaaggagggcagaaucgacgaccugcugagagccaacugcgaccugagaagacagaucgacgagcagcagaagcugcuggagaaguacaaggagagacugaacaagugcaucagcaugagcaagaagcugcugaucgagaagagcacccaggagaagcugagcagcagagagaagagcaugcaggacagacugagacugggccacuucaccaccgugagacacggcgccagcuucaccgagcaguggaccgacggcuucgccuuccagaaccuggugaagcagcaggagugggugaaccagcagagagaggacaucgagagacagagaaagcugcuggccaagagaaagccccccaccgccaacaacagccaggcccccagcaccaacagcgagcccaagcagagaaagaacaaggccgugaacggcgccgagaacgaccccuucgugagacccaaccugccccagcugcugacccuggccgaguaccacgagcaggaggagaucuucaagcugagacugggccaccugaagaaggaggaggccgagauccaggccgagcuggagagacuggagagagugagaaaccugcacaucagagagcugaagagaaucaacaacgaggacaacagccaguucaaggaccaccccacccugaacgagagauaccugcugcugcaccugcugggcagaggcggcuucagcgagguguacaaggccuucgaccuguacgagcagagauacgccgccgugaagauccaccagcugaacaagagcuggagagacgagaagaaggagaacuaccacaagcacgccugcagagaguacagaauccacaaggagcuggaccaccccagaaucgugaagcuguacgacuacuucagccuggacaccgacaccuucugcaccgugcuggaguacugcgagggcaacgaccuggacuucuaccugaagcagcacaagcugaugagcgagaaggaggccagaagcaucgugaugcagaucgugaacgcccugagauaccugaacgagaucaagccccccaucauccacuacgaccugaagcccggcaacauccugcugguggacggcaccgccugcggcgagaucaagaucaccgacuucggccugagcaagaucauggacgacgacagcuacggcguggacggcauggaccugaccagccagggcgccggcaccuacugguaccugccccccgagugcuucguggugggcaaggagccccccaagaucagcaacaagguggacguguggagcgugggcgugaucuucuuccagugccuguacggcagaaagcccuucggccacaaccagagccagcaggacauccugcaggagaacaccauccugaaggccaccgaggugcaguuccccgugaagcccguggugagcagcgaggccaaggccuucaucagaagaugccuggccuacagaaaggaggacagauucgacgugcaccagcuggccaacgaccccuaccugcugccccacaugagaagaagcaacagcagcggcaaccugcacauggccggccugaccgccagccccaccccccccagcagcagcaucaucaccuacuaa

SEQ ID NO: 24661 - RNA, 2319 nt, Artificial Sequence
  TLK2__Homo_sapiens__NP_001271262
augauggaggagcugcacagccuggaccccagaagacaggagcugcuggaggccagauucaccggcgugggcgugagcaagggcccccugaacagcgagagcagcaaccagagccugugcagcgugggcagccugagcgacaaggagguggagacccccgagaagaagcagaacgaccagagaaacagaaagagaaaggccgagcccuacgagaccagccagggcaagggcacccccagaggccacaagaucagcgacuacuucgaguucgccggcggcagcgcccccggcaccagccccggcagaagcgugccccccguggccagaagcagcccccagcacagccugagcaacccccugcccagaagaguggagcagccccuguacggccuggacggcagcgccgccaaggaggccaccgaggagcagagcgcccugcccacccugaugagcgugaugcuggccaagcccagacuggacaccgagcagcuggcccagagaggcgccggccugugcuucaccuucgugagcgcccagcagaacagccccagcagcaccggcagcggcaacaccgagcacagcugcagcagccagaagcagaucagcauccagcacagacagacccagagcgaccugaccaucgagaagaucagcgcccuggagaacagcaagaacagcgaccuggagaagaaggagggcagaaucgacgaccugcugagagccaacugcgaccugagaagacagaucgacgagcagcagaagaugcuggagaaguacaaggagagacugaacagaugcgugaccaugagcaagaagcugcugaucgagaagagcaagcaggagaagauggccugcagagacaagagcaugcaggacagacugagacugggccacuucaccaccgugagacacggcgccagcuucaccgagcaguggaccgacggcuacgccuuccagaaccugaucaagcagcaggagagaaucaacagccagagagaggagaucgagagacagagaaagaugcuggccaagagaaagccccccgccaugggccaggccccccccgccaccaacgagcagaagcagagaaagagcaagaccaacggcgccgagaacgagacccccagcagcggcaacaccgagcugaaggacaccgcccccgcccugggcgcccacagccugcugagacugacccuggccgaguaccacgagcaggaggagaucuucaagcugagacugggccaccugaagaaggaggaggccgagauccaggccgagcuggagagacuggagagagugagaaaccugcacaucagagagcugaagagaauccacaacgaggacaacagccaguucaaggaccaccccacccugaacgacagauaccugcugcugcaccugcugggcagaggcggcuucagcgagguguacaaggccuucgaccugaccgagcagagauacguggccgugaagauccaccagcugaacaagaacuggagagacgagaagaaggagaacuaccacaagcacgccugcagagaguacagaauccacaaggagcuggaccaccccagaaucgugaagcuguacgacuacuucagccuggacaccgacagcuucugcaccgugcuggaguacugcgagggcaacgaccuggacuucuaccugaagcagcacaagcugaugagcgagaaggaggccagaagcaucaucaugcagaucgugaacgcccugaaguaccugaacgagaucaagccccccaucauccacuacgaccugaagcccggcaacauccugcuggugaacggcaccgccugcggcgagaucaagaucaccgacuucggccugagcaagaucauggacgacgacagcuacaacagcguggacggcauggagcugaccagccagggcgccggcaccuacugguaccugccccccgagugcuucguggugggcaaggagccccccaagaucagcaacaagguggacguguggagcgugggcgugaucuucuaccagugccuguacggcagaaagcccuucggccacaaccagagccagcaggacauccugcaggagaacaccauccugaaggccaccgaggugcaguucccccccaagcccguggugacccccgaggccaaggccuucaucagaagaugccuggccuacagaaaggaggacagaaucgacgugcagcagcuggccugcgaccccuaccugcugccccacaucagaaagagcgugagcaccagcagccccgccggcgccgccaucgccagcaccagcggcgccagcaacaacagcagcagcaacuaa

SEQ ID NO: 24662 - RNA, 1179 nt, Artificial Sequence
  TLL1__Homo_sapiens__NP_001191689
augggccugggcacccugagccccagaaugcugguguggcugguggccagcggcaucguguucuacggcgagcugugggugugcgccggccuggacuacgacuacaccuucgacggcaacgaggaggacaagaccgagaccaucgacuacaaggaccccugcaaggccgccguguucuggggcgacaucgcccuggacgacgaggaccugaacaucuuccagaucgacagaaccaucgaccugacccagaaccccuucggcaaccugggccacaccaccggcggccugggcgaccacgccaugagcaagaagagaggcgcccuguaccagcugaucgacagaaucagaagaaucggcuucggccuggagcagaacaacaccgugaagggcaaggugccccugcaguucagcggccagaacgagaagaacagagugcccagagccgccaccagcagaaccgagagaaucuggcccggcggcgugauccccuacgugaucggcggcaacuucaccggcagccagagagccauguucaagcaggccaugagacacugggagaagcacaccugcgugaccuucaucgagagaagcgacgaggagagcuacaucguguucaccuacagacccugcggcugcugcagcuacgugggcagaagaggcaacggcccccaggccaucagcaucggcaagaacugcgacaaguucggcaucguggugcacgagcugggccacgugaucggcuucuggcacgagcacaccagacccgacagagacaaccacgugaccaucaucagagagaacauccagcccggccaggaguacaacuuccugaagauggagcccggcgaggugaacagccugggcgagagauacgacuucgacagcaucaugcacuacgccagaaacaccuucagcagaggcauguuccuggacaccauccugcccagcagagacgacaacggcaucagacccgccaucggccagagaaccagacugagcaagggcgacaucgcccaggccagaaagcuguacagaugccccgccugcggcgagacccugcaggagagcaacggcaaccugagcagccccggcuuccccaacggcuaccccagcuacacccacugcaucuggagagugagcgugacccccggcgagaaggugguguucagccugugcuaa

SEQ ID NO: 24663 - RNA, 3048 nt, Artificial Sequence
  TLL2__Homo_sapiens__NP_036597
augcccagagccaccgcccugggcgcccuggugagccugcugcugcugcugccccugcccagaggcgccggcggccugggcgagagacccgacgccaccgccgacuacagcgagcuggacggcgaggagggcaccgagcagcagcuggagcacuaccacgaccccugcaaggccgccguguucuggggcgacaucgcccuggacgaggacgaccugaagcuguuccacaucgacaaggccagagacuggaccaagcagaccgugggcgccaccggccacagcaccggcggccuggaggagcaggccagcgagagcagccccgacaccaccgccauggacaccggcaccaaggaggccggcaaggacggcagagagaacaccacccugcugcacagccccggcacccugcacgccgccgccaagaccuucagccccagagugagaagagccaccaccagcagaaccgagagaaucuggcccggcggcgugauccccuacgugaucggcggcaacuucaccggcagccagagagccaucuucaagcaggccaugagacacugggagaagcacaccugcgugaccuucaucgagagaaccgacgaggagagcuucaucguguucagcuacagaaccugcggcugcugcagcuacgugggcagaagaggcggcggcccccaggccaucagcaucggcaagaacugcgacaaguucggcaucguggcccacgagcugggccacguggugggcuucuggcacgagcacaccagacccgacagagaccagcacgugaccaucaucagagagaacauccagcccggccaggaguacaacuuccugaagauggaggccggcgaggugagcagccugggcgagaccuacgacuucgacagcaucaugcacuacgccagaaacaccuucagcagaggcguguuccuggacaccauccugcccagacaggacgacaacggcgugagacccaccaucggccagagagugagacugagccagggcgacaucgcccaggccagaaagcuguacaagugccccgccugcggcgagacccugcaggacaccaccggcaacuucagcgcccccggcuuccccaacggcuaccccagcuacagccacugcguguggagaaucagcgugacccccggcgagaagaucgugcugaacuucaccagcauggaccuguucaagagcagacugugcugguacgacuacguggaggugagagacggcuacuggagaaaggccccccugcugggcagauucugcggcgacaagauccccgagccccuggugagcaccgacagcagacuguggguggaguucagaagcagcagcaacauccugggcaagggcuucuucgccgccuacgaggccaccugcggcggcgacaugaacaaggacgccggccagauccagagccccaacuaccccgacgacuacagacccagcaaggagugcguguggagaaucaccgugagcgagggcuuccacgugggccugaccuuccaggccuucgagaucgagagacacgacagcugcgccuacgacuaccuggaggugagagacggccccaccgaggagagcgcccugaucggccacuucugcggcuacgagaagcccgaggacgugaagagcagcagcaacagacuguggaugaaguucgugagcgacggcagcaucaacaaggccggcuucgccgccaacuucuucaaggagguggacgagugcagcuggcccgaccacggcggcugcgagcacagaugcgugaacacccugggcagcuacaagugcgccugcgaccccggcuacgagcuggccgccgacaagaagaugugcgagguggccugcggcggcuucaucaccaagcugaacggcaccaucaccagccccggcuggcccaaggaguaccccaccaacaagaacugcguguggcaggugguggcccccgcccaguacagaaucagccugcaguucgagguguucgagcuggagggcaacgacgugugcaaguacgacuucguggaggugagaagcggccugagccccgacgccaagcugcacggcagauucugcggcagcgagacccccgaggugaucaccagccagagcaacaacaugagaguggaguucaagagcgacaacaccgugagcaagagaggcuucagagcccacuucuucagcgacaaggacgagugcgccaaggacaacggcggcugccagcacgagugcgugaacaccuucggcagcuaccugugcagaugcagaaacggcuacuggcugcacgagaacggccacgacugcaaggaggccggcugcgcccacaagaucagcagcguggagggcacccuggccagccccaacuggcccgacaaguaccccagcagaagagagugcaccuggaacaucagcagcaccgccggccacagagugaagcugaccuucaacgaguucgagaucgagcagcaccaggagugcgccuacgaccaccuggagauguacgacggccccgacagccuggcccccauccugggcagauucugcggcagcaagaagcccgaccccaccguggccagcggcagcagcauguuccugagauucuacagcgacgccagcgugcagagaaagggcuuccaggccgugcacagcaccgagugcggcggcagacugaaggccgaggugcagaccaaggagcuguacagccacgcccaguucggcgacaacaacuaccccagcgaggccagaugcgacugggugaucguggccgaggacggcuacggcguggagcugaccuucagaaccuucgagguggaggaggaggccgacugcggcuacgacuacauggaggccuacgacggcuacgacagcagcgcccccagacugggcagauucugcggcagcggcccccuggaggagaucuacagcgccggcgacagccugaugaucagauucagaaccgacgacaccaucaacaagaagggcuuccacgccagauacaccagcaccaaguuccaggacgcccugcacaugaagaaguaa

SEQ ID NO: 24664 - RNA, 7626 nt, Artificial Sequence
  TLN1__Homo_sapiens__NP_006280
augguggcccugagccugaagaucagcaucggcaacguggugaagaccaugcaguucgagcccagcaccaugguguacgacgccugcagaaucaucagagagagaauccccgaggcccccgccggcccccccagcgacuucggccuguuccugagcgacgacgaccccaagaagggcaucuggcuggaggccggcaaggcccuggacuacuacaugcugagaaacggcgacaccauggaguacagaaagaagcagagaccccugaagaucagaaugcuggacggcaccgugaagaccaucaugguggacgacagcaagaccgugaccgacaugcugaugaccaucugcgccagaaucggcaucaccaaccacgacgaguacagccuggugagagagcugauggaggagaagaaggaggagaucaccggcacccugagaaaggacaagacccugcugagagacgagaagaagauggagaagcugaagcagaagcugcacaccgacgacgagcugaacuggcuggaccacggcagaacccugagagagcagggcguggaggagcacgagacccugcugcugagaagaaaguucuucuacagcgaccagaacguggacagcagagaccccgugcagcugaaccugcuguacgugcaggccagagacgacauccugaacggcagccaccccgugagcuucgacaaggccugcgaguucgccggcuuccagugccagauccaguucggcccccacaacgagcagaagcacaaggccggcuuccuggaccugaaggacuuccugcccaaggaguacgugaagcagaagggcgagagaaagaucuuccaggcccacaagaacugcggccagaugagcgagaucgaggccaaggugagauacgugaagcuggccagaagccugaagaccuacggcgugagcuucuuccuggugaaggagaagaugaagggcaagaacaagcuggugcccagacugcugggcaucaccaaggagugcgugaugagaguggacgagaagaccaaggaggugauccaggaguggaaccugaccaacaucaagagaugggccgccagccccaagagcuucacccuggacuucggcgacuaccaggacggcuacuacagcgugcagaccaccgagggcgagcagaucgcccagcugaucgccggcuacaucgacaucauccugaagaagaagaagagcaaggaccacuucggccuggagggcgacgaggagagcaccaugcuggaggacagcgugagccccaagaagagcaccgugcugcagcagcaguacaacagagugggcaagguggagcacggcagcguggcccugcccgccaucaugagaagcggcgccagcggccccgagaacuuccaggugggcagcaugccccccgcccagcagcagaucaccagcggccagaugcacagaggccacaugcccccccugaccagcgcccagcaggcccugaccggcaccaucaacagcagcaugcaggccgugcaggccgcccaggccacccuggacgacuucgacacccugcccccccugggccaggacgccgccagcaaggccuggagaaagaacaagauggacgagagcaagcacgagauccacagccagguggacgccaucaccgccggcaccgccagcguggugaaccugaccgccggcgaccccgccgagaccgacuacaccgccgugggcugcgccgugaccaccaucagcagcaaccugaccgagaugagcagaggcgugaagcugcuggccgcccugcuggaggacgagggcggcagcggcagaccccugcugcaggccgccaagggccuggccggcgccgugagcgagcugcugagaagcgcccagcccgccagcgccgagcccagacagaaccugcugcaggccgccggcaacgugggccaggccagcggcgagcugcugcagcagaucggcgagagcgacaccgacccccacuuccaggacgcccugaugcagcuggccaaggccguggccagcgccgccgccgcccuggugcugaaggccaagagcguggcccagagaaccgaggacagcggccugcagacccaggugaucgccgccgccacccagugcgcccugagcaccagccagcugguggccugcaccaaggugguggcccccaccaucagcagccccgugugccaggagcagcugguggaggccggcagacugguggccaaggccguggagggcugcgugagcgccagccaggccgccaccgaggacggccagcugcugagaggcgugggcgccgccgccaccgccgugacccaggcccugaacgagcugcugcagcacgugaaggcccacgccaccggcgccggccccgccggcagauacgaccaggccaccgacaccauccugaccgugaccgagaacaucuucagcagcaugggcgacgccggcgagauggugagacaggccagaauccuggcccaggccaccagcgaccuggugaacgccaucaaggccgacgccgagggcgagagcgaccuggagaacagcagaaagcugcugagcgccgccaagauccuggccgacgccaccgccaagaugguggaggccgccaagggcgccgccgcccaccccgacagcgaggagcagcagcagagacugagagaggccgccgagggccugagaauggccaccaacgccgccgcccagaacgccaucaagaagaagcuggugcagagacuggagcacgccgccaagcaggccgccgccagcgccacccagaccaucgccgccgcccagcacgccgccagcacccccaaggccagcgccggcccccagccccugcuggugcagagcugcaaggccguggccgagcagaucccccugcuggugcagggcgugagaggcagccaggcccagcccgacagccccagcgcccagcuggcccugaucgccgccagccagagcuuccugcagcccggcggcaagaugguggccgccgccaaggccagcgugcccaccauccaggaccaggccagcgccaugcagcugagccagugcgccaagaaccugggcaccgcccuggccgagcugagaaccgccgcccagaaggcccaggaggccugcggcccccuggagauggacagcgcccugagcguggugcagaaccuggagaaggaccugcaggaggugaaggccgccgccagagacggcaagcugaagccccugcccggcgagaccauggagaagugcacccaggaccugggcaacagcaccaaggccgugagcagcgccaucgcccagcugcugggcgagguggcccagggcaacgagaacuacgccggcaucgccgccagagacguggccggcggccugagaagccuggcccaggccgccagaggcguggccgcccugaccagcgaccccgccgugcaggccaucgugcuggacaccgccagcgacgugcuggacaaggccagcagccugaucgaggaggccaagaaggccgccggccaccccggcgaccccgagagccagcagagacuggcccagguggccaaggccgugacccaggcccugaacagaugcgugagcugccugcccggccagagagacguggacaacgcccugagagccgugggcgacgccagcaagagacugcugagcgacagccugccccccagcaccggcaccuuccaggaggcccagagcagacugaacgaggccgccgccggccugaaccaggccgccaccgagcuggugcaggccagcagaggcaccccccaggaccuggccagagccagcggcagauucggccaggacuucagcaccuuccuggaggccggcguggagauggccggccaggcccccagccaggaggacagagcccagguggugagcaaccugaagggcaucagcaugagcagcagcaagcugcugcuggccgccaaggcccugagcaccgaccccgccgcccccaaccugaagagccagcuggccgccgccgccagagccgugaccgacagcaucaaccagcugaucaccaugugcacccagcaggcccccggccagaaggagugcgacaacgcccugagagagcuggagaccgugagagagcugcuggagaaccccgugcagcccaucaacgacaugagcuacuucggcugccuggacagcgugauggagaacagcaaggugcugggcgaggccaugaccggcaucagccagaacgccaagaacggcaaccugcccgaguucggcgacgccaucagcaccgccagcaaggcccugugcggcuucaccgaggccgccgcccaggccgccuaccuggugggcgugagcgaccccaacagccaggccggccagcagggccugguggagcccacccaguucgccagagccaaccaggccauccagauggccugccagagccugggcgagcccggcugcacccaggcccaggugcugagcgccgccaccaucguggccaagcacaccagcgcccugugcaacagcugcagacuggccagcgccagaaccaccaaccccaccgccaagagacaguucgugcagagcgccaaggagguggccaacagcaccgccaaccuggugaagaccaucaaggcccuggacggcgccuucaccgaggagaacagagcccagugcagagccgccaccgccccccugcuggaggccguggacaaccugagcgccuucgccagcaaccccgaguucagcagcauccccgcccagaucagccccgagggcagagccgccauggagcccaucgugaucagcgccaagaccaugcuggagagcgccggcggccugauccagaccgccagagcccuggccgugaaccccagagacccccccagcuggagcgugcuggccggccacagcagaaccgugagcgacagcaucaagaagcugaucaccagcaugagagacaaggcccccggccagcuggagugcgagaccgccaucgccgcccugaacagcugccugagagaccuggaccaggccagccuggccgccgugagccagcagcuggcccccagagagggcaucagccaggaggcccugcacacccagaugcugaccgccgugcaggagaucagccaccugaucgagccccuggccaacgccgccagagccgaggccagccagcugggccacaaggugagccagauggcccaguacuucgagccccugacccuggccgccgugggcgccgccagcaagacccugagccacccccagcagauggcccugcuggaccagaccaagacccuggccgagagcgcccugcagcugcuguacaccgccaaggaggccggcggcaaccccaagcaggccgcccacacccaggaggcccuggaggaggccgugcagaugaugaccgaggccguggaggaccugaccaccacccugaacgaggccgccagcgccgccggcguggugggcggcaugguggacagcaucacccaggccaucaaccagcuggacgagggccccaugggcgagcccgagggcagcuucguggacuaccagaccaccauggugagaaccgccaaggccaucgccgugaccgugcaggagauggugaccaagagcaacaccagccccgaggagcugggcccccuggccaaccagcugaccagcgacuacggcagacuggccagcgaggccaagcccgccgccguggccgccgagaacgaggagaucggcagccacaucaagcacagagugcaggagcugggccacggcugcgccgcccuggugaccaaggccggcgcccugcagugcagccccagcgacgccuacaccaagaaggagcugaucgagugcgccagaagagugagcgagaaggugagccacgugcuggccgcccugcaggccggcaacagaggcacccaggccugcaucaccgccgccagcgccgugagcggcaucaucgccgaccuggacaccaccaucauguucgccaccgccggcacccugaacagagagggcaccgagaccuucgccgaccacagagagggcauccugaagaccgccaaggugcugguggaggacaccaaggugcuggugcagaacgccgccggcagccaggagaagcuggcccaggccgcccagagcagcguggccaccaucaccagacuggccgacguggugaagcugggcgccgccagccugggcgccgaggaccccgagacccagguggugcugaucaacgccgugaaggacguggccaaggcccugggcgaccugaucagcgccaccaaggccgccgccggcaaggugggcgacgaccccgccguguggcagcugaagaacagcgccaaggugauggugaccaacgugaccagccugcugaagaccgugaaggccguggaggacgaggccaccaagggcaccagagcccuggaggccaccaccgagcacaucagacaggagcuggccguguucugcagccccgagccccccgccaagaccagcacccccgaggacuucaucagaaugaccaagggcaucaccauggccaccgccaaggccguggccgccggcaacagcugcagacaggaggacgugaucgccaccgccaaccugagcagaagagccaucgccgacaugcugagagccugcaaggaggccgccuaccaccccgagguggcccccgacgugagacugagagcccugcacuacggcagagagugcgccaacggcuaccuggagcugcuggaccacgugcugcugacccugcagaagcccagccccgagcugaagcagcagcugaccggccacagcaagagaguggccggcagcgugaccgagcugauccaggccgccgaggccaugaagggcaccgaguggguggaccccgaggaccccaccgugaucgccgagaacgagcugcugggcgccgccgccgccaucgaggccgccgccaagaagcuggagcagcugaagcccagagccaagcccaaggaggccgacgagagccugaacuucgaggagcagauccuggaggccgccaagagcaucgccgccgccaccagcgcccuggugaaggccgccagcgccgcccagagagagcugguggcccagggcaaggugggcgccauccccgccaacgcccuggacgacggccaguggagccagggccugaucagcgccgccagaaugguggccgccgccaccaacaaccugugcgaggccgccaacgccgccgugcagggccacgccagccaggagaagcugaucagcagcgccaagcagguggccgccagcaccgcccagcugcugguggccugcaaggugaaggccgaccaggacagcgaggccaugaagagacugcaggccgccggcaacgccgugaagagagccagcgacaaccuggugaaggccgcccagaaggccgccgccuucgaggagcaggagaacgagaccgugguggugaaggagaagauggugggcggcaucgcccagaucaucgccgcccaggaggagaugcugagaaaggagagagagcuggaggaggccagaaagaagcuggcccagaucagacagcagcaguacaaguuccugcccagcgagcugagagacgagcacuaa

SEQ ID NO: 24665 - RNA, 7629 nt, Artificial Sequence
  TLN2__Homo_sapiens__XP_011520408
augguggcccugagccugaagaucugcgugagacacugcaacguggugaagaccaugcaguucgagcccagcaccgccguguacgacgccugcagagugaucagagagagagugcccgaggcccagaccggccaggccagcgacuacggccuguuccugagcgacgaggaccccagaaagggcaucuggcuggaggccggcagaacccuggacuacuacaugcugagaaacggcgacauccuggaguacaagaagaagcagagaccccagaagaucagaaugcuggacggcagcgugaagaccgugaugguggacgacagcaagaccgugggcgagcugcuggugaccaucugcagcagaaucggcaucaccaacuacgaggaguacagccugauccaggagaccaucgaggagaagaaggaggagggcaccggcacccugaagaaggacagaacccugcugagagacgagagaaagauggagaagcugaaggccaagcugcacaccgacgacgaccugaacuggcuggaccacagcagaaccuucagagagcagggcguggacgagaacgagacccugcugcugagaagaaaguucuucuacagcgaccagaacguggacagcagagaccccgugcagcugaaccugcuguacgugcaggccagagacgacauccugaacggcagccaccccgugagcuucgagaaggccugcgaguucggcggcuuccaggcccagauccaguucggcccccacguggagcacaagcacaagcccggcuuccuggaccugaaggaguuccugcccaaggaguacaucaagcagagaggcgccgagaagagaaucuuccaggagcacaagaacugcggcgagaugagcgagaucgaggccaaggugaaguacgugaagcuggccagaagccugagaaccuacggcgugagcuucuuccuggugaaggagaagaugaagggcaagaacaagcuggugcccagacugcugggcaucaccaaggacagcgugaugagaguggacgagaagaccaaggaggugcugcaggaguggccccugaccaccgugaagagaugggccgccagccccaagagcuucacccuggacuucggcgaguaccaggagagcuacuacagcgugcagaccaccgagggcgagcagaucagccagcugaucgccggcuacaucgacaucauccugaagaagaagcagagcaaggacagauucggccuggagggcgacgaggagagcaccaugcuggaggagagcgugagccccaagaagagcaccauccugcagcagcaguucaacagaaccggcaaggccgagcacggcagcguggcccugcccgccgugaugagaagcggcagcagcggccccgagaccuucaacgugggcagcaugcccagcccccagcagcaggugauggugggccagaugcacagaggccacaugcccccccugaccagcgcccagcaggcccugaugggcaccaucaacaccagcaugcacgccgugcagcaggcccaggacgaccugagcgagcuggacagccugcccccccugggccaggacauggccagcagagugugggugcagaacaagguggacgagagcaagcacgagauccacagccagguggacgccaucaccgccggcaccgccagcguggugaaccugaccgccggcgaccccgccgacaccgacuacaccgccgugggcugcgccaucaccaccaucagcagcaaccugaccgagaugagcaagggcgugaagcugcuggccgcccugauggacgacgaggugggcagcggcgaggaccugcugagagccgccagaacccuggccggcgccgugagcgaccugcugaaggccgugcagcccaccagcggcgagcccagacagaccgugcugaccgccgccggcagcaucggccaggccagcggcgaccugcugagacagaucggcgagaacgagaccgacgagagauuccaggacgugcugaugagccuggccaaggccguggccaacgccgccgccaugcuggugcugaaggccaagaacguggcccagguggccgaggacaccgugcugcagaacagagugaucgccgccgccacccagugcgcccugagcaccagccagcugguggccugcgccaagguggugagccccaccaucagcagccccgugugccaggagcagcugaucgaggccggcaagcugguggacagaagcguggagaacugcgugagagccugccaggccgccaccaccgacagcgagcugcugaagcaggugagcgccgccgccagcguggugagccaggcccugcacgaccugcugcagcacgugagacaguucgccagcagaggcgagcccaucggcagauacgaccaggccaccgacaccaucaugugcgugaccgagagcaucuucagcagcaugggcgacgccggcgagauggugagacaggccagagugcuggcccaggccaccagcgaccuggugaacgccaugagaagcgacgccgaggccgagaucgacauggagaacagcaagaagcugcuggccgccgccaagcugcuggccgacagcaccgccagaaugguggaggccgccaagggcgccgccgccaaccccgagaacgaggaccagcagcagagacugagagaggccgccgagggccugagaguggccaccaacgccgccgcccagaacgccaucaagaagaagaucgugaacagacuggagguggccgccaagcaggccgccgccgccgccacccagaccaucgccgccagccagaacgccgccgugagcaacaagaaccccgccgcccagcagcagcuggugcagagcugcaaggccguggccgaccacaucccccagcuggugcagggcgugagaggcagccaggcccaggccgaggaccugagcgcccagcuggcccugaucaucagcagccagaacuuccugcagcccggcagcaagauggugagcagcgccaaggccgccgugcccaccgugagcgaccaggccgccgccaugcagcugagccagugcgccaagaaccuggccaccagccuggccgagcugagaaccgccagccagaaggcccacgaggccugcggccccauggagaucgacagcgcccugaacaccgugcagacccugaagaacgagcugcaggacgccaagauggccgccguggagagccagcugaagccccugcccggcgagacccuggagaagugcgcccaggaccugggcagcaccagcaaggccgugggcagcagcauggcccagcugcugaccugcgccgcccagggcaacgagcacuacaccggcguggccgccagagagaccgcccaggcccugaagacccuggcccaggccgccagaggcguggccgccagcaccaccgaccccgccgccgcccacgccaugcuggacagcgccagagacgugauggagggcagcgccaugcugauccaggaggccaagcaggcccugaucgcccccggcgacgccgagagacagcagagacuggcccagguggccaaggccgugagccacagccugaacaacugcgugaacugccugcccggccagaaggacguggacguggcccugaagagcaucggcgagagcagcaagaagcugcugguggacagccugccccccagcaccaagcccuuccaggaggcccagagcgagcugaaccaggccgccgccgaccugaaccagagcgccggcgagguggugcacgccaccagaggccagagcggcgagcuggccgccgccagcggcaaguucagcgacgacuucgacgaguuccuggacgccggcaucgagauggccggccaggcccagaccaaggaggaccagauccaggugaucggcaaccugaagaacaucagcauggccagcagcaagcugcugcuggccgccaagagccugagcguggaccccggcgcccccaacgccaagaaccugcuggccgccgccgccagagccgugaccgagagcaucaaccagcugaucacccugugcacccagcaggcccccggccagaaggagugcgacaacgcccugagagagcuggagaccgugaagggcaugcuggacaaccccaacgagcccgugagcgaccugagcuacuucgacugcaucgagagcgugauggagaacagcaaggugcugggcgagagcauggccggcaucagccagaacgccaagaccggcgaccugcccgccuucggcgagugcgugggcaucgccagcaaggcccugugcggccugaccgaggccgccgcccaggccgccuaccuggugggcaucagcgaccccaacagccaggccggccaccagggccugguggaccccauccaguucgccagagccaaccaggccauccagauggccugccagaaccugguggaccccggcagcagccccagccaggugcugagcgccgccaccaucguggccaagcacaccagcgcccugugcaacgccugcagaaucgccagcagcaagaccgccaaccccguggccaagagacacuucgugcagagcgccaaggagguggccaacagcaccgccaaccuggugaagaccaucaaggcccuggacggcgacuucagcgaggacaacagaaacaagugcagaaucgccaccgccccccugaucgaggccguggagaaccugaccgccuucgccagcaaccccgaguucgugagcauccccgcccagaucagcagcgagggcagccaggcccaggagcccauccuggugagcgccaagaccaugcuggagagcagcagcuaccugaucagaaccgccagaagccuggccaucaaccccaaggacccccccaccuggagcgugcuggccggccacagccacaccgugagcgacagcaucaagagccugaucaccagcaucagagacaaggcccccggccagagagagugcgacuacagcaucgacggcaucaacagaugcaucagagacaucgagcaggccagccuggccgccgugagccagagccuggccaccagagacgacaucagcguggaggcccugcaggagcagcugaccagcguggugcaggagaucggccaccugaucgaccccaucgccaccgccgccagaggcgaggccgcccagcugggccacaaggugacccagcuggccagcuacuucgagccccugauccuggccgccgugggcguggccagcaagauccuggaccaccagcagcagaugaccgugcuggaccagaccaagacccuggccgagagcgcccugcagaugcuguacgccgccaaggagggcggcggcaaccccaaggcccagcacacccacgacgccaucaccgaggccgcccagcugaugaaggaggccguggacgacaucauggugacccugaacgaggccgccagcgaggugggccuggugggcggcaugguggacgccaucgccgaggccaugagcaagcuggacgagggcaccccccccgagcccaagggcaccuucguggacuaccagaccaccguggugaaguacagcaaggccaucgccgugaccgcccaggagaugaugaccaagagcgugaccaaccccgaggagcugggcggccuggccagccagaugaccagcgacuacggccaccuggccuuccagggccagauggccgccgccaccgccgagcccgaggagaucggcuuccagaucagaaccagagugcaggaccugggccacggcugcaucuuccuggugcagaaggccggcgcccugcaggugugccccaccgacagcuacaccaagagagagcugaucgagugcgccagagccgugaccgagaaggugagccuggugcugagcgcccugcaggccggcaacaagggcacccaggccugcaucaccgccgccaccgccgugagcggcaucaucgccgaccuggacaccaccaucauguucgccaccgccggcacccugaacgccgagaacagcgagaccuucgccgaccacagagagaacauccugaagaccgccaaggcccugguggaggacaccaagcugcuggugagcggcgccgccagcacccccgacaagcuggcccaggccgcccagagcagcgccgccaccaucacccagcuggccgagguggugaagcugggcgccgccagccugggcagcgacgaccccgagacccagguggugcugaucaacgccaucaaggacguggccaaggcccugagcgaccugaucagcgccaccaagggcgccgccagcaagcccguggacgaccccagcauguaccagcugaagggcgccgccaaggugauggugaccaacgugaccagccugcugaagaccgugaaggccguggaggacgaggccaccagaggcaccagagcccuggaggccaccaucgagugcaucaagcaggagcugaccguguuccagagcaaggacgugcccgagaagaccagcagccccgaggagagcaucagaaugaccaagggcaucaccauggccaccgccaaggccguggccgccggcaacagcugcagacaggaggacgugaucgccaccgccaaccugagcagaaaggccgugagcgacaugcugaccgccugcaagcaggccagcuuccaccccgacgugagcgacgaggugagaaccagagcccugagauucggcaccgagugcacccugggcuaccuggaccugcuggagcacgugcuggugauccugcagaagcccacccccgaguucaagcagcagcuggccgccuucagcaagagaguggccggcgccgugaccgagcugauccaggccgccgaggccaugaagggcaccgaguggguggaccccgaggaccccaccgugaucgccgagaccgagcugcugggcgccgccgccagcaucgaggccgccgccaagaagcuggagcagcugaagcccagagccaagcccaagcaggccgacgagacccuggacuucgaggagcagauccuggaggccgccaagagcaucgccgccgccaccagcgcccuggugaagagcgccagcgccgcccagagagagcugguggcccagggcaaggugggcagcauccccgccaacgccgccgacgacggccaguggagccagggccugaucagcgccgccagaaugguggccgccgccaccagcagccugugcgaggccgccaacgccagcgugcagggccacgccagcgaggagaagcugaucagcagcgccaagcagguggccgccagcaccgcccagcugcugguggccugcaaggugaaggccgaccaggacagcgaggccaugagaagacugcaggccgccggcaacgccgugaagagagccagcgacaaccuggugagagccgcccagaaggccgccuucggcaaggccgacgacgacgacgugguggugaagaccaaguucgugggcggcaucgcccagaucaucgccgcccaggaggagaugcugaagaaggagagagagcuggaggaggccagaaagaagcuggcccagaucagacagcagcaguacaaguuccugcccaccgagcugagagaggacgagggcuaa

SEQ ID NO: 24666 - RNA, 2436 nt, Artificial Sequence
  TLR10__Homo_sapiens__XP_011512064
augagacugaucagaaacaucuacaucuucugcagcaucgugaugaccgccgagggcgacgcccccgagcugcccgaggagagagagcugaugaccaacugcagcaacaugagccugagaaaggugcccgccgaccugacccccgccaccaccacccuggaccugagcuacaaccugcuguuccagcugcagagcagcgacuuccacagcgugagcaagcugagagugcugauccugugccacaacagaauccagcagcuggaccugaagaccuucgaguucaacaaggagcugagauaccuggaccugagcaacaacagacugaagagcgugaccugguaccugcuggccggccugagauaccuggaccugagcuucaacgacuucgacaccaugcccaucugcgaggaggccggcaacaugagccaccuggagauccugggccugagcggcgccaagauccagaagagcgacuuccagaagaucgcccaccugcaccugaacaccguguuccugggcuucagaacccugccccacuacgaggagggcagccugcccauccugaacaccaccaagcugcacaucgugcugcccauggacaccaacuucugggugcugcugagagacggcaucaagaccagcaagauccuggagaugaccaacaucgacggcaagagccaguucgugagcuacgagaugcagagaaaccugagccuggagaacgccaagaccagcgugcugcugcugaacaagguggaccugcugugggacgaccuguuccugauccugcaguucguguggcacaccagcguggagcacuuccagaucagaaacgugaccuucggcggcaaggccuaccuggaccacaacagcuucgacuacagcaacaccgugaugagaaccaucaagcuggagcacgugcacuucagaguguucuacauccagcaggacaagaucuaccugcugcugaccaagauggacaucgagaaccugaccaucagcaacgcccagaugccccacaugcuguuccccaacuaccccaccaaguuccaguaccugaacuucgccaacaacauccugaccgacgagcuguucaagagaaccauccagcugccccaccugaagacccugauccugaacggcaacaagcuggagacccugagccuggugagcugcuucgccaacaacaccccccuggagcaccuggaccugagccagaaccugcugcagcacaagaacgacgagaacugcagcuggcccgagaccguggugaacaugaaccugagcuacaacaagcugagcgacagcguguucagaugccugcccaagagcauccagauccuggaccugaacaacaaccagauccagaccgugcccaaggagaccauccaccugauggcccugagagagcugaacaucgccuucaacuuccugaccgaccugcccggcugcagccacuucagcagacugagcgugcugaacaucgagaugaacuucauccugagccccagccuggacuucgugcagagcugccaggaggugaagacccugaacgccggcagaaaccccuucagaugcaccugcgagcugaagaacuucauccagcuggagaccuacagcgaggugaugauggugggcuggagcgacagcuacaccugcgaguacccccugaaccugagaggcaccagacugaaggacgugcaccugcacgagcugagcugcaacaccgcccugcugaucgugaccaucguggugaucaugcuggugcugggccuggccguggccuucugcugccugcacuucgaccugcccugguaccugagaaugcugggccagugcacccagaccuggcacagagugagaaagaccacccaggagcagcugaagagaaacgugagauuccacgccuucaucagcuacagcgagcacgacagccugugggugaagaacgagcugauccccaaccuggagaaggaggacggcagcauccugaucugccuguacgagagcuacuucgaccccggcaagagcaucagcgagaacaucgugagcuucaucgagaagagcuacaagagcaucuucgugcugagccccaacuucgugcagaacgaguggugccacuacgaguucuacuucgcccaccacaaccuguuccacgagaacagcgaccacaucauccugauccugcuggagcccauccccuucuacugcauccccaccagauaccacaagcugaaggcccugcuggagaagaaggccuaccuggaguggcccaaggacagaagaaagugcggccuguucugggccaaccugagagccgccaucaacgugaacgugcuggccaccagagagauguacgagcugcagaccuucaccgagcugaacgaggagagcagaggcagcaccaucagccugaugagaaccgacugccuguaa

SEQ ID NO: 24667 - RNA, 2361 nt, Artificial Sequence
  TLR1__Homo_sapiens__NP_003254
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaucagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaagcaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccgagggccugcaggacuucaacaccgagagccugcacaucguguuccccaccaacaaggaguuccacuucauccuggacgugagcgugaagaccguggccaaccuggagcugagcaacaucaagugcgugcuggaggacaacaagugcagcuacuuccugagcauccuggccaagcugcagaccaaccccaagcugagcaaccugacccugaacaacaucgagaccaccuggaacagcuucaucagaauccugcagcugguguggcacaccaccgugugguacuucagcaucagcaacgugaagcugcagggccagcuggacuucagagacuucgacuacagcggcaccagccugaaggcccugagcauccaccagguggugagcgacguguucggcuucccccagagcuacaucuacgagaucuucagcaacaugaacaucaagaacuucaccgugagcggcaccagaauggugcacaugcugugccccagcaagaucagccccuuccugcaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggugagcagcgaggugcuggagggcuggcccgacagcuacaagugcgacuaccccgagagcuacagaggcacccugcugaaggacuuccacaugagcgagcugagcugcaacaucacccugcugaucgugaccaucguggccaccaugcuggugcuggccgugaccgugaccagccugugcagcuaccuggaccugcccugguaccugagaauggugugccaguggacccagaccagaagaagagccagaaacaucccccuggaggagcugcagagaaaccugcaguuccacgccuucaucagcuacagcggccacgacagcuucugggugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguaa

SEQ ID NO: 24668 - RNA, 2355 nt, Artificial Sequence
  TLR2__Homo_sapiens__XP_011530518
augccccacacccuguggauggugugggugcugggcgugaucaucagccugagcaaggaggagagcagcaaccaggccagccugagcugcgacagaaacggcaucugcaagggcagcagcggcagccugaacagcauccccagcggccugaccgaggccgugaagagccuggaccugagcaacaacagaaucaccuacaucagcaacagcgaccugcagagaugcgugaaccugcaggcccuggugcugaccagcaacggcaucaacaccaucgaggaggacagcuucagcagccugggcagccuggagcaccuggaccugagcuacaacuaccugagcaaccugagcagcagcugguucaagccccugagcagccugaccuuccugaaccugcugggcaaccccuacaagacccugggcgagaccagccuguucagccaccugaccaagcugcagauccugagagugggcaacauggacaccuucaccaagauccagagaaaggacuucgccggccugaccuuccuggaggagcuggagaucgacgccagcgaccugcagagcuacgagcccaagagccugaagagcauccagaacgugagccaccugauccugcacaugaagcagcacauccugcugcuggagaucuucguggacgugaccagcagcguggagugccuggagcugagagacaccgaccuggacaccuuccacuucagcgagcugagcaccggcgagaccaacagccugaucaagaaguucaccuucagaaacgugaagaucaccgacgagagccuguuccaggugaugaagcugcugaaccagaucagcggccugcuggagcuggaguucgacgacugcacccugaacggcgugggcaacuucagagccagcgacaacgacagagugaucgaccccggcaagguggagacccugaccaucagaagacugcacauccccagauucuaccuguucuacgaccugagcacccuguacagccugaccgagagagugaagagaaucaccguggagaacagcaagguguuccuggugcccugccugcugagccagcaccugaagagccuggaguaccuggaccugagcgagaaccugaugguggaggaguaccugaagaacagcgccugcgaggacgccuggcccagccugcagacccugauccugagacagaaccaccuggccagccuggagaagaccggcgagacccugcugacccugaagaaccugaccaacaucgacaucagcaagaacagcuuccacagcaugcccgagaccugccaguggcccgagaagaugaaguaccugaaccugagcagcaccagaauccacagcgugaccggcugcauccccaagacccuggagauccuggacgugagcaacaacaaccugaaccuguucagccugaaccugccccagcugaaggagcuguacaucagcagaaacaagcugaugacccugcccgacgccagccugcugcccaugcugcuggugcugaagaucagcagaaacgccaucaccaccuucagcaaggagcagcuggacagcuuccacacccugaagacccuggaggccggcggcaacaacuucaucugcagcugcgaguuccugagcuucacccaggagcagcaggcccuggccaaggugcugaucgacuggcccgccaacuaccugugcgacagccccagccacgugagaggccagcaggugcaggacgugagacugagcgugagcgagugccacagaaccgcccuggugagcggcaugugcugcgcccuguuccugcugauccugcugaccggcgugcugugccacagauuccacggccugugguacaugaagaugaugugggccuggcugcaggccaagagaaagcccagaaaggcccccagcagaaacaucugcuacgacgccuucgugagcuacagcgagagagacgccuacuggguggagaaccugauggugcaggagcuggagaacuucaacccccccuucaagcugugccugcacaagagagacuucauccccggcaaguggaucaucgacaacaucaucgacagcaucgagaagagccacaagaccguguucgugcugagcgagaacuucgugaagagcgaguggugcaaguacgagcuggacuucagccacuucagacuguucgacgagaacaacgacgccgccauccugauccugcuggagcccaucgagaagaaggccaucccccagagauucugcaagcugagaaagaucaugaacaccaagaccuaccuggaguggcccauggacgaggcccagagagagggcuucugggugaaccugagagccgccaucaagagcuaa

SEQ ID NO: 24669 - RNA, 2715 nt, Artificial Sequence
  TLR3__Homo_sapiens__NP_003256
augagacagacccugcccugcaucuacuucuggggcggccugcugcccuucggcaugcugugcgccagcagcaccaccaagugcaccgugagccacgagguggccgacugcagccaccugaagcugacccaggugcccgacgaccugcccaccaacaucaccgugcugaaccugacccacaaccagcugagaagacugcccgccgccaacuucaccagauacagccagcugaccagccuggacgugggcuucaacaccaucagcaagcuggagcccgagcugugccagaagcugcccaugcugaaggugcugaaccugcagcacaacgagcugagccagcugagcgacaagaccuucgccuucugcaccaaccugaccgagcugcaccugaugagcaacagcauccagaagaucaagaacaaccccuucgugaagcagaagaaccugaucacccuggaccugagccacaacggccugagcagcaccaagcugggcacccaggugcagcuggagaaccugcaggagcugcugcugagcaacaacaagauccaggcccugaagagcgaggagcuggacaucuucgccaacagcagccugaagaagcuggagcugagcagcaaccagaucaaggaguucagccccggcugcuuccacgccaucggcagacuguucggccuguuccugaacaacgugcagcugggccccagccugaccgagaagcugugccuggagcuggccaacaccagcaucagaaaccugagccugagcaacagccagcugagcaccaccagcaacaccaccuuccugggccugaaguggaccaaccugaccaugcuggaccugagcuacaacaaccugaacguggugggcaacgacagcuucgccuggcugccccagcuggaguacuucuuccuggaguacaacaacauccagcaccuguucagccacagccugcacggccuguucaacgugagauaccugaaccugaagagaagcuucaccaagcagagcaucagccuggccagccugcccaagaucgacgacuucagcuuccaguggcugaagugccuggagcaccugaacauggaggacaacgacauccccggcaucaagagcaacauguucaccggccugaucaaccugaaguaccugagccugagcaacagcuucaccagccugagaacccugaccaacgagaccuucgugagccuggcccacagcccccugcacauccugaaccugaccaagaacaagaucagcaagaucgagagcgacgccuucagcuggcugggccaccuggaggugcuggaccugggccugaacgagaucggccaggagcugaccggccaggaguggagaggccuggagaacaucuucgagaucuaccugagcuacaacaaguaccugcagcugaccagaaacagcuucgcccuggugcccagccugcagagacugaugcugagaagaguggcccugaagaacguggacagcagccccagccccuuccagccccugagaaaccugaccauccuggaccugagcaacaacaacaucgccaacaucaacgacgacaugcuggagggccuggagaagcuggagauccuggaccugcagcacaacaaccuggccagacuguggaagcacgccaaccccggcggccccaucuacuuccugaagggccugagccaccugcacauccugaaccuggagagcaacggcuucgacgagauccccguggagguguucaaggaccuguucgagcugaagaucaucgaccugggccugaacaaccugaacacccugcccgccagcguguucaacaaccaggugagccugaagagccugaaccugcagaagaaccugaucaccagcguggagaagaagguguucggccccgccuucagaaaccugaccgagcuggacaugagauucaaccccuucgacugcaccugcgagagcaucgccugguucgugaacuggaucaacgagacccacaccaacauccccgagcugagcagccacuaccugugcaacacccccccccacuaccacggcuuccccgugagacuguucgacaccagcagcugcaaggacagcgcccccuucgagcuguucuucaugaucaacaccagcauccugcugaucuucaucuucaucgugcugcugauccacuucgagggcuggagaaucagcuucuacuggaacgugagcgugcacagagugcugggcuucaaggagaucgacagacagaccgagcaguucgaguacgccgccuacaucauccacgccuacaaggacaaggacugggugugggagcacuucagcagcauggagaaggaggaccagagccugaaguucugccuggaggagagagacuucgaggccggcguguucgagcuggaggccaucgugaacagcaucaagagaagcagaaagaucaucuucgugaucacccaccaccugcugaaggacccccugugcaagagauucaaggugcaccacgccgugcagcaggccaucgagcagaaccuggacagcaucauccugguguuccuggaggagauccccgacuacaagcugaaccacgcccugugccugagaagaggcauguucaagagccacugcauccugaacuggcccgugcagaaggagagaaucggcgccuucagacacaagcugcagguggcccugggcagcaagaacagcgugcacuaa

SEQ ID NO: 24670 - RNA, 2400 nt, Artificial Sequence
  TLR4__Homo_sapiens__NP_003257
auggagcugaacuucuacaagauccccgacaaccugcccuucagcaccaagaaccuggaccugagcuucaacccccugagacaccugggcagcuacagcuucuucagcuuccccgagcugcaggugcuggaccugagcagaugcgagauccagaccaucgaggacggcgccuaccagagccugagccaccugagcacccugauccugaccggcaaccccauccagagccuggcccugggcgccuucagcggccugagcagccugcagaagcugguggccguggagaccaaccuggccagccuggagaacuuccccaucggccaccugaagacccugaaggagcugaacguggcccacaaccugauccagagcuucaagcugcccgaguacuucagcaaccugaccaaccuggagcaccuggaccugagcagcaacaagauccagagcaucuacugcaccgaccugagagugcugcaccagaugccccugcugaaccugagccuggaccugagccugaaccccaugaacuucauccagcccggcgccuucaaggagaucagacugcacaagcugacccugagaaacaacuucgacagccugaacgugaugaagaccugcauccagggccuggccggccuggaggugcacagacuggugcugggcgaguucagaaacgagggcaaccuggagaaguucgacaagagcgcccuggagggccugugcaaccugaccaucgaggaguucagacuggccuaccuggacuacuaccuggacgacaucaucgaccuguucaacugccugaccaacgugagcagcuucagccuggugagcgugaccaucgagagagugaaggacuucagcuacaacuucggcuggcagcaccuggagcuggugaacugcaaguucggccaguuccccacccugaagcugaagagccugaagagacugaccuucaccagcaacaagggcggcaacgccuucagcgagguggaccugcccagccuggaguuccuggaccugagcagaaacggccugagcuucaagggcugcugcagccagagcgacuucggcaccaccagccugaaguaccuggaccugagcuucaacggcgugaucaccaugagcagcaacuuccugggccuggagcagcuggagcaccuggacuuccagcacagcaaccugaagcagaugagcgaguucagcguguuccugagccugagaaaccugaucuaccuggacaucagccacacccacaccagaguggccuucaacggcaucuucaacggccugagcagccuggaggugcugaagauggccggcaacagcuuccaggagaacuuccugcccgacaucuucaccgagcugagaaaccugaccuuccuggaccugagccagugccagcuggagcagcugagccccaccgccuucaacagccugagcagccugcaggugcugaacaugagccacaacaacuucuucagccuggacaccuuccccuacaagugccugaacagccugcaggugcuggacuacagccugaaccacaucaugaccagcaagaagcaggagcugcagcacuuccccagcagccuggccuuccugaaccugacccagaacgacuucgccugcaccugcgagcaccagagcuuccugcaguggaucaaggaccagagacagcugcugguggagguggagagaauggagugcgccacccccagcgacaagcagggcaugcccgugcugagccugaacaucaccugccagaugaacaagaccaucaucggcgugagcgugcugagcgugcugguggugagcgugguggccgugcugguguacaaguucuacuuccaccugaugcugcuggccggcugcaucaaguacggcagaggcgagaacaucuacgacgccuucgugaucuacagcagccaggacgaggacugggugagaaacgagcuggugaagaaccuggaggagggcgugccccccuuccagcugugccugcacuacagagacuucauccccggcguggccaucgccgccaacaucauccacgagggcuuccacaagagcagaaaggugaucgugguggugagccagcacuucauccagagcagauggugcaucuucgaguacgagaucgcccagaccuggcaguuccugagcagcagagccggcaucaucuucaucgugcugcagaagguggagaagacccugcugagacagcagguggagcuguacagacugcugagcagaaacaccuaccuggagugggaggacagcgugcugggcagacacaucuucuggagaagacugagaaaggcccugcuggacggcaagagcuggaaccccgagggcaccgugggcaccggcugcaacuggcaggaggccaccagcaucuaa

SEQ ID NO: 24671 - RNA, 2577 nt, Artificial Sequence
  TLR5__Homo_sapiens__XP_006711569
augggcgaccaccuggaccugcugcugggcguggugcugauggccggccccguguucggcauccccagcugcagcuucgacggcagaaucgccuucuacagauucugcaaccugacccaggugccccaggugcugaacaccaccgagagacugcugcugagcuucaacuacaucagaaccgugaccgccagcagcuuccccuuccuggagcagcugcagcugcuggagcugggcagccaguacaccccccugaccaucgacaaggaggccuucagaaaccugcccaaccugagaauccuggaccugggcagcagcaagaucuacuuccugcaccccgacgccuuccagggccuguuccaccuguucgagcugagacuguacuucugcggccugagcgacgccgugcugaaggacggcuacuucagaaaccugaaggcccugaccagacuggaccugagcaagaaccagaucagaagccuguaccugcaccccagcuucggcaagcugaacagccugaagagcaucgacuucagcagcaaccagaucuuccuggugugcgagcacgagcuggagccccugcagggcaagacccugagcuucuucagccuggccgccaacagccuguacagcagagugagcguggacuggggcaagugcaugaaccccuucagaaacauggugcuggagauccuggacgugagcggcaacggcuggaccguggacaucaccggcaacuucagcaacgccaucagcaagagccaggccuucagccugauccuggcccaccacaucaugggcgccggcuucggcuuccacaacaucaaggaccccgaccagaacaccuucgccggccuggccagaagcagcgugagacaccuggaccugagccacggcuucguguucagccugaacagcagaguguucgagacccugaaggaccugaaggugcugaaccuggccuacaacaagaucaacaagaucgccgacgaggccuucuacggccuggacaaccugcaggugcugaaccugagcuacaaccugcugggcgagcuguacagcagcaacuucuacggccugcccaagguggccuacaucgaccugcagaagaaccacaucgccaucauccaggaccagaccuucaaguuccuggagaagcugcagacccuggaccugagagacaacgcccugaccaccauccacuucauccccagcauccccgacaucuuccugagcggcaacaagcuggugacccugcccaagaucaaccugaccgccaaccugauccaccugagcgagaacagacuggagaaccuggacauccuguacuuccugcugagagugccccaccugcagauccugauccugaaccagaacagauucagcagcugcagcggcgaccagacccccagcgagaaccccagccuggagcagcuguuccugggcgagaacaugcugcagcuggccugggagaccgagcugugcugggacguguucgagggccugagccaccugcaggugcuguaccugaaccacaacuaccugaacagccugccccccggcguguucagccaccugaccgcccugagaggccugagccugaacagcaacagacugaccgugcugagccacaacgaccugcccgccaaccuggagauccuggacaucagcagaaaccagcugcuggcccccaaccccgacguguucgugagccugagcgugcuggacaucacccacaacaaguucaucugcgagugcgagcugagcaccuucaucaacuggcugaaccacaccaacgugaccaucgccggcccccccgccgacaucuacugcguguaccccgacagcuucagcggcgugagccuguucagccugagcaccgagggcugcgacgaggaggaggugcugaagagccugaaguucagccuguucaucgugugcaccgugacccugacccuguuccugaugaccauccugaccgugaccaaguucagaggcuucugcuucaucugcuacaagaccgcccagagacugguguucaaggaccacccccagggcaccgagcccgacauguacaaguacgacgccuaccugugcuucagcagcaaggacuucaccugggugcagaacgcccugcugaagcaccuggacacccaguacagcgaccagaacagauucaaccugugcuucgaggagagagacuucgugcccggcgagaacagaaucgccaacauccaggacgccaucuggaacagcagaaagaucgugugccuggugagcagacacuuccugagagacggcuggugccuggaggccuucagcuacgcccagggcagaugccugagcgaccugaacagcgcccugaucauggugguggugggcagccugagccaguaccagcugaugaagcaccagagcaucagaggcuucgugcagaagcagcaguaccugagauggcccgaggaccugcaggacgugggcugguuccugcacaagcugagccagcagauccugaagaaggagaaggagaagaagaaggacaacaacaucccccugcagaccguggccaccaucagcuaa

SEQ ID NO: 24672 - RNA, 2391 nt, Artificial Sequence
  TLR6__Homo_sapiens__NP_006059
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggcagcacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcgugcccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugacccagagaaccuaccugcaguggcccaaggagaagagcaagagaggccuguucugggccaacaucagagccgccuucaacaugaagcugacccuggugaccgagaacaacgacgugaagagcuaa

SEQ ID NO: 24673 - RNA, 3150 nt, Artificial Sequence
  TLR7__Homo_sapiens__NP_057646
augguguuccccauguggacccugaagagacagauccugauccuguucaacaucauccugaucagcaagcugcugggcgccagaugguuccccaagacccugcccugcgacgugacccuggacgugcccaagaaccacgugaucguggacugcaccgacaagcaccugaccgagauccccggcggcauccccaccaacaccaccaaccugacccugaccaucaaccacauccccgacaucagccccgccagcuuccacagacuggaccaccugguggagaucgacuucagaugcaacugcgugcccaucccccugggcagcaagaacaacaugugcaucaagagacugcagaucaagcccagaagcuucagcggccugaccuaccugaagagccuguaccuggacggcaaccagcugcuggagaucccccagggccugccccccagccugcagcugcugagccuggaggccaacaacaucuucagcaucagaaaggagaaccugaccgagcuggccaacaucgagauccuguaccugggccagaacugcuacuacagaaaccccugcuacgugagcuacagcaucgagaaggacgccuuccugaaccugaccaagcugaaggugcugagccugaaggacaacaacgugaccgccgugcccaccgugcugcccagcacccugaccgagcuguaccuguacaacaacaugaucgccaagauccaggaggacgacuucaacaaccugaaccagcugcagauccuggaccugagcggcaacugccccagaugcuacaacgcccccuuccccugcgcccccugcaagaacaacagcccccugcagauccccgugaacgccuucgacgcccugaccgagcugaaggugcugagacugcacagcaacagccugcagcacgugccccccagaugguucaagaacaucaacaagcugcaggagcuggaccugagccagaacuuccuggccaaggagaucggcgacgccaaguuccugcacuuccugcccagccugauccagcuggaccugagcuucaacuucgagcugcagguguacagagccagcaugaaccugagccaggccuucagcagccugaagagccugaagauccugagaaucagaggcuacguguucaaggagcugaagagcuucaaccugagcccccugcacaaccugcagaaccuggaggugcuggaccugggcaccaacuucaucaagaucgccaaccugagcauguucaagcaguucaagagacugaaggugaucgaccugagcgugaacaagaucagccccagcggcgacagcagcgaggugggcuucugcagcaacgccagaaccagcguggagagcuacgagccccaggugcuggagcagcugcacuacuucagauacgacaaguacgccagaagcugcagauucaagaacaaggaggccagcuucaugagcgugaacgagagcugcuacaaguacggccagacccuggaccugagcaagaacagcaucuucuucgugaagagcagcgacuuccagcaccugagcuuccugaagugccugaaccugagcggcaaccugaucagccagacccugaacggcagcgaguuccagccccuggccgagcugagauaccuggacuucagcaacaacagacuggaccugcugcacagcaccgccuucgaggagcugcacaagcuggaggugcuggacaucagcagcaacagccacuacuuccagagcgagggcaucacccacaugcugaacuucaccaagaaccugaaggugcugcagaagcugaugaugaacgacaacgacaucagcagcagcaccagcagaaccauggagagcgagagccugagaacccuggaguucagaggcaaccaccuggacgugcuguggagagagggcgacaacagauaccugcagcuguucaagaaccugcugaagcuggaggagcuggacaucagcaagaacagccugagcuuccugcccagcggcguguucgacggcaugccccccaaccugaagaaccugagccuggccaagaacggccugaagagcuucagcuggaagaagcugcagugccugaagaaccuggagacccuggaccugagccacaaccagcugaccaccgugcccgagagacugagcaacugcagcagaagccugaagaaccugauccugaagaacaaccagaucagaagccugaccaaguacuuccugcaggacgccuuccagcugagauaccuggaccugagcagcaacaagauccagaugauccagaagaccagcuuccccgagaacgugcugaacaaccugaagaugcugcugcugcaccacaacagauuccugugcaccugcgacgccgugugguucguguggugggugaaccacaccgaggugaccauccccuaccuggccaccgacgugaccugcgugggccccggcgcccacaagggccagagcgugaucagccuggaccuguacaccugcgagcuggaccugaccaaccugauccuguucagccugagcaucagcgugagccuguuccugauggugaugaugaccgccagccaccuguacuucugggacgugugguacaucuaccacuucugcaaggccaagaucaagggcuaccagagacugaucagccccgacugcugcuacgacgccuucaucguguacgacaccaaggaccccgccgugaccgagugggugcuggccgagcugguggccaagcuggaggaccccagagagaagcacuucaaccugugccuggaggagagagacuggcugcccggccagcccgugcuggagaaccugagccagagcauccagcugagcaagaagaccguguucgugaugaccgacaaguacgccaagaccgagaacuucaagaucgccuucuaccugagccaccagagacugauggacgagaagguggacgugaucauccugaucuuccuggagaagcccuuccagaagagcaaguuccugcagcugagaaagagacugugcggcagcagcgugcuggaguggcccaccaacccccaggcccaccccuacuucuggcagugccugaagaacgcccuggccaccgacaaccacguggccuacagccagguguucaaggagaccguguaa

SEQ ID NO: 24674 - RNA, 3126 nt, Artificial Sequence
  TLR8__Homo_sapiens__NP_619542
auggagaacauguuccugcagagcagcaugcugaccugcaucuuccugcugaucagcggcagcugcgagcugugcgccgaggagaacuucagcagaagcuaccccugcgacgagaagaagcagaacgacagcgugaucgccgagugcagcaacagaagacugcaggaggugccccagaccgugggcaaguacgugaccgagcuggaccugagcgacaacuucaucacccacaucaccaacgagagcuuccagggccugcagaaccugaccaagaucaaccugaaccacaaccccaacgugcagcaccagaacggcaaccccggcauccagagcaacggccugaacaucaccgacggcgccuuccugaaccugaagaaccugagagagcugcugcuggaggacaaccagcugccccagauccccagcggccugcccgagagccugaccgagcugagccugauccagaacaacaucuacaacaucaccaaggagggcaucagcagacugaucaaccugaagaaccuguaccuggccuggaacugcuacuucaacaaggugugcgagaagaccaacaucgaggacggcguguucgagacccugaccaaccuggagcugcugagccugagcuucaacagccugagccacgugccccccaagcugcccagcagccugagaaagcuguuccugagcaacacccagaucaaguacaucagcgaggaggacuucaagggccugaucaaccugacccugcuggaccugagcggcaacugccccagaugcuucaacgcccccuuccccugcgugcccugcgacggcggcgccagcaucaacaucgacagauucgccuuccagaaccugacccagcugagauaccugaaccugagcagcaccagccugagaaagaucaacgccgccugguucaagaacaugccccaccugaaggugcuggaccuggaguucaacuaccuggugggcgagaucgccagcggcgccuuccugaccaugcugcccagacuggagauccuggaccugagcuucaacuacaucaagggcagcuacccccagcacaucaacaucagcagaaacuucagcaagcugcugagccugagagcccugcaccugagaggcuacguguuccaggagcugagagaggacgacuuccagccccugaugcagcugcccaaccugagcaccaucaaccugggcaucaacuucaucaagcagaucgacuucaagcuguuccagaacuucagcaaccuggagaucaucuaccugagcgagaacagaaucagcccccuggugaaggacaccagacagagcuacgccaacagcagcagcuuccagagacacaucagaaagagaagaagcaccgacuucgaguucgacccccacagcaacuucuaccacuucaccagaccccugaucaagccccagugcgccgccuacggcaaggcccuggaccugagccugaacagcaucuucuucaucggccccaaccaguucgagaaccugcccgacaucgccugccugaaccugagcgccaacagcaacgcccaggugcugagcggcaccgaguucagcgccaucccccacgugaaguaccuggaccugaccaacaacagacuggacuucgacaacgccagcgcccugaccgagcugagcgaccuggaggugcuggaccugagcuacaacagccacuacuucagaaucgccggcgugacccaccaccuggaguucauccagaacuucaccaaccugaaggugcugaaccugagccacaacaacaucuacacccugaccgacaaguacaaccuggagagcaagagccugguggagcugguguucagcggcaacagacuggacauccuguggaacgacgacgacaacagauacaucagcaucuucaagggccugaagaaccugaccagacuggaccugagccugaacagacugaagcacauccccaacgaggccuuccugaaccugcccgccagccugaccgagcugcacaucaacgacaacaugcugaaguucuucaacuggacccugcugcagcaguuccccagacuggagcugcuggaccugagaggcaacaagcugcuguuccugaccgacagccugagcgacuucaccagcagccugagaacccugcugcugagccacaacagaaucagccaccugcccagcggcuuccugagcgaggugagcagccugaagcaccuggaccugagcagcaaccugcugaagaccaucaacaagagcgcccuggagaccaagaccaccaccaagcugagcaugcuggagcugcacggcaaccccuucgagugcaccugcgacaucggcgacuucagaagauggauggacgagcaccugaacgugaagauccccagacugguggacgugaucugcgccagccccggcgaccagagaggcaagagcaucgugagccuggagcugaccaccugcgugagcgacgugaccgccgugauccuguucuucuucaccuucuucaucaccaccauggugaugcuggccgcccuggcccaccaccuguucuacugggacgugugguucaucuacaacgugugccuggccaaggugaagggcuacagaagccugagcaccagccagaccuucuacgacgccuacaucagcuacgacaccaaggacgccagcgugaccgacugggugaucaacgagcugagauaccaccuggaggagagcagagacaagaacgugcugcugugccuggaggagagagacugggaccccggccuggccaucaucgacaaccugaugcagagcaucaaccagagcaagaagaccguguucgugcugaccaagaaguacgccaagagcuggaacuucaagaccgccuucuaccuggcccugcagagacugauggacgagaacauggacgugaucaucuucauccugcuggagcccgugcugcagcacagccaguaccugagacugagacagagaaucugcaagagcagcauccugcaguggcccgacaaccccaaggccgagggccuguucuggcagacccugagaaacguggugcugaccgagaacgacagcagauacaacaacauguacguggacagcaucaagcaguacuaa

SEQ ID NO: 24675 - RNA, 3099 nt, Artificial Sequence
  TLR9__Homo_sapiens__NP_059138
augggcuucugcagaagcgcccugcacccccugagccugcuggugcaggccaucaugcuggccaugacccuggcccugggcacccugcccgccuuccugcccugcgagcugcagccccacggccuggugaacugcaacuggcuguuccugaagagcgugccccacuucagcauggccgcccccagaggcaacgugaccagccugagccugagcagcaacagaauccaccaccugcacgacagcgacuucgcccaccugcccagccugagacaccugaaccugaaguggaacugcccccccgugggccugagccccaugcacuuccccugccacaugaccaucgagcccagcaccuuccuggccgugcccacccuggaggagcugaaccugagcuacaacaacaucaugaccgugcccgcccugcccaagagccugaucagccugagccugagccacaccaacauccugaugcuggacagcgccagccuggccggccugcacgcccugagauuccuguucauggacggcaacugcuacuacaagaaccccugcagacaggcccuggagguggcccccggcgcccugcugggccugggcaaccugacccaccugagccugaaguacaacaaccugaccguggugcccagaaaccugcccagcagccuggaguaccugcugcugagcuacaacagaaucgugaagcuggcccccgaggaccuggccaaccugaccgcccugagagugcuggacgugggcggcaacugcagaagaugcgaccacgcccccaaccccugcauggagugccccagacacuucccccagcugcaccccgacaccuucagccaccugagcagacuggagggccuggugcugaaggacagcagccugagcuggcugaacgccagcugguucagaggccugggcaaccugagagugcuggaccugagcgagaacuuccuguacaagugcaucaccaagaccaaggccuuccagggccugacccagcugagaaagcugaaccugagcuucaacuaccagaagagagugagcuucgcccaccugagccuggcccccagcuucggcagccugguggcccugaaggagcuggacaugcacggcaucuucuucagaagccuggacgagaccacccugagaccccuggccagacugcccaugcugcagacccugagacugcagaugaacuucaucaaccaggcccagcugggcaucuucagagccuuccccggccugagauacguggaccugagcgacaacagaaucagcggcgccagcgagcugaccgccaccaugggcgaggccgacggcggcgagaagguguggcugcagcccggcgaccuggcccccgcccccguggacacccccagcagcgaggacuucagacccaacugcagcacccugaacuucacccuggaccugagcagaaacaaccuggugaccgugcagcccgagauguucgcccagcugagccaccugcagugccugagacugagccacaacugcaucagccaggccgugaacggcagccaguuccugccccugaccggccugcaggugcuggaccugagccacaacaagcuggaccuguaccacgagcacagcuucaccgagcugcccagacuggaggcccuggaccugagcuacaacagccagcccuucggcaugcagggcgugggccacaacuucagcuucguggcccaccugagaacccugagacaccugagccuggcccacaacaacauccacagccaggugagccagcagcugugcagcaccagccugagagcccuggacuucagcggcaacgcccugggccacaugugggccgagggcgaccuguaccugcacuucuuccagggccugagcggccugaucuggcuggaccugagccagaacagacugcacacccugcugccccagacccugagaaaccugcccaagagccugcaggugcugagacugagagacaacuaccuggccuucuucaagugguggagccugcacuuccugcccaagcuggaggugcuggaccuggccggcaaccagcugaaggcccugaccaacggcagccugcccgccggcaccagacugagaagacuggacgugagcugcaacagcaucagcuucguggcccccggcuucuucagcaaggccaaggagcugagagagcugaaccugagcgccaacgcccugaagaccguggaccacagcugguucggcccccuggccagcgcccugcagauccuggacgugagcgccaacccccugcacugcgccugcggcgccgccuucauggacuuccugcuggaggugcaggccgccgugcccggccugcccagcagagugaagugcggcagccccggccagcugcagggccugagcaucuucgcccaggaccugagacugugccuggacgaggcccugagcugggacugcuucgcccugagccugcuggccguggcccugggccugggcgugcccaugcugcaccaccugugcggcugggaccugugguacugcuuccaccugugccuggccuggcugcccuggagaggcagacagagcggcagagacgaggacgcccugcccuacgacgccuucgugguguucgacaagacccagagcgccguggccgacuggguguacaacgagcugagaggccagcuggaggagugcagaggcagaugggcccugagacugugccuggaggagagagacuggcugcccggcaagacccuguucgagaaccugugggccagcguguacggcagcagaaagacccuguucgugcuggcccacaccgacagagugagcggccugcugagagccagcuuccugcuggcccagcagagacugcuggaggacagaaaggacgugguggugcuggugauccugagccccgacggcagaagaagcagauacgugagacugagacagagacugugcagacagagcgugcugcuguggccccaccagcccagcggccagagaagcuucugggcccagcugggcauggcccugaccagagacaaccaccacuucuacaacagaaacuucugccagggccccaccgccgaguaa

SEQ ID NO: 24676 - RNA, 774 nt, Artificial Sequence
  TLX1__Homo_sapiens__NP_001182446
auggagcaccugggcccccaccaccugcaccccggccacgccgagcccaucagcuucggcaucgaccagauccugaacagccccgaccagggcggcugcaugggccccgccagcagacugcaggacggcgaguacggccugggcugccuggugggcggcgccuacaccuacggcggcggcggcagcgccgccgccaccggcgccggcggcgccggcgccuacggcaccggcggccccggcggccccggcggccccgccggcggcggcggcgccugcagcaugggcccccugaccggcagcuacaacgugaacauggcccuggccggcggccccggccccggcggcggcggcggcagcagcggcggcgccggcgcccugagcgccgccggcgugaucagagugcccgcccacagaccccuggccggcgccguggcccacccccagccccuggccaccggccugcccaccgugcccagcgugcccgccaugcccggcgugaacaaccugaccggccugaccuuccccuggauggagagcaacagaagauacaccaaggacagauucaccggccaccccuaccagaacagaaccccccccaagaagaagaagcccagaaccagcuucaccagacugcagaucugcgagcuggagaagagauuccacagacagaaguaccuggccagcgccgagagagccgcccuggccaaggcccugaagaugaccgacgcccaggugaagaccugguuccagaacagaagaaccaaguggagauaa

SEQ ID NO: 24677 - RNA, 855 nt, Artificial Sequence
  TLX2__Homo_sapiens__NP_057254
auggagcccggcaugcugggcccccacaaccugccccaccacgagcccaucagcuucggcaucgaccagauccugagcggccccgagacccccggcggcggccugggccugggcagaggcggccagggccacggcgagaacggcgccuucagcggcggcuaccacggcgccagcggcuacggccccgccggcagccuggccccccugcccggcagcagcggcgugggccccggcggcgugaucagagugcccgcccacagaccccugcccgugcccccccccgccggcggcgcccccgccgugcccggccccagcggccugggcggcgccggcggccuggccggccugaccuuccccuggauggacagcggcagaagauucgccaaggacagacugaccgccgcccugagccccuucagcggcaccagaagaaucggccaccccuaccagaacagaaccccccccaagagaaagaagcccagaaccagcuucagcagaagccaggugcuggagcuggagagaagauuccugagacagaaguaccuggccagcgccgagagagccgcccuggccaaggcccugagaaugaccgacgcccaggugaagaccugguuccagaacagaagaaccaaguggagaagacagaccgccgaggagagagaggccgagagacacagagccggcagacugcugcugcaccugcagcaggacgcccugcccagaccccugagacccccccugccccccgacccccugugccugcacaacagcagccuguucgcccugcagaaccugcagcccugggccgaggacaacaagguggccagcgugagcggccuggccagcgugguguaa

SEQ ID NO: 24678 - RNA, 876 nt, Artificial Sequence
  TLX3__Homo_sapiens__NP_066305
auggaggcccccgccagcgcccagaccccccacccccacgagcccaucagcuucggcaucgaccagauccugaacagccccgaccaggacagcgcccccgcccccagaggccccgacggcgccagcuaccugggcggcccccccggcggcagacccggcgccaccuaccccagccugcccgccagcuucgccggccugggcgcccccuucgaggacgccggcagcuacagcgugaaccugagccuggcccccgccggcgugaucagagugcccgcccacagaccccugcccggcgccgugccccccccccugcccagcgcccugcccgccaugcccagcgugcccaccgugagcagccugggcggccugaacuuccccuggauggagagcagcagaagauucgugaaggacagauucaccgccgccgccgcccugacccccuucaccgugaccagaagaaucggccaccccuaccagaacagaaccccccccaagagaaagaagcccagaaccagcuucagcagagugcagaucugcgagcuggagaagagauuccacagacagaaguaccuggccagcgccgagagagccgcccuggccaagagccugaagaugaccgacgcccaggugaagaccugguuccagaacagaagaaccaaguggagaagacagaccgccgaggagagagaggccgagagacagcaggccagcagacugaugcugcagcugcagcacgacgccuuccagaagagccugaacgacagcauccagcccgacccccugugccugcacaacagcagccuguucgcccugcagaaccugcagcccugggaggaggacagcagcaaggugcccgccgugaccagccugguguaa

SEQ ID NO: 24679 - RNA, 609 nt, Artificial Sequence
  TM4SF1__Homo_sapiens__NP_055035
augugcuacggcaagugcgccagaugcaucggccacagccuggugggccuggcccugcugugcaucgccgccaacauccugcuguacuuccccaacggcgagaccaaguacgccagcgagaaccaccugagcagauucgugugguucuucagcggcaucgugggcggcggccugcugaugcugcugcccgccuucguguucaucggccuggagcaggacgacugcugcggcugcugcggccacgagaacugcggcaagagaugcgccaugcugagcagcgugcuggccgcccugaucggcaucgccggcagcggcuacugcgugaucguggccgcccugggccuggccgagggcccccugugccuggacagccugggccaguggaacuacaccuucgccagcaccgagggccaguaccugcuggacaccagcaccuggagcgagugcaccgagcccaagcacaucguggaguggaacgugagccuguucagcauccugcuggcccugggcggcaucgaguucauccugugccugauccaggugaucaacggcgugcugggcggcaucugcggcuucugcugcagccaccagcagcaguacgacugcuaa

SEQ ID NO: 24680 - RNA, 690 nt, Artificial Sequence
  TM4SF20__Homo_sapiens__NP_079071
augaccugcugcgagggcuggaccagcugcaacggcuucagccugcuggugcugcugcugcugggcguggugcugaacgccaucccccugaucgugagccugguggaggaggaccaguucagccagaaccccaucagcugcuucgaguggugguuccccggcaucaucggcgccggccugauggccauccccgccaccaccaugagccugaccgccagaaagagagccugcugcaacaacagaaccggcauguuccugagcagccuguucagcgugaucaccgugaucggcgcccuguacugcaugcugaucagcauccaggcccugcugaagggcccccugaugugcaacagccccagcaacagcaacgccaacugcgaguucagccugaagaacaucagcgacauccaccccgagagcuucaaccugcagugguucuucaacgacagcugcgccccccccaccggcuucaacaagcccaccagcaacgacaccauggccagcggcuggagagccagcagcuuccacuucgacagcgaggagaacaagcacagacugauccacuucagcguguuccugggccugcugcuggugggcauccuggaggugcuguucggccugagccagaucgugaucggcuuccugggcugccugugcggcgugagcaagagaagaagccagaucguguaa

SEQ ID NO: 24681 - RNA, 609 nt, Artificial Sequence
  TM4SF4__Homo_sapiens__NP_004608
augugcaccggcggcugcgccagaugccugggcggcacccugaucccccuggccuucuucggcuuccuggccaacauccugcuguucuuccccggcggcaaggugaucgacgacaacgaccaccugagccaggagaucugguucuucggcggcauccugggcagcggcgugcugaugaucuuccccgcccugguguuccugggccugaagaacaacgacugcugcggcugcugcggcaacgagggcugcggcaagagauucgccauguucaccagcaccaucuucgccguggugggcuuccugggcgccggcuacagcuucaucaucagcgccaucagcaucaacaagggccccaagugccugauggccaacagcaccuggggcuaccccuuccacgacggcgacuaccugaacgacgaggcccuguggaacaagugcagagagccccugaacguggugcccuggaaccugacccuguucagcauccugcugguggugggcggcauccagauggugcugugcgccauccagguggugaacggccugcugggcacccugugcggcgacugccagugcugcggcugcugcggcggcgacggccccguguaa

SEQ ID NO: 24682 - RNA, 594 nt, Artificial Sequence
  TM4SF5__Homo_sapiens__NP_003954
augugcaccggcaagugcgccagaugcgugggccugagccugaucacccugugccuggugugcaucguggccaacgcccugcugcuggugcccaacggcgagaccagcuggaccaacaccaaccaccugagccugcagguguggcugaugggcggcuucaucggcggcggccugauggugcugugccccggcaucgccgccgugagagccggcggcaagggcugcugcggcgccggcugcugcggcaacagaugcagaaugcugagaagcguguucagcagcgccuucggcgugcugggcgccaucuacugccugagcgugagcggcgccggccugagaaacggccccagaugccugaugaacggcgaguggggcuaccacuucgaggacaccgccggcgccuaccugcugaacagaacccugugggacagaugcgaggccccccccagaguggugcccuggaacgugacccuguucagccugcugguggccgccagcugccuggagaucgugcugugcggcauccagcuggugaacgccaccaucggcguguucugcggcgacugcagaaagaagcaggacaccccccacuaa

SEQ ID NO: 24683 - RNA, 1134 nt, Artificial Sequence
  TM6SF2__Homo_sapiens__NP_001001524
auggacauccccccccuggccggcaagaucgccgcccugagccugagcgcccugcccgugagcuacgcccugaaccacgugagcgcccugagccacccccuguggguggcccugaugagcgcccugauccugggccugcuguucguggccguguacagccugagccacggcgaggugagcuacgacccccuguacgccguguucgccguguucgccuucaccagcgugguggaccugaucaucgcccugcaggaggacagcuacguggugggcuucauggaguucuacaccaaggagggcgagcccuaccugagaaccgcccacggcguguucaucugcuacugggacggcaccgugcacuaccugcuguaccuggccauggccggcgccaucugcagaagaaagagauacagaaacuucggccuguacuggcugggcagcuucgccaugagcauccugguguuccugaccggcaacauccugggcaaguacagcagcgagaucagacccgccuucuuccugaccauccccuaccugcuggugcccugcugggccggcaugaagguguucagccagcccagagcccugaccagaugcaccgccaacauggugcaggaggagcagagaaagggccugcugcagagacccgccgaccuggcccuggugaucuaccugauccuggccggcuucuucacccuguucagaggccugguggugcuggacugccccaccgacgccugcuucguguacaucuaccaguacgagcccuaccugagagaccccguggccuaccccaaggugcagaugcugauguacauguucuacgugcugcccuucugcggccuggccgccuacgcccugaccuuccccggcugcagcuggcugcccgacugggcccugguguucgccggcggcaucggccaggcccaguucagccacaugggcgccagcaugcaccugagaacccccuucaccuacagagugcccgaggacaccuggggcugcuucuucgugugcaaccugcuguacgcccugggcccccaccugcuggccuacagaugccugcaguggcccgccuucuuccaccagcccccccccagcgacccccuggcccugcacaagaagcagcacuaa

SEQ ID NO: 24684 - RNA, 1176 nt, Artificial Sequence
  TM7SF2__Homo_sapiens__NP_001264162
auggcccccacccagggccccagagccccccuggaguucggcggcccccugggcgccgccgcccugcugcugcugcugcccgccaccauguuccaccugcugcuggccgccagaagcggccccgccagacugcugggcccccccgccagccugcccggccuggaggugcuguggagccccagagcccugcugcuguggcuggccuggcugggccugcaggccgcccuguaccugcugcccgccagaaagguggccgagggccaggagcugaaggacaagagcagacugagauaccccaucaacggcuuccaggcccuggugcugaccgcccugcuggugggccugggcaugagcgccggccugccccugggcgcccugcccgagaugcugcugccccuggccuucguggccacccugaccgccuucaucuucagccuguuccuguacaugaaggcccagguggcccccgugagcgcccuggcccccggcggcaacagcggcaaccccaucuacgacuucuuccugggcagagagcugaaccccagaaucugcuucuucgacuucaaguacuucugcgagcugagacccggccugaucggcugggugcugaucaaccuggcccugcugaugaaggaggccgagcugagaggcagccccagccuggccauguggcuggugaacggcuuccagcugcuguacgugggcgacgcccuguggcacgaggaggccgugcugaccaccauggacaucacccacgacggcuucggcuucaugcuggccuucggcgacauggccugggugcccuucaccuacagccugcaggcccaguuccugcugcaccacccccagccccugggccugcccauggccagcgugaucugccugaucaacggccuggagaccaucagcaccgccaccggcagaaagcugcuggugagcggcugguggggcauggugagacaccccaacuaccugggcgaccugaucauggcccuggccuggagccugcccugcggcgugagccaccugcugcccuacuucuaccugcuguacuucaccgcccugcuggugcacagagaggccagagacgagagacagugccugcagaaguacggccuggccuggcaggaguacugcagaagagugcccuacagaaucaugcccuacaucuacuaa

SEQ ID NO: 24685 - RNA, 1992 nt, Artificial Sequence
  TM9SF2__Homo_sapiens__NP_004791
augagcgccagacugcccgugcugagcccccccagauggcccagacugcugcugcugagccugcugcugcugggcgccgugcccggccccagaagaagcggcgccuucuaccugcccggccuggcccccgugaacuucugcgacgaggagaagaagagcgacgagugcaaggccgagaucgagcuguucgugaacagacuggacagcguggagagcgugcugcccuacgaguacaccgccuucgacuucugccaggccagcgagggcaagagacccagcgagaaccugggccaggugcuguucggcgagagaaucgagcccagccccuacaaguucaccuucaacaagaaggagaccugcaagcuggugugcaccaagaccuaccacaccgagaaggccgaggacaagcagaagcuggaguuccugaagaagagcaugcugcugaacuaccagcaccacuggaucguggacaacaugcccgugaccuggugcuacgacguggaggacggccagagauucugcaaccccggcuuccccaucggcugcuacaucaccgacaagggccacgccaaggacgccugcgugaucagcagcgacuuccacgagagagacaccuucuacaucuucaaccacguggacaucaagaucuacuaccacgugguggagaccggcagcaugggcgccagacugguggccgccaagcuggagcccaagagcuucaagcacacccacaucgacaagcccgacugcagcggcccccccauggacaucagcaacaaggccagcggcgagaucaagaucgccuacaccuacagcgugagcuucgaggaggacgacaagaucagaugggccagcagaugggacuacauccuggagagcaugccccacacccacauccagugguucagcaucaugaacagccuggugaucgugcuguuccugagcggcaugguggccaugaucaugcugagaacccugcacaaggacaucgccagauacaaccagauggacagcaccgaggacgcccaggaggaguucggcuggaagcuggugcacggcgacaucuucagaccccccagaaagggcaugcugcugagcguguuccugggcagcggcacccagauccugaucaugaccuucgugacccuguucuucgccugccugggcuuccugagccccgccaacagaggcgcccugaugaccugcgccguggugcugugggugcugcugggcacccccgccggcuacguggccgccagauucuacaagagcuucggcggcgagaaguggaagaccaacgugcugcugaccagcuuccugugccccggcaucguguucgccgacuucuucaucaugaaccugauccuguggggcgagggcagcagcgccgccauccccuucggcacccugguggccauccuggcccugugguucugcaucagcgugccccugaccuucaucggcgccuacuucggcuucaagaagaacgccaucgagcaccccgugagaaccaaccagauccccagacagauccccgagcagagcuucuacaccaagccccugcccggcaucaucaugggcggcauccugcccuucggcugcaucuucauccagcuguucuucauccugaacagcaucuggagccaccagauguacuacauguucggcuuccuguuccugguguucaucauccuggugaucaccugcagcgaggccaccauccugcugugcuacuuccaccugugcgccgaggacuaccacuggcaguggagaagcuuccugaccagcggcuucaccgccguguacuuccugaucuacgccgugcacuacuucuucagcaagcugcagaucaccggcaccgccagcaccauccuguacuucggcuacaccaugaucauggugcugaucuucuuccuguucaccggcaccaucggcuucuucgccugcuucugguucgugaccaagaucuacagcguggugaagguggacuaa

SEQ ID NO: 24686 - RNA, 1929 nt, Artificial Sequence
  TM9SF4__Homo_sapiens__NP_055557
auggccaccgccauggacuggcugcccuggagccugcugcuguucagccugaugugcgagaccagcgccuucuacgugcccggcguggcccccaucaacuuccaccagaacgaccccguggagaucaaggccgugaagcugaccagcagcagaacccagcugcccuacgaguacuacagccugcccuucugccagcccagcaagaucaccuacaaggccgagaaccugggcgaggugcugagaggcgacagaaucgugaacacccccuuccaggugcugaugaacagcgagaagaagugcgaggugcugugcagccagagcaacaagcccgugacccugaccguggagcagagcagacugguggccgagagaaucaccgaggacuacuacgugcaccugaucgccgacaaccugcccguggccaccagacuggagcuguacagcaacagagacagcgacgacaagaagaaggagaaggacgugcaguucgagcacggcuacagacugggcuucaccgacgugaacaagaucuaccugcacaaccaccugagcuucauccuguacuaccacagagaggacauggaggaggaccaggagcacaccuacagaguggugagauucgaggugaucccccagagcaucagacuggaggaccugaaggccgacgagaagagcagcugcacccugcccgagggcaccaacagcagcccccaggagaucgaccccaccaaggagaaccagcuguacuucaccuacagcgugcacugggaggagagcgacaucaagugggccagcagaugggacaccuaccugaccaugagcgacgugcagauccacugguucagcaucaucaacagcgugguggugguguucuuccugagcggcauccugagcaugaucaucaucagaacccugagaaaggacaucgccaacuacaacaaggaggacgacaucgaggacaccauggaggagagcggcuggaagcuggugcacggcgacguguucagacccccccaguaccccaugauccugagcagccugcugggcagcggcauccagcuguucugcaugauccugaucgugaucuucguggccaugcugggcaugcugagccccagcagcagaggcgcccugaugaccaccgccugcuuccuguucauguucaugggcguguucggcggcuucagcgccggcagacuguacagaacccugaagggccacagauggaagaagggcgccuucugcaccgccacccuguaccccggcgugguguucggcaucugcuucgugcugaacugcuucaucuggggcaagcacagcagcggcgccgugcccuuccccaccaugguggcccugcugugcaugugguucggcaucagccugccccugguguaccugggcuacuacuucggcuucagaaagcagcccuacgacaaccccgugagaaccaaccagauccccagacagauccccgagcagagaugguacaugaacagauucgugggcauccugauggccggcauccugcccuucggcgccauguucaucgagcuguucuucaucuucagcgccaucugggagaaccaguucuacuaccuguucggcuuccuguuccugguguucaucauccugguggugagcugcagccagaucagcaucgugaugguguacuuccagcugugcgccgaggacuacagauggugguggagaaacuuccuggugagcggcggcagcgccuucuacgugcugguguacgccaucuucuacuucgugaacaagcuggacaucguggaguucauccccagccugcuguacuucggcuacaccgcccugauggugcugagcuucuggcugcugaccggcaccaucggcuucuacgccgccuacauguucgugagaaagaucuacgccgccgugaagaucgacuaa

SEQ ID NO: 24687 - RNA, 858 nt, Artificial Sequence
  TMBIM4__Homo_sapiens__NP_001269535
auggccgaccccgaccccagauaccccagaagcagcaucgaggacgacuucaacuacggcagcagcguggccagcgccaccgugcacaucagaauggugcugcagagagacugcaccuucagcaagcaguacaugagaauccccagcgcccccagcgccacccugaacaucaucagauucuuccaccugagacagagcggcagaagcggcauggugaacaucuucuacaagggccccaccuuccugagaaagguguacagcauccugagccugcaggugcugcugaccaccgugaccagcaccguguuccuguacuucgagagcgugagaaccuucgugcacgagagccccgcccugauccugcuguucgcccugggcagccugggccugaucuucgcccugauccugaacagacacaaguacccccugaaccuguaccugcuguucggcuucacccugcuggaggcccugaccguggccgugguggugaccuucuacgacguguacaucauccugcaggccuucauccugaccaccaccguguucuucggccugaccguguacacccugcagagcaagaaggacuucagcaaguucggcgccggccuguucgcccugcuguggauccugugccugagcggcuuccugaaguucuucuucuacagcgagaucauggagcuggugcuggccgccgccggcgcccugcuguucugcggcuucaucaucuacgacacccacagccugaugcacaagcugagccccgaggaguacgugcuggccgccaucagccuguaccuggacaucaucaaccuguuccugcaccugcugagauuccuggaggccgugaacaagaaguaa

SEQ ID NO: 24688 - RNA, 714 nt, Artificial Sequence
  TMBIM6__Homo_sapiens__NP_003208
augaacaucuucgacagaaagaucaacuucgacgcccugcugaaguucagccacaucacccccagcacccagcagcaccugaagaagguguacgccagcuucgcccugugcauguucguggccgccgccggcgccuacgugcacauggugacccacuucauccaggccggccugcugagcgcccugggcagccugauccugaugaucuggcugauggccaccccccacagccacgagaccgagcagaagagacugggccugcuggccggcuucgccuuccugaccggcgugggccugggccccgcccuggaguucugcaucgccgugaaccccagcauccugcccaccgccuucaugggcaccgccaugaucuucaccugcuucacccugagcgcccuguacgccagaagaagaagcuaccuguuccugggcggcauccugaugagcgcccugagccugcugcugcugagcagccugggcaacguguucuucggcagcaucuggcuguuccaggccaaccuguacgugggccugguggugaugugcggcuucgugcuguucgacacccagcugaucaucgagaaggccgagcacggcgaccaggacuacaucuggcacugcaucgaccuguuccuggacuucaucaccguguucagaaagcugaugaugauccuggccaugaacgagaaggacaagaagaaggagaagaaguaa

SEQ ID NO: 24689 - RNA, 2283 nt, Artificial Sequence
  TMC1__Homo_sapiens__NP_619636
augagccccaagaaggugcagaucaagguggaggagaaggaggacgagaccgaggagagcagcagcgaggaggaggaggagguggaggacaagcugcccagaagagagagccugagacccaagagaaagagaaccagagacgugaucaacgaggacgaccccgagcccgagcccgaggacgaggagaccagaaaggccagagagaaggagagaagaagaagacugaagagaggcgccgaggaggaggagaucgacgaggaggagcuggagagacugaaggccgagcuggacgagaagagacagaucaucgccaccgugaagugcaagcccuggaagauggagaagaagaucgaggugcugaaggaggccaagaaguucgugagcgagaacgagggcgcccugggcaagggcaagggcaagagaugguucgccuucaagaugaugauggccaagaagugggccaaguuccugagagacuucgagaacuucaaggccgccugcgugcccugggagaacaagaucaaggccaucgagagccaguucggcagcagcguggccagcuacuuccuguuccugagauggauguacggcgugaacauggugcuguucauccugaccuucagccugaucaugcugcccgaguaccuguggggccugcccuacggcagccugcccagaaagaccgugcccagagccgaggaggccagcgccgccaacuucggcgugcuguacgacuucaacggccuggcccaguacagcgugcuguucuacggcuacuacgacaacaagagaaccaucggcuggaugaacuucagacugccccugagcuacuuccuggugggcaucaugugcaucggcuacagcuuccugguggugcugaaggccaugaccaagaacaucggcgacgacggcggcggcgacgacaacaccuucaacuucagcuggaagguguucaccagcugggacuaccugaucggcaaccccgagaccgccgacaacaaguucaacagcaucaccaugaacuucaaggaggccaucaccgaggagaaggccgcccagguggaggagaacgugcaccugaucagauuccugagauuccuggccaacuucuucguguuccugacccugggcggcagcggcuaccugaucuucugggccgugaagagaagccaggaguucgcccagcaggaccccgacacccugggcuggugggagaagaacgagaugaacauggugaugagccugcugggcauguucugccccacccuguucgaccuguucgccgagcuggaggacuaccacccccugaucgcccugaaguggcugcugggcagaaucuucgcccugcugcugggcaaccuguacguguucauccuggcccugauggacgagaucaacaacaagaucgaggaggagaagcuggugaaggccaacaucacccugugggaggccaacaugaucaaggccuacaacgccagcuucagcgagaacagcaccggcccccccuucuucgugcaccccgccgacgugcccagaggccccugcugggagaccauggugggccaggaguucgugagacugaccgugagcgacgugcugaccaccuacgugaccauccugaucggcgacuuccugagagccugcuucgugagauucugcaacuacugcuggugcugggaccuggaguacggcuaccccagcuacaccgaguucgacaucagcggcaacgugcuggcccugaucuucaaccagggcaugaucuggaugggcagcuucuucgcccccagccugcccggcaucaacauccugagacugcacaccagcauguacuuccagugcugggccgugaugugcugcaacgugcccgaggccagaguguucaaggccagcagaagcaacaacuucuaccugggcaugcugcugcugauccuguuccugagcaccaugcccgugcuguacaugaucgugagccugccccccagcuucgacugcggccccuucagcggcaagaacagaauguucgaggugaucggcgagacccuggagcacgacuuccccagcuggauggccaagauccugagacagcugagcaaccccggccuggugaucgccgugauccuggugauggugcuggccaucuacuaccugaacgccaccgccaagggccagaaggccgccaaccuggaccugaagaagaagaugaagaugcaggcccuggagaacaagaugagaaacaagaagauggccgccgccagagccgccgccgccgccggcagacaguaa

SEQ ID NO: 24690 - RNA, 2721 nt, Artificial Sequence
  TMC2__Homo_sapiens__NP_542789
augagccaccaggugaagggccugaaggaggaggccagaggcggcgugaagggcagagugaagagcggcagcccccacaccggcgacagacugggcagaagaagcagcagcaagagagcccugaaggccgagggcacccccggcagaagaggcgcccagagaagccagaaggagagagccggcggcagccccagccccggcagccccagaagaaagcagaccggcagaagaagacacagagaggagcugggcgagcaggagagaggcgaggccgagagaaccugcgagggcagaagaaagagagacgagagagccagcuuccaggagagaaccgccgcccccaagagagagaaggagauccccagaagagaggagaagagcaagagacagaagaagcccagaagcagcagccuggccagcagcgccagcggcggcgagagccugagcgaggaggagcuggcccagauccuggagcagguggaggagaagaagaagcugaucgccaccaugagaagcaagcccuggcccauggccaagaagcugaccgagcugagagaggcccaggaguucguggagaaguacgagggcgcccugggcaagggcaagggcaagcagcuguacgccuacaagaugcugauggccaagaagugggugaaguucaagagagacuucgacaacuucaagacccagugcauccccugggagaugaagaucaaggacaucgagagccacuucggcagcagcguggccagcuacuucaucuuccugagauggauguacggcgugaaccuggugcuguucggccugaucuucggccuggugaucauccccgaggugcugaugggcaugcccuacggcagcauccccagaaagaccgugcccagagccgaggaggagaaggccauggacuucagcgugcugugggacuucgagggcuacaucaaguacagcgcccuguucuacggcuacuacaacaaccagagaaccaucggcuggcugagauacagacugcccauggccuacuucauggugggcgugagcguguucggcuacagccugaucaucgugaucagaagcauggccagcaacacccagggcagcaccggcgagggcgagagcgacaacuucaccuucagcuucaagauguucaccagcugggacuaccugaucggcaacagcgagaccgccgacaacaaguacgccagcaucaccaccagcuucaaggagagcaucguggacgagcaggagagcaacaaggaggagaacauccaccugaccagauuccugagagugcuggccaacuuccugaucaucugcugccugugcggcagcggcuaccugaucuacuucguggugaagagaagccagcaguucagcaagaugcagaacgugagcugguacgagagaaacgagguggagaucgugaugagccugcugggcauguucugccccccccuguucgagaccaucgccgcccuggagaacuaccaccccagaaccggccugaaguggcagcugggcagaaucuucgcccuguuccugggcaaccuguacaccuuccugcuggcccugauggacgacgugcaccugaagcuggccaacgaggagaccaucaagaacaucacccacuggacccuguucaacuacuacaacagcagcggcuggaacgagagcgugcccagacccccccugcaccccgccgacgugcccagaggcagcugcugggagaccgccgugggcaucgaguucaugagacugaccgugagcgacaugcuggugaccuacaucaccauccugcugggcgacuuccugagagccugcuucgugagauucaugaacuacugcuggugcugggaccuggaggccggcuuccccagcuacgccgaguucgacaucagcggcaacgugcugggccugaucuucaaccagggcaugaucuggaugggcagcuucuacgcccccggccuggugggcaucaacgugcugagacugcugaccagcauguacuuccagugcugggccgugaugagcagcaacgugccccacgagagaguguucaaggccagcagaagcaacaacuucuacaugggccugcugcugcuggugcuguuccugagccugcugcccguggccuacaccaucaugagccugccccccagcuucgacugcggccccuucagcggcaagaacagaauguacgacgugcugcaggagaccaucgagaacgacuuccccaccuuccugggcaagaucuucgccuuccuggccaaccccggccugaucauccccgccauccugcugauguuccuggccaucuacuaccugaacagcgugagcaagagccugagcagagccaacgcccagcugagaaagaagauccaggugcugagagagguggagaagagccacaagagcgugaagggcaaggccaccgccagagacagcgaggacacccccaagagcagcagcaagaacgccacccagcugcagcugaccaaggaggagaccaccccccccagcgccagccagagccaggccauggacaagaaggcccagggccccggcaccagcaacagcgccagcagaaccacccugcccgccagcggccaccugcccaucagcagaccccccggcaucggccccgacagcggccacgcccccagccagacccaccccuggagaagcgccagcggcaagagcgcccagagacccccccacuaa

SEQ ID NO: 24691 - RNA, 3303 nt, Artificial Sequence
  TMC3__Homo_sapiens__NP_001074001
augaagaccagcaaggccagccagagauacagaggcaucagaagaaacgccagccagugcuaccuguaccaggagagccugcugcugagcaaccuggacgacagcuucagcgccgacgagaccggcgacagcaacgaccccgagcagaucuuccagaacauccaguuccagaaggaccugauggccaacaucagaugcagacccuggaccaugggccagaagcugagagcccugagacaggccaagaacaucgugcugaaguucgagggcagacugaccagaaccagaggcuaccaggccgccggcgccgagcuguggagaaaguucgccagacuggccugcaacuucguggugaucuucauccccugggagaugagaaucaagaagaucgagagccacuucggcagcggcguggccagcuacuucaucuuccugagauggcuguucggcaucaacaucgugcugaccaucaugaccggcgccuucaucgugauccccgagcugaucgccggccagcccuucggcagcaccgccagaaagaccauccccaaggagcaggugagcagcgcccaggaccuggacaccguguggagccugggcggcuaccugcaguacagcgugcuguucuacggcuacuacggcagagagagaaagaucggcagagccggcuacagacugccccuggccuacuuccuggugggcauggccguguucgccuacagcuucaucauccugcugaagaagauggccaagaacagcagaaccagccuggccagcgccagcaacgagaacuacaccuucugcuggagaguguucugcgccugggacuaccugaucggcaaccccgaggccgccgagagcaagaccgccgccaucgugaacagcaucagagaggccauccuggaggagcaggagaagaagaagagcaagaaccuggccgugaccaucugccugagaaucaucgccaacauccuggugcugcugagccuggccggcagcaucuaccugaucuacuucgugguggacagaagccagaagcuggagcagagcaagaaggagcugacccugugggagaagaacgaggugagcgugguggugagccuggugaccaugaucgcccccagcgccuucgaccugaucgccgcccuggagauguaccaccccagaaccacccugagauuccagcuggccagagugcuggugcuguaccugggcaaccuguacagccugaucaucgcccugcuggacaaggugaacagcaugagcaucgaggagauggccaccaagaacaacaccagccacuggaucgacagcaccaccuucuucgccaccagaaccgcccccgaggaggagaaguggagcaccagcagacccggcaugggccugagaagaaacaacaccugggcccuggaggagaccagcaucagcgccuacaccaugccccugaucaaggccaacaagaccagccugcacacccagagcccccaggaccagugcugggagaccuacgugggccaggagaugcugaagcugagcaucaucgacaugcuguucaccguggccagcauccugcugaucgacuucuucagaggccuguucgugagauaccugagcgacuacuggugcugggaccuggagagcaaguuccccgaguacggcgaguucaagaucgccgagaacgugcugcaccugguguacaaccagggcaugaucuggaugggcgccuucuucagccccugccugcccgccuucaacgugcugaagcugaucggccugauguaccugagaagcugggccgugcugaccugcaacgugccccaccagcagguguucagagccagcagaagcaacaacuucuaccuggccaugcugcuguucaugcuguuccugugcaugcugcccaccaucuucgccaucgugagauacaagcccagccugaacugcggccccuucagcggccaggagaagaucuacgacaucgugagcgagaccaucgagaaggacuuccccgugugguucggcagcguggugggccacaucagcagccccguggugauccugcccgccgugcugcugcuguucaugcugaucuacuaccugcagagcaucgccagaagccugaagcugagcaaccaccagcugaagaugcagauccagaacgccagaagcgaggacaagaagaagguggcccagaugguggaggccagaauccagacccaggaggagagcaccaagaagcugcccaacgacagcgaccugaccagccagcugagcagcgcccacagcggcaccccccagaacaacggcaacguggcccacuucgacagcggcagcagcaagagcggcagaaucgagaccguggcccagagcaugccccagagccccagacccggcgacagagcccccagcagcccccugcccggcgugcccaagagcagacuggagcacgagaccaacagauaccugcacggccugugcgccagcaccagcgaccugcacagaaacagaagcagaacccccaugaccuucaccacccacaucgaggacgugcacagcgagccccuguucagaaaggacuuccagcagaucaaccccccccacagaggcccccaggccagcacccugcuggcccagggccccagaccccacgcccccagauacuacgugaucaacgagugcgacagcuacaagaagaagcaccugaacguguggcccgagagacacuucaagaucgacgccagcggcgacaucguggagcuguaccccagaaacgugagacaguacgccagcagagugcccagacagccccccagcccccagcugagcgaggaggaggaggagacccccagcagagacuggaucaagagaagccugccccccagaagccugaucgaccugagaagagccccccacuucuacaucggcgagagaagcgagagccagaccagagaccccgagcaccagggcagagugcacuacaagagcuggaacgaggacuucgagggccaccuggagagacccgccuacgugcccagaaagcccagaagcagaaacuuccaguacccccagcccccccugaagcccagaggcaagcccagauucgagcccagccugaccgagagcgacagcgugagcgccgccagcagcagcgaccagcagaacagcagcgccgaccaguaccugcaggugacccacagccagggcagauuccccagaagcgugggccagcccagcagaagaaaggccaagagcggccaggagcugaccguggaccuggacgaccugaucugcagcgacguguaa

SEQ ID NO: 24692 - RNA, 3021 nt, Artificial Sequence
  TMC5__Homo_sapiens__NP_001098718
augagcgccuacuacagaaacaacuggagcgaggaggaccccgacuaccccgacuacagcggcagccagaacagaacccagggcuaccugaagacccagggcuaccccgacgugcccggcccccugaacaaccccgacuaccccggcaccagaagcaaccccuacagcguggccagcagaaccagacccgacuaccccggcagccuggccgagcccaacuaccccagaagccugagcaaccccgacuacagcggcaccagaagcaacgccuacagcgccgccagcagaaccagccccgaccaccccaccagccugcccgagcccgacuacagcgaguuccagagccaccccuaccacagagccagcagcagacagcccgacuaccccggcagccagagaaaccccgacuucgccggcagcagcagcagcggcaacuacgccggcagcagaacccaccccgaccacuucggcagccuggagcccgacuaccccggcgcccagagcaacagcgaccaccccggccccagagccaaccugaaccaccccggcagcagaaagaaccuggagcacaccagcuucagaaucaaccccuacgccgacagccugggcaagcccgacuaccccggcgccgacauccagcccaacagcccccccuucuucggcgagcccgacuaccccagcgccgaggacaaccagaaccugcccagcaccuggagagagcccgacuacagcgacgccgagaacggccacgacuacggcagcagcgagacccccaagaugaccagaggcgugcugagcagaaccagcagcauccagcccagcuucagacacagaagcgacgaccccgugggcagccuguggggcgagaacgacuaccccgagggcaucgagauggccagcauggagauggccaacagcuacggccacagccugcccggcgcccccggcagcggcuacgugaaccccgccuacgugggcgagagcggccccgugcacgccuacggcaaccccccccugagcgagugcgacuggcacaagagcccccagggccagaagcugaucgccagccugauccccaugaccagcagagacagaaucaaggccaucagaaaccagcccagaaccauggaggagaagagaaaccugagaaagaucguggacaaggagaagagcaagcagacccacagaauccugcagcugaacugcugcauccagugccugaacagcaucagcagagccuacagaagaagcaagaacagccugagcgagauccugaacagcaucagccuguggcagaagacccugaagaucaucggcggcaaguucggcaccagcgugcugagcuacuucaacuuccugagauggcugcugaaguucaacaucuucagcuucauccugaacuucagcuucaucaucaucccccaguucaccguggccaagaagaacacccugcaguucaccggccuggaguucuucaccggcgugggcuacuucagagacaccgugauguacuacggcuucuacaccaacagcaccauccagcacggcaacagcggcgccagcuacaacaugcagcuggccuacaucuucaccaucggcgccugccugaccaccugcuucuucagccugcuguucagcauggccaaguacuucagaaacaacuucaucaacccccacaucuacagcggcggcaucaccaagcugaucuucugcugggacuucaccgugacccacgagaaggccgugaagcugaagcagaagaaccugagcaccgagaucagagagaaccugagcgagcugagacaggagaacagcaagcugaccuucaaccagcugcugaccagauucagcgccuacaugguggccuggguggugagcaccggcguggccaucgccugcugcgccgccguguacuaccuggccgaguacaaccuggaguuccugaagacccacagcaaccccggcgccgugcugcugcugcccuucguggugagcugcaucaaccuggccgugcccugcaucuacagcauguucagacugguggagagauacgagaugcccagacacgagguguacgugcugcugaucagaaacaucuuccugaagaucagcaucaucggcauccugugcuacuacuggcugaacaccguggcccugagcggcgaggagugcugggagacccugaucggccaggacaucuacagacugcugcugauggacuucguguucagccuggugaacagcuuccugggcgaguuccugagaagaaucaucggcaugcagcugaucaccagccugggccugcaggaguucgacaucgccagaaacgugcuggagcugaucuacgcccagacccugguguggaucggcaucuucuucugcccccugcugcccuucauccagaugaucaugcuguucaucauguucuacagcaagaacaucagccugaugaugaacuuccagccccccagcaaggccuggagagccagccagaugaugaccuucuucaucuuccugcuguucuuccccagcuucaccggcgugcugugcacccuggccaucaccaucuggagacugaagcccagcgccgacugcggccccuucagaggccugccccuguucauccacagcaucuacagcuggaucgacacccugagcaccagacccggcuaccugugggugguguggaucuacagaaaccugaucggcagcgugcacuucuucuucauccugacccugaucgugcugaucaucaccuaccuguacuggcagaucaccgagggcagaaagaucaugaucagacugcugcacgagcagaucaucaacgagggcaaggacaagauguuccugaucgagaagcugaucaagcugcaggacauggagaagaaggccaaccccagcagccuggugcuggagagaagagagguggagcagcagggcuuccugcaccugggcgagcacgacggcagccuggaccugagaagcagaagaagcgugcaggagggcaaccccagagccuaa

SEQ ID NO: 24693 - RNA, 2418 nt, Artificial Sequence
  TMC6__Homo_sapiens__NP_009198
auggcccagccccuggccuucauccuggacgugcccgagacccccggcgaccagggccagggccccagccccuacgacgagagcgaggugcacgacagcuuccagcagcugauccaggagcagagccagugcaccgcccaggagggccuggagcugcagcagagagagagagaggugaccggcagcagccagcagacccuguggagacccgagggcacccagagcaccgccacccugagaauccuggccagcaugcccagcagaaccaucggcagaagcagaggcgccaucaucagccaguacuacaacagaaccgugcagcugagaugcagaagcagcagaccccugcugggcaacuucgugagaagcgccuggcccagccugagacuguacgaccuggagcuggaccccaccgcccuggaggaggaggagaagcagagccugcuggugaaggagcugcagagccuggccguggcccagagagaccacaugcugagaggcaugccccugagccuggccgagaagagaagccugagagagaagagcagaacccccagaggcaaguggagaggccagcccggcagcggcggcgugugcagcugcugcggcagacugagauacgccugcgugcuggcccugcacagccugggccuggcccugcugagcgcccugcaggcccugaugcccuggagauacgcccugaagagaaucggcggccaguucggcagcagcgugcugagcuacuuccuguuccugaagacccugcuggccuucaacgcccugcugcugcugcugcugguggccuucaucaugggcccccagguggccuucccccccgcccugcccggccccgcccccgugugcaccggccuggagcugcugaccggcgccggcugcuucacccacaccgugauguacuacggccacuacagcaacgccacccugaaccagcccugcggcagcccccuggacggcagccagugcacccccagagugggcggccugcccuacaacaugccccuggccuaccugagcaccgugggcgugagcuucuucaucaccugcaucacccugguguacagcauggcccacagcuucggcgagagcuacagagugggcagcaccagcggcauccacgccaucaccguguucugcagcugggacuacaaggugacccagaagagagccagcagacugcagcaggacaacaucagaaccagacugaaggagcugcuggccgaguggcagcugagacacagccccagaagcgugugcggcagacugagacaggccgccgugcugggccugguguggcugcugugccugggcaccgcccugggcugcgccguggccgugcacguguucagcgaguucaugauccagagccccgaggccgccggccaggaggccgugcugcuggugcugccccugguggugggccugcugaaccugggcgcccccuaccugugcagagugcuggccgcccuggagccccacgacagccccgugcuggagguguacguggccaucugcagaaaccugauccugaagcuggccauccugggcacccugugcuaccacuggcugggcagaagagugggcgugcugcagggccagugcugggaggacuucgugggccaggagcuguacagauuccuggugauggacuucgugcugaugcugcuggacacccuguucggcgagcugguguggagaaucaucagcgagaagaagcugaagagaagaagaaagcccgaguucgacaucgccagaaacgugcuggagcugaucuacggccagacccugaccuggcugggcgugcuguucagcccccugcugcccgccgugcagaucaucaagcugcugcugguguucuacgugaagaagaccagccugcuggccaacugccaggcccccagaagacccuggcuggccagccacaugagcaccguguuccugacccugcugugcuuccccgccuuccugggcgccgccguguuccugugcuacgccguguggcaggugaagcccagcagcaccugcggccccuucagaacccuggacaccauguacgaggccggcagagugugggugagacaccuggaggccgccggccccagagugagcuggcugcccugggugcacagauaccugauggagaacaccuucuucguguuccuggugagcgcccugcugcuggccgugaucuaccugaacauccagguggugagaggccagagaaaggugaucugccugcugaaggagcagaucagcaacgagggcgaggacaagaucuuccugaucaacaagcugcacagcaucuacgagagaaaggagagagaggagagaagcagagugggcaccaccgaggaggccgccgccccccccgcccugcugaccgacgagcaggacgccuaa

SEQ ID NO: 24694 - RNA, 2181 nt, Artificial Sequence
  TMC8__Homo_sapiens__NP_689681
augcugcugcccagaagcgugagcagcgagagagcccccggcgugcccgagcccgaggagcugugggaggccgagauggagagacugagaggcagcggcacccccgugagaggccugcccuacgccaugauggacaagagacugaucuggcagcugagagagcccgccggcgugcagacccugagauggcagagauggcagagaagaagacagaccguggagagaagacugagagaggccgcccagagacuggccagaggccugggccugugggagggcgcccuguacgagaucggcggccuguucggcaccggcaucagaagcuacuucaccuuccugagauuccugcugcugcugaaccugcugagccugcugcugaccgccagcuucgugcugcugccccugguguggcugagaccccccgaccccggccccacccugaaccugacccugcagugccccggcagcagacagagcccccccggcgugcugagauuccacaaccagcuguggcacgugcugaccggcagagccuucaccaacaccuaccuguucuacggcgccuacagagugggccccgagagcagcagcguguacagcaucagacuggccuaccugcugagcccccuggccugccugcugcugugcuucugcggcacccugagaagaauggugaagggccugccccagaagacccugcugggccagggcuaccaggccccccugagcgccaagguguucagcagcugggacuucugcaucagagugcaggaggccgccaccaucaagaagcacgagaucagcaacgaguucaagguggagcuggaggagggcagaagauuccagcugaugcagcagcagaccagagcccagaccgccugcagacugcugagcuaccugagagugaacgugcugaacggccugcugguggugggcgccaucagcgccaucuucugggccaccaaguacagccaggacaacaaggaggagagccuguuccugcugcugcaguaccugccccccggcgugaucgcccuggugaacuuccugggcccccugcuguucaccuuccuggugcagcuggagaacuacccccccaacaccgaggugaaccugacccugaucuggugcguggugcugaagcuggccagccugggcauguucagcgugagccugggccagaccauccugugcaucggcagagacaagagcagcugcgagagcuacggcuacaacgugugcgacuaccagugcugggagaacagcgugggcgaggagcuguacaagcugagcaucuucaacuuccugcugaccguggccuucgccuuccuggugacccugcccagaagacugcugguggacagauucagcggcagauucugggccuggcuggagagagaggaguuccuggugcccaagaacgugcuggacaucguggccggccagaccgugaccuggaugggccuguucuacugcccccugcugccccugcugaacagcguguuccuguuccugaccuucuacaucaagaaguacacccugcugaagaacagcagagccagcagcagacccuucagagccagcagcagcaccuucuucuuccagcuggugcugcugcugggccugcugcuggccgccgugccccugggcuacguggugagcagcauccacagcagcugggacugcggccuguucaccaacuacagcgcccccuggcagguggugcccgagcugguggcccugggccugccccccaucggccagagagcccugcacuaccugggcagccacgccuucagcuucccccugcugaucaugcugagccuggugcugaccgugugcgugagccagacccaggccaacgccagagccauccacagacugagaaagcagcugguguggcaggugcaggagaaguggcaccugguggaggaccugagcagacugcugcccgagcccggccccagcgacagccccggccccaaguaccccgccagccaggccagcagaccccagagcuucugccccggcugccccugccccggcagccccggccaccaggcccccagacccggccccagcgugguggacgccgccggccugagaagccccugccccggccagcacggcgcccccgccagcgccagaagauucagauuccccagcggcgccgagcuguaa

SEQ ID NO: 24695 - RNA, 1443 nt, Artificial Sequence
  TMCC1__Homo_sapiens__XP_006713615
auguggugcggcugcaccugccuguucugcgagagccacuucagcgagaccgugaagaucgagagacuggaggugagcagccuggcccagaccagcagcgccguggccagcagcaccgacggcagcauccacaccgacagcguggacggcacccccgacccccagagaaccaaggccgccaucgcccaccugcagcagaagauccugaagcugaccgagcagaucaagaucgcccagaccgccagagacgacaacguggccgaguaccugaagcuggccaacagcgccgacaagcagcaggccgccagaaucaagcagguguucgagaagaagaaccagaagagcgcccagaccauccugcagcugcagaagaagcuggagcacuaccacagaaagcugagagagguggagcagaacggcauccccagacagcccaaggacguguucagagacaugcaccagggccugaaggacgugggcgccaaggugaccggcuucagcgagggcgugguggacagcgugaagggcggcuucagcagcuucagccaggccacccacagcgccgccggcgccguggugagcaagcccagagagaucgccagccugaucagaaacaaguucggcagcgccgacaacauccccaaccugaaggacagccuggaggagggccagguggacgacgccggcaaggcccugggcgugaucagcaacuuccagagcagccccaaguacggcagcgaggaggacugcagcagcgccaccagcggcagcgugggcgccaacagcaccaccggcggcaucgccgugggcgccagcagcagcaagaccaacacccuggacaugcagagcagcggcuucgacgcccugcugcacgagauccaggagaucagagagacccaggccagacuggaggagagcuucgagacccugaaggagcacuaccagagagacuacagccugaucaugcagacccugcaggaggagagauacagaugcgagagacuggaggagcagcugaacgaccugaccgagcugcaccagaacgagauccugaaccugaagcaggagcuggccagcauggaggagaagaucgccuaccagagcuacgagagagccagagacauccaggaggcccuggaggccugccagaccagaaucagcaagauggagcugcagcagcagcagcagcagguggugcagcuggagggccuggagaacgccaccgccagaaaccugcugggcaagcugaucaacauccugcuggccgugauggccgugcugcugguguucgugagcaccguggccaacugcguggugccccugaugaagaccagaaacagaaccuucagcacccuguuccuggugguguucaucgccuuccuguggaagcacugggacgcccuguucagcuacguggagagauucuucagcagccccagauaa

SEQ ID NO: 24696 - RNA, 1896 nt, Artificial Sequence
  TMCC2__Homo_sapiens__NP_001229854
auguucggccacggccugaagcaccuguuccacagcagaagaagaagcagagagagagagcaccagaccagccaggacagccagcagcaccagcagcagcagggcaugagcgaccacgacagccccgacgagaaggagagaagccccgagaugcacagagugagcuacgccaugagccugcacgaccugcccgccagacccaccgccuucaacagagugcugcagcagaucagaagcagacccagcaucaagagaggcgccagccugcacagcagcagcggcggcggcagcagcggcagcagcagcagaagaaccaagagcagcagccuggagccccagagaggcagcccccaccugcugagaaaggccccccaggacagcagccuggccgccauccugcaccagcaccagugcagacccagaagcagcagcaccaccgacaccgcccugcugcuggccgacggcagcaacguguaccugcuggccgaggaggccgagggcaucggcgacaagguggacaagggcgaccugguggcccugagccugcccgccggccacggcgacaccgacggccccaucagccuggacgugcccgacggcgcccccgacccccagagaaccaaggccgccaucgaccaccugcaccagaagauccugaagaucaccgagcagaucaagaucgagcaggaggccagagacgacaacguggccgaguaccugaagcuggccaacaacgccgacaagcagcaggugagcagaaucaagcagguguucgagaagaagaaccagaagagcgcccagaccaucgcccagcugcacaagaagcuggagcacuacagaagaagacugaaggagaucgagcagaacggccccagcagacagcccaaggacgugcugagagacaugcagcagggccugaaggacgugggcgccaacgugagagccggcaucagcggcuucggcggcggcgugguggagggcgugaagggcagccugagcggccugagccaggccacccacaccgccguggugagcaagcccagagaguucgccagccugaucagaaacaaguucggcagcgccgacaacaucgcccaccugaaggacccccuggaggacggcccccccgaggaggccgccagagcccugagcggcagcgccacccuggugagcagccccaaguacggcagcgacgacgagugcagcagcgccagcgccagcagcgccggcgccggcagcaacagcggcgccggccccggcggcgcccugggcagccccaagagcaacgcccuguacggcgcccccggcaaccuggacgcccugcuggaggagcugagagagaucaaggagggccagagccaccuggaggacagcauggaggaccugaagacccagcugcagagagacuacaccuacaugacccagugccugcaggaggagagauacagauacgagagacuggaggagcagcugaacgaccugaccgagcugcaccagaacgagaugaccaaccugaagcaggagcuggccagcauggaggagaagguggccuaccagagcuacgagagagccagagacauccaggaggccguggagagcugccugaccagagugaccaagcuggagcugcagcagcagcagcagcagguggugcagcuggagggcguggagaacgccaacgccagagcccugcugggcaaguucaucaacgugauccuggcccugauggccgugcugcugguguucgugagcaccaucgccaacuucaucaccccccugaugaagaccagacugagaaucaccagcaccacccugcuggugcuggugcuguuccugcuguggaagcacugggacagccugaccuaccugcuggagcacgugcugcugcccagcuaa

SEQ ID NO: 24697 - RNA, 1434 nt, Artificial Sequence
  TMCC3__Homo_sapiens__NP_065749
augcccggcagcgacaccgcccugaccguggacagaaccuacagcgaccccggcagacaccacagaugcaagagcagaguggagagacacgacaugaacacccugagccugccccugaacaucagaagaggcggcagcgacaccaaccugaacuucgacgugcccgacggcauccuggacuuccacaaggugaagcugaccgccgacagccugaagcagaagauccugaaggugaccgagcagaucaagaucgagcagaccagcagagacggcaacguggccgaguaccugaagcuggugaacaacgccgacaagcagcaggccggcagaaucaagcagguguucgagaagaagaaccagaagagcgcccacagcaucgcccagcugcagaagaagcuggagcaguaccacagaaagcugagagagaucgagcagaacggcgccagcagaagcagcaaggacaucagcaaggaccaccugaaggacauccacagaagccugaaggacgcccacgugaagagcagaaccgccccccacugcauggagagcagcaagagcggcaugcccggcgugagccugaccccccccguguucguguucaacaagagcagagaguucgccaaccugaucagaaacaaguucggcagcgccgacaacaucgcccaccugaagaacagccuggaggaguucagacccgaggccagcgccagagccuacggcggcagcgccaccaucgugaacaagcccaaguacggcagcgacgacgagugcagcagcggcaccagcggcagcgccgacagcaacggcaaccagagcuucggcgccggcggcgccagcacccuggacagccagggcaagcuggccgugauccuggaggagcugagagagaucaaggacacccaggcccagcuggccgaggacaucgaggcccugaaggugcaguucaagagagaguacggcuucaucagccagacccugcaggaggagagauacagauacgagagacuggaggaccagcugcacgaccugaccgaccugcaccagcacgagaccgccaaccugaagcaggagcuggccagcaucgaggagaagguggccuaccaggccuacgagagaagcagagacauccaggaggcccuggagagcugccagaccagaaucagcaagcuggagcugcaccagcaggagcagcaggcccugcagaccgacaccgugaacgccaaggugcugcugggcagaugcaucaacgugauccuggccuucaugaccgugauccuggugugcgugagcaccaucgccaaguucgugagccccaugaugaagagcagaugccacauccugggcaccuucuucgccgugacccugcuggccaucuucugcaagaacugggaccacauccugugcgccaucgagagaaugaucauccccagauaa

SEQ ID NO: 24698 - RNA, 720 nt, Artificial Sequence
  TMCO1__Homo_sapiens__NP_061899
augcccagaaagagaaagugcgaccugagagccgugagagugggccugcugcugggcggcggcggcguguacggcagcagauucagauucaccuuccccggcugcagagcccugagccccuggagagugagagugcagagaagaagaugcgagaugagcaccauguucgccgacacccugcugaucguguucaucagcgugugcaccgcccugcuggccgagggcaucaccugggugcugguguacagaaccgacaaguacaagagacugaaggccgagguggagaagcagagcaagaagcuggagaagaagaaggagaccaucaccgagagcgccggcagacagcagaagaagaagaucgagagacaggaggagaagcugaagaacaacaacagagaccugagcauggugagaaugaagagcauguucgccaucggcuucugcuucaccgcccugaugggcauguucaacagcaucuucgacggcagagugguggccaagcugcccuucaccccccugagcuacauccagggccugagccacagaaaccugcugggcgacgacaccaccgacugcagcuucaucuuccuguacauccugugcaccaugagcaucagacagaacauccagaagauccugggccuggcccccagcagagccgccaccaagcaggccggcggcuuccugggcccccccccccccagcggcaaguucagcuaa

SEQ ID NO: 24699 - RNA, 1905 nt, Artificial Sequence
  TMCO4__Homo_sapiens__XP_011539488
auggccauguggaacagacccugccagagacugccccagcagccccugguggccgagcccaccgccgagggcgagccccaccugcccaccggcagagagcugaccgaggccaacagauucgccuacgccgcccugugcggcaucagccugagccagcuguuccccgagcccgagcacagcagcuucugcaccgaguucauggccggccuggugcaguggcuggagcugagcgaggccgugcugcccaccaugaccgccuucgccagcggccugggcggcgagggcgccgacguguucgugcagauccugcugaaggaccccauccugaaggacgaccccaccgugaucacccaggaccugcugagcuucagccugaaggacggccacuacgacgccagagccagagugcuggugugccacaugaccagccugcugcaggugccccuggaggagcuggacgugcuggaggagauguuccuggagagccugaaggagaucaaggaggaggagagcgagauggccgaggccagcagaaagaagaaggagaacagaagaaaguggaagagauaccugcugaucggccuggccaccgugggcggcggcaccgugaucggcgugaccggcggccuggccgccccccugguggccgccggcgccgccaccaucaucggcagcgccggcgccgccgcccugggcagcgccgccggcaucgccaucaugaccagccuguucggcgccgccggcgccggccugaccggcuacaagaugaagaagagagugggcgccaucgaggaguucaccuuccugccccugaccgagggcagacagcugcacaucaccaucgccgugaccggcuggcuggccagcggcaaguacagaaccuucagcgcccccugggccgcccuggcccacagcagagagcaguacugccuggccugggaggccaaguaccugauggagcugggcaacgcccuggagaccauccugagcggccuggccaacaugguggcccaggaggcccugaaguacaccgugcugagcggcaucguggccgcccugaccuggcccgccagccugcugagcguggccaacgugaucgacaaccccuggggcgugugccugcacagaagcgccgaggugggcaagcaccuggcccacauccugcugagcagacagcagggcagaagacccgugacccugaucggcuucagccugggcgccagagugaucuacuucugccugcaggagauggcccaggagaaggacugccagggcaucaucgaggacgugauccugcugggcgcccccguggagggcgaggccaagcacugggagcccuucagaaagguggugagcggcagaaucaucaacggcuacugcagaggcgacuggcugcugagcuucguguacagaaccagcagcgugcagcugagaguggccggccugcagcccgugcugcugcaggacagaagaguggagaacguggaccugaccagcguggugagcggccaccuggacuacgccaagcagauggacgccauccugaaggccgugggcaucagaaccaagcccggcugggacgagaagggccugcugcuggcccccggcugccugcccagcgaggagcccagacaggccgccgccgccgccagcagcggcgagaccccccaccaggugggccagacccagggccccaucagcggcgacaccagcaagcuggccaugagcaccgaccccagccaggcccaggugcccgugggccuggaccagagcgagggcgccagccugcccgccgccgccagccccgagagaccccccaucugcagccacggcauggaccccaacccccugggcugccccgacugcgccugcaagacccagggccccagcaccggccuggacuaa

SEQ ID NO: 24700 - RNA, 867 nt, Artificial Sequence
  TMCO5A__Homo_sapiens__XP_005254225
auggagaucagcagacuggcccagagcaagagaaacaucaucagccugaacauggaccuggagagagacacccagagaaucgacgaggccaaccagaagcugcugcugaagauccaggagagagaggacaagauccagagacuggagagcgagaucauccagaccagaggccugguggaggacgaggagugggagaaggagaacagaaccaccauggagagagagagagcccugcaggagcuggaggaggagaccgccagacuggagagaaagaacaagacccuggugcacagcaucaccgagcugcagcagaagcugaccagaaagagccagaagaucaccaacugcgagcagagcagccccgacggcgcccuggaggagaccaaggugaagcugcagcagcuggaggccagcuacgccugccaggagaaggagcugcugaaggugaugaaggaguacgccuucgugacccagcugugcgaggaccaggcccuguacaucaagaaguaccaggagacccugaagaagaucgaggaggagcuggaggcccuguuccuggagagagaggugagcaagcuggugagcaugaaccccguggagaaggagcacaccagccagaacaacgagggcacccccacccagaagaccgccagacuguucagcaagaagaucuucugcugccuguucuucaucacccuguucuucaucagacugcugagcuacauguucuuccacgugagauucaucaaccccgaccugcuggugaacgugcugcccaaggugcugggcagaagcacccuguggaagcugagaugcuucuucuuccccagccugacccuggagaccgaggacaugcugccccacuaa

SEQ ID NO: 24701 - RNA, 660 nt, Artificial Sequence
  TMED10__Homo_sapiens__NP_006818
augagcggccugagcggcccccccgccagaagaggccccuucccccuggcccugcugcugcuguuccugcugggccccagacuggugcuggccaucagcuuccaccugcccaucaacagcagaaagugccugagagaggagauccacaaggaccugcuggugaccggcgccuacgagaucagcgaccagagcggcggcgccggcggccugagaagccaccugaagaucaccgacagcgccggccacauccuguacagcaaggaggacgccaccaagggcaaguucgccuucaccaccgaggacuacgacauguucgaggugugcuucgagagcaagggcaccggcagaauccccgaccagcuggugauccuggacaugaagcacggcguggaggccaagaacuacgaggagaucgccaagguggagaagcugaagccccuggagguggagcugagaagacuggaggaccugagcgagagcaucgugaacgacuucgccuacaugaagaagagagaggaggagaugagagacaccaacgagagcaccaacaccagagugcuguacuucagcaucuucagcauguucugccugaucggccuggccaccuggcagguguucuaccugagaagauucuucaaggccaagaagcugaucgaguaa

SEQ ID NO: 24702 - RNA, 684 nt, Artificial Sequence
  TMED1__Homo_sapiens__NP_006849
augauggccgccggcgccgcccuggcccuggcccuguggcugcugaugccccccguggaggugggcggcgccggccccccccccauccaggacggcgaguucaccuuccugcugcccgccggcagaaagcagugcuucuaccagagcgcccccgccaacgccagccuggagaccgaguaccaggugaucggcggcgccggccuggacguggacuucacccuggagagcccccagggcgugcugcuggugagcgagagcagaaaggccgacggcgugcacaccguggagcccaccgaggccggcgacuacaagcugugcuucgacaacagcuucagcaccaucagcgagaagcugguguucuucgagcugaucuucgacagccugcaggacgacgaggagguggagggcugggccgaggccguggagcccgaggagaugcuggacgugaagauggaggacaucaaggagagcaucgagaccaugagaaccagacuggagagaagcauccagaugcugacccugcugagagccuucgaggccagagacagaaaccugcaggagggcaaccuggagagagugaacuucuggagcgccgugaacguggccgugcugcugcugguggccgugcugcaggugugcacccugaagagauucuuccaggacaagagacccgugcccaccuaa

SEQ ID NO: 24703 - RNA, 606 nt, Artificial Sequence
  TMED2__Homo_sapiens__NP_006806
auggugacccuggccgagcugcuggugcugcuggccgcccugcuggccaccgugagcggcuacuucgugagcaucgacgcccacgccgaggagugcuucuucgagagagugaccagcggcaccaagaugggccugaucuucgagguggccgagggcggcuuccuggacaucgacguggagaucaccggccccgacaacaagggcaucuacaagggcgacagagagagcagcggcaaguacaccuucgccgcccacauggacggcaccuacaaguucugcuucagcaacagaaugagcaccaugacccccaagaucgugauguucaccaucgacaucggcgaggcccccaagggccaggacauggagaccgaggcccaccagaacaagcuggaggagaugaucaacgagcuggccguggccaugaccgccgugaagcacgagcaggaguacauggaggugagagagagaauccacagagccaucaacgacaacaccaacagcagaguggugcuguggagcuucuucgaggcccuggugcugguggccaugacccugggccagaucuacuaccugaagagauucuucgaggugagaagagugguguaa

SEQ ID NO: 24704 - RNA, 468 nt, Artificial Sequence
  TMED3__Homo_sapiens__NP_001288132
augggcagcaccgugcccagaagcgccagcgugcugcugcugcugcugcugcugagaagagccgagcagcccugcggcgccgagcugaccuucgagcugcccgacaacgccaagcagugcuuccacgaggagguggagcagggcgugaaguucagccuggacuaccaggugaucaccggcggccacuacgacguggacugcuacguggaggacccccagggcaacaccaucuacagagagaccaagaagcaguacgacagcuucaccuacagagccgaggugaagggcguguaccaguucugcuucagcaacgaguucagcaccuucagccacaagaccguguacuucgacuuccaggugggcgacgagccccccauccugcccgacaugggcaacagagugaccgcccugacccagggccccagcgccagccccacccccacccccccccugagagugcccguguaa

SEQ ID NO: 24705 - RNA, 684 nt, Artificial Sequence
  TMED4__Homo_sapiens__NP_872353
auggccggcgugggcgccggcccccugagagccaugggcagacaggcccugcugcugcuggcccugugcgccaccggcgcccagggccuguacuuccacaucggcgagaccgagaagagaugcuucaucgaggagauccccgacgagaccauggugaucggcaacuacagaacccagaugugggacaagcagaaggagguguuccugcccagcacccccggccugggcaugcacguggaggugaaggaccccgacggcaagguggugcugagcagacaguacggcagcgagggcagauucaccuucaccagccacacccccggcgaccaccagaucugccugcacagcaacagcaccagaauggcccuguucgccggcggcaagcugagagugcaccuggacauccaggugggcgagcacgccaacaacuaccccgagaucgccgccaaggacaagcugaccgagcugcagcugagagccagacagcugcuggaccagguggagcagauccagaaggagcaggacuaccagagauacagagaggagagauucagacugaccagcgagagcaccaaccagagagugcugugguggagcaucgcccagaccgugauccugauccugaccggcaucuggcagaugagacaccugaagagcuucuucgaggccaagaagcugguguaa

SEQ ID NO: 24706 - RNA, 675 nt, Artificial Sequence
  TMED7__Homo_sapiens__NP_861974
augcccagacccggcagcgcccagagaugggccgccguggccggcagauggggcugcagacugcuggcccugcugcugcuggugcccggccccggcggcgccagcgagaucaccuucgagcugcccgacaacgccaagcagugcuucuacgaggacaucgcccagggcaccaagugcacccuggaguuccaggugaucaccggcggccacuacgacguggacugcagacuggaggaccccgacggcaaggugcuguacaaggagaugaagaagcaguacgacagcuucaccuucaccgccagcaagaacggcaccuacaaguucugcuucagcaacgaguucagcaccuucacccacaagaccguguacuucgacuuccaggugggcgaggaccccccccuguuccccagcgagaacagagugagcgcccugacccagauggagagcgccugcgugagcauccacgaggcccugaagagcgugaucgacuaccagacccacuucagacugagagaggcccagggcagaagcagagccgaggaccugaacaccagaguggccuacuggagcgugggcgaggcccugauccugcugguggugagcaucggccagguguuccugcugaagagcuucuucagcgacaagagaaccaccaccaccagagugggcagcuaa

SEQ ID NO: 24707 - RNA, 1215 nt, Artificial Sequence
  TMED7-TICAM2__Homo_sapiens__NP_001157940
augcccagacccggcagcgcccagagaugggccgccguggccggcagauggggcugcagacugcuggcccugcugcugcuggugcccggccccggcggcgccagcgagaucaccuucgagcugcccgacaacgccaagcagugcuucuacgaggacaucgcccagggcaccaagugcacccuggaguuccaggugaucaccggcggccacuacgacguggacugcagacuggaggaccccgacggcaaggugcuguacaaggagaugaagaagcaguacgacagcuucaccuucaccgccagcaagaacggcaccuacaaguucugcuucagcaacgaguucagcaccuucacccacaagaccguguacuucgacuuccaggugggcgaggaccccccccuguuccccagcgagaacagagugagcgcccugacccagauggagagcgccugcgugagcauccacgaggcccugaagagcgugaucgacuaccagacccacuucagacugagagaggcccagggcagaagcagagccgaggaccugaacaccagaguggccuacuggcacagcguggacaccagccccggcuaccacgagagcgacagcaagaagagcgaggaccugagccugugcaacguggccgagcacagcaacaccaccgagggccccaccggcaagcaggagggcgcccagagcguggaggagauguucgaggaggaggccgaggaggagguguuccugaaguucgugauccugcacgccgaggacgacaccgacgaggcccugagagugcagaaccugcugcaggacgacuucggcaucaagcccggcaucaucuucgccgagaugcccugcggcagacagcaccugcagaaccuggacgacgccgugaacggcagcgccuggaccauccugcugcugaccgagaacuuccugagagacaccuggugcaacuuccaguucuacaccagccugaugaacagcgugaacagacagcacaaguacaacagcgugauccccaugagaccccugaacaacccccugcccagagagagaacccccuucgcccugcagaccaucaacgcccuggaggaggagagcagaggcuuccccacccagguggagagaaucuuccaggagagcguguacaagacccagcagaccaucuggaaggagaccagaaacauggugcagagacaguucaucgccuaa

SEQ ID NO: 24708 - RNA, 708 nt, Artificial Sequence
  TMED9__Homo_sapiens__NP_059980
auggccguggagcugggcgugcugcuggugagacccagacccggcaccggccugggcagagugaugagaacccugcugcuggugcuguggcuggccaccagaggcagcgcccuguacuuccacaucggcgagaccgagaagaagugcuucaucgaggagauccccgacgagaccauggugaucggcaacuacagaacccagcuguacgacaagcagagagaggaguaccagcccgccacccccggccugggcauguucguggaggugaaggaccccgaggacaaggugauccuggccagacaguacggcagcgagggcagauucaccuucaccagccacacccccggcgagcaccagaucugccugcacagcaacagcaccaaguucagccuguucgccggcggcaugcugagagugcaccuggacauccaggugggcgagcacgccaacgacuacgccgagaucgccgccaaggacaagcugagcgagcugcagcugagagugagacagcugguggagcagguggagcagauccagaaggagcagaacuaccagagauggagagaggagagauucagacagaccagcgagagcaccaaccagagagugcugugguggagcauccugcagacccugauccugguggccaucggcguguggcagaugagacaccugaagagcuucuucgaggccaagaagcugguguaa

SEQ ID NO: 24709 - RNA, 1143 nt, Artificial Sequence
  TMEFF1__Homo_sapiens__NP_003683
augggcgccgccgccgccgaggccccccugagacugcccgccgcccccccccuggccuucugcugcuacaccagcgugcugcugcuguucgccuucagccugcccggcagcagagccagcaaccagccccccggcggcggcggcggcagcggcggcgacugccccggcggcaagggcaagagcaucaacugcagcgagcugaacgugagagagagcgacgugagagugugcgacgagagcagcugcaaguacggcggcgugugcaaggaggacggcgacggccugaagugcgccugccaguuccagugccacaccaacuacauccccgugugcggcagcaacggcgacaccuaccagaacgagugcuuccugagaagagccgccugcaagcaccagaaggagaucaccgugaucgccagaggccccugcuacagcgacaacggcagcggcagcggcgagggcgaggaggagggcagcggcgccgaggugcacagaaagcacagcaagugcggccccugcaaguacaaggccgagugcgacgaggacgccgagaacgugggcugcgugugcaacaucgacugcagcggcuacagcuucaaccccgugugcgccagcgacggcagcagcuacaacaaccccugcuucgugagagaggccagcugcaucaagcaggagcagaucgacaucagacaccugggccacugcaccgacaccgacgacaccagccugcugggcaagaaggacgacggccugcaguacagacccgacgugaaggacgccagcgaccagagagaggacguguacaucggcaaccacaugcccugccccgagaaccugaacggcuacugcauccacggcaagugcgaguucaucuacagcacccagaaggccagcugcagaugcgagagcggcuacaccggccagcacugcgagaagaccgacuucagcauccuguacguggugcccagcagacagaagcugacccacgugcugaucgccgccaucaucggcgccgugcagaucgccaucaucguggccaucgugaugugcaucaccagaaagugccccaagaacaacagaggcagaagacagaagcagaaccugggccacuucaccagcgacaccagcagcagaaugguguaa

SEQ ID NO: 24710 - RNA, 1125 nt, Artificial Sequence
  TMEFF2__Homo_sapiens__NP_057276
auggugcugugggagagccccagacagugcagcagcuggacccugugcgagggcuucugcuggcugcugcugcugcccgugaugcugcugaucguggccagacccgugaagcuggccgccuuccccaccagccugagcgacugccagacccccaccggcuggaacugcagcggcuacgacgacagagagaacgaccuguuccugugcgacaccaacaccugcaaguucgacggcgagugccugagaaucggcgacaccgugaccugcgugugccaguucaagugcaacaacgacuacgugcccgugugcggcagcaacggcgagagcuaccagaacgagugcuaccugagacaggccgccugcaagcagcagagcgagauccugguggugagcgagggcagcugcgccaccgacgccggcagcggcagcggcgacggcgugcacgagggcagcggcgagaccagccagaaggagaccagcaccugcgacaucugccaguucggcgccgagugcgacgaggacgccgaggacguguggugcgugugcaacaucgacugcagccagaccaacuucaacccccugugcgccagcgacggcaagagcuacgacaacgccugccagaucaaggaggccagcugccagaagcaggagaagaucgaggugaugagccugggcagaugccaggacaacaccaccaccaccaccaagagcgaggacggccacuacgccagaaccgacuacgccgagaacgccaacaagcuggaggagagcgccagagagcaccacauccccugccccgagcacuacaacggcuucugcaugcacggcaagugcgagcacagcaucaacaugcaggagcccagcugcagaugcgacgccggcuacaccggccagcacugcgagaagaaggacuacagcgugcuguacguggugcccggccccgugagauuccaguacgugcugaucgccgccgugaucggcaccauccagaucgccgugaucugcgugguggugcugugcaucaccagaaagugccccagaagcaacagaauccacagacagaagcagaacaccggccacuacagcagcgacaacaccaccagagccagcaccagacugaucuaa

SEQ ID NO: 24711 - RNA, 405 nt, Artificial Sequence
  TMEM100__Homo_sapiens__NP_060756
augaccgaggagcccaucaaggagauccugggcgcccccaaggcccacauggccgccaccauggagaagagccccaagagcgagguggugaucaccaccgugccccuggugagcgagauccagcugauggccgccaccggcggcaccgagcugagcugcuacagaugcaucauccccuucgccguggugguguucaucgccggcaucguggugaccgccguggccuacagcuucaacagccacggcagcaucaucagcaucuucggccugguggugcugagcagcggccuguuccugcuggccagcagcgcccugugcuggaaggugagacagagaagcaagaaggccaagagaagagagagccagaccgcccugguggccaaccagagaagccuguucgccuaa

SEQ ID NO: 24712 - RNA, 774 nt, Artificial Sequence
  TMEM101__Homo_sapiens__XP_011523653
auggccagcaagaucggcagcagaagauggaugcugcagcugaucaugcagcugggcagcgugcugcugaccagaugccccuucuggggcugcuucagccagcugaugcuguacgccgagagagccgaggccagaagaaagcccgacauccccgugcccuaccuguacuucgacaugggcgccgccgugcugugcgccagcuucaugagcuucggcgugaagagaagaugguucgcccugggcgccgcccugcagcuggccaucagcaccuacgccgccuacaucggcggcuacgugcacuacggcgacuggcugaaggugagaauguacagcagaaccguggccaucaucggcggcuuccuggugcuggccagcggcgccggcgagcuguacagaagaaagcccagaagcagaagccugcagagcaccggccagguguuccugggcaucuaccugaucugcguggccuacagccugcagcacagcaaggaggacagacuggccuaccugaaccaccugcccggcggcgagcugaugauccagcuguucuucgugcuguacggcauccuggcccuggccuuccugagcggcuacuacgugacccuggccgcccagauccuggccgugcugcugccccccgugaugcugcugaucgacggcaacguggccuacuggcacaacaccagaagaguggaguucuggaaccagaugaagcugcugggcgagagcgugggcaucuucggcaccgccgugauccuggccaccgacggcuaa

SEQ ID NO: 24713 - RNA, 390 nt, Artificial Sequence
  TMEM105__Homo_sapiens__NP_848615
augcugcugaaggugagaagagccagccugaagccccccgccaccccccaccagggcgccuucagagccggcaacgugaucggccagcugaucuaccugcugaccuggagccuguucaccgccuggcugagaccccccacccugcugcagggccccagaaccagcccccagggcagcccccccagaagccccuggggcgacugcgccgagcccagcugccugugcgagaugaagaucagaagaagaagacacgagggccccgccuggggccagagcggcuuccuggccggcggccugcaccuggugcccagcagccugagccuggccgccugcggcguggugagaaugaagggccuguggggcagaggcgccggcaucagaggcagauaa

SEQ ID NO: 24714 - RNA, 825 nt, Artificial Sequence
  TMEM106B__Homo_sapiens__XP_005249846
augggcaagagccugagccaccugccccugcacagcagcaaggaggacgccuacgacggcgugaccagcgagaacaugagaaacggccuggugaacagcgaggugcacaacgaggacggcagaaacggcgacgugagccaguuccccuacguggaguucaccggcagagacagcgugaccugccccaccugccagggcaccggcagaauccccagaggccaggagaaccagcugguggcccugauccccuacagcgaccagagacugagacccagaagaaccaagcuguacgugauggccagcguguucgugugccugcugcugagcggccuggccguguucuuccuguuccccagaagcaucgacgugaaguacaucggcgugaagagcgccuacgugagcuacgacgugcagaagagaaccaucuaccugaacaucaccaacacccugaacaucaccaacaacaacuacuacagcguggagguggagaacaucaccgcccaggugcaguucagcaagaccgugaucggcaaggccagacugaacaacaucaccaucaucggcccccuggacaugaagcagaucgacuacaccgugcccaccgugaucgccgaggagaugagcuacauguacgacuucugcacccugaucagcaucaaggugcacaacaucgugcugaugaugcaggugaccgugaccaccaccuacuucggccacagcgagcagaucagccaggagagauaccaguacguggacugcggcagaaacaccaccuaccagcugggccagagcgaguaccugaacgugcugcagccccagcaguaa

SEQ ID NO: 24715 - RNA, 318 nt, Artificial Sequence
  TMEM108__Homo_sapiens__NP_001269794
augaagagaagccugcaggcccuguacugccagcugcugaccgugcugcugaccgugugcugcaugaagagaaagaagaagaccgccaaccccgagaacaaccugagcuacuggaacaacaccaucaccauggacuacuucaacagacacgccguggagcugcccagagagauccagagccuggagaccagcgaggaccagcugagcgagcccagaagccccgccaacggcgacuacagagacaccggcauggugcuggugaaccccuucugccaggagacccuguucgugggcaacgaccaggugagcgagaucuaa

SEQ ID NO: 24716 - RNA, 429 nt, Artificial Sequence
  TMEM114__Homo_sapiens__NP_001277026
augaaccccuucagacuggagaacgugaccgugagcgagagcagcagacagcugcugaccaugcacggcaccuucgugauccugcugccccugagccugauccugaugguguucggcggcaugaccggcuuccugagcuuccugcugcaggccuaccugcugcugcugcugaccggcauccuguuccuguucggcgccauggugacccuggccggcaucagcguguacaucgccuacagcgccgccgccuucagagaggcccugugccugcuggaggagaaggcccugcuggaccagguggacaucagcuucggcuggagccuggcccugggcuggaucagcuucaucgccgagcugcugaccggcgccgccuuccuggccgccgccagagagcugagccugagaagaagacaggaccaggccaucuaa

SEQ ID NO: 24717 - RNA, 1056 nt, Artificial Sequence
  TMEM115__Homo_sapiens__NP_008955
augcagagagcccugcccggcgccagacagcaccugggcgccauccuggccagcgccagcgugguggugaaggcccugugcgccgccgugcuguuccuguaccugcugagcuucgccguggacaccggcugccuggccgugacccccggcuaccuguucccccccaacuucuggaucuggacccuggccacccacggccugauggagcagcacgugugggacguggccaucagccugaccaccguggugguggccggcagacugcuggagccccuguggggcgcccuggagcugcugaucuucuucagcguggugaacgugagcgugggccugcugggcgccuucgccuaccugcugaccuacauggccagcuucaaccugguguaccuguucaccgugagaauccacggcgcccugggcuuccugggcggcgugcugguggcccugaagcagaccaugggcgacugcguggugcugagagugccccaggugagagugagcgugaugcccaugcugcugcuggcccugcugcugcugcugagacuggccacccugcugcagagccccgcccuggccagcuacggcuucggccugcugagcagcuggguguaccugagauucuaccagagacacagcagaggcagaggcgacauggccgaccacuucgccuucgccaccuucuuccccgagauccugcagcccguggugggccugcuggccaaccuggugcacagccugcuggugaaggugaagaucugccagaagaccgugaagagauacgacgugggcgcccccagcagcaucaccaucagccugcccggcaccgacccccaggacgccgagagaagaagacagcuggcccugaaggcccugaacgagagacugaagagaguggaggaccagagcaucuggcccagcauggacgacgacgaggaggagagcggcgccaagguggacagcccccugcccagcgacaaggcccccaccccccccggcaagggcgccgcccccgagagcagccugaucaccuucgaggccgccccccccacccuguaa

SEQ ID NO: 24718 - RNA, 1233 nt, Artificial Sequence
  TMEM117__Homo_sapiens__NP_001273141
auggccaccugccacagccacagaaccaacagcuggcagaucagcgugcccagcgccuucguguggagcguggcccccaucaagaacgugagcagaagaagcugggugguggacgacaacgugcugcagcacaacagccugagccugcacaucuucagccacauccagcacgacagcagcaacggcugggagcacggcgugaccgacaugaugcugcaggacaagcccuaccccgacuggggcaagagcgccagagccuucuggaagaagggcaacgugagaaucacccuguucuggaccgugcuguucacccugaccagcgugguggugcuggugaucaccaccgacuggaucagcugggacaagcugaacagaggcuuccugcccagcgacgaggugagcagagccuuccuggccagcuucauccugguguucgaccugcugaucgugaugcaggacugggaguucccccacuucaugggcgacguggacgugaaccugcccggccugcacaccccccacaugcaguucaagauccccuucuuccagaagaucuucaaggaggaguacagaauccacaucaccggcaagugguucaacuacggcaucaucuuccuggugcugauccuggaccugaacauguggaagaaccagaucuucuacaagccccacgaguacggccaguacaucggccccggccagaagaucuacaccgugaaggacagcgagagccugaaggaccugaacagaaccaagcugagcugggaguggagaagcaaccacaccaaccccagaaccaacaagaccuacguggagggcgacauguuccugcacagcagauucaucggcgccagccuggacgugaagugccuggccuucgugcccagccugaucgccuucgugugguucggcuucuucaucugguucuucggcagauuccugaagaacgagcccagaauggagaaccaggacaagaccuacaccagaaugaagagaaagagccccagcgagcacagcaaggacaugggcaucaccagagagaacacccaggccagcguggaggacccccugaacgaccccagccuggugugcaucagaagcgacuucaacgagaucguguacaagagcagccaccugaccagcgagaaccugagcagccagcugaacgagagcaccagcgccaccgaggccgaccaggaccccaccaccagcaagagcacccccaccaacuaa

SEQ ID NO: 24719 - RNA, 579 nt, Artificial Sequence
  TMEM11__Homo_sapiens__NP_003867
auggccgccuggggcagaagaagacugggccccggcagcagcggcggcagcgccagagagagagugagccugagcgccaccgacugcuacaucgugcacgagaucuacaacggcgagaacgcccaggaccaguucgaguacgagcuggagcaggcccuggaggcccaguacaaguacaucgugaucgagcccaccagaaucggcgacgagaccgccagauggaucaccgugggcaacugccugcacaagaccgccgugcuggccggcaccgccugccuguucaccccccuggcccugccccuggacuacagccacuacaucagccugcccgccggcgugcugagccuggccugcugcacccuguacggcaucagcuggcaguucgaccccugcugcaaguaccagguggaguacgacgccuacaagcugagcagacugccccugcacacccugaccagcagcacccccguggugcuggugagaaaggacgaccugcacagaaagagacugcacaacaccaucgcccuggccgcccugguguacugcgugaagaagaucuacgagcuguacgccguguaa

SEQ ID NO: 24720 - RNA, 378 nt, Artificial Sequence
  TMEM126A__Homo_sapiens__NP_001231664
auggccggcauccccuuccugaccaccgaccugaccuacagaugcuucgugagcuucccccugaacaccggcgaccuggacugcgagaccugcaccaucaccagaagcggccugaccggccuggugaucggcggccuguaccccguguuccuggccauccccgugaacggcggccuggccgccagauaccagagcgcccugcugccccacaagggcaacauccugagcuacuggaucagaaccagcaagcccguguucagaaagaugcuguuccccauccugcugcagaccauguucagcgccuaccugggcagcgagcaguacaagcugcugaucaaggcccugcagcugagcgagcccggcaaggagauccacuaa

SEQ ID NO: 24721 - RNA, 717 nt, Artificial Sequence
  TMEM127__Homo_sapiens__NP_001180233
auguacgcccccggcggcgccggccugcccggcggcagaagaagaagaagccccggcggcagcgcccugcccaagcagcccgagagaagccuggccagcgcccugcccggcgcccugagcaucaccgcccugugcaccgcccuggccgagcccgccuggcugcacauccacggcggcaccugcagcagacaggagcugggcgugagcgacgugcugggcuacgugcaccccgaccugcugaaggacuucugcaugaacccccagaccgugcugcugcugagagugaucgccgccuucugcuuccugggcauccugugcagccugagcgccuuccugcuggacguguucggccccaagcaccccgcccugaagaucaccagaagauacgccuucgcccacauccugaccgugcugcagugcgccaccgugaucggcuucagcuacugggccagcgagcugauccuggcccagcagcagcagcacaagaaguaccacggcagccagguguacgugaccuucgccgugagcuucuaccugguggccggcgccggcggcgccagcauccuggccaccgccgccaaccugcugagacacuaccccaccgaggaggaggagcaggcccuggagcugcugagcgagauggaggagaacgagcccuaccccgccgaguacgaggugaucaaccaguuccagcccccccccgccuacacccccuaa

SEQ ID NO: 24722 - RNA, 498 nt, Artificial Sequence
  TMEM128__Homo_sapiens__NP_001284480
auggacagcagcagagccagacagcagcugagaagaagauuccugcugcugcccgacgccgaggcccagcuggacagagagggcgacgccggccccgagaccagcaccgccguggagaagaaggagaagccccugcccagacugaacauccacagcggcuucuggauccuggccagcaucguggugaccuacuacguggacuucuucaagacccugaaggagaacuuccacaccagcagcugguuccugugcggcagcgcccugcugcuggugagccugagcaucgccuucuacugcaucguguaccuggagugguacugcggcaucggcgaguacgacgugaaguaccccgcccugauccccaucaccaccgccagcuucaucgccgccggcaucugcuucaacaucgcccuguggcacguguggagcuucuucaccccccugcugcuguucacccaguucaugggcguggugauguucaucacccugcugggcuaa

SEQ ID NO: 24723 - RNA, 3075 nt, Artificial Sequence
  TMEM132A__Homo_sapiens__NP_060340
augugcgccagaauggccggcagaaccaccgccgcccccagaggccccuacggccccuggcugugccugcugguggcccuggcccuggacguggugagaguggacugcggccaggccccccuggaccccguguaccugcccgccgcccuggagcugcuggacgcccccgagcacuucagagugcagcaggugggccacuacccccccgccaacagcagccugagcagcagaagcgagaccuuccugcugcugcagcccuggcccagagcccagccccugcugagagccagcuacccccccuucgccacccagcagguggugccccccagagugaccgagccccaccagagacccgugcccugggacgugagagccgugagcguggaggccgccgugacccccgccgagcccuacgccagagugcuguuccaccugaagggccaggacuggccccccggcagcggcagccugcccugcgccagacugcacgccacccaccccgccggcaccgcccaccaggccugcagauuccagcccagccugggcgccugcgugguggagcuggagcugcccagccacugguucagccaggccagcaccaccagagccgagcuggccuacacccuggagcccgccgccgagggccccggcggcugcggcagcggcgaggagaacgaccccggcgagcaggcccugcccgugggcggcguggagcugagacccgccgaccccccccaguaccaggaggugccccuggacgaggccgugacccugagagugcccgacaugcccgugagacccggccagcuguucagcgccacccugcugcugagacacaacuucaccgccagccugcugacccugagaaucaaggugaagaagggccugcacgugaccgccgccagacccgcccagcccacccuguggaccgccaagcuggacagauucaagggcagcagacaccacaccacccugaucaccugccacagagccggccugaccgagcccgacagcagcagcccccuggagcugagcgaguuccuguggguggacuucgugguggagaacagcaccggcggcggcguggccgugaccagacccgugaccuggcagcuggaguaccccggccaggcccccgaggccgagaaggacaagauggugugggagauccuggugagcgagagagacaucagagcccugaucccccuggccaaggccgaggagcuggugaacaccgccccccugaccggcgugccccagcacgugcccgugagacuggugaccguggacggcggcggcgcccugguggaggugaccgagcacgugggcugcgagagcgccaacacccaggugcugcaggugagcgaggccugcgacgccguguucguggccggcaaggagagcagaggcgccagaggcgugagaguggacuucugguggagaagacugagagccagccugagacugaccgugugggccccccugcugccccugagaaucgagcugaccgacaccacccuggagcaggugagaggcuggagagugcccggccccgccgagggccccgccgagcccgccgccgaggccagcgacgaggccgagagaagagccagaggcugccaccugcaguaccagagagccggcgugagauuccuggcccccuucgccgcccacccccuggacggcggcagaagacugacccaccugcugggccccgacuggcugcuggacgugagccaccugguggccccccacgccagagugcuggacagcagaguggccagccuggagggcggcagagugguggugggcagagagcccggcgugaccagcaucgaggugagaagcccccugagcgacagcauccugggcgagcaggcccuggccgugaccgacgacaaggugagcgugcuggagcugagagugcagcccgugaugggcaucagccugacccugagcagaggcaccgcccaccccggcgaggugaccgccaccugcugggcccagagcgcccugcccgcccccaagcaggagguggcccugagccuguggcugagcuucagcgaccacaccguggcccccgccgagcuguacgacagaagagaccugggccugagcgugagcgccgaggagcccggcgccauccugcccgccgaggagcagggcgcccagcugggcgugguggugagcggcgccggcgccgagggccugccccugcacguggcccugcacccccccgagcccugcagaagaggcagacacagagugccccuggccagcggcaccgccuggcugggccugccccccgccagcacccccgcccccgcccugcccagcagccccgccuggagcccccccgccaccgaggccaccaugggcggcaagagacagguggccggcagcgugggcggcaacaccggcgugagaggcaaguucgagagagccgaggaggaggccagaaaggaggagaccgaggccagagaggaggaggaggaggaggaggaggagauggugcccgccccccagcacgugaccgagcuggagcugggcauguacgcccugcugggcguguucugcguggccaucuucaucuuccuggugaacggcgugguguucgugcugagauaccagagaaaggagccccccgacagcgccaccgaccccaccagcccccagccccacaacuggguguggcugggcaccgaccaggaggagcugagcagacagcuggacagacagagccccggcccccccaagggcgagggcagcugccccugcgagagcggcggcggcggcgaggcccccacccuggcccccggcccccccggcggcaccaccagcagcagcagcacccuggccagaaaggaggccggcggcagaagaaagagaguggaguucgugaccuucgcccccgccccccccgcccagagccccgaggagcccgugggcgcccccgccgugcagagcauccugguggccggcgaggaggacaucagaugggugugcgaggacaugggccugaaggaccccgaggagcugagaaacuacauggagagaaucagaggcagcagcuaa

SEQ ID NO: 24724 - RNA, 3237 nt, Artificial Sequence
  TMEM132B__Homo_sapiens__NP_443139
auguucggcgccgccagcagaauggacaccaccgccgugugcaccggcggcgugaccgagagcagaggcaucguggacagccugcagaaguucagcagccugcccgccuaccugcccaccaaccugcacaucagcaacgccgaggagagcuucuuccugaaggaggccaaccaggaccugaccagaaacagcagccugcaggccagaguggagcccuucuucaucuacagagccagaaccccccccaucaucaacgccagcuacggccccuucagcguggagaagaucaucccccaggagcugcugcugaccagcaccgccuucggcaacauggacaaguuccccuucaacuggaagcugaagagccacauccuggacagcagcaucuacagcaacagacccaaggugcagacccuguucuacgugaccggcaugggcugggacgacagcgaccugaccgaggaccugcccugcgugaagauguucgccuuccccgaggccagagagguggccgccagcugcagacugcagggcgcccccggccugugcguggccgagcuggagcugcugcccgagugguucagcagcggccuggaccuggagcccgaggaggagauccccgcccugcugggcggcaccaccauggagcuguucuucacccuguaccccgccgacaaggccggccagugcccccuggaggaggagggcaagugggagaacaacauccacagcggccuggagagcccccagcaggccuuccccgccagagagagaaucggcagcguggugguguaccccacccaggacgaccugaaguggagccuggugagccuggacgagaacguggugaucagcgugccccugaaccuggugagagagggcgacaccgccaccuuccuggugagccugaccagcagcagcguggccgaccaguucacccugagaaucaaggccgccgccggcgugaagaucaccgccgugagagugagcagcgaggaccagugggccgugcaggaggagaucgacaacggcagcacccagaccagcgccacccugaccugcaugggccacagacccgacacccagagcagagugaacggcagcuucuacgagauccugcagguggacuucggcaucgacaacagcagcgaccuggccggcgcccagcagaucaccuggcagguggaguaccccaucgaggacagcaugagcgagcugguggugagcgagaucuucgugagccagaccaccuucgugggcaucgugccccuggccauggacaccgaggugcugaacaccgccauccugaccggcaagcccgugagcgugcccgugaagguggugggcgugcaggaggacggcagcgugguggacgugagcgagagcguggagugcaagagcgccgacgaggacgugaucaaggugagcaacaacugcgacagcaucuucgugaacggcaaggagaugaagagcaagguggacaccaucgugaacuucacccaccagcacuucaccagccaguucgaggugaccgugugggcccccagacugccccugcagaucgagaucagcgacaccgagcugagccagaucaagggcuggagaauccccguggccgccaacagaagacccaccagagagagcgacgacgaggacgacgaggagaagaagggcagaggcugcagccugcaguaccagcacgccaccgugagagugcugacccaguucguggccgagagccccgaccugggccagcugaccuacaugcugggccccgacuggcaguucgacaucaccgaccuggugaccgaguucaugaagguggaggagcccaagaucgcccagcugcaggacggcagaacccuggccggcagagagcccggcaucaccaccgugcaggugcugagcccccugagcgacagcauccuggccgagaagaccgugaucgugcuggacgacagagugaccaucgccgagcugggcgugcagcugguggccggcaugagccugagccugcagccccacagagccgacaagagagccaucgugagcaccgccgccgcccuggacgugcugcagagcccccagcaggaggccaucgugagcagcuggauccuguucagcgacggcagcgugaccccccuggacaucuacgaccccaaggacuacagcgugaccgugagcagccuggacgagaugguggugagcgugcaggccaaccuggagagcaaguggcccaucgugguggccgagggcgagggccagggcccccugaucaagcuggagaugaugaucagcgagcccugccagaagaccaagagaaagagcgugcuggccgugggcaagggcaacgugaaggugaaguucgagcccagcagcgacgagcaccagggcggcagcaacgacaucgagggcaucaacagagaguacaaggaccaccugagcaacagcaucgagagagagggcaaccaggagagagccgugcaggagugguuccacagaggcacccccgugggccaggaggagagcaccaacaagagcaccaccccccagagccccauggagggcaagaacaagcugcugaagagcggcggccccgacgccuucaccagcuuccccacccagggcaagagccccgaccccaacaaccccagcgaccugaccgugaccagcagaggccugaccgaccuggagaucggcauguacgcccugcugugcguguucugccuggccauccugguguuccugaucaacugcguggccuucgccuggaaguacagacacaagagauucgccgugagcgagcagggcaacaucccccacagccacgacuggguguggcugggcaacgagguggagcugcuggagaaccccguggacaucacccugcccagcgaggagugcaccaccaugaucgacagaggccugcaguucgaggagagaaacuuccugcugaacggcagcagccagaagaccuuccacagccagcugcugagacccagcgacuacguguacgagaaggagaucaagaacgagcccaugaacagcagcggccccaagagaaagagagugaaguucaccagcuacaccaccauccugcccgaggacggcggccccuacaccaacagcauccuguucgacagcgacgacaacaucaagugggugugccaggacaugggccugggcgacagccaggacuucagagacuacauggagagccugcaggaccagauguaa

SEQ ID NO: 24725 - RNA, 3327 nt, Artificial Sequence
  TMEM132C__Homo_sapiens__NP_001129575
augagaagcgagggcgccgcccccggccccgccgccccccugugcggcgcccugagccugcugcugggcgcccugcugggcaaggugaucgagggccacggcgugaccgacaacauccagagauucagcagccugccccccuaccugcccgugagcuaccacauccugagagccgagaccagcuucuuccugaaggaggccaaccaggaccugcugagaaacagcagccugcaggccagaguggagagcuucuucaccuacaagaccagacagccccccgugcugaacgccagcuacggccccuucagcguggagaagguggugccccuggaccugaugcugaccagcaacuuccugggccccaccaacaaguucagcuucgacuggaagcugaaggcccacauccugagagacaagguguaccugagcagacccaaggugcaggugcuguuccacaucaugggcagagacugggacgaccacggcgccggcgagaagcugcccugccugagaguguucgccuucagagagaccagagaggugagaggcagcugcagacugaagggcgaccugggccugugcguggccgagcuggagcugcugagcagcugguucagcgcccccaccgugggcgccggcagaaagaagagcauggaccagcccgagggcacccccguggagcuguacuacaccgugcaccccggcaacgagagaggcgacugcgccggcggcgacuucagaaagggcaacgccaucagacccggcaaggacggccuggaggagaccaccagccaccugcagagaaucggcaccgugggccuguacagagcccaggacagcgcccagcugagcgagcugagacuggacggcaacguggugaucuggcugcccagcagacccgugaagcagggcgagguggugaccgccuacgugaccaucagcagcaacagcagcguggaccuguucauccugagagccaaggugaagaagggcgugaacauccugagcgcccagaccagagagcccagacaguggggcgugaagcaggaggugggcagcggcggcaagcacgugaccgccaccguggccugccagagacugggccccagccccagaaacagaagcagcagccuguucaacgagguggugcagaugaacuucgagaucgccagcuucagcagccugagcggcacccagcccaucaccuggcagguggaguaccccagaaagggcaccaccgacaucgccgugagcgagaucuucgugagccagaaggaccuggugggcaucgugccccuggccauggacaccgagauccugaacaccgccgugcugaccggcaagaccguggccaugcccaucaagguggugagcguggaggagaacagcgccgugauggacaucagcgagagcguggagugcaagagcaccgacgaggacgugaucaaggugagcgagagaugcgacuacaucuucgugaacggcaaggagaucaagggcaagauggacgccguggugaacuucaccuaccaguaccugagcgccccccugugcgugaccgugugggugcccagacugccccugcagaucgaggugagcgacaccgagcugagccagaucaagggcuggagagugcccaucgugaccaacaagagacccaccagagagagcgaggacgaggacgaggaggagagaagaggcagaggcugcgcccugcaguaccagcacgccaccgugagagugcugacccaguucgugagcgagggcgccggccccuggggccagcccaacuaccugcugagccccaacuggcaguucgacaucacccaccugguggccgacuucaugaagcuggaggagccccacguggccacccugcaggacagcagagugcuggugggcagagaggugggcaugaccaccauccaggugcugagcccccugagcgacagcauccuggccgagaagaccaucaccgugcuggacgacaaggugagcgugaccgaccuggccauccagcugguggccggccugagcguggcccuguaccccaacgccgagaacagcaaggccgugaccgccguggugaccgccgaggaggugcugagaacccccaagcaggaggccguguucagcaccuggcugcaguucagcgacggcagcgugaccccccuggacaucuacgacaccaaggacuucagccuggccgccaccagccaggacgaggccguggugagcgugccccagcccagaagccccagauggcccguggugguggccgagggcgagggccagggcccccugaucagaguggacaugaccaucgccgaggccugccagaagagcaagagaaagagcauccuggccgugggcgugggcaacgugagagugaaguucggccagaacgacgccgacagcagccccggcggcgacuacgaggaggacgagaucaagaaccacgccagcgacagaagacagaagggccagcaccacgagagaaccggccaggacggccaccuguacggcagcagccccguggagagagaggagggcgcccugagaagagccaccaccaccgccagaagccugcuggacaacaagguggugaagaacagcagagccgacggcggcagacuggccggcgagggccagcugcagaacauccccaucgacuucaccaacuuccccgcccacguggaccugcccaaggccggcagcggccuggaggagaacgaccuggugcagacccccagaggccugagcgaccuggagaucggcauguacgcccugcugggcguguucugccuggccauccugguguuccugaucaacugcgccaccuucgcccugaaguacagacacaagcaggugccccuggagggccaggccagcaugacccacagccacgacuggguguggcugggcaacgaggccgagcugcuggagagcaugggcgacgccccccccccccaggacgagcacaccaccaucaucgacagaggccccggcgccugcgaggagagcaaccaccugcugcugaacggcggcagccacaagcacgugcagagccagauccacagaagcgccgacagcggcggcagacagggcagagagcagaagcaggacccccugcacagccccaccagcaagagaaagaaggugaaguucaccaccuucaccaccaucccccccgacgacagcugccccaccgugaacagcaucgugagcagcaacgacgaggacaucaagugggugugccaggacguggccgugggcgcccccaaggagcugagaaacuaccuggagaagcugaaggacaaggccuaa

SEQ ID NO: 24726 - RNA, 3300 nt, Artificial Sequence
  TMEM132D__Homo_sapiens__NP_597705
augugccccagcgagaugggcacccuguggcaccacuggagccccgugcugaucagccuggccgcccuguucagcaaggugaccgagggcagaggcauccuggagagcauccagagauucagccugcugcccaccuaccugcccgugaccuaccacaucaacaacgccgacgugagcuucuuccugaaggaggccaaccaggacaucaugagaaacagcagccugcagagcagaguggagagcuuccugaucuacaagagcagaagacugcccgugcugaacgccagcuacggccccuucagcaucgagcagguggugccccaggaccugaugcugcccagcaaccccuucggcuucaccaacaaguucagccugaacuggaagcugaaggcccacauccugagagacaagguguaccugagcagacccaaggugcaggugcuguuccacaucaugggcagagacugggacgacagaagcgccggcgagaagcugcccugccugagaguguucgccuucagagagaccagagaggugagaggcagcugcagacugcagggcgaccugggccugugcguggccgagcuggagcugcugagcagcugguucagcccccccaccgugguggccggcagaagaaagagcguggaccagcccgagggcacccccguggagcuguacuacaccgugcaccccggcggcgagagaggcgacugcgugagagaggacgccagaagaagcaacggcaucagaaccggccacagcgacaucgacgagagcggccccccccugcagagaaucggcagcaucuuccuguaccagacccacagaaagcccagccugagagagcugagacuggacaacagcguggccauccacuacauccccaagaccgugagaaagggcgacgugcugaccuuccccgugagcaucagcagaaacagcaccgaggacagauucacccugagagccaaggugaagaagggcgugaacaucaucggcgugagagccagcagccccagcaucugggacgugaaggagagaaccgacuacaccggcaaguacgcccccgccgugaucgugugccagaagaaggccgccggcagcgagaacagcgccgacggcgccagcuacgaggugaugcagaucgacguggagguggaggagcccggcgaccugcccgccacccagcuggugaccuggcagguggaguaccccggcgagaucaccagcgaccugggcgugagcaagaucuacgugagccccaaggaccugaucggcguggugccccuggccauggaggccgagauccugaacaccgccauccugaccggcaagaccguggccgugcccgugaagguggugagcguggaggacgacggcaccgugaccgagcugcuggagagcguggagugcagaagcagcgacgaggacgugaucaaggugagcgacagaugcgacuacguguucgugaacggcaaggagaugaagggcaaggugaacgugguggugaacuucaccuaccagcaccugagcagcccccuggagaugaccgugugggugcccagacugccccugcagaucgaggugagcgacaccgagcugaaccagaucaagggcuggagagugcccaucgugagcagcagaagacccgccggcgacagcgaggaggaggaggacgacgagagaagaggcagaggcugcacccugcaguaccagcacgccauggugagagugcugacccaguucguggccgaggccgccggccccggcggccaccuggcccaccugcugggcagcgacuggcagguggacaucaccgagcugaucaacgacuucaugcagguggaggagcccagaaucgccaagcugcagggcggccagauccugaugggccaggagcugggcaugaccaccauccagauccugagcccccugagcgacaccauccuggccgagaagaccaucaccgugcuggacgagaaggugaccaucaccgaccugggcgugcagcuggugaccggccugagccugagccugcagcugagccccggcagcaacagagccaucuucgccaccgccguggcccaggagcugcugcagagacccaagcaggaggccgccaucagcugcugggugcaguucagcgacggcagcgugaccccccuggacaucuacgacggcaaggacuucagccugauggccaccagccuggacgagaagguggugagcauccaccaggaccccaaguucaaguggcccaucaucgccgccgagaccgagggccagggcacccuggugaagguggagauggugaucagcgagagcugccagaagagcaagagaaagagcgugcuggccgugggcaccgccaacaucaaggugaaguucggccagaacgacgccaaccccaacaccagcgacagcagacacaccggcgccggcgugcacauggagaacaacgugagcgacagaagacccaagaagcccagccaggaguggggcagccaggagggccaguacuacggcagcagcagcaugggccugauggagggcagaggcaccaccaccgacagaagcauccugcagaagaagaagggccaggagagccugcuggacgacaacagccaccugcagaccauccccagcgaccugaccagcuuccccgcccagguggaccugcccagaagcaacggcgagauggacggcaacgaccugaugcaggccagcaagggccugagcgaccuggagaucggcauguacgcccugcugggcguguucugccuggccauccugguguuccugaucaacugcgugaccuucgcccugaaguacagacacaagcaggugcccuucgaggagcaggagggcaugagccacagccacgacugggugggccugagcaacagaaccgagcugcuggagaaccacaucaacuucgccagcagccaggacgagcagaucaccgccaucgacagaggcauggacuucgaggagagcaaguaccugcugagcaccaacagccagaagagcaucaacggccagcuguucaagccccugggccccaucaucaucgacggcaaggaccagaagagcgagccccccaccagccccaccagcaagagaaagagagugaaguucaccaccuucaccgccgugagcagcgacgacgaguaccccaccagaaacagcaucgugaugagcagcgaggacgacaucaagugggugugccaggaccuggaccccggcgacugcaaggagcugcacaacuacauggagagacugcacgagaacguguaa

SEQ ID NO: 24727 - RNA, 3225 nt, Artificial Sequence
  TMEM132E__Homo_sapiens__NP_001291367
auggcccccggcaugagcggcagaggcggcgccgcccugcugugccugagcgcccugcuggcccacgccagcggcagaagccaccccgccagccccagcccccccggcccccaggccagccccgugcugcccgugagcuacagacugagccacaccagacuggccuucuuccugagagaggccagaccccccagccccgccguggccaacagcagccugcagagaagcgagcccuucgugguguuccagaccaaggagcugcccgugcugaacgugagccugggccccuucagcaccagccaggugguggccagagagcugcugcagcccagcagcacccuggacauccccgagagacugaccgugaacuggaaggugagagccuucaucgugagaagccacgugcccgccagccagcccguggugcaggugcuguucuacguggccggcagagacugggacgacuucggcgugaccgagagacugcccugcgugagacugcacgccuucagagacgccagagaggugaagagcagcugcagacugagcggcggccuggccaccugccuggugagagccgagcugccccuggccugguucggcccccccgcccccgccgccccccccaccgccagaagaaagagccccgacggccuggagcccgaggccaccggcgagagccagcaggccgagcuguacuacacccugcacgcccccgacgccagcggcggcugcggcggcagcagaagaggcgccggccccggcgugggcgccagagccgagagccccacccagcacccccugcugagaaucggcagcaucagccuguucagacccccccccagaagaacccugcaggagcacagacuggacagcaaccugaugaucagacugcccgacagaccccugaagcccggcgaggugcugagcauccugcuguaccuggcccccaacagcagcagccccagcagccccagcguggagcacuucacccugagagugaaggccaagaagggcgugacccugcugggcaccaagagcagaagcggccaguggcacgugaccagcgagcugcugaccggcgccaagcacagcaccgccaccguggacguggccugggcccagagcaccccccugccccccagagagggccagggcccccuggagauccugcagcuggacuucgagauggagaacuucaccagccagagcgugaagagaagaaucauguggcacaucgacuacagaggccacggcgcccugcccgaccuggagagagccgugaccgagcugaccgugauccagagagacgugcaggccauccugccccuggccauggacaccgagaucaucaacaccgccauccugaccggcagaaccguggccauccccgugaaggugaucgccaucgaggugaacggccuggugcuggacaucagcgcccugguggagugcgagagcgacaacgaggacaucaucaaggugagcagcagcugcgacuacguguucgugagcggcaaggagagcagaggcagcaugaacgccagagugaccuucagauacgacgugcugaacgccccccuggagaugaccgugugggugcccaagcugccccugcacaucgagcugagcgacgccagacugagccaggugaagggcuggagagugcccauccugcccgacagaagaagcgugagagagagcgaggacgaggacgaggaggaggaggagagaagacagagcgccagcagaggcugcacccugcaguaccagcacgccacccugcagguguucacccaguuccacaccaccagcagcgagggcaccgaccagguggugaccaugcugggccccgacuggcugguggaggugaccgaccuggugagcgacuucaugagagugggcgaccccagaguggcccacaugguggacagcagcacccuggccggccuggagcccggcaccacccccuucaagguggugagcccccugaccgaggccgugcugggcgagacccugcugaccgugaccgaggagaaggugagcaucacccagcugcaggcccaggugguggccagccuggcccugagccugagacccagccccggcagcagccacaccauccuggccaccaccgccgcccagcagacccugagcuuccugaagcaggaggcccugcugagccuguggcugagcuacagcgacggcaccaccgccccccugagccuguacagccccagagacuacggccugcuggugagcagccuggacgagcacguggccaccgugacccaggacagagccuucccccuggugguggccgaggccgagggcagcggcgagcugcugagagccgagcugaccaucgccgagagcugccagaagaccaagagaaagagcgugcuggccaccacccccgugggccugagagugcacuucggcagagacgaggaggaccccaccuacgacuaccccggccccagccagcccggccccggcggcggcgaggacgaggccagaggcgccggcccccccggcagcgcccugcccgcccccgaggcccccggccccggcaccgccagccccguggugccccccaccgaggacuuccugccccugcccaccggcuuccugcaggugcccagaggccugaccgaccuggagaucggcauguacgcccugcugggcguguucugccuggccauccugguguuccugaucaacugcaucguguucgugcugagauacagacacaagagaaucccccccgagggccagaccagcauggaccacagccaccacuggguguuccugggcaacggccagccccugagagugcagggcgagcugagcccccccgccggcaacccccuggagaccgugcccgccuucugccacggcgaccaccacagcagcggcagcagccagaccagcgugcagagccaggugcacggcagaggcgacggcagcagcggcggcagcgccagagaccaggccgaggaccccgccagcagccccaccagcaagagaaagagagugaaguucaccaccuucaccacccugcccagcgaggagcuggccuacgacagcgugcccgccggcgaggaggacgaggaggaggaggaggaccugggcuggggcugccccgacguggccggccccaccagacccaccgccccccccgaccugcacaacuacaugagaagaaucaaggagaucgccuaa

SEQ ID NO: 24728 - RNA, 543 nt, Artificial Sequence
  TMEM134__Homo_sapiens__NP_001072118
augagcgccgccagaccccaguucagcaucgacgacgccuucgagcugagccuggaggacggcggccccggccccgagagcagcggcguggccagauucggcccccugcacuucgagagaagagccagauucgagguggccgacgaggacaagcagagcagacugagauaccagaaccuggagaacgacgaggacggcgcccaggccagccccgagcccgacggcggcgugggcaccagagacagcagcagaaccagcaucagaagcagccaguggagcuucagcaccaucagcagcagcacccagagaagcuacaacaccugcugcagcuggacccagcacccccugauccagaagaacagaagaguggugcuggccagcuuccugcugcugcugcugggccugggcgugagcagcgccaucuucuucgugcccggcuuccugcugcuggugcccggcguguaccacgugaucuucaucuacugcgccgugaagggccacagaggcuuccaguucuucuaccugcccuacuucgagaaguaa

SEQ ID NO: 24729 - RNA, 1311 nt, Artificial Sequence
  TMEM135__Homo_sapiens__NP_001162195
auggccgcccugagcaagagcaucccccacaacugcuacgagaucggccacaccuggcaccccagcugcagagugagcuuccugcagaucaccggcggcgcccuggaggagagccugaagaucuacgccccccuguaccugaucgccgccauccugagaaagagaaagcuggacuacuaccugcacaagcugcugcccgagauccugcagagcgccagcuuccugaccgccaacggcgcccuguacauggccuucuucugcauccugagaaagauccugggcaaguucuacagcuggacccccggcuucggcgccgcccugcccgccagcuacguggccauccugaucgagagaaagagcagaagaggccugcugaccaucuacauggccaaccuggugcugcuguucugcaucaccgccgccauguacauguucuucuucagaugcaaggacggccugaagggcuucaccuucagcgcccugagauucaucgugggcaaggaggagauccccacccacagcuucagccccgaggccgccuacgccaagguggagcagaagagagagcagcacgaggagaagcccggcagaaugaacaugaucggccuggugagaaaguucguggacagcaucugcaagcacggccccagacacagaugcugcaagcacuacgaggacaacugcaucagcuacugcaucaagggcuucaucagaauguucagcgugggcuaccugauccagugcugccugagaauccccagcgccuucagacaccuguucacccagcccagcagacugcugagccuguucuacaacaaggagaacuuccagcugggcgccuuccugggcagcuucgugagcaucuacaagggcaccagcugcuuccugagauggaucagaaaccuggacgacgagcugcacgccaucaucgccggcuuccuggccggcaucagcaugauguucuacaagagcaccaccaucagcauguaccuggccagcaagcugguggagaccauguacuucaagggcaucgaggccggcaaggugcccuacuucccccacgccgacaccaucaucuacagcaucagcaccgccaucugcuuccaggccgccgugauggaggugcagacccugagacccagcuacuggaaguuccugcugagacugaccaagggcaaguucgccgugaugaacagaaaggugcuggacguguucggcaccggcgccagcaagcacuuccaggacuucauccccagacuggaccccagauacaccaccgugacccccgagcugcccaccgaguucagcuaa

SEQ ID NO: 24730 - RNA, 489 nt, Artificial Sequence
  TMEM138__Homo_sapiens__NP_057548
augcugcagaccagcaacuacagccuggugcugagccugcaguuccugcugcugagcuacgaccuguucgugaacagcuucagcgagcugcugcagaagacccccgugauccagcuggugcuguucaucauccaggacaucgccgugcuguucaacaucaucaucaucuuccugauguucuucaacaccuucguguuccaggccggccuggugaaccugcuguuccacaaguucaagggcaccaucauccugaccgccguguacuucgcccugagcaucagccugcacgugugggugaugaaccugagauggaagaacagcaacagcuucaucuggaccgacggccugcagaugcuguucguguuccagagacuggccgccgugcuguacugcuacuucuacaagagaaccgccgugagacugggcgacccccacuucuaccaggacagccuguggcugagaaaggaguucaugcaggugagaagauaa

SEQ ID NO: 24731 - RNA, 702 nt, Artificial Sequence
  TMEM150B__Homo_sapiens__XP_011525158
auguggggcuaccugagccugaugcccguguuccuggccgugugggccaucagcggcguguggaucguguucgccaucgccgugaccaacagaaccguggaccugagcaagggcuuccccuacaucagcaucugcggcagcuuccccccccagagcugcaucuucagccaggugcugaacaugggcgccgcccuggccgccuggaucugcaucgugagauaccaccagcugagagacuggggcgugagaagauggcccaaccagcugauccuguggaccggccugcugugcgcccugggcaccagcguggugggcaacuuccaggagaagaaccagagacccacccaccuggccggcgccuuccuggccuucauccugggcaacguguacuucuggcugcagcugcugcuguggagacugaagagacugccccagcccggcgccgccuggaucggcccccugagacugggccugugcagcgugugcaccauccugaucguggccaugaucgugcugcacgccugcagccugagaagcgugagcgccgccugcgagugggugguggccaugcugcuguucgcccuguucggccugcuggccguggacuucagcgcccuggagagcugcacccugugcgugcagcccuggcccagccugagccccccccccgccagccccaucagccugcccgugcagcuguaa

SEQ ID NO: 24732 - RNA, 1407 nt, Artificial Sequence
  TMEM151A__Homo_sapiens__NP_694998
augcccgaggacggcgccggcgacggcggcgaggugcccgcccugauccccgacggcgagccccugagagaggagcagagaccccugaagcagagccugggcagcagccugugcagagagagccacuggaagugccugcugcugacccugcugauccacgccugcggcgccgugguggccuggugcagacuggccaccgugcccagacuggugcugggccccgaggccgcccuggccagaggcgccggcggccccccccccaccuaccccgccagccccugcagcgacggcuaccuguacaucccccuggccuucgugagccugcuguaccugcuguaccuggccgagugcuggcacugccacgugagaagcugccaggcccccagaaccgacgcccacaccgugcuggcccugaucagaagacugcagcaggccccccccugcgugugguggaaggccaccagcuaccacuacgugagaagaaccagacagaucaccagauacagaaacggcgacgccuacaccaccacccagguguaccacgagagagccgacagcagaaccgccagaggcgaguucgacuacagcgcccacggcgugagagacgugagcaaggagcuggugggccuggccgagcacgccgccaccagacugagauucaccaagugcuucagcuucggcagcgccgaggccgaggccagcuaccugacccagagagccagauucuucagcgccaacgagggccuggacgacuaccuggaggccagagagggcaugcaccugaaggacguggacuucagagagagccugaugguguucgccgaccccagaagcccccccugguacgccagagccuggguguucuggcuggugagcgccgccacccugagcuggccccugagagugguggccgccuacggcaccgcccacgugcacuaccagguggagaagcuguucggcgccagcagccccccccccggcgccgugcccagcggccccccccugagcagaguggccaccguggacuucaccgagcuggaguggcacaucugcagcaacagacagcuggugcccagcuacagcgaggccguggugaugggcgccggcagcggcgccuaccugagaggcugccagagaugcagaagaagcgugagcagcaacagccugccccccgccagacccagcggccccagacugcccuucagcagaagcagacugagccugggcgccggcggcagagccacccccggcguguucagaagccugagcggcggcccccugggcagaagaggcgaggacaccgagccccuggagagcccccccugcuacgaggacgcccuguacuuccccgugcugaucgugcacggcgacagcggcugccagggcgacggccagggcgcccuguaa

SEQ ID NO: 24733 - RNA, 1701 nt, Artificial Sequence
  TMEM151B__Homo_sapiens__NP_001131032
augagcccccccggcagcgccgccggcgagagcgccgccggcggcggcggcggcggcggcggccccggcgugagcgaggagcugaccgccgccgccgccgccgccgccgccgacgagggccccgccagagaggagcagagacccauccagcccagcuucaccaagagccugugcagagagagccacuggaagugccugcugcugagccugcugauguacggcugccugggcgccguggccuggugccacgugaccaccgugaccagacugaccuucagcagcgccuaccagggcaacagccugauguaccacgacagccccugcagcaacggcuacguguacaucccccuggccuuccugcugaugcuguacgccguguaccugguggagugcuggcacugccaggccagacacgagcugcagcacagaguggacgugagcagcgugagagagagagugggcagaaugcagcaggccacccccugcaucugguggaaggccaucagcuaccacuacgugagaagaaccagacaggugaccagauacagaaacggcgacgccuacaccaccacccagguguaccacgagagagugaacacccacguggccgaggccgaguucgacuacgccagaugcggcgugagagacgugagcaagacccuggugggccuggagggcgcccccgccaccagacugagauucaccaagugcuucagcuucgccagcguggaggccgagaacgccuaccugugccagagagccagauucuucgccgagaacgagggccuggacgacuacauggaggccagagagggcaugcaccugaagaacguggacuucagagaguucaugguggccuuccccgaccccgccagaccccccugguacgccugcagcagcgccuucugggccgccgcccugcugacccugagcuggccccugagagugcuggccgaguacagaaccgccuacgcccacuaccacguggagaagcuguucggccuggagggccccggcagcgccagcagcgccggcggcggccugagccccagcgacgagcugcugcccccccugacccacagacugcccagagugaacaccguggacagcaccgagcuggaguggcacaucagaagcaaccagcagcuggugcccagcuacagcgaggccgugcugauggaccuggccggccugggcaccagaugcggcggcgccggcggcggcuacgcccccagcugcagauacggcggcgugggcggccccggcgccgccggcguggcccccuacagaagaagcugcgagcacugccagagagccgugagcagcagcagcaucuucagcagaagcgcccugagcaucugcgccagccccagagccggccccggccccggcggcggcgccggcugcggcggcagcagauucagccugggcagacuguacggcagcagaagaagcugccuguggagaagcagaagcggcagcgugaacgaggccagcugccccaccgagcagaccagacugagcagccaggccagcaugggcgacgacgaggacgacgacgaggaggaggccggcccccccccccccuaccacgacgcccuguacuuccccgugcugaucgugcacagacaggagggcugccugggccacagccacagaccccugcacagacacggcagcugcguggagaccagccuguaa

SEQ ID NO: 24734 - RNA, 552 nt, Artificial Sequence
  TMEM154__Homo_sapiens__NP_689893
augcaggcccccagagccgcccugguguucgcccuggugaucgcccuggugcccgugggcagaggcaacuacgaggagcuggagaacagcggcgacaccaccguggagagcgagagacccaacaaggugaccauccccagcaccuucgccgccgugaccaucaaggagacccugaacgccaacaucaacagcaccaacuucgcccccgacgagaaccagcuggaguucauccugauggugcugaucccccugauccugcuggugcugcugcugcugagcgugguguuccuggccaccuacuacaagagaaagagaaccaagcaggagcccagcagccagggcagccagagcgcccugcagaccuacgagcugggcagcgagaacgugaaggugcccaucuucgaggaggacacccccagcgugauggagaucgagauggaggagcuggacaaguggaugaacagcaugaacagaaacgccgacuucgagugccugcccacccugaaggaggagaaggagagcaaccacaaccccagcgacagcgagagcuaa

SEQ ID NO: 24735 - RNA, 903 nt, Artificial Sequence
  TMEM158__Homo_sapiens__NP_056259
augcugccccugcuggccgcccugcuggccgccgccugcccccugccccccgugagaggcggcgccgccgacgcccccggccugcugggcgugcccagcaacgccagcgugaacgccagcagcgccgacgagcccaucgcccccagacugcuggccagcgccgcccccggcccccccgagagacccggccccgaggaggccgccgccgccgccgcccccugcaacaucagcgugcagagacagaugcugagcagccugcuggugagauggggcagacccagaggcuuccagugcgaccugcugcuguucagcaccaacgcccacggcagagccuucuucgccgccgccuuccacagagugggccccccccugcugaucgagcaccugggccuggccgccggcggcgcccagcaggaccugagacugugcgugggcugcggcugggugagaggcagaagaaccggcagacugagacccgccgccgcccccagcgccgccgccgccaccgccggcgcccccaccgcccugcccgccuaccccgccgccgagccccccggcccccuguggcugcagggcgagccccugcacuucugcugccuggacuucagccuggaggagcugcagggcgagcccggcuggagacugaacagaaagcccaucgagagcacccugguggccugcuucaugacccuggugaucgugguguggagcguggccgcccugaucuggcccgugcccaucaucgccggcuuccugcccaacggcauggagcagagaagaaccaccgccagcaccaccgccgccacccccgccgccgugcccgccggcaccaccgccgccgccgccgccgccgccgccgccgccgccgccgccgccgugaccagcggcguggccaccaaguaa

SEQ ID NO: 24736 - RNA, 567 nt, Artificial Sequence
  TMEM160__Homo_sapiens__NP_060324
augggcggcggcugguggugggccagagccgccagacuggccagacugagauucagaagaagccugcugcccccccagagacccagaagcggcggcgccagaggcagcuucgcccccggccacggccccagagccggcgccagccccccccccgugagcgagcuggacagagccgacgccuggcugcugagaaaggcccacgagaccgccuuccugagcugguucagaaacggccugcuggccagcggcaucggcgugaucagcuucaugcagagcgacaugggcagagaggccgccuacggcuucuuccugcugggcggccugugcgugguguggggcagcgccagcuacgccgugggccuggccgcccugagaggccccaugcagcugacccugggcggcgccgccgugggcgccggcgccgugcuggccgccagccugcugugggccugcgccgugggccuguacaugggccagcuggagcuggacguggagcuggugcccgaggacgacggcaccgccagcgccgagggccccgacgaggccggcagacccccccccgaguaa

SEQ ID NO: 24737 - RNA, 1464 nt, Artificial Sequence
  TMEM161B__Homo_sapiens__NP_699185
augggcgugaucggcauccagcugguggugaccauggugauggccagcgugaugcagaagaucaucccccacuacagccuggccagauggcugcugugcaacggcagccugagaugguaccagcaccccaccgaggaggagcugagaauccuggccggcaagcagcagaagggcaagaccaagaaggacagaaaguacaacggccacaucgagagcaagccccugaccauccccaaggacaucgaccugcaccuggagaccaagagcgugaccgagguggacacccuggcccugcacuacuuccccgaguaccaguggcugguggacuucaccguggccgccaccgugguguaccuggugaccgagguguacuacaacuucaugaagcccacccaggagaugaacaucagccugguguggugccugcuggugcugagcuucgccaucaaggugcuguucagccugaccacccacuacuucaagguggaggacggcggcgagagaagcgugugcgugaccuucggcuucuucuucuucgugaaggccauggccgugcugaucgugaccgagaacuaccuggaguucggccuggagaccggcuucaccaacuucagcgacagcgccaugcaguuccuggagaagcagggccuggagagccagagccccgugagcaagcugaccuucaaguucuuccuggccaucuucugcagcuucaucggcgccuuccugaccuuccccggccugagacuggcccagaugcaccuggacgcccugaaccuggccaccgagaagaucacccagacccugcugcacaucaacuuccuggccccccuguucauggugcugcugugggugaagcccaucaccaaggacuacaucaugaaccccccccugggcaaggagagcaucccccugaugaccgaggccaccuucgacacccugagacuguggcugaucauccugcugugcgcccugagacuggccaugaugagaagccaccugcaggccuaccugaaccuggcccagaagugcguggaccagaugaagaaggaggccggcagaaucagcaccguggagcugcagaagaugguggccagaguguucuacuaccugugcgugaucgcccugcaguacguggccccccuggugaugcugcugcacaccacccugcugcugaagacccugggcaaccacagcuggggcaucuaccccgagagcaucagcacccugcccguggacaacagccugcugagcaacagcguguacagcgagcugcccagcgccgagggcaagaugaaggugaccgugacccagaucaccguggcccugagcagccugaagaacaucuucaccccccugcuguucagaggccugcugagcuuccugaccugguggaucgccgccugccuguucagcaccagccuguucggccuguucuaccaccaguaccugaccguggccuaa

SEQ ID NO: 24738 - RNA, 870 nt, Artificial Sequence
  TMEM163__Homo_sapiens__NP_112185
auggagcccgccgccggcauccagagaagaagcagccagggccccaccgugccccccccccccagaggccacgccccccccgccgccgcccccggccccgccccccugagcagccccgugagagagcccccccagcuggaggaggagagacaggugagaaucagcgagagcggccaguucagcgacggccuggaggacagaggccugcuggagagcagcaccagacugaagccccacgaggcccagaacuacagaaagaaggcccugugggugagcugguucagcaucaucgugacccuggcccuggccguggccgccuucaccgugagcgugaugagauacagcgccagcgccuucggcuucgccuucgacgccauccuggacgugcugagcagcgccaucgugcuguggagauacagcaacgccgccgccgugcacagcgcccacagagaguacaucgccugcgugauccugggcgugaucuuccugcugagcagcaucugcaucguggugaaggccauccacgaccugagcaccagacugcugcccgagguggacgacuuccuguucagcgugagcauccugagcggcauccugugcagcauccuggccgugcugaaguucaugcugggcaaggugcugaccagcagagcccugaucaccgacggcuucaacagccuggugggcggcgugaugggcuucagcauccugcugagcgccgagguguucaagcacgacagcgccgugugguaccuggacggcagcaucggcgugcugaucggccugaccaucuucgccuacggcgugaagcugcugaucgacauggugcccagagugagacagaccagacacuacgagauguucgaguaa

SEQ ID NO: 24739 - RNA, 975 nt, Artificial Sequence
  TMEM165__Homo_sapiens__NP_060945
auggccgccgccgcccccggcaacggcagagccagcgcccccagacugcugcugcuguuccuggugccccugcugugggcccccgccgccgugagagccggccccgacgaggaccugagccacagaaacaaggagccccccgcccccgcccagcagcugcagccccagcccguggccgugcagggccccgagcccgccagaguggagaagaucuucacccccgccgcccccgugcacaccaacaaggaggaccccgccacccagaccaaccugggcuucauccacgccuucguggccgccaucagcgugaucaucgugagcgagcugggcgacaagaccuucuucaucgccgccaucauggccaugagauacaacagacugaccgugcuggccggcgccaugcuggcccugggccugaugaccugccugagcgugcuguucggcuacgccaccaccgugauccccagaguguacaccuacuacgugagcaccgugcuguucgccaucuucggcaucagaaugcugagagagggccugaagaugagccccgacgagggccaggaggagcuggaggaggugcaggccgagcugaagaagaaggacgaggaguuccagagaaccaagcugcugaacggccccggcgacguggagaccggcaccagcaucaccgugccccagaagaaguggcugcacuucaucagccccaucuucgugcaggcccugacccugaccuuccuggccgaguggggcgacagaagccagcugaccaccaucgugcuggccgccagagaggaccccuacggcguggccgugggcggcaccgugggccacugccugugcaccggccuggccgugaucggcggcagaaugaucgcccagaagaucagcgugagaaccgugaccaucaucggcggcaucguguuccuggccuucgccuucagcgcccuguucaucagccccgacagcggcuucuaa

SEQ ID NO: 24740 - RNA, 894 nt, Artificial Sequence
  TMEM169__Homo_sapiens__NP_001135784
auggaggagcccaccgccguggagggccaggugcagcugcccagcccccaccagggcagccugagaaaggccguggccgccgcccuggcccuggacggcgagagcaccaugggccacagaaagaagaagagaaaggagagcagacccgagagcaucaucaucuacagaagcgacaacgagaagaccgacgaggagcccggcgagagcgagggcggcgaccagcccaaggaggaggagggcgacgacuuccuggacuaccccguggacgacgacauguggaaccugccccuggacagcagauacgugacccugaccggcaccaucaccagaggcaagaagaagggccagaugguggacauccacgugacccugaccgagaaggagcugcaggagcugaccaagcccaaggagagcagcagagagaccacccccgagggcagaauggccugccagaugggcgccgacagaggcccccacguggugcuguggacccugaucugccugcccgugguguucauccugagcuucguggugagcuucuacuacggcaccaucaccugguacaacaucuuccugguguacaacgaggagagaaccuucuggcacaagaucagcuacugccccugccuggugcuguucuaccccgugcugaucauggccauggccagcagccugggccuguacgccgccguggugcagcugagcuggagcugggaggccugguggcaggccgccagagacauggagaagggcuucugcggcuggcugugcagcaagcugggccuggaggacugcagccccuacagcaucguggagcugcuggagagcgacaacaucagcagcacccugagcaacaaggaccccauccaggagguggagaccagcaccguguaa

SEQ ID NO: 24741 - RNA, 435 nt, Artificial Sequence
  TMEM170A__Homo_sapiens__NP_660297
auggagagagagggcagcggcggcagcggcggcagcgccggccugcugcagcagauccugagccugaagguggugcccagagugggcaacggcacccugugccccaacagcaccagccugugcagcuuccccgagaugugguacggcguguuccugugggcccuggugagcagccuguucuuccacgugcccgccggccugcuggcccuguucacccugagacaccacaaguacggcagauucaugagcgugagcauccugcugaugggcaucgugggccccaucaccgccggcauccugaccagcgccgccaucgccggcguguacagagccgccggcaaggagaugauccccuucgaggcccugacccugggcaccggccagaccuucugcgugcugguggugagcuuccugagaauccuggccacccuguaa

SEQ ID NO: 24742 - RNA, 972 nt, Artificial Sequence
  TMEM171__Homo_sapiens__NP_001154814
augagccccgccgccgccgccgagcccgacggcgaccagcaggacagacacgugagcaagcugaucuucugcuucuucguguucggcgccgugcugcugugcgugggcgugcugcugagcaucuucggcuuccaggccugccaguacaagccccugcccgacugccccauggugcugaagguggccggccccgccugcgccguggugggccugggcgccgugauccuggccagaagcagagcccagcugcagcugagagccggccugcagagaggccagcagauggaccccgacagagccuucaucugcggcgagagcagacaguucgcccagugccugaucuucggcuuccuguuccugaccagcggcaugcugaucagcgugcugggcaucugggugcccggcugcggcagcaacugggcccaggagccccugaacgagaccgacaccggcgacagcgagcccagaaugugcggcuuccugagccugcagaucaugggcccccugaucgugcuggugggccugugcuucuucgugguggcccacgugaagaagagaaacacccugaacgccggccaggacgccagcgagagagaggagggccagauccagaucauggagcccgugcaggugaccgugggcgacagcgugaucaucuucccccccccccccccccccuacuuccccgagagcagcgccagcgccguggccgagagccccggcaccaacagccugcugcccaacgagaacccccccagcuacuacagcaucuucaacuacggcacccccaccagcgagggcgccgccagcgagagagacugcgagagcaucuacaccaucagcggcaccaacagcagcagcgaggccagccacaccccccaccugcccagcgagcugccccccagauacgaggagaaggagaacgccgccgccaccuuccugccccugagcagcgagcccagcccccccuaa

SEQ ID NO: 24743 - RNA, 1140 nt, Artificial Sequence
  TMEM173__Homo_sapiens__NP_938023
augccccacagcagccugcaccccagcauccccugccccagaggccacggcgcccagaaggccgcccuggugcugcugagcgccugccuggugacccuguggggccugggcgagccccccgagcacacccugagauaccuggugcugcaccuggccagccugcagcugggccugcugcugaacggcgugugcagccuggccgaggagcugagacacauccacagcagauacagaggcagcuacuggagaaccgugagagccugccugggcugcccccugagaagaggcgcccugcugcugcugagcaucuacuucuacuacagccugcccaacgccgugggcccccccuucaccuggaugcuggcccugcugggccugagccaggcccugaacauccugcugggccugaagggccuggcccccgccgagaucagcgccgugugcgagaagggcaacuucaacguggcccacggccuggccuggagcuacuacaucggcuaccugagacugauccugcccgagcugcaggccagaaucagaaccuacaaccagcacuacaacaaccugcugagaggcgccgugagccagagacuguacauccugcugccccuggacugcggcgugcccgacaaccugagcauggccgaccccaacaucagauuccuggacaagcugccccagcagaccggcgaccacgccggcaucaaggacagaguguacagcaacagcaucuacgagcugcuggagaacggccagagagccggcaccugcgugcuggaguacgccaccccccugcagacccuguucgccaugagccaguacagccaggccggcuucagcagagaggacagacuggagcaggccaagcuguucugcagaacccuggaggacauccuggccgacgcccccgagagccagaacaacugcagacugaucgccuaccaggagcccgccgacgacagcagcuucagccugagccaggaggugcugagacaccugagacaggaggagaaggaggaggugaccgugggcagccugaagaccagcgccgugcccagcaccagcaccaugagccaggagcccgagcugcugaucagcggcauggagaagccccugccccugagaaccgacuucagcuaa

SEQ ID NO: 24744 - RNA, 1269 nt, Artificial Sequence
  TMEM175__Homo_sapiens__NP_001284354
augaccuuccugaucgugaccguggccugggccgcccacaccagacuguuccagguggugggcaagaccgacgacacccuggcccugcugaaccuggccugcaugaugaccaucaccuuccugcccuacaccuucagccugauggugaccuuccccgacgugccccugggcaucuuccuguucugcgugugcgugaucgccaucggcguggugcaggcccugaucgugggcuacgccuuccacuucccccaccugcugagcccccagauccagagaagcgcccacagagcccuguacagaagacacgugcugggcaucgugcugcagggccccgcccugugcuucgccgccgccaucuucagccuguucuucgugccccugagcuaccugcugauggugaccgugauccugcugcccuacgugagcaaggugaccggcuggugcagagacagacugcugggccacagagagcccagcgcccaccccguggagguguucagcuucgaccugcacgagccccugagcaaggagagaguggaggccuucagcgacggcguguacgccaucguggccacccugcugauccuggacaucugcgaggacaacgugcccgaccccaaggacgugaaggagagauucagcggcagccugguggccgcccugagcgccaccggccccagauuccuggccuacuucggcagcuucgccaccgugggccugcugugguucgcccaccacagccuguuccugcacgugagaaaggccaccagagccaugggccugcugaacacccugagccuggccuucgugggcggccugccccuggccuaccagcagaccagcgccuucgccagacagcccagagacgagcuggagagagugagagugagcugcaccaucaucuuccuggccagcaucuuccagcuggccauguggaccaccgcccugcugcaccaggccgagacccugcagcccagcgugugguucggcggcagagagcacgugcugauguucgccaagcuggcccuguaccccugcgccagccugcuggccuucgccagcaccugccugcugagcagauucagcgugggcaucuuccaccugaugcagaucgccgugcccugcgccuuccugcugcugagacugcuggugggccuggcccuggccacccugagagugcugagaggccuggccagacccgagcaccccccccccgcccccaccggccaggacgacccccagagccagcugcugcccgcccccugcuaa

SEQ ID NO: 24745 - RNA, 702 nt, Artificial Sequence
  TMEM176B__Homo_sapiens__NP_001094784
augacccagaacaccgugaucgugaacggcguggccauggccagcagacccagccagcccacccacgugaacgugcacauccaccaggagagcgcccugacccagcugcugaaggccggcggcagccugaagaaguuccuguuccaccccggcgacaccgugcccagcaccgccagaaucggcuacgagcagcuggcccugggcgugaucgccgccggcgccggcgccaucgugcacgagaagcaccccggcaagcuggccggcuacaucagcagccugcugacccuggccggcuucgccaccgccauggccgccguggugcugugcgugaacagcuucaucuggcagaccgagcccuuccuguacaucgacaccgugugcgacagaagcgaccccguguuccccaccaccggcuacagauggaugagaagaagccaggagaaccaguggcagaaggaggagugcagagccuacaugcagaugcugagaaagcuguucaccgccaucagagcccuguuccuggccgugugcgugcugaaggugaucgugagccuggugagccugggcgugggccugagaaaccugugcggccagagcagccagccccugaacgaggagggcagcgagaagagacugcugggcgagaacagcgugccccccagccccagcagagagcagaccagcaccgccaucgugcuguaa

SEQ ID NO: 24746 - RNA, 894 nt, Artificial Sequence
  TMEM178A__Homo_sapiens__NP_689603
auggagcccagagcccuggugaccgcccugagccugggccugagccugugcagccugggccugcuggugaccgccaucuucaccgaccacugguacgagaccgaccccagaagacacaaggagagcugcgagagaagcagagccggcgccgacccccccgaccagaagaacagacugaugccccugagccaccugccccugagagacagccccccccugggcagaagacugcugcccggcggccccggcagagccgaccccgagagcuggagaagccugcugggccugggcggccuggacgccgagugcggcagaccccuguucgccaccuacagcggccuguggagaaagugcuacuuccugggcaucgacagagacaucgacacccugauccugaagggcaucgcccagagaugcaccgccaucaaguaccacuucagccagcccaucagacugagaaacauccccuucaaccugaccaagaccauccagcaggacgaguggcaccugcugcaccugagaagaaucaccgccggcuuccugggcauggccguggccgugcugcugugcggcugcaucguggccaccgugagcuucuucugggaggagagccugacccagcacguggccggccugcuguuccugaugaccggcaucuucugcaccaucagccugugcaccuacgccgccagcaucagcuacgaccugaacagacugcccaagcugaucuacagccugcccgccgacguggagcacggcuacagcuggagcaucuucugcgccuggugcagccugggcuucaucguggccgccggcggccugugcaucgccuaccccuucaucagcagaaccaagaucgcccagcugaagagcggcagagacagcaccguguaa

SEQ ID NO: 24747 - RNA, 690 nt, Artificial Sequence
  TMEM182__Homo_sapiens__NP_653233
augagacugaacaucgccaucuucuucggcgcccuguucggcgcccugggcgugcugcuguuccugguggccuucggcagcgacuacuggcugcuggccaccgaggugggcagaugcagcggcgagaagaacaucgagaacgugaccuuccaccacgagggcuucuucuggagaugcugguucaacggcaucguggaggagaacgacagcaacaucuggaaguucugguacaccaaccagccccccagcaagaacugcacccacgccuaccugagccccuaccccuucaugagaggcgagcacaacagcaccagcuacgacagcgccgugaucuacagaggcuucugggccgugcugaugcugcugggcgugguggccguggugaucgccagcuuccugaucaucugcgccgcccccuucgccagccacuuccuguacaaggccggcggcggcagcuacaucgccgccggcauccuguucagccugguggugaugcuguacgugaucugggugcaggccguggccgacauggagagcuacagaaacaugaagaugaaggacugccuggacuucacccccagcgugcuguacggcuggagcuucuuccuggcccccgccggcaucuucuucagccugcuggccggccugcuguuccugguggugggcagacacauccagauccaccacuaa

SEQ ID NO: 24748 - RNA, 1131 nt, Artificial Sequence
  TMEM183A__Homo_sapiens__NP_612400
auggccagaggccccggcccccugggcagacccagacccgacaccguggccaugcccaagagaggcaagagacugaaguucagagcccacgacgccugcagcggcagagugaccguggccgacuacgccaacagcgaccccgccguggugagaagcggcagagugaagaaggccguggccaacgccgugcagcaggaggugaagagccugugcggccuggaggccagccaggugcccgccgaggaggcccugagcggcgccggcgagcccugcgacaucaucgacagcagcgacgagauggacgcccaggaggagagcauccacgagagaaccgugagcagaaagaagaagagcaagagacacaaggaggagcuggacggcgccggcggcgaggaguaccccauggacaucuggcugcugcuggccagcuacaucagacccgaggacaucgugaacuucagccugaucugcaagaacgccuggaccgugaccugcaccgccgccuucuggaccagacuguacagaagacacuacacccuggacgccagccugccccugagacugagacccgagagcauggagaagcugagaugccugagagccugcgugaucagaagccuguaccacauguacgagcccuucgccgccagaaucagcaagaaccccgccauccccgagagcacccccagcacccugaagaacagcaagugccugcuguucuggugcagaaagaucgugggcaacagacaggagcccaugugggaguucaacuucaaguucaagaagcagagccccagacugaagagcaagugcaccggcggccugcagccccccgugcaguacgaggacgugcacaccaaccccgaccaggacugcugccugcugcaggugaccacccugaacuucaucuucauccccaucgugaugggcaugaucuucacccuguucaccaucaacgugagcaccgacaugagacaccacagagugagacugguguuccaggacagccccgugcacggcggcagaaagcugagaagcgagcagggcgugcaggugauccuggaccccgugcacagcgugagacuguucgacugguggcacccccaguaccccuucagccugagagccuaa

SEQ ID NO: 24749 - RNA, 1317 nt, Artificial Sequence
  TMEM184C__Homo_sapiens__NP_060711
augcccugcaccugcaccuggagaaacuggagacaguggaucagaccccugguggccgugaucuaccuggugagcaucgugguggccgugccccugugcgugugggagcugcagaagcuggaggugggcauccacaccaaggccugguucaucgccggcaucuuccugcugcugaccauccccaucagccugugggugauccugcagcaccuggugcacuacacccagcccgagcugcagaagcccaucaucagaauccuguggauggugcccaucuacagccuggacagcuggaucgcccugaaguaccccggcaucgccaucuacguggacaccugcagagagugcuacgaggccuacgugaucuacaacuucaugggcuuccugaccaacuaccugaccaacagauaccccaaccuggugcugauccuggaggccaaggaccagcagaagcacuuccccccccugugcugcugcccccccugggccaugggcgaggugcugcuguucagaugcaagcugggcgugcugcaguacaccguggugagacccuucaccaccaucguggcccugaucugcgagcugcugggcaucuacgacgagggcaacuucagcuucagcaacgccuggaccuaccuggugaucaucaacaacaugagccagcuguucgccauguacugccugcugcuguucuacaaggugcugaaggaggagcugagccccauccagcccgugggcaaguuccugugcgugaagcuggugguguucgugagcuucuggcaggccguggugaucgcccugcuggugaaggugggcgugaucagcgagaagcacaccugggaguggcagaccguggaggccguggccaccggccugcaggacuucaucaucugcaucgagauguuccuggccgccaucgcccaccacuacaccuucagcuacaagcccuacgugcaggaggccgaggagggcagcugcuucgacagcuuccuggccaugugggacgugagcgacaucagagacgacaucagcgagcaggugagacacgugggcagaaccgugagaggccaccccagaaagaagcuguuccccgaggaccaggaccagaacgagcacaccagccugcugagcagcagcagccaggacgccaucagcaucgccagcagcaugccccccagccccaugggccacuaccagggcuucggccacaccgugaccccccagaccacccccaccaccgccaagaucagcgacgagauccugagcgacaccaucggcgagaagaaggagcccagcgacaagagcguggacagcuaa

SEQ ID NO: 24750 - RNA, 876 nt, Artificial Sequence
  TMEM185A__Homo_sapiens__NP_001167563
augaaccugagaggccuguuccaggacuucaaccccagagccgagggcgagaccugcguggaguucaaggccaugcugaucgccgugggcauccaccugcugcugcugauguucgaggugcuggugugcgacagaaucgagagaggcagccacuucuggcugcugguguucaugccccuguucuucgugagccccgugagcguggccgccugcguguggggcuucagacacgacagaagccuggagcuggagauccugugcagcgugaacauccugcaguucaucuucaucgcccugagacuggacaagaucauccacuggcccuggcugguggugugcgugccccuguggauccugaugagcuuccugugccugguggugcuguacuacaucguguggagcgugcuguuccugagaagcauggacgugaucgccgagcagagaagaacccacaucaccauggcccugagcuggaugaccaucguggugccccugcugaccuucgagauccugcuggugcacaagcuggacggccacaacgccuucagcugcauccccaucuucgugccccuguggcugagccugaucacccugauggccaccaccuucggccagaagggcggcaaccacuggugguucggcaucagaaaggacuucugccaguuccugcuggagaucuuccccuuccugagagaguacggcaacaucagcuacgaccugcaccacgaggacaacgaggagaccgaggagacccccgugcccgagccccccaagaucgcccccauguucagaaagaaggccagaguggugaucacccagagccccggcaaguacgugcugcccccccccaagcugaacaucgagaugcccgacuaa

SEQ ID NO: 24751 - RNA, 786 nt, Artificial Sequence
  TMEM187__Homo_sapiens__XP_011529501
augaaccccgaguggggccaggccuucgugcacguggccguggccggcggccugugcgccguggccguguucaccggcaucuucgacagcgugagcgugcaggugggcuacgagcacuacgccgaggcccccguggccggccugcccgccuuccuggccaugcccuucaacagccuggugaacauggccuacacccugcugggccugagcuggcugcacagaggcggcgccaugggccugggccccagauaccugaaggacguguucgccgccauggcccugcuguacggccccgugcaguggcugagacuguggacccaguggagaagagccgccgugcuggaccaguggcugacccugcccaucuucgccuggcccguggccuggugccuguaccuggacagaggcuggagacccuggcuguuccugagccuggagugcgugagccuggccagcuacggccuggcccugcugcacccccagggcuucgagguggcccugggcgcccacgugguggccgccgugggccaggcccugagaacccacagacacuacggcagcaccaccagcgccaccuaccuggcccugggcgugcugagcugccugggcuucguggugcugaagcugugcgaccaccagcuggccagauggagacuguuccagugccugaccggccacuucuggagcaaggugugcgacgugcugcaguuccacuucgccuuccuguuccugacccacuucaacacccaccccagauuccaccccagcggcggcaagaccagauaa

SEQ ID NO: 24752 - RNA, 804 nt, Artificial Sequence
  TMEM189__Homo_sapiens__NP_001155977
auggccggcgccgaggacuggcccggccagcagcuggagcuggacgaggacgaggccagcugcugcagauggggcgcccagcacgccggcgccagagagcuggccgcccuguacagccccggcaagagacugcaggaguggugcagcgugauccugugcuucagccugaucgcccacaaccuggugcaccugcugcugcuggccagaugggaggacaccccccuggugauccugggcgugguggccggcgcccugaucgccgacuuccugagcggccuggugcacuggggcgccgacaccuggggcagcguggagcugcccaucgccuucaucagacccuucagagagcaccacaucgaccccaccgccaucaccagacacgacuucaucgagaccaacggcgacaacugccuggugacccugcugccccugcugaacauggccuacaaguucagaacccacagccccgaggcccuggagcagcuguaccccugggagugcuucguguucugccugaucaucuucggcaccuucaccaaccagauccacaaguggagccacaccuacuucggccugcccagaugggugacccugcugcaggacuggcacgugauccugcccagaaagcaccacagaauccaccacgugagcccccacgagaccuacuucugcaucaccaccggcuggcugaacuacccccuggagaagaucggcuucuggagaagacuggaggaccugauccagggccugaccggcgagaagcccagagccgacgacaugaagugggcccagaagaucaaguaa

SEQ ID NO: 24753 - RNA, 1113 nt, Artificial Sequence
  TMEM189-UBE2V1__Homo_sapiens__NP_954673
auggccggcgccgaggacuggcccggccagcagcuggagcuggacgaggacgaggccagcugcugcagauggggcgcccagcacgccggcgccagagagcuggccgcccuguacagccccggcaagagacugcaggaguggugcagcgugauccugugcuucagccugaucgcccacaaccuggugcaccugcugcugcuggccagaugggaggacaccccccuggugauccugggcgugguggccggcgcccugaucgccgacuuccugagcggccuggugcacuggggcgccgacaccuggggcagcguggagcugcccaucgugggcaaggccuucaucagacccuucagagagcaccacaucgaccccaccgccaucaccagacacgacuucaucgagaccaacggcgacaacugccuggugacccugcugccccugcugaacauggccuacaaguucagaacccacagccccgaggcccuggagcagcuguaccccugggagugcuucguguucugccugaucaucuucggcaccuucaccaaccagauccacaaguggagccacaccuacuucggccugcccagaugggugacccugcugcaggacuggcacgugauccugcccagaaagcaccacagaauccaccacgugagcccccacgagaccuacuucugcaucaccaccggcgugaaggugcccagaaacuucagacugcuggaggagcuggaggagggccagaagggcgugggcgacggcaccgugagcuggggccuggaggacgacgaggacaugacccugaccagauggaccggcaugaucaucggcccccccagaaccaucuacgagaacagaaucuacagccugaagaucgagugcggccccaaguaccccgaggccccccccuucgugagauucgugaccaagaucaacaugaacggcgugaacagcagcaacggcgugguggaccccagagccaucagcgugcuggccaaguggcagaacagcuacagcaucaagguggugcugcaggagcugagaagacugaugaugagcaaggagaacaugaagcugccccagccccccgagggccagugcuacagcaacuaa

SEQ ID NO: 24754 - RNA, 423 nt, Artificial Sequence
  TMEM18__Homo_sapiens__NP_690047
augcccagcgccuucagcgugagcagcuuccccgugagcauccccgccgugcugacccagaccgacuggaccgagcccuggcugaugggccuggccaccuuccacgcccugugcgugcugcugaccugccugagcagcagaagcuacagacugcagaucggccacuuccugugccuggugauccugguguacugcgccgaguacaucaacgaggccgccgccaugaacuggagacuguucagcaaguaccaguacuucgacagcagaggcauguucaucagcaucguguucagcgccccccugcuggugaacgccaugaucaucguggugauguggguguggaagacccugaacgugaugaccgaccugaagaacgcccaggagagaagaaaggagaagaagagaagaagaaaggaggacuaa

SEQ ID NO: 24755 - RNA, 627 nt, Artificial Sequence
  TMEM199__Homo_sapiens__NP_689677
auggccagcagccugcuggccggcgagagacuggugagagcccugggccccggcggcgagcuggagcccgagagacugcccagaaagcugagagccgagcuggaggccgcccugggcaagaagcacaagggcggcgacagcagcagcggcccccagagacuggugagcuucagacugaucagagaccugcaccagcaccugagagagagagacagcaagcuguaccugcacgagcugcuggagggcagcgagaucuaccugcccgagguggugaagccccccagaaaccccgagcugguggccagacuggagaagaucaagauccagcuggccaacgaggaguacaagagaaucaccagaaacgugaccugccaggacaccagacacggcggcacccugagcgaccugggcaagcaggugagaagccugaaggcccuggugaucaccaucuucaacuucaucgugaccgugguggccgccuucgugugcaccuaccugggcagccaguacaucuucaccgagauggccagcagagugcuggccgcccugaucguggccagcguggugggccuggccgagcuguacgugauggugagagccauggagggcgagcugggcgagcuguaa

SEQ ID NO: 24756 - RNA, 1476 nt, Artificial Sequence
  TMEM200A__Homo_sapiens__NP_001245206
augaucgccaccggcggcgugaucaccggccuggccgcccugaagagacaggacagcgccagaagccagcagcacgugaaccugagccccagccccgccacccaggagaagaagcccaucagaagaagacccagagccgacguggugguggugagaggcaagaucagacuguacagccccagcggcuucuuccugauccugggcgugcugaucagcaucaucggcaucgccauggccgugcugggcuacuggccccagaaggagcacuucaucgacgccgagaccacccugagcaccaacgagacccaggugaucagaaacgagggcggcgugguggugagauucuucgagcagcaccugcacagcgacaagaugaagaugcugggccccuucaccaugggcaucggcaucuucaucuucaucugcgccaacgccauccugcacgagaacagagacaaggagaccaagaucauccacaugagagacaucuacagcaccgugaucgacauccacacccugagaaucaaggagcagagacagaugaacggcauguacaccggccugaugggcgagaccgaggugaagcagaacggcagcagcugcgccagcagacuggccgccaacaccaucgccagcuucagcggcuucagaagcagcuucagaauggacagcagcguggaggaggacgagcugaugcugaacgagggcaagagcagcggccaccugaugcccccccugcugagcgacagcagcgugagcguguucggccuguaccccccccccagcaagaccaccgacgacaagaccagcggcagcaagaagugcgagaccaagagcaucgugagcagcagcaucagcgccuucacccugcccgugaucaagcugaacaacugcgugaucgacgagcccagcaucgacaacaucaccgaggacgccgacaaccugaagagcagaagcagaaaccugagcauggacagccugguggugccccugcccaacaccagcgagagcuuccagcccgugagcaccgugcugcccagaaacaacagcaucggcgagagccugagcagccaguacaagagcagcauggcccugggccccggcgccggccagcugcugagccccggcgccgccagaagacaguucggcagcaacaccagccugcaccugcugagcagccacagcaagagccuggaccuggacagaggccccagcacccugaccgugcaggccgagcagagaaagcaccccagcuggcccagacuggacagaaacaacagcaagggcuacaugaagcuggagaacaaggaggaccccauggacagacugcuggugccccagguggccaucaagaaggacuucaccaacaaggagaagcugcugaugaucagcagaagccacaacaaccugagcuucgagcacgacgaguuccugagcaacaaccugaagagaggcaccagcgagaccagauucuaa

SEQ ID NO: 24757 - RNA, 570 nt, Artificial Sequence
  TMEM205__Homo_sapiens__NP_001138888
auggaggagggcggcaaccugggcggccugaucaagauggugcaccugcuggugcugagcggcgccuggggcaugcagaugugggugaccuucgugagcggcuuccugcuguucagaagccugcccagacacaccuucggccuggugcagagcaagcuguuccccuucuacuuccacaucagcaugggcugcgccuucaucaaccugugcauccuggccagccagcacgccugggcccagcugaccuucugggaggccagccagcuguaccugcuguuccugagccugacccuggccaccgugaacgccagauggcuggagcccagaaccaccgccgccaugugggcccugcagaccguggagaaggagagaggccugggcggcgaggugcccggcagccaccagggccccgaccccuacagacagcugagagagaaggaccccaaguacagcgcccugagacagaacuucuucagauaccacggccugagcagccugugcaaccugggcugcgugcugagcaacggccugugccuggccggccuggcccuggagaucagaagccuguaa

SEQ ID NO: 24758 - RNA, 441 nt, Artificial Sequence
  TMEM207__Homo_sapiens__NP_997199
augagcagaagcagacuguucagcgugaccagcgccaucagcaccaucggcauccugugccugccccuguuccagcuggugcugagcgaccugcccugcgaggaggacgagaugugcgugaacuacaacgaccagcaccccaacggcugguacaucuggauccugcugcugcuggugcugguggccgcccugcugugcggcgccguggugcugugccugcagugcuggcugagaagacccagaaucgacagccacagaagaaccauggccguguucgccgugggcgaccuggacagcaucuacggcaccgaggccgccgugagccccaccgugggcauccaccugcagacccagacccccgaccuguaccccgugcccgcccccugcuucggcccccugggcagccccccccccuacgaggagaucgugaagaccaccuaa

SEQ ID NO: 24759 - RNA, 1560 nt, Artificial Sequence
  TMEM209__Homo_sapiens__NP_001288092
augaugcagggcgaggcccaccccagcgccagccugaucgacagaaccaucaagaugagaaaggagaccgaggccagaaagguggugcuggccuggggccugcugaacgugagcauggccggcaugaucuacaccgagaugaccggcaagcugaucagcagcuacuacaacgugaccuacuggccccugugguacaucgagcuggcccuggccagccuguucagccugaacgcccuguucgacuucuggagauacuucaaguacaccguggcccccaccagccugguggugagccccggccagcagacccugcugggccugaagaccgccguggugcagaccacccccccccacgaccuggccgccacccagaucccccccgccccccccagccccagcauccagggccagagcgugcugagcuacagccccagcagaagccccagcaccagccccaaguucaccaccagcugcaugaccggcuacagcccccagcugcagggccugagcagcggcggcagcggcagcuacagccccggcgugaccuacagccccgugagcggcuacaacaagcuggccagcuucagccccagcccccccagccccuaccccaccaccgugggccccguggagagcagcggccugagaagcagauacagaagcagccccaccguguacaacagccccaccgacaaggaggacuacaugaccgaccugagaacccuggacaccuuccugagaagcgaggaggagaagcagcacagagugaagcugggcagccccgacagcaccagccccagcagcagccccaccuucuggaacuacagcagaagcaugggcgacuacgcccagacccugaagaaguuccaguaccagcuggccugcagaagccaggcccccugcgccaacaaggacgaggccgaccugagcagcaagcaggccgccgaggaggugugggccagaguggccaugaacagacagcugcuggaccacauggacagcuggaccgccaaguucagaaacuggaucaacgagaccauccuggugccccuggugcaggagaucgagagcgugagcacccagaugagaagaaugggcugccccgagcugcagaucggcgagcugagccagggcggcugcaugagcagcuucagauggaacagaggcggcgacuucaagggcagaaagugggacaccgaccugcccaccgacagcgccaucaucaugcacguguucugcaccuaccuggacagcagacugcccccccaccccaaguaccccgacggcaagaccuucaccagccagcacuucgugcagacccccaacaagcccgacgugaccaacgagaacguguucugcaucuaccagagcgccaucaaccccccccacuacgagcugaucuaccagagacacguguacaaccugcccaagggcagaaacaacauguuccacacccugcugauguuccuguacaucaucaagaccaaggagagcggcaugcugggcagagugaaccugggccugagcggcgugaacauccuguggaucuucggcgaguaa

SEQ ID NO: 24760 - RNA, 324 nt, Artificial Sequence
  TMEM213__Homo_sapiens__NP_001078898
augcagagacugcccgccgccaccagagccacccugauccugagccuggccuucgccagccugcacagcgccugcagcgccgaggccagcagcagcaacagcagcagccugaccgcccaccaccccgaccccggcacccuggagcagugccugaacguggacuucugcccccaggccgccagaugcugcagaaccggcguggacgaguacggcuggaucgccgccgccgugggcuggagccugugguuccugacccugauccugcugugcguggacaagcugaugaagcugacccccgacgagcccaaggaccugcaggccuaa

SEQ ID NO: 24761 - RNA, 708 nt, Artificial Sequence
  TMEM215__Homo_sapiens__NP_997723
augagacccgacgacaucaaccccagaaccggccuggugguggcccuggugagcguguuccugguguucggcuucauguucaccgugagcggcaugaagggcgagacccugggcaacaucccccugcuggccaucggccccgccaucugccugcccggcaucgccgccaucgcccuggccagaaagaccgagggcugcaccaaguggcccgagaacgagcugcugugggugagaaagcugcccugcuucagaaagcccaaggacaaggaggugguggagcugcugagaacccccagcgaccuggagagcggcaagggcagcagcgacgagcuggccaagaaggccggccugagaggcaagccccccccccagagccagggcgaggugagcguggccagcagcaucaacagccccacccccaccgaggagggcgagugccagagccuggugcagaacggccaccaggaggagaccagcagauaccuggacggcuacugccccagcggcagcagccugaccuacagcgcccuggacgugaagugcagcgccagagacagaagcgagugccccgagcccgaggacagcaucuucuucgugccccaggacagcaucaucgugugcagcuacaagcagaacagccccuacgacagauacugcugcuacaucaaccagauccagggcagaugggaccacgagaccaucguguaa

SEQ ID NO: 24762 - RNA, 438 nt, Artificial Sequence
  TMEM216__Homo_sapiens__NP_001167461
augcugcccagaggccugaagauggcccccagaggcaagagacugagcagcaccccccuggagauccuguucuuccugaacggcugguacaacgccaccuacuuccugcuggagcuguucaucuuccuguacaagggcgugcugcugcccuaccccaccgccaaccuggugcuggacguggugaugcugcugcuguaccugggcaucgaggugaucagacuguucuucggcaccaagggcaaccugugccagagaaagaugccccugagcaucagcguggcccugaccuuccccagcgccaugauggccagcuacuaccugcugcugcagaccuacgugcugagacuggaggccaucaugaacggcauccugcuguucuucugcggcagcgagcugcugcuggaggugcugacccuggccgccuucagcagaaucuaa

SEQ ID NO: 24763 - RNA, 636 nt, Artificial Sequence
  TMEM217__Homo_sapiens__NP_001273330
augaagcagcagcaguggugcggcaugaccgccaagaugggcaccgugcugagcggcguguucaccaucauggccguggacauguaccugaucuucgagcagaagcaccugggcaacggcagcugcaccgagaucacccccaaguacagaggcgccagcaacaucaucaacaacuucaucaucugcuggagcuucaagaucgugcuguuccugagcuucaucaccauccugaucagcugcuuccugcuguacagcguguacgcccagaucuucagaggccuggugaucuacaucguguggaucuucuucuacgagaccgccaacguggugauccagauccugaccaacaacgacuucgacaucaaggaggugagaaucaugagaugguucggccuggugagcagaaccgugaugcacugcuucuggauguucuucgugaucaacuacgcccacaucaccuacaagaacagaagccagggcaacaucaucagcuacaagagaagaaucagcaccgccgagauccugcacagcagaaacaagagacugagcaucagcagcggcuucagcggcagccaccuggagagccaguacuucgagagacagagaagaugcagcggcaagaccagcaucaaguaa

SEQ ID NO: 24764 - RNA, 723 nt, Artificial Sequence
  TMEM219__Homo_sapiens__NP_001077082
augggcaacugccaggccggccacaaccugcaccugugccuggcccaccaccccccccuggugugcgccacccugauccugcugcugcugggccugagcggccugggccugggcagcuuccugcugacccacagaaccggccugagaagccccgacaucccccaggacugggugagcuuccugagaagcuucggccagcugacccugugccccagaaacggcaccgugaccggcaaguggagaggcagccacguggugggccugcugaccacccugaacuucggcgacggccccgacagaaacaagaccagaaccuuccaggccaccgugcugggcagccagaugggccugaagggcagcagcgccggccagcuggugcugaucaccgccagagugaccaccgagagaaccgccggcaccugccuguacuucagcgccgugcccggcauccugcccagcagccagccccccaucagcugcagcgaggagggcgccggcaacgccacccugagccccagaaugggcgaggagugcgugagcguguggagccacgagggccuggugcugaccaagcugcugaccagcgaggagcuggcccugugcggcagcagacugcuggugcugggcagcuuccugcugcuguucugcggccugcugugcugcgugaccgccaugugcuuccaccccagaagagagagccacuggagcagaaccagacuguaa

SEQ ID NO: 24765 - RNA, 483 nt, Artificial Sequence
  TMEM220__Homo_sapiens__NP_001004313
auggcccccgcccuguggagagccugcaacggccugauggccgccuucuucgcccuggccgcccuggugcaggugaacgaccccgacgccgagguguggguggugguguacaccauccccgccgugcugacccugcuggugggccugaaccccgaggugaccggcaacgugaucuggaagagcaucagcgccauccacauccuguucugcaccgugugggccgugggccuggccagcuaccugcugcacagaacccagcagaacauccugcacgaggaggagggcagagagcugagcggccuggugaucaucaccgccuggaucauccugugccacagcagcagcaagaaccccgugggcggcagaauccagcuggccaucgccaucgugaucacccuguuccccuucaucagcuggguguacaucuacaucaacaaggagaugagaagcagcuggcccacccacugcaagaccgugaucuaa

SEQ ID NO: 24766 - RNA, 1143 nt, Artificial Sequence
  TMEM229A__Homo_sapiens__NP_001129474
auggccggcagcgacguggacagcgagggccccgccagaagaggcggcgccgccagaagacccggcgcccccggcggccccggcagcgaggccgccgccggcugccccgagccccugagcaccgccgaggcccccgccgagagcgccacccugcccgccuggaugagacuguacuucuacggcaugcacggcaucacccuggacgugcuggugagcagcgccagaagauucgccagaagccccgaccugagaaugcugggcuucagcagccccuacagaugccugcugcacagccugacccacuucgcccuggagaagguguaccugcagcagagaagaugccccaacgccuucguguucaacuuccugcuguaccccagcgcccacgugggccugcagacccuggccggccaggcccugcugcugagccugggcggcggcgccggcguggccguggcccccggcgcccuggaccuggcccugcaguacgugcuggcccuguaccacugccagguguuccugaagagauuccugagacugagauacggcagacagagaagaagacagcagcagcagcagcagcagcagcagcagcagcagagaagaggcgcccugcccgugccccccggcgccagagugcccaccgccgccggcgccagaagaagaagacccagaggccccagaggcgccggcggcgcccccagccagggccugcccgaccugcccagauuccuguucuucggcaugcacggcuuccuggacgagaucuucuucaccuucuucuucaacgugcugggccagggcgacggcaccaccagcggccacaccagccuguggagcuucuucauguacggcagcugcagcuucgugguggagaagcuguacuuccaccugcacuacagcagaggcuggggcaccuggaagagagugcccaucuacgugaucuucaucuacgugugggagcugagcuggggccugggccugagaaccugcggcgccugcagcugggacuacagccacuacccccugaacuucaugggccugaucacccugauguaccugcccggcuggaucuuccugagcguguaccaggaccugaucagcaacgugcuguggagagugcaguacgugcccgccaacuaa

SEQ ID NO: 24767 - RNA, 1110 nt, Artificial Sequence
  TMEM231__Homo_sapiens__NP_001070884
auggccaccagaagaagccagaccuggagccccggcagcagaagcgccugcgagagaugcagcuggagaagcaugagcagcagccugaccagaagcagcgccgugaccgccagaggcagcgcccccaagcccagaugcagcugcugcuggccccugagaagcagaaccagcagaagaugcugguggcccagcggcgccaccgugagccugcccagaccccugugccacgaggcccccagagccagaagcgccagagccggccugcccaacagacugcccaccgcccuguucaacagcggcuucuggcugaagagaagcagcuacgaggagcagcccaccgugagauuccagcaccaggugcugcugguggcccugcugggccccgagagcgacggcuuccuggccuggagcaccuuccccgccuucaacagacugcagggcgacagacugagagugccccuggugagcaccagagaggaggacagaaaccaggacggcaagaccgacaugcugcacuucaagcuggagcugccccugcagagcaccgagcacgugcugggcgugcagcugauccugaccuucagcuacagacugcacagaauggccacccuggugaugcagagcauggccuuccugcagagcagcuuccccgugcccggcagccagcuguacgugaacggcgaccugagacugcagcagaagcagccccugagcugcggcggccuggacgccagauacaacaucagcgugaucaacggcaccagccccuucgccuacgacuacgaccugacccacaucguggccgccuaccaggagagaaacgugaccaccgugcugaacgaccccaaccccaucuggcuggugggcagagccgccgacgcccccuucgugaucaacgccaucaucagauaccccguggaggugaucagcuaccagcccggcuucugggagauggugaaguucgccugggugcaguacgugagcauccugcugaucuuccuguggguguucgagagaaucaagaucuucguguuccagaaccagguggugaccaccauccccgugaccgugacccccagaggcgaccugugcaaggagcaccugagcuaa

SEQ ID NO: 24768 - RNA, 330 nt, Artificial Sequence
  TMEM233__Homo_sapiens__NP_001130006
augagccaguacgcccccagccccgacuucaagagagcccuggacagcagccccgaggccaacaccgaggacgacaagaccgaggaggacgugcccaugcccaagaacuaccuguggcugaccaucgugagcugcuucugccccgccuaccccaucaacaucguggcccugguguucagcaucaugagccugaacagcuacaacgacggcgacuacgagggcgccagaagacugggcagaaacgccaaguggguggccaucgccagcaucaucaucggccugcugaucaucggcaucagcugcgccgugcacuucaccagaaacgccuaa

SEQ ID NO: 24769 - RNA, 1227 nt, Artificial Sequence
  TMEM237__Homo_sapiens__NP_001037850
augagaaccgacagcggcgccagacuggaggagggccaccugagaccccccagagcccugccccccgugcccagccaggacgacaucccccugagcagacccaagaagaagaagcccagaaccaagaacacccccgccagcgccagccuggagggccuggcccagaccgccggcagaagacccagcgagggcaacgagcccagcaccaaggagcugaaggagcaccccgaggcccccgugcagagaagacagaagaagaccagacugccccuggagcuggagaccagcagcacccagaagaagagcagcagcagcagccugcugagaaacgagaacggcaucgacgccgagcccgccgaggaggccgugauccagaagcccagaagaaagaccaagaagacccagcccgccgagcugcaguacgccaacgagcugggcguggaggacgaggacaucaucaccgacgagcagaccaccguggagcagcagagcguguucaccgcccccaccggcaucagccagcccgugggcaagguguucguggagaagagcagaagauuccaggccgccgacagaagcgagcugaucaagaccaccgagaacaucgacgugagcauggacgugaagcccagcuggaccaccagagacguggcccugaccgugcacagagccuucagaaugaucggccuguucagccacggcuuccuggccggcugcgccguguggaacaucguggugaucuacgugcuggccggcgaccagcugagcaaccugagcaaccugcugcagcaguacaagacccuggccuaccccuuccagagccugcuguaccugcugcuggcccugagcaccaucagcgccuucgacagaaucgacuucgccaagaucagcguggccaucagaaacuuccuggcccuggaccccaccgcccuggccagcuuccuguacuucaccgcccugauccugagccugagccagcagaugaccagcgacagaauccaccuguacacccccagcagcgugaacggcagccugugggaggccggcaucgaggagcagauccugcagcccuggaucguggugaaccuggugguggcccugcuggugggccugagcuggcuguuccugagcuacagacccggcauggaccugagcgaggagcugauguucagcagcgagguggaggaguaccccgacaaggagaaggagaucaaggccagcagcuaa

SEQ ID NO: 24770 - RNA, 891 nt, Artificial Sequence
  TMEM241__Homo_sapiens__NP_116322
augugcgugagaagaagccuggugggccugaccuucugcaccugcuaccuggccagcuaccugaccaacaaguacgugcugagcgugcugaaguucaccuaccccacccuguuccagggcuggcagacccugaucggcggccugcugcugcacgugagcuggaagcugggcuggguggagaucaacagcagcagcagaagccacgugcugguguggcugcccgccagcgugcuguucgugggcaucaucuacgccggcagcagagcccugagcagacuggccauccccguguuccugacccugcacaacguggccgaggugaucaucugcggcuaccagaagugcuuccagaaggagaagaccagccccgccaagaucugcagcgcccugcugcugcuggccgccgccggcugccugcccuucaacgacagccaguucaaccccgacggcuacuucugggccaucauccaccugcugugcgugggcgccuacaagauccugcagaagagccagaagcccagcgcccugagcgacaucgaccagcaguaccugaacuacaucuucagcguggugcugcuggccuucgccagccaccccaccggcgaccuguucagcgugcuggacuuccccuuccuguacuucuacagauuccacggcagcugcugcgccagcggcuuccugggcuucuuccugauguucagcaccgugaagcugaagaaccugcuggcccccggccagugcgccgccuggaucuucuucgccaagaucaucaccgccggccugagcauccugcuguucgacgccauccugaccagcgccaccaccggcugccugcugcugggcgcccugggcgaggcccugcugguguucagcgagagaaagagcagcuaa

SEQ ID NO: 24771 - RNA, 387 nt, Artificial Sequence
  TMEM244__Homo_sapiens__NP_001010876
auggcccugcaggugagaguggcccccagcaagguggugcugcagaaguuccugcugugcgugauccuguucuacaccguguacuacgugagccugagcaugggcugcgugauguucgaggugcacgagcugaacgugcuggcccccuucgacuucaagaccaaccccagcuggcugaacaucaacuacaaggugcugcuggugagcaccgaggugaccuacuucgugugcggccuguucuucgugcccgugguggaggagugggugugggacuacgccaucagcgugaccauccugcacguggccaucaccagcaccgugaugcuggaguucccccugaccagccacuggugggccgcccugggcaucagcaagcugcugguguaa

SEQ ID NO: 24772 - RNA, 2640 nt, Artificial Sequence
  TMEM245__Homo_sapiens__NP_114401
auggccgacggcggcggccccaaggacgcccccagccugagaagcagccccggccccgcccccagagugcccagagccgugggccccagcggcggcggcggcgagacccccagaaccgccgcccuggcccugagauucgacaagcccaucaagcaggccuucuacaacaccggcgccgugcuguucgugugccugugcugcggcgccgccgugcugguguacuucauccuggaggccuuccugagaccccugcugugggccgugcugugcggcaccuuccugcaccccuucaagagcagccugaccagacugggcagacacuggcugcagagacugcacagagcccacacccccaucgugcuggccgcccugcugcugccccugugcuucguggacuacggcguggaggcccugggcgagcaggcccugagaagaagaagacugcugcugcugcugggcgccggcggcccccugcuguacggccuguacugccugggcagcuaccugggcgugcaggugcugcuggugcacgccgccacccugaucugcagaggccuggacuacuucagcagccuguggaucuggacccugguggugggcuacgugcugaccgugagcuucaaguggaacgccagcaccgagagauaccugagagccgugagcauccccguguggaucauccugcuguuccaccuggccagccuggccggcagcuggagaauccccguguuccuggugaucguguuccugaugagcgugggcacccuguacgagaagcagaacggcaaggagagcagcggcgccgagcugcccggccaggugaucagcauggccgccagcacccuggccaaccuggccaucagcaucaccggcuacgagagcagcagcgaggaccagcccagcacccagcccgccgaggccguggacagaggcgagagcgcccccacccugagcaccagccccagccccagcagccccagccccaccagccccagccccacccugggcagaagaagacccgagaucggcaccuuccugagaaagaagaagaccagcgacaucuacuucgugagccuggugugggccaucguggugaugcagaucuggcugaaccuguggaucgugcagcugcugcccgugcccaucgccguguggauccugaagaagcuggugauccacuucggcgugguggacuuccuggagaagagauaccacgugugguggggcaucaucgagagcuuccugaaggagagacagggcgcccuggcccccuggcccaucgugggccugggcaaguuccugcugaagguggacagcaagcuguggcacuggcugaacaagaagaugaucaucuggcuggagaagaugcuggacaagaucaucagcaucuucaucaucuuccugcuggugaucggcacccugcugcuggcccugcugcugaccgccaaggugcaccaggagagcgugcacaugaucgaggugaccagcaaccugaucaacgagacccuggccaaccaccccgagugggccaacuggcugcccgaggcccagguggugcagagagcccugaacagcgccgccaacaacguguaccaguacggcagagaguggaucacccacaagcugcacaagauccugggcgacaaggugaacaacaccgccgugaucgagaagcaggugcuggagcugugggacagacuguaccacagcugguucgugaagaacgugacccacagcggcagacacaagggccagaagcugcacgugagcagacagaacagcuggcugggcgacauccuggacuggcaggacaucgugagcuucgugcacgagaacaucgagaccuuccugagcauccuggagagccuguggaucgugaugagcagaaacgugagccugcuguucaccaccgugaccacccugcugaccauccuguucuacagcggcaccgcccugcugaacuucgugcugagccugaucaucuuccugaccacccuguucuaccugcugagcagcagcgacgaguacuacaagcccgugaagugggugaucagccugaccccccugagccagcccggccccagcagcaacaucaucggccagagcguggaggaggccaucagaggcguguucgacgccagccugaagauggccggcuucuacggccuguacaccuggcugacccacaccauguucggcaucaacaucguguucauccccagcgcccuggccgccauccugggcgccgugcccuuccugggcaccuacugggccgccgugcccgccgugcuggaccuguggcugacccagggccugggcugcaaggccauccugcugcugaucuuccaccugcugcccaccuacuucguggacaccgccaucuacagcgacaucagcggcggcggccaccccuaccugaccggccuggccguggccggcggcgccuacuaccugggccuggagggcgccaucaucggccccauccugcugugcauccuggugguggccagcaacaucuacagcgccaugcuggugagccccaccaacagcgugcccacccccaaccagacccccuggcccgcccagccccagagaaccuucagagacaucagcgaggaccugaagagcagcgugggcuaa

SEQ ID NO: 24773 - RNA, 1863 nt, Artificial Sequence
  TMEM259__Homo_sapiens__NP_001028198
augagcgagcacguggagcccgccgcccccggccccggccccaacggcggcggcggcggccccgcccccgccagaggccccagaacccccaaccugaaccccaacccccugaucaacgugagagacagacuguuccacgcccuguucuucaagauggccgugaccuacagcagacuguucccccccgccuucagaagacuguucgaguucuucgugcugcugaaggcccuguucgugcuguucgugcuggccuacauccacaucguguucagcagaagccccaucaacugccuggagcacgugagagacaaguggcccagagagggcauccugagaguggaggugagacacaacagcagcagagcccccguguuccugcaguucugcgacagcggcggcagaggcagcuuccccggccuggccguggagcccggcagcaaccuggacauggaggacgaggaggaggaggagcugaccauggagauguucggcaacagcagcaucaaguucgagcuggacaucgagcccaagguguucaagccccccagcagcaccgaggcccugaacgacagccaggaguuccccuuccccgagacccccaccaagguguggccccaggacgaguacaucguggaguacagccuggaguacggcuuccugagacugagccaggccaccagacagagacugagcauccccgugaugguggugacccuggaccccaccagagaccagugcuucggcgacagauucagcagacugcugcuggacgaguuccugggcuacgacgacauccugaugagcagcgugaagggccuggccgagaacgaggagaacaagggcuuccugagaaacguggugagcggcgagcacuacagauucgugagcauguggauggccagaaccagcuaccuggccgccuucgccaucauggugaucuucacccugagcgugagcaugcugcugagauacagccaccaccagaucuucguguucaucguggaccugcugcagaugcuggagaugaacauggccaucgccuuccccgccgccccccugcugaccgugauccuggcccuggugggcauggaggccaucaugagcgaguucuucaacgacaccaccaccgccuucuacaucauccugaucguguggcuggccgaccaguacgacgccaucugcugccacaccagcaccagcaagagacacuggcugagauucuucuaccuguaccacuucgccuucuacgccuaccacuacagauucaacggccaguacagcagccuggcccuggugaccagcuggcuguucauccagcacagcaugaucuacuucuuccaccacuacgagcugcccgccauccugcagcaggugagaauccaggagaugcugcugcaggcccccccccugggccccggcacccccaccgcccugcccgacgacaugaacaacaacagcggcgcccccgccaccgcccccgacagcgccggccagccccccgcccugggccccgugagccccggcgccagcggcagccccggccccguggccgccgcccccagcagccugguggccgccgccgccagcguggccgccgccgccggcggcgaccugggcuggauggccgagaccgccgccaucaucaccgacgccagcuuccugagcggccugagcgccagccugcuggagagaagacccgccagcccccugggccccgccggcggccugccccacgccccccaggacagcgugccccccagcgacagcgccgccagcgacaccaccccccugggcgccgccgugggcggccccagccccgccagcauggcccccaccgaggcccccagcgaggugggcagcuaa

SEQ ID NO: 24774 - RNA, 969 nt, Artificial Sequence
  TMEM25__Homo_sapiens__NP_001137507
auggcccugccccccggccccgccgcccugagacacacccugcugcugcugcccgcccugcugagcagcggcuggggcgagcuggagccccagaucgacggccagaccugggccgagagagcccugagagagaacgagagacacgccuucaccugcagaguggccggcggccccggcacccccagacuggccugguaccuggacggccagcugcaggaggccagcaccagcagacugcugagcgugggcggcgaggccuucagcggcggcaccagcaccuucaccgugaccgcccacagagcccagcacgagcugaacugcagccugcaggaccccagaagcggcagaagcgccaacgccagcgugauccugaacgugcaguucaagcccgagaucgcccaggugggcgccaaguaccaggaggcccagggccccggccugcugguggugcuguucgcccuggugagagccaacccccccgccaacgugaccuggaucgaccaggacggccccgugaccgugaacaccagcgacuuccuggugcuggacgcccagaacuaccccuggcugaccaaccacaccgugcagcugcagcugagaagccuggcccacaaccugagcgugguggccaccaacgacgugggcgugaccagcgccagccugcccgcccccggccccagcagacaccccagccugaucagcagcgacagcaacaaccugaagcugaacaacgugagacugcccagagagaacaugagccugcccagcaaccugcagcugaacgaccugacccccgacagcagagccgugaagcccgccgacagacagauggcccagaacaacagcagacccgagcugcuggaccccgagcccggcggccugcugaccagccagggcuucaucagacugcccgugcugggcuacaucuacagagugagcagcgugagcagcgacgagaucuggcuguaa

SEQ ID NO: 24775 - RNA, 339 nt, Artificial Sequence
  TMEM261__Homo_sapiens__NP_219500
augggcagcagacugagccagcccuucgagagcuacaucaccgccccccccggcaccgccgccgcccccgccaagcccgccccccccgccacccccggcgcccccaccagccccgccgagcacagacugcugaagaccugcuggagcugcagagugcugagcggccugggccugaugggcgccggcggcuacguguacuggguggccagaaagcccaugaagaugggcuacccccccagccccuggaccaucacccagauggugaucggccugagcaucgccaccuggggcaucguggugauggccgaccccaagggcaaggccuacagagugguguaa

SEQ ID NO: 24776 - RNA, 669 nt, Artificial Sequence
  TMEM27__Homo_sapiens__NP_065716
augcuguggcugcuguucuuccuggugaccgccauccacgccgagcugugccagcccggcgccgagaacgccuucaaggugagacugagcaucagaaccgcccugggcgacaaggccuacgccugggacaccaacgaggaguaccuguucaaggccaugguggccuucagcaugagaaaggugcccaacagagaggccaccgagaucagccacgugcugcugugcaacgugacccagagagugagcuucugguucguggugaccgaccccagcaagaaccacacccugcccgccguggaggugcagagcgccaucagaaugaacaagaacagaaucaacaacgccuucuuccugaacgaccagacccuggaguuccugaagauccccagcacccuggccccccccauggaccccagcgugcccaucuggaucaucaucuucggcgugaucuucugcaucaucaucguggccaucgcccugcugauccugagcggcaucuggcagagaagaagaaagaacaaggagcccagcgagguggacgacgccgaggacaagugcgagaacaugaucaccaucgagaacggcauccccagcgacccccuggacaugaagggcggccacaucaacgacgccuucaugaccgaggacgagagacugaccccccuguaa

SEQ ID NO: 24777 - RNA, 3963 nt, Artificial Sequence
  TMEM2__Homo_sapiens__NP_001129292
auguacgccaccgacagcagaggccacagccccgccuuccugcagccccagaacggcaacagcagacaccccagcggcuacgugcccggcaagguggugccccugagacccccccccccccccaagagccaggccagcgccaaguucaccagcaucagaagagaggacagagccaccuucgccuucagccccgaggagcagcaggcccagagagagagccagaagcagaagagacacaagaacaccuucaucugcuucgccaucaccagcuucagcuucuucaucgcccuggccaucauccugggcaucagcagcaaguacgcccccgacgagaacugccccgaccagaaccccagacugagaaacugggaccccggccaggacagcgccaagcagguggugaucaaggagggcgacaugcugagacugaccagcgacgccaccgugcacagcaucgugauccaggacggcggccugcugguguucggcgacaacaaggacggcagcagaaacaucacccugagaacccacuacauccugauccaggacggcggcgcccugcacaucggcgccgagaagugcagauacaagagcaaggccaccaucacccuguacggcaagagcgacgagggcgagagcaugcccaccuucggcaagaaguucaucggcguggaggccggcggcacccuggagcugcacggcgccagaaaggccagcuggacccugcuggccagaacccugaacagcagcggccugcccuucggcagcuacaccuucgagaaggacuucagcagaggccugaacgugagagugaucgaccaggacaccgccaagauccuggagagcgagagauucgacacccacgaguacagaaacgagagcagaagacugcaggaguuccugagauuccaggaccccggcagaaucguggccaucgccgugggcgacagcgccgccaagagccugcugcagggcaccauccagaugauccaggagagacugggcagcgagcugauccagggccugggcuacagacaggccugggcccuggugggcgugaucgacggcggcagcaccagcugcaacgagagcgugagaaacuacgagaaccacagcagcggcggcaaggcccuggcccagagagaguucuacaccguggacggccagaaguucagcgugaccgccuacagcgaguggaucgaggagaccccccaguuccugcacaugggcgagaucaucgacggcguggacaugagagccgaggugggcauccugaccagaaacaucgugauccagggcgagguggaggacagcugcuacgccgagaaccagugccaguucuucgacuacgacaccuucggcggccacaucaugaucaugaagaacuucaccagcgugcaccugagcuacguggagcugaagcacaugggccagcagcagaugggcagauaccccgugcacuuccaccugugcggcgacguggacuacaagggcggcuacagacacgccaccuucguggacggccugagcauccaccacagcuucagcagaugcaucaccgugcacggcaccaacggccugcugaucaaggacaccaucggcuucgacacccugggccacugcuucuuccuggaggacggcaucgagcagagaaacacccuguuccacaaccugggccugcugaccaagcccggcacccugcugcccaccgacagaaacaacagcaugugcaccaccaugagagacaagguguucggcaacuacauccccgugcccgccaccgacugcauggccgugagcaccuucuggaucgcccaccccaacaacaaccugaucaacaacgccgccgccggcagccaggacgccggcaucugguaccuguuccacaaggagcccaccggcgagagcagcggccugcagcugcuggccaagcccgagcugaccccccugggcaucuucuacaacaacagagugcacagcaacuucaaggccggccuguucaucgacaagggcgugaagaccaccaacagcagcgccgccgaccccagagaguaccugugccuggacaacagcgccagauucagaccccaccaggacgccaaccccgagaagcccagaguggccgcccugaucgacagacugaucgccuucaagaacaacgacaacggcgccugggugagaggcggcgacaucaucgugcagaacagcgccuucgccgacaacggcaucggccugaccuucgccagcgacggcagcuuccccagcgacgagggcagcagccaggaggugagcgagagccuguucgugggcgagagcagaaacuacggcuuccagggcggccagaacaaguacgugggcaccggcggcaucgaccagaagcccagaacccugcccagaaacagaaccuuccccaucagaggcuuccagaucuacgacggccccauccaccugaccagaagcaccuucaagaaguacgugcccacccccgacagauacagcagcgccaucggcuuccugaugaagaacagcuggcagaucacccccagaaacaacaucagccuggugaaguucggcccccacgugagccugaacguguucuucggcaagcccggccccugguucgaggacugcgagauggacggcgacaagaacagcaucuuccacgacaucgacggcagcgugaccggcuacaaggacgccuacgugggcagaauggacaacuaccugaucagacaccccagcugcgugaacgugagcaaguggaacgccgugaucugcagcggcaccuacgcccagguguacgugcagaccuggagcacccagaaccugagcaugaccaucaccagagacgaguaccccagcaaccccauggugcugagaggcaucaaccagaaggccgccuucccccaguaccagcccguggugaugcuggagaagggcuacaccauccacuggaacggccccgcccccagaaccaccuuccuguaccuggugaacuucaacaagaacgacuggaucagagugggccugugcuaccccagcaacaccagcuuccaggugaccuucggcuaccugcagagacagaacggcagccugagcaagaucgaggaguacgagcccgugcacagccuggaggagcugcagagaaagcagagcgagagaaaguucuacuucgacagcagcaccggccugcuguuccuguaccugaaggccaagagccacagacacggccacagcuacugcagcagccagggcugcgagagagugaagauccaggccgccaccgacagcaaggacaucagcaacugcauggccaaggccuacccccaguacuacagaaagcccagcguggugaagagaaugcccgccaugcugaccggccugugccagggcugcggcaccagacaggugguguucaccagcgacccccacaagagcuaccugcccgugcaguuccagagccccgacaaggccgagacccagagaggcgaccccagcgugaucagcgugaacggcaccgacuucaccuucagaagcgccggcgugcugcugcuggugguggaccccugcagcgugcccuucagacugaccgagaagaccguguucccccuggccgacgugagcagaaucgaggaguaccugaagaccggcaucccccccagaagcaucgugcugcugagcaccagaggcgagaucaagcagcugaacaucagccaccugcuggugccccugggccuggccaagcccgcccaccuguacgacaagggcagcaccaucuuccugggcuucagcggcaacuucaagcccagcuggaccaagcuguucaccagccccgccggccagggccugggcgugcuggagcaguucaucccccugcagcuggacgaguacggcugccccagagccaccaccgugagaagaagagaccuggagcugcugaagcaggccagcaaggcccacuaa

SEQ ID NO: 24778 - RNA, 978 nt, Artificial Sequence
  TMEM30A__Homo_sapiens__NP_001137430
auggccaugaacuacaacgccaaggacgagguggacggcggcccccccugcgcccccggcggcaccgccaagaccagaagacccgacaacaccgccuucaagcagcagagacugcccgccuggcagcccauccugaccgccggcaccgugcugcccaucuucuucaucaucggccugaucuucauccccaucggcaucggcaucuucgugaccagcaacaacaucagagagaucgagggcaacguguucauguacuacggccugagcaacuucuaccagaaccacagaagauacgugaagagcagagacgacagccagcugaacggcgacagcagcgcccugcugaaccccagcaaggagugcgagcccuacagaagaaacgaggacaagcccaucgcccccugcggcgccaucgccaacagcauguucaacgacacccuggagcuguuccugaucggcaacgacagcuaccccauccccaucgcccugaagaagaagggcaucgccugguggaccgacaagaacgugaaguucagaaacccccccggcggcgacaaccuggaggagagauucaagggcaccaccaagcccgugaacuggcugaagcccguguacaugcuggacagcgaccccgacaacaacggcuucaucaacgaggacuucaucguguggaugagaaccgccgcccugcccaccuucagaaagcuguacagacugaucgagagaaagagcgaccugcaccccacccugcccgccggcagauacagccugaacgugaccuacaacuaccccgugcacuacuucgacggcagaaagagaaugauccugagcaccaucagcuggaugggcggcaagaaccccuuccugggcaucgccuacaucgccgugggcagcaucagcuuccugcugggcguggugcugcuggugaucaaccacaaguacagaaacagcagcaacaccgccgacaucaccaucuaa

SEQ ID NO: 24779 - RNA, 1056 nt, Artificial Sequence
  TMEM30B__Homo_sapiens__NP_001017970
augaccuggagcgccaccgccagaggcgcccaccagcccgacaacaccgccuucacccagcagagacugcccgccuggcagccccugcugagcgccagcaucgcccugccccuguucuucugcgccggccuggccuucaucggccugggccugggccuguacuacagcagcaacggcaucaaggagcuggaguacgacuacaccggcgaccccggcaccggcaacugcagcgugugcgccgccgccggccagggcagagcccugcccccccccugcagcugcgccugguacuucagccugcccgagcuguuccagggccccguguaccuguacuacgagcugaccaacuucuaccagaacaacagaagauacggcgugagcagagacgacgcccagcugagcggccugcccagcgcccugagacaccccgugaacgagugcgcccccuaccagagaagcgccgccggccugcccaucgcccccugcggcgccaucgccaacagccuguucaacgacagcuucagccuguggcaccagagacagcccggcggccccuacguggaggugccccuggacagaagcggcaucgccugguggaccgacuaccacgugaaguucagaaaccccccccuggugaacggcagccuggcccuggccuuccagggcaccgcccccccccccaacuggagaagacccguguacgagcugagccccgaccccaacaacaccggcuucaucaaccaggacuucgugguguggaugagaaccgccgcccugcccaccuucagaaagcuguacgccagaaucagacagggcaacuacagcgccggccugcccagaggcgccuacagagugaacaucaccuacaacuaccccgugagagccuucggcggccacaagcugcugaucuucagcagcaucagcuggaugggcggcaagaaccccuuccugggcaucgccuaccugguggugggcagccugugcauccugaccggcuucgugaugcuggugguguacaucagauaccaggaccaggacgacgacgacgaggaguaa

SEQ ID NO: 24780 - RNA, 573 nt, Artificial Sequence
  TMEM37__Homo_sapiens__NP_899063
augaccgccgugggcgugcaggcccagagaccccugggccagagacagcccagaagaagcuucuucgagagcuucaucagaacccugaucaucaccugcguggcccuggccguggugcugagcagcgugagcaucugcgacggccacuggcugcuggccgaggacagacuguucggccuguggcacuucugcaccaccaccaaccagaccaucugcuucagagaccugggccaggcccacgugcccggccuggccgugggcaugggccuggugagaagcgugggcgcccuggccgugguggccgccaucuucggccuggaguuccugauggugagccagcugugcgaggacaagcacagccagugcaagugggugaugggcagcauccugcugcuggugagcuucgugcugagcagcggcggccugcugggcuucgugauccugcugagaaaccaggugacccugaucggcuucacccugauguucuggugcgaguucaccgccagcuuccugcuguuccugaacgccaucagcggccugcacaucaacagcaucacccaccccugggaguaa

SEQ ID NO: 24781 - RNA, 900 nt, Artificial Sequence
  TMEM38A__Homo_sapiens__NP_076979
auggagcugcugagcgcccugagccugggcgagcuggcccugagcuucagcagagugccccuguuccccguguucgaccugagcuacuucaucgugagcauccuguaccugaaguacgagcccggcgccguggagcugagcagaagacaccccaucgccagcuggcugugcgccaugcugcacugcuucggcagcuacauccuggccgaccugcugcugggcgagccccugaucgacuacuucagcaacaacagcagcauccugcuggccagcgccgugugguaccugaucuucuucugcccccuggaccuguucuacaagugcgugugcuuccugcccgugaagcugaucuucguggccaugaaggagguggugagagugagaaagaucgccgugggcauccaccacgcccaccaccacuaccaccacggcugguucgugaugaucgccaccggcugggugaagggcagcggcguggcccugaugagcaacuucgagcagcugcugagaggcguguggaagcccgagaccaacgagauccugcacaugagcuuccccaccaaggccagccuguacggcgccauccuguucacccugcagcagaccagauggcugcccgugagcaaggccagccugaucuucaucuucacccuguucauggugagcugcaagguguuccugaccgccacccacagccacagcagccccuucgacgcccuggagggcuacaucugccccgugcuguucggcagcgccugcggcggcgaccaccaccacgacaaccacggcggcagccacagcggcggcggccccggcgcccagcacagcgccaugcccgccaagagcaaggaggagcugagcgagggcagcagaaagaagaaggccaagaaggccgacuaa

SEQ ID NO: 24782 - RNA, 876 nt, Artificial Sequence
  TMEM38B__Homo_sapiens__NP_060582
auggacagccccugggacgagcuggcccuggccuucagcagaaccagcauguuccccuucuucgacaucgcccacuaccuggugagcgugauggccgugaagagacagcccggcgccgccgcccuggccuggaagaaccccaucagcagcugguucaccgccaugcugcacugcuucggcggcggcauccugagcugccugcugcuggccgagcccccccugaaguuccuggccaaccacaccaacauccugcuggccagcagcaucugguacaucaccuucuucugcccccacgaccuggugagccagggcuacagcuaccugcccgugcagcugcuggccagcggcaugaaggaggugaccagaaccuggaagaucgugggcggcgugacccacgccaacagcuacuacaagaacggcuggaucgugaugaucgccaucggcugggccagaggcgccggcggcaccaucaucaccaacuucgagagacuggugaagggcgacuggaagcccgagggcgacgaguggcugaagaugagcuaccccgccaaggugacccugcugggcagcgugaucuucaccuuccagcacacccagcaccuggccaucagcaagcacaaccugauguuccuguacaccaucuucaucguggccaccaagaucaccaugaugaccacccagaccagcaccaugaccuucgcccccuucgaggacacccugagcuggaugcuguucggcuggcagcagcccuucagcagcugcgagaagaagagcgaggccaagagccccagcaacggcgugggcagccuggccagcaagcccguggacguggccagcgacaacgugaagaagaagcacaccaagaagaacgaguaa

SEQ ID NO: 24783 - RNA, 1467 nt, Artificial Sequence
  TMEM39A__Homo_sapiens__NP_060736
augcccggcggcagaagaggccccagcagacagcagcugagcagaagcgcccugcccagccugcagacccuggugggcggcggcugcggcaacggcaccggccugagaaacagaaacggcagcgccaucggccugcccgugccccccaucaccgcccugaucacccccggccccgugagacacugccagauccccgaccugcccguggacggcagccugcuguucgaguuccuguucuucaucuaccugcugguggcccuguucauccaguacaucaacaucuacaagaccguguggugguaccccuacaaccaccccgccagcugcaccagccugaacuuccaccugaucgacuaccaccuggccgccuucaucaccgugaugcuggccagaagacuggugugggcccugaucagcgaggccaccaaggccggcgccgccagcaugauccacuacauggugcugaucagcgccagacuggugcugcugacccugugcggcugggugcugugcuggacccuggugaaccuguucagaagccacagcgugcugaaccugcuguuccugggcuaccccuucggcguguacgugccccugugcugcuuccaccaggacagcagagcccaccugcugcugaccgacuacaacuacguggugcagcacgaggccguggaggagagcgccagcaccgugggcggccuggccaagagcaaggacuuccugagccugcugcuggagagccugaaggagcaguucaacaacgccacccccauccccacccacagcugcccccugagccccgaccugaucagaaacgagguggagugccugaaggccgacuucaaccacagaaucaaggaggugcuguucaacagccuguucagcgccuacuacguggccuuccugccccugugcuucgugaagagcacccaguacuacgacaugagauggagcugcgagcaccugaucaugguguggaucaacgccuucgugaugcugaccacccagcugcugcccagcaaguacugcgaccugcugcacaagagcgccgcccaccugggcaaguggcagaagcuggagcacggcagcuacagcaacgccccccagcacaucuggagcgagaacaccaucuggccccagggcgugcuggugagacacagcagaugccuguacagagccaugggccccuacaacguggccgugcccagcgacgugagccacgccagauucuacuuccuguuccacagaccccugagacugcugaaccugcugauccugaucgagggcagcgugguguucuaccagcuguacagccugcugagaagcgagaaguggaaccacacccugagcauggcccugauccuguucugcaacuacuacgugcuguucaagcugcugagagacagaaucgugcugggcagagccuacagcuacccccugaacagcuacgagcugaaggccaacuaa

SEQ ID NO: 24784 - RNA, 750 nt, Artificial Sequence
  TMEM40__Homo_sapiens__NP_001271335
auggccgaggccggcgccggcagccugagccugcccggcggcaaggccauggagaccagcgccagcagcagccagccccaggacaacagccaggugcacagagagaccgaggacguggacuacggcgagaccgacuuccacaagcaggacggcaaggccggccuguucagccaggagcaguacgagagaaacaagagcagcagcagcagcagcagcagcagcagcagcagcagcagcagcagcagcagcagcagcagcgagagcaacgacgaggaccagcagcccagagccaccggcaagcacagaagaagccugggcgccggcuacccccacggcaacggcagccccggccccggccacggcgagcccgacgugcugaaggacgagcugcagcuguacggcgacgcccccggcgagguggugcccagcggcgagagcggccugagaagaagaggcagcgaccccgccagcggcgagguggaggccagccagcugagaagacugaacaucaagaaggacgacgaguucuuccacuucgugcugcugugcuucgccaucggcgcccugcuggugugcuaccacuacuacgccgacugguucaugagccugggcgugggccugcugaccuucgccagccuggagaccgugggcaucuacuucggccugguguacagaauccacagcgugcugcagggcuucaucccccuguuccagaaguucagacugaccggcuucagaaagaccgacuaa

SEQ ID NO: 24785 - RNA, 1203 nt, Artificial Sequence
  TMEM43__Homo_sapiens__NP_077310
auggccgccaacuacagcagcaccagcaccagaagagagcacgugaaggugaagaccagcagccagcccggcuuccuggagagacugagcgagaccagcggcggcauguucgugggccugauggccuuccugcugagcuucuaccugaucuucaccaacgagggcagagcccugaagaccgccaccagccuggccgagggccugagccugguggugagccccgacagcauccacagcguggcccccgagaacgagggcagacuggugcacaucaucggcgcccugagaaccagcaagcugcugagcgaccccaacuacggcgugcaccugcccgccgugaagcugagaagacacguggagauguaccaguggguggagaccgaggagagcagagaguacaccgaggacggccaggugaagaaggagaccagauacagcuacaacaccgaguggagaagcgagaucaucaacagcaagaacuucgacagagagaucggccacaagaaccccagcgccauggccguggagagcuucauggccaccgcccccuucgugcagaucggcagauucuuccugagcagcggccugaucgacaagguggacaacuucaagagccugagccugagcaagcuggaggacccccacguggacaucaucagaagaggcgacuucuucuaccacagcgagaaccccaaguaccccgaggugggcgaccugagagugagcuucagcuacgccggccugagcggcgacgaccccgaccugggccccgcccacguggugaccgugaucgccagacagagaggcgaccagcuggugcccuucagcaccaagagcggcgacacccugcugcugcugcaccacggcgacuucagcgccgaggagguguuccacagagagcugagaagcaacagcaugaagaccuggggccugagagccgccggcuggauggccauguucaugggccugaaccugaugaccagaauccuguacacccugguggacugguuccccguguucagagaccuggugaacaucggccugaaggccuucgccuucugcguggccaccagccugacccugcugaccguggccgccggcuggcuguucuacagaccccugugggcccugcugaucgccggccuggcccuggugcccauccugguggccagaaccagagugcccgccaagaagcuggaguaa

SEQ ID NO: 24786 - RNA, 828 nt, Artificial Sequence
  TMEM45A__Homo_sapiens__NP_060474
augggcaacuucagaggccacgcccugcccggcaccuucuucuucaucaucggccugugguggugcaccaagagcauccugaaguacaucugcaagaagcagaagagaaccugcuaccugggcagcaagacccuguucuacagacuggagauccuggagggcaucaccaucgugggcauggcccugaccggcauggccggcgagcaguucauccccggcggcccccaccugaugcuguacgacuacaagcagggccacuggaaccagcugcugggcuggcaccacuucaccauguacuucuucuucggccugcugggcguggccgacauccugugcuucaccaucagcagccugcccgugagccugaccaagcugaugcugagcaacgcccuguucguggaggccuucaucuucuacaaccacacccacggcagagagaugcuggacaucuucgugcaccagcugcuggugcuggugguguuccugaccggccugguggccuuccuggaguuccuggugagaaacaacgugcugcuggagcugcugagaagcagccugauccugcugcagggcagcugguucuuccagaucggcuucgugcuguacccccccagcggcggccccgccugggaccugauggaccacgagaacauccuguuccugaccaucugcuucugcuggcacuacgccgugaccaucgugaucgugggcaugaacuacgccuucaucaccuggcuggugaagagcagacugaagagacugugcagcagcgaggugggccugcugaagaacgccgagagagagcaggagagcgaggaggagauguaa

SEQ ID NO: 24787 - RNA, 546 nt, Artificial Sequence
  TMEM47__Homo_sapiens__NP_113630
auggccagcgccggcagcggcauggaggaggugagagugagcgugcugaccccccugaagcuggugggccuggugugcaucuuccuggcccugugccuggaccugggcgccgugcugagccccgccugggugaccgccgaccaccaguacuaccugagccugugggagagcugcagaaagcccgccagccuggacaucuggcacugcgagagcacccugagcagcgacuggcagaucgccacccuggcccugcugcugggcggcgccgccaucauccugaucgccuuccuggugggccugaucagcaucugcgugggcagcagaagaagauucuacagacccguggccgugaugcuguucgccgccguggugcugcaggugugcagccuggugcuguaccccaucaaguucaucgagaccgugagccugaagaucuaccacgaguucaacuggggcuacggccuggccuggggcgccaccaucuucagcuucggcggcgccauccuguacugccugaaccccaagaacuacgaggacuacuacuaa

SEQ ID NO: 24788 - RNA, 477 nt, Artificial Sequence
  TMEM50B__Homo_sapiens__NP_006125
auggccggcuuccuggacaacuucagauggcccgagugcgagugcaucgacuggagcgagagaagaaacgccguggccagcgugguggccggcauccuguucuucaccggcugguggaucaugaucgacgccgccgugguguaccccaagcccgagcagcugaaccacgccuuccacaccugcggcguguucagcacccuggccuucuucaugaucaacgccgugagcaacgcccaggugagaggcgacagcuacgagagcggcugccugggcagaaccggcgccagaguguggcuguucaucggcuucaugcugauguucggcagccugaucgccagcauguggauccuguucggcgccuacgugacccagaacaccgacguguaccccggccuggccguguucuuccagaacgcccugaucuucuucagcacccugaucuacaaguucggcagaaccgaggagcuguggaccuaa

SEQ ID NO: 24789 - RNA, 774 nt, Artificial Sequence
  TMEM55A__Homo_sapiens__NP_061180
auggccgccgacggcguggacgagagaagcccccugcugagcgccagccacagcggcaacgugacccccaccgccccccccuaccugcaggagagcagccccagagccgagcugcccccccccuacaccgccaucgccagccccgacgccagcggcauccccgugaucaacugcagagugugccagagccugaucaaccuggacggcaagcugcaccagcacguggugaagugcaccgugugcaacgaggccacccccaucaagaacccccccaccggcaagaaguacgugagaugccccugcaacugccugcugaucugcaaggacaccagcagaagaaucggcugccccagacccaacugcagaagaaucaucaaccugggccccgugaugcugaucagcgaggagcagcccgcccagcccgcccugcccauccagcccgagggcaccagaguggugugcggccacugcggcaacaccuuccuguggauggagcugagauucaacacccuggccaagugcccccacugcaagaagaucagcagcgugggcagcgcccugcccagaagaagaugcugcgccuacaucaccaucggcaugaucugcaucuucaucggcgugggccugaccgugggcacccccgacuucgccagaagauucagagccaccuacgugagcugggccaucgccuaccugcugggccugaucugccugaucagagccugcuacuggggcgccaucagagugagcuaccccgagcacagcuucgccuaa

SEQ ID NO: 24790 - RNA, 1464 nt, Artificial Sequence
  TMEM57__Homo_sapiens__XP_011540006
augagacugagaaagcagaaggaggugcagaaggagaacgaguucuacaugcagcugcugcagcaggcccugccccccgagcagcagaugcugcagaagcaggagaaggaggccgaggaggccgccaagggccugcccgacauggacagcagcauccugauccaccacaacggcggcauccccgccaacaagaagcugagcaccacccugcccgagaucgaguacagagagaagggcaaggagaaggacaaggacgccaagaagcacaaccugggcaucaacaacaacaacauccugcagcccguggacagcaagauccaggagaucgaguacauggagaaccacaucaacagcaagagacugaacaacgaccuggugggcagcaccgagaaccugcugaaggaggacagcugcaccgccagcagcaagaacuacaagaacgccagcggcguggugaacagcagccccagaagccacagcgccaccaacggcagcauccccagcagcagcagcaagaacgagaagaagcagaagugcaccagcaagagccccagcacccacaaggaccugauggagaacugcauccccaacaaccagcugagcaagcccgacgcccuggugagacuggagcaggacaucaagaagcugaaggccgaccugcaggccagcagacagguggagcaggagcugagaagccagaucagcagccugagcagcaccgagagaggcaucagaagcgagaugggccagcugagacaggagaacgagcugcugcagaacaagcugcacaacgccgugcagaugaagcagaaggacaagcagaacaucagccagcuggagaagaagcugaaggccgagcaggaggccagaagcuucguggagaagcagcugauggaggagaagaagagaaagaagcuggaggaggccaccgccgccagagccguggccuucgccgccgccagcagaggcgagugcaccgagacccugagaaacagaaucagagagcuggaggccgagggcaagaagcugaccauggacaugaaggugaaggaggaccagaucagagagcuggagcugaaggugcaggagcugagaaaguacaaggagaacgagaaggacaccgaggugcugaugagcgcccugagcgccaugcaggacaagacccagcaccuggagaacagccugagcgccgagaccagaaucaagcuggaccuguucagcgcccugggcgacgccaagagacagcuggagaucgcccagggccagauccugcagaaggaccaggagaucaaggaccugaagcagaagaucgccgaggugauggccgugaugcccagcaucaccuacagcgccgccaccagcccccugagccccgugagcccccacuacagcagcaaguucguggagaccagccccagcggccuggaccccaacgccagcguguaccagccccugaagaaguaa

SEQ ID NO: 24791 - RNA, 1332 nt, Artificial Sequence
  TMEM5__Homo_sapiens__NP_055069
augagacugaccagaaagagacugugcagcuuccugaucgcccuguacugccuguucagccuguacgccgccuaccacguguucuucggcagaagaagacaggcccccgccggcagccccagaggccugagaaagggcgccgcccccgccagagagagaagaggcagagagcagagcacccuggagagcgaggaguggaaccccugggagggcgacgagaagaacgagcagcagcacagauucaagaccagccugcagauccuggacaagagcaccaagggcaagaccgaccugagcgugcagaucuggggcaaggccgccaucggccuguaccugugggagcacaucuucgagggccugcuggaccccagcgacgugaccgcccaguggagagagggcaagagcaucgugggcagaacccaguacagcuucaucaccggccccgccgugauccccggcuacuucagcguggacgugaacaacguggugcugauccugaacggcagagagaaggccaagaucuucuacgccacccaguggcugcuguacgcccagaaccuggugcagauccagaagcugcagcaccuggccguggugcugcugggcaacgagcacugcgacaacgaguggaucaaccccuuccugaagagaaacggcggcuucguggagcugcuguucaucaucuacgacagccccuggaucaacgacguggacguguuccaguggccccugggcguggccaccuacagaaacuuccccgugguggaggccagcuggagcaugcugcacgacgagagacccuaccugugcaacuuccugggcaccaucuacgagaacagcagcagacaggcccugaugaacauccugaagaaggacggcaacgacaagcugugcugggugagcgccagagagcacuggcagccccaggagaccaacgagagccugaagaacuaccaggacgcccugcugcagagcgaccugacccugugccccgugggcgugaacaccgagugcuacagaaucuacgaggccugcagcuacggcagcauccccgugguggaggacgugaugaccgccggcaacugcggcaacaccagcgugcaccacggcgccccccugcagcugcugaagagcaugggcgcccccuucaucuucaucaagaacuggaaggagcugcccgccgugcuggagaaggagaagaccaucauccugcaggagaagaucgagagaagaaagaugcugcugcagugguaccagcacuucaagaccgagcugaagaugaaguucaccaacauccuggagagcagcuuccugaugaacaacaagagcuaa

SEQ ID NO: 24792 - RNA, 402 nt, Artificial Sequence
  TMEM60__Homo_sapiens__NP_116325
augagaaugagccuggcccagagagugcugcugaccuggcuguucacccugcuguuccugaucaugcuggugcugaagcuggacgagaaggcccccuggaacugguuccugaucuucauccccguguggaucuucgacaccauccugcuggugcugcugaucgugaagauggccggcagaugcaagagcggcuucgaccccagacacggcagccacaacaucaagaagaaggccugguaccugaucgccaugcugcugaagcuggccuucugccuggcccugugcgccaagcuggagcaguucaccaccaugaaccugagcuacguguucaucccccugugggcccugcuggccggcgcccugaccgagcugggcuacaacguguucuucgugagagacuaa

SEQ ID NO: 24793 - RNA, 1932 nt, Artificial Sequence
  TMEM62__Homo_sapiens__NP_079232
auggccgccgugcuggcccugagagugguggccggccuggccgccgccgcccugguggccaugcugcuggagcacuacggccuggccggccagcccagcccccugcccagacccgccccccccagaagaccccaccccgcccccggccccggcgacagcaacaucuucuggggccugcagaucagcgacauccaccugagcagauucagagaccccggcagagccguggaccuggagaaguucugcagcgagaccaucgacaucauccagcccgcccuggugcuggccaccggcgaccugaccgacgccaagaccaaggagcagcugggcagcagacagcacgagguggaguggcagaccuaccagggcauccugaagaagaccagagugauggagaagaccaaguggcuggacaucaagggcaaccacgacgccuucaacauccccagccuggacagcaucaagaacuacuacagaaaguacagcgccgugagaagagacggcagcuuccacuacgugcacagcacccccuucggcaacuacagcuucaucugcguggacgccaccgugaaccccggccccaagagacccuacaacuucuucggcauccuggacaagaagaagauggaggagcugcugcugcuggccaaggagagcagcagaagcaaccacaccaucugguucggccacuucaccaccagcaccauccugagccccagccccggcaucagaagcaucaugagcagcgccaucgccuaccugugcggccaccugcacacccugggcggccugaugcccgugcugcacaccagacacuuccagggcacccuggagcuggaggugggcgacuggaaggacaacagaagauacagaaucuucgccuucgaccacgaccuguucagcuucgccgaccugaucuucggcaaguggcccguggugcugaucaccaaccccaagagccugcuguacagcugcggcgagcacgagccccuggagagacugcugcacagcacccacaucagagugcuggccuucagccugagcagcaucaccagcgugaccgugaagaucgacggcgugcaccugggccaggccgugcacgugagcggccccaucuucgugcugaaguggaaccccagaaacuacagcagcggcacccacaacaucgaggugaucgugcaggacagcgccggcagaagcaagagcgugcaccacaucuucagcgugcaggagaacaaccaccugagcuucgacccccuggccagcuucauccugagaaccgaccacuacaucauggccagagugcuguucgugcugaucgugcugagccagcugaccauccugaucaucuucagauacagaggcuaccccgagcugaaggagcccagcggcuucaucaaccugaccagcuucagccugcacgugcugagcaagaucaacaucuucuacuacagcgugcugcugcugacccuguacaccgugcugggccccugguucuucggcgagaucaucgacggcaaguucggcugcugcuucagcuucggcaucuucgugaacggccacuuccugcagggcagcaucaccuucaucaucggcauccugcagcuggccuucuucaacaucccccugauggccuacaugugcuggagccugcugcagagaugcuucggccacaacuucagaagccaccugcaccagagaaaguaccugaagaucaugcccgugcaccugcugaugcugcugcuguacaucuggcagguguacagcugcuacuuccuguacgccaccuacggcacccuggccuuccuguucagcccccugagaaccuggcugacccugcugacccccgugcugaucagauacguguggacccugaacagcaccaaguucggcaucuucauggugcagcugaagagccaccugagcagcuaa

SEQ ID NO: 24794 - RNA, 2424 nt, Artificial Sequence
  TMEM63A__Homo_sapiens__NP_055513
augauggacagccccuuccuggagcuguggcagagcaaggccgugagcaucagagagcagcugggccugggcgacagacccaacgacagcuacugcuacaacagcgccaagaacagcaccgugcugcagggcgugaccuucggcggcauccccaccgugcugcugaucgacgugagcugcuuccuguuccugauccugguguucagcaucaucagaagaagauucugggacuacggcagaaucgcccuggugagcgaggccgacagcgagagcagauuccagagacugagcagcaccagcagcagcggccagcaggacuucgagaacgagcugggcugcugccccuggcugaccgccaucuucagacugcacgacgaccagauccuggaguggugcggcgaggacgccauccacuaccugagcuuccagagacacaucaucuuccugcuggugguggugagcuuccugagccugugcgugauccugcccgugaaccugagcggcgaccugcuggacaaggaccccuacagcuucggcagaaccaccaucgccaaccugcagaccgacaacgaccugcuguggcugcacaccaucuucgccgugaucuaccuguuccugaccgugggcuucaugagacaccacacccagagcaucaaguacaaggaggagaaccuggugagaagaacccuguucaucaccggccugcccagagacgccagaaaggagaccguggagagccacuucagagacgccuaccccaccugcgaggugguggacgugcagcugugcuacaacguggccaagcugaucuaccugugcaaggagaagaagaagaccgagaagagccugaccuacuacaccaaccugcaggugaagaccggccagagaacccugaucaaccccaagcccugcggccaguucugcugcugcgaggugcugggcugcgagugggaggacgccaucagcuacuacaccagaaugaaggacagacugcuggagagaaucaccgaggaggagagacacgugcaggaccagccccugggcauggccuucgugaccuuccaggagaagagcauggccaccuacauccugaaggacuucaacgccugcaagugccagagccugcagugcaagggcgagccccagcccagcagccacagcagagagcuguacaccagcaaguggaccgugaccuucgccgccgaccccgaggacaucugcuggaagaaccugagcauccagggccugagaugguggcugcaguggcugggcaucaacuucacccuguuccugggccuguucuuccugaccacccccagcaucauccugagcaccauggacaaguucaacgugaccaagcccauccacgcccugaacaaccccaucaucagccaguucuuccccacccugcugcuguggagcuucagcgcccugcugcccagcaucguguacuacagcacccugcuggagagccacuggaccaagagcggcgagaaccagaucaugaugaccaagguguacaucuuccugaucuucauggugcugauccugcccagccugggccugaccagccuggacuucuucuucagauggcuguucgacaagaccagcagcgaggccagcaucagacuggagugcguguuccugcccgaccagggcgccuucuucgugaacuacgugaucgccagcgccuucaucggcaacggcauggagcugcugagacugcccggccugauccuguacaccuucagaaugaucauggccaagaccgccgccgacagaagaaacgugaagcagaaccaggccuuccaguacgaguucggcgccauguacgccuggaugcugugcguguucaccgugaucguggccuacagcaucaccugccccaucaucgcccccuucggccugaucuacauccugcugaagcacaugguggacagacacaaccuguacuucguguaccugcccgccaagcuggagaagggcauccacuucgccgccgugaaccaggcccuggccgcccccauccugugccuguucuggcuguacuucuucagcuuccugagacugggcaugaaggcccccgccacccuguucaccuuccuggugcugcugcugaccauccuggugugccuggcccacaccugcuucggcugcuucaagcaccugagcccccugaacuacaagaccgaggagcccgccagcgacaagggcagcgaggccgaggcccacaugcccccccccuucacccccuacgugcccagaauccugaacggccuggccagcgagagaaccgcccugagcccccagcagcagcagcagcagaccuacggcgccauccacaacaucagcggcaccauccccggccagugccuggcccagagcgccaccggcagcguggccgccgccccccaggaggccuaa

SEQ ID NO: 24795 - RNA, 2745 nt, Artificial Sequence
  TMEM67__Homo_sapiens__NP_001135773
augagccugagccacuggcccuacuucagacuggugcugaacuucagaccccaggugaucugccugccccagccccccaaggugcugggcuacagacuggagcccccccaccugacccuggccugcacccuggagggcauguacaacaucaucgaggagauccuggagagagacaucaacggcacccugcugagccaggccaccugcgagcugugcgacggcaacgagaacagcuucaugguggugaacgcccugggcgacagaugcgugagaugcgagcccaccuucgugaacaccagcagaagcugcgccugcagcgagcccaacauccugaccggcggccugugcuucagcagcaccggcaacuucccccugagaagaaucagcgccgccagauacggcgaggugggcaugagccugaccagcgagugguucgccaaguaccugcagagcagcgccgccgccugcuggguguacgccaaccugaccagcugccaggcccugggcaacaugugcgugaugaacaugaacagcuacgacuucgccaccuucgacgccugcggccuguuccaguucaucuucgagaacaccgccggccugagcaccgugcacagcaucagcuucuggagacagaaccugcccuggcuguucuacggcgaccagcugggccuggccccccaggugcugagcagcaccagccugcccaccaacuucagcuucaagggcgagaaccagaacaccaagcugaaguucguggccgccagcuacgacaucagaggcaacuuccugaaguggcagacccuggagggcggcgugcugcagcugugccccgacaccgagaccagacugaacgccgccuacagcuucggcaccaccuaccagcagaacugcgagauccccaucagcaagauccugaucgacuuccccacccccaucuucuacgacguguaccuggaguacaccgacgagaaccagcaccaguacauccuggccgugcccgugcugaaccugaaccugcagcacaacaagaucuucgugaaccaggacagcaacagcggcaaguggcugcugaccagaagaaucuuccugguggacgccgugagcggcagagagaacgaccugggcacccagcccagagugaucagaguggccacccagaucagccugagcgugcaccuggugcccaacaccaucaacggcaacaucuaccccccccugaucaccaucgccuacagcgacaucgacaucaaggacgccaacagccagagcgugaaggugagcuucagcgugaccuacgagauggaccacggcgaggcccacgugcagaccgacaucgcccugggcgugcugggcggccuggccgugcuggccagccugcugaagaccgccggcuggaagagaagaaucggcagccccaugaucgaccugcagaccguggugaaguuccugguguacuacgccggcgaccuggccaacguguucuucaucaucaccgugggcaccggccuguacuggcugaucuucuucaaggcccagaagagcgugagcgugcugcugcccaugcccauccaggaggagagauucgugaccuacgugggcugcgccuucgcccugaaggcccugcaguuccugcacaagcugaucagccagaucaccaucgacguguucuucaucgacugggagagacccaagggcaaggugcugaaggccguggagggcgagggcggcgugagaagcgccaccgugcccgugagcaucuggagaaccuacuucguggccaacgaguggaacgagauccagaccgugagaaagaucaacagccuguuccaggugcugaccgugcuguucuuccuggagguggugggcuucaagaaccuggcccugauggacagcagcagcagccugagcagaaacccccccagcuacaucgcccccuacagcugcauccugagauacgccgugagcgccgcccuguggcuggccaucggcaucauccaggugguguucuucgccguguucuacgagagauucaucgaggacaagaucagacaguucguggaccugugcagcaugagcaacaucagcguguuccugcugagccacaagugcuucggcuacuacauccacggcagaagcgugcacggccacgccgacaccaacauggaggagaugaacaugaaccugaagagagaggccgagaaccugugcagccagagaggccuggugcccaacaccgacggccagaccuucgagaucgccaucagcaaccagaugagacagcacuacgacagaauccacgagacccugaucagaaagaacggccccgccagacugcugagcagcagcgccagcaccuucgagcagagcaucaaggccuaccacaugaugaacaaguuccugggcagcuucaucgaccacgugcacaaggagauggacuacuucaucaaggacaagcugcugcuggagagaauccugggcauggaguucauggagcccauggagaagagcaucuucuacaacgacgagggcuacagcuucagcagcgugcuguacuacggcaacgaggccacccugcugaucuucgaccugcuguucuucugcgugguggaccuggccugccagaacuucauccuggccagcuuccugaccuaccugcagcaggagaucuucagauacaucagaaacaccgugggccagaagaaccuggccagcaagacccugguggaccagagauuccugaucuaa

SEQ ID NO: 24796 - RNA, 324 nt, Artificial Sequence
  TMEM70__Homo_sapiens__NP_001035703
augcuguuccuggcccugggcagccccugggccguggagcugccccugugcggcagaagaaccgcccugugcgccgccgccgcccugagaggccccagagccagcgugagcagagccagcagcagcagcggccccagcggccccguggccggcuggagcaccggccccagcggcgccgccagacugcugagaagacccggcagagcccagauccccguguacugggagggcuacgugagauuccugaacacccccagcgacaagagcgaggacggcagacugaucuacaccggcaacauggccagagccguguucggcaaguaa

SEQ ID NO: 24797 - RNA, 771 nt, Artificial Sequence
  TMEM74B__Homo_sapiens__NP_001291677
augccccccgcccagggcuacgaguucgccgccgccaagggccccagagacgagcugggccccagcuuccccauggccagcccccccggccuggagcugaagacccugagcaacggcccccaggcccccagaagaagcgccccccugggccccguggcccccaccagagagggcguggagaacgccugcuucagcagcgaggagcacgagacccacuuccagaaccccggcaacaccagacugggcagcagccccagcccccccggcggcgugagcagccugcccagaagccagagagacgaccugagccugcacagcgaggagggccccgcccuggagcccgugagcagacccguggacuacggcuucgugagcgcccugguguuccuggugagcggcauccugcugguggugaccgccuacgccauccccagagaggccagagugaaccccgacaccgugaccgccagagagauggagagacuggagauguacuacgccagacugggcagccaccuggacagaugcaucaucgccggccugggccugcugaccgugggcggcaugcugcugagcgugcugcugauggugagccugugcaagggcgagcuguacagaagaagaaccuucgugcccggcaagggcagcagaaagaccuacggcagcaucaaccugagaaugagacagcugaacggcgacggcggccaggcccugguggagaacgagguggugcaggugagcgagaccagccacacccugcagagaagcuaa

SEQ ID NO: 24798 - RNA, 1185 nt, Artificial Sequence
  TMEM79__Homo_sapiens__NP_115699
augaccgagcaggagacccuggcccugcuggaggugaagagaagcgacagccccgagaagagcagcccccaggcccuggugcccaacggcagacagcccgagggcgagggcggcgccgagagccccggcgccgagagccugagagugggcagcagcgccggcagccccaccgccaucgagggcgccgaggacggccuggacagcaccgugagcgaggccgccacccugcccuggggcaccggcccccagcccagcgcccccuuccccgacccccccggcuggagagacaucgagcccgagccccccgagagcgagccccugaccaagcuggaggagcugcccgaggacgacgccaaccugcugcccgagaaggccgccagagccuucgugcccaucgaccugcagugcaucgagagacagccccaggaggaccugaucgugagaugcgaggccggcgagggcgagugcagaaccuucaugccccccagagugacccaccccgaccccaccgagagaaagugggccgaggccguggugagaccccccggcugcagcugcggcggcugcggcagcugcggcgacagagaguggcugagagccguggccagcgugggcgccgcccugauccuguuccccugccugcuguacggcgccuacgccuuccugcccuucgacgugcccagacugcccaccaugagcagcagacugaucuacacccugagaugcggcguguucgccaccuuccccaucgugcugggcauccugguguacggccugagccugcugugcuucagcgcccugagacccuucggcgagcccagaagagagguggagauccacagaagauacguggcccagagcgugcagcuguucauccuguacuucuucaaccuggccgugcugagcaccuaccugccccaggacacccugaagcugcugccccugcugaccggccuguucgccgugagcagacugaucuacuggcugaccuucgccgugggcagaagcuucagaggcuucggcuacggccugaccuuccugccccugcugagcaugcugauguggaaccuguacuacauguucgugguggagcccgagagaaugcugaccgccaccgagagcagacuggacuaccccgaccacgccagaagcgccagcgacuacagacccagacccuggggcuaa

SEQ ID NO: 24799 - RNA, 546 nt, Artificial Sequence
  TMEM87A__Homo_sapiens__NP_001103973
auggccgccgccgccuggcugcaggugcugcccgugauccugcugcugcugggcgcccaccccagcccccugagcuucuucagcgccggccccgccaccguggccgccgccgacagaagcaaguggcacauccccauccccagcggcaagaacuacuucagcuucggcaagauccuguucagaaacaccaccaucuuccugaaguucgacggcgagcccugcgaccugagccugaacaucaccugguaccugaagagcgccgacugcuacaacgagaucuacaacuucaaggccgaggagguggagcuguaccuggagaagcugaaggagaagagaggccugagcggcaaguaccagaccagcagcaagcuguuccagaacugcagcgagcuguucaagacccagaccuucagcggcgacuucaugcacagacugccccugcugggcgagaagcaggaggccaaggagaacggcaccaaccugaccuucaucggcgacaagaccauccagaugcccuuccugaagaagcacuuccuggacugcuaa

SEQ ID NO: 24800 - RNA, 480 nt, Artificial Sequence
  TMEM88__Homo_sapiens__NP_981956
auggccgacgugcccggcgcccagagagccgugcccggcgacggccccgagcccagagacccccuggacugcugggccugcgccgugcuggugaccgcccagaaccugcugguggccgccuucaaccugcugcugcuggugcuggugcugggcaccauccugcugcccgccgugaccaugcugggcuucggcuuccugugccacagccaguuccugagaagccaggccccccccugcaccgcccaccugagagaccccggcuucaccgcccugcuggugaccggcuuccugcugcuggugccccugcuggugcuggcccuggccagcuacagaagacugugccugagacugagacuggccgacugccuggugcccuacagcagagcccuguacagaagaagaagagccccccagcccagacagaucagagccagccccggcagccaggccgugcccaccagcggcaagguguggguguaa

SEQ ID NO: 24801 - RNA, 480 nt, Artificial Sequence
  TMEM89__Homo_sapiens__NP_001008270
augcugcacgugcuggccagccugccccugcugcugcugcuggugaccagcgccagcacccacgccuggagcagaccccugugguaccaggugggccuggaccugcagcccuggggcugccagcccaagagcguggagggcugcagaggcggccugagcugccccggcuacuggcugggccccggcgccagcagaaucuaccccguggccgccgugaugaucaccaccaccaugcugaugaucugcagaaagauccugcagggcagaagaagaagccaggccaccaagggcgagcacccccaggugaccaccgagcccugcggccccuggaagagaagagcccccaucagcgaccacacccugcugagaggcgugcugcacaugcuggacgcccugcuggugcacaucgagggccaccugagacaccuggccacccagagacagauccagaucaagggcaccagcacccagagcggcuaa

SEQ ID NO: 24802 - RNA, 1419 nt, Artificial Sequence
  TMEM8B__Homo_sapiens__NP_001036055
augaacaugccccagagccugggcaaccagccccugccccccgagccccccagccugggcacccccgccgagggccccggcaccaccagcccccccgagcacugcuggcccgugagacccacccugagaaacgagcuggacaccuucagcgugcacuucuacaucuucuucggccccagcguggcccugccccccgagagacccgccguguucgccaugagacugcugcccgugcuggacagcggcggcgugcugagccuggagcugcagcugaacgccagcagcgugagacaggagaacgugaccguguucggcugccugacccacgaggugccccugagccugggcgacgccgccgugaccugcagcaaggagagccuggccggcuuccugcugagcgugagcgccaccaccagaguggccagacugagaauccccuucccccagaccggcaccugguuccuggcccugagaagccugugcggcgugggccccagauucgugagaugcagaaacgccaccgccgaggugagaaugagaaccuuccugagccccugcguggacgacugcggccccuacggccagugcaagcugcugagaacccacaacuaccuguacgccgccugcgagugcaaggccggcuggagaggcuggggcugcaccgacagcgccgacgcccugaccuacggcuuccagcugcugagcacccugcugcugugccugagcaaccugauguuccugccccccguggugcuggccaucagaagcagauacgugcuggaggccgccguguacaccuucaccauguucuucagcaccuucuaccacgccugcgaccagcccggcaucgugguguucugcaucauggacuacgacgugcugcaguucugcgacuuccugggcagccugaugagcgugugggugaccgugaucgccauggccagacugcagcccguggugaagcaggugcuguaccugcugggcgccaugcugcugagcauggcccugcagcuggacagacacggccuguggaaccugcugggccccagccuguucgcccugggcauccuggccaccgccuggaccgugagaagcgugagaagaagacacugcuacccccccaccuggagaagauggcuguucuaccugugccccggcagccugaucgccggcagcgccgugcugcuguacgccuucguggagaccagagacaacuacuucuacauccacagcaucuggcacaugcugaucgccggcagcgugggcuuccugcugccccccagagccaagaccgaccacggcgugcccagcggcgccagagccagaggcugcggcuaccagcugugcaucaacgagcaggaggagcugggccuggugggccccggcggcgccaccgugagcagcaucugcgccagcuaa

SEQ ID NO: 24803 - RNA, 531 nt, Artificial Sequence
  TMEM95__Homo_sapiens__NP_001307365
auguggagacuggcccugggcggcguguuccuggccgccgcccaggccugcguguucugcagacugcccgcccacgaccugagcggcagacuggccagacugugcagccagauggaggccagacagaaggagugcggcgccagccccgacuucagcgccuucgcccuggacgaggugagcaugaacaaggugaccgagaagacccacagagugcugagagugauggagaucaaggaggccgugagcagccugcccagcuacuggagcuggcugagaaagaccaagcugcccgaguacaccagagaggcccugugcccccccgccugcagaggcagcaccacccuguacaacugcagcaccugcaagggcaccgaggugagcugcuggcccagaaagagaugcuuccccggcagccaggaccugugggaggccaagauccugcugcugagcaucuucggcgccuuccugcugcugggcgugcugagccugcugguggagagccaccaccugcaggccaagagcggccuguaa

SEQ ID NO: 24804 - RNA, 531 nt, Artificial Sequence
  TMEM97__Homo_sapiens__NP_055388
augggcgcccccgccaccagaagaugcguggaguggcugcugggccuguacuuccugagccacauccccaucacccuguucauggaccugcaggccgugcugcccagagagcuguaccccguggaguucagaaaccugcugaagugguacgccaaggaguucaaggacccccugcugcaggagccccccgccugguucaagagcuuccuguucugcgagcugguguuccagcugcccuucuuccccaucgccaccuacgccuuccugaagggcagcugcaaguggaucagaacccccgccaucaucuacagcgugcacaccaugaccacccugauccccauccugagcaccuuccuguucgaggacuucagcaaggccagcggcuucaagggccagagacccgagacccugcacgagagacugacccuggugagcguguacgcccccuaccugcugauccccuucauccugcugaucuucaugcugagaagccccuacuacaaguacgaggagaagagaaagaagaaguaa

SEQ ID NO: 24805 - RNA, 681 nt, Artificial Sequence
  TMEM98__Homo_sapiens__NP_001288675
auggagaccguggugaucguggccaucggcgugcuggccaccaucuuccuggccagcuucgccgcccuggugcuggugugcagacagagauacugcagacccagagaccugcugcagagauacgacagcaagcccaucguggaccugaucggcgccauggagacccagagcgagcccagcgagcuggagcuggacgacguggugaucaccaacccccacaucgaggccauccuggagaacgaggacuggaucgaggacgccagcggccugaugagccacugcaucgccauccugaagaucugccacacccugaccgagaagcugguggccaugaccaugggcagcggcgccaagaugaagaccagcgccagcgugagcgacaucaucgugguggccaagagaaucagccccagaguggacgacguggugaagagcauguaccccccccuggaccccaagcugcuggacgccagaaccaccgcccugcugcugagcgugagccaccuggugcuggugaccagaaacgccugccaccugaccggcggccuggacuggaucgaccagagccugagcgccgccgaggagcaccuggaggugcugagagaggccgcccuggccagcgagcccgacaagggccugcccggccccgagggcuuccugcaggagcagagcgccaucuaa

SEQ ID NO: 24806 - RNA, 3282 nt, Artificial Sequence
  TMF1__Homo_sapiens__NP_009045
augagcugguucaacgccagccagcugagcagcuucgccaagcaggcccugagccaggcccagaagagcaucgacagagugcuggacauccaggaggaggagcccagcaucugggccgagaccauccccuacggcgagcccggcaucagcagccccgugagcggcggcugggacaccagcaccuggggccugaagagcaacaccgagccccagagcccccccaucgccagccccaaggccaucaccaagcccgugagaagaaccgugguggacgagagcgagaacuucuucagcgccuuccugagccccaccgacgugcagaccauccagaagagccccguggugagcaagccccccgccaagagccagagacccgaggaggaggugaagagcagccugcacgagagccugcacaucggccagagcagaacccccgagaccaccgagagccaggugaaggacagcagccugugcgugagcggcgagacccuggccgccggcaccagcagccccaagaccgagggcaagcacgaggagaccgugaacaaggagagcgacaugaaggugcccaccgugagccugaaggugagcgagagcgugaucgacgugaagaccaccauggagagcaucagcaacaccagcacccagagccugaccgccgagaccaaggacaucgcccuggagcccaaggagcagaagcacgaggacagacagagcaacacccccagcccccccgugagcaccuucagcagcggcaccagcaccaccagcgacaucgaggugcuggaccacgagagcgugaucagcgagagcagcgccagcagcagacaggagaccaccgacagcaagagcagccugcaccugaugcagaccagcuuccagcugcugagcgccagcgccugccccgaguacaacagacuggacgacuuccagaagcugaccgagagcugcugcagcagcgacgccuucgagagaaucgacagcuucagcgugcagagccuggacagcagaagcgugagcgagaucaacagcgacgacgagcugagcggcaagggcuacgcccuggugcccaucaucgugaacagcagcacccccaagagcaagaccguggagagcgccgagggcaagagcgaggaggugaacgagacccuggugauccccaccgaggaggccgagauggaggagagcggcagaagcgccacccccgugaacugcgagcagcccgacauccuggugagcagcacccccaucaacgagggccagaccgugcuggacaagguggccgagcagugcgagcccgccgagagccagcccgaggcccugagcgagaaggaggacgugugcaagaccguggaguuccugaacgagaagcuggagaagagagaggcccagcugcugagccugagcaaggagaaggcccugcuggaggaggccuucgacaaccugaaggacgagauguucagagugaaggaggagagcagcagcaucagcagccugaaggacgaguucacccagagaaucgccgaggccgagaagaaggugcagcuggccugcaaggagagagacgccgccaagaaggagaucaagaacaucaaggaggagcuggccaccagacugaacagcagcgagaccgccgaccugcugaaggagaaggacgagcagaucagaggccugauggaggagggcgagaagcugagcaagcagcagcugcacaacagcaacaucaucaagaagcugagagccaaggacaaggagaacgagaacaugguggccaagcugaacaagaaggugaaggagcuggaggaggagcugcagcaccugaagcaggugcuggacggcaaggaggagguggagaagcagcacagagagaacaucaagaagcugaacagcaugguggagagacaggagaaggaccugggcagacugcagguggacauggacgagcuggaggagaagaacagaagcauccaggccgcccuggacagcgccuacaaggagcugaccgaccugcacaaggccaacgccgccaaggacagcgaggcccaggaggccgcccugagcagagagaugaaggccaaggaggagcugagcgccgcccuggagaaggcccaggaggaggccagacagcagcaggagacccuggccauccaggugggcgaccugagacuggcccugcagagaaccgagcaggccgccgccagaaaggaggacuaccugagacacgagaucggcgagcugcagcagagacugcaggaggccgagaacagaaaccaggagcugagccagagcgugagcagcaccaccagaccccugcugagacagaucgagaaccugcaggccacccugggcagccagaccagcagcugggagaagcuggagaagaaccugagcgacagacugggcgagagccagacccugcuggccgccgccguggagagagagagagccgccaccgaggagcugcuggccaacaagauccagaugagcagcauggagagccagaacagccugcugagacaggagaacagcagauuccaggcccagcuggagagcgagaagaacagacugugcaagcuggaggacgagaacaacagauaccagguggagcuggagaaccugaaggacgaguacgugagaacccuggaggagaccagaaaggagaagacccugcugaacagccagcuggagauggagagaaugaagguggagcaggagagaaagaaggccaucuucacccaggagaccaucaaggagaaggagagaaagcccuucagcgugagcagcacccccaccaugagcagaagcagcagcaucagcggcguggacauggccggccugcagaccagcuuccugagccaggacgagagccacgaccacagcuucggccccaugcccaucagcgccaacggcagcaaccuguacgacgccgugagaaugggcgccggcagcagcaucaucgagaaccugcagagccagcugaagcugagagagggcgagaucacccaccugcagcuggagaucggcaaccuggagaagaccagaagcaucauggccgaggagcuggugaagcugaccaaccagaacgacgagcuggaggagaaggugaaggagauccccaagcugagaacccagcugagagaccuggaccagagauacaacaccauccugcagauguacggcgagaaggccgaggaggccgaggagcugagacuggaccuggaggacgugaagaacauguacaagacccagaucgacgagcugcugagacagagccugagcuaa

SEQ ID NO: 24807 - RNA, 471 nt, Artificial Sequence
  TMIE__Homo_sapiens__NP_671729
auggccggcuggcccggcgccggcccccugugcgugcugggcggcgccgcccugggcgugugccuggccggcguggccggccagcugguggagcccagcaccgccccccccaagcccaagccccccccccugaccaaggagaccgugguguucugggacaugagacuguggcacguggugggcaucuucagccuguucgugcugagcaucaucaucacccugugcugcguguucaacugcagagugcccagaaccagaaaggagaucgaggccagauaccugcagagaaaggccgccaagauguacaccgacaagcuggagaccgugcccccccugaacgagcugaccgaggugcccggcgaggacaagaagaagaagaagaagaagaagaaggacagcguggacaccguggccaucaagguggaggaggacgagaagaacgaggccaagaagaagaagggcgagaaguaa

SEQ ID NO: 24808 - RNA, 849 nt, Artificial Sequence
  TMIGD2__Homo_sapiens__NP_653216
augggcagccccggcauggugcugggccugcuggugcagaucugggcccugcaggaggccagcagccugagcgugcagcagggccccaaccugcugcaggugagacagggcagccaggccacccuggugugccagguggaccaggccaccgccugggagagacugagagugaaguggaccaaggacggcgccauccugugccagcccuacaucaccaacggcagccugagccugggcgugugcggcccccagggcagacugagcuggcaggcccccagccaccugacccugcagcuggaccccgugagccugaaccacagcggcgccuacgugugcugggccgccguggagauccccgagcuggaggaggccgagggcaacaucaccagacuguucguggaccccgacgaccccacccagaacagaaacagaaucgccagcuuccccggcuuccuguucgugcugcugggcgugggcagcaugggcguggccgccaucguguggggcgccugguucuggggcagaagaagcugccagcagagagacagcggcaacagccccggcaacgccuucuacagcaacgugcuguacagacccagaggcgcccccaagaagagcgaggacugcagcggcgagggcaaggaccagagaggccagagcaucuacagcaccagcuucccccagcccgcccccagacagccccaccuggccagcagacccugccccagccccagacccugccccagccccagacccggccaccccgugagcauggugagagugagccccagacccagccccacccagcagcccagacccaagggcuuccccaaggugggcgaggaguaa

SEQ ID NO: 24809 - RNA, 537 nt, Artificial Sequence
  TMIGD3__Homo_sapiens__NP_001289609
auggagggcagccccgccggccccaucgagcagaaggaggccagaugggagagcagcugggaggagcagcccgacuggacccugggcugccugagccccgagagccacaccaaccacguggcccugagagacaccggcaaccagcugaucgugaccaugagcugccugaccaaggaggacaccggcugguacuggugcggcauccagagagacuucgccagagacgacauggacuucaccgagcugaucgugaccgacgacaagggcacccuggccaacgacuucuggagcggcaaggaccugagcggcaacaagaccagaagcugcaaggcccccaagguggugagaaaggccgacagaagcagaaccagcauccugaucaucugcauccugaucaccggccugggcaucaucagcgugaucagccaccugaccaagagaagaagaagccagagaaacagaagagugggcaacacccugaagcccuucagcagagugcugacccccaaggagauggcccccaccgagcagauguaa

SEQ ID NO: 24810 - RNA, 1131 nt, Artificial Sequence
  TMLHE__Homo_sapiens__NP_001171726
augugguaccacagacugagccaccugcacagcagacugcaggaccugcugaagggcggcgugaucuaccccgcccugccccagcccaacuucaagagccugcugccccuggccgugcacuggcaccacaccgccagcaagagccugaccugcgccuggcagcagcacgaggaccacuucgagcugaaguacgccaacaccgugaugagauucgacuacguguggcugagagaccacugcagaagcgccagcugcuacaacagcaagacccaccagagaagccuggacaccgccagcguggaccugugcaucaagcccaagaccaucagacuggacgagaccacccuguucuucaccuggcccgacggccacgugaccaaguacgaccugaacuggcuggugaagaacagcuacgagggccagaagcagaaggugauccagcccagaauccuguggaacgccgagaucuaccagcaggcccaggugcccagcguggacugccagagcuuccuggagaccaacgagggccugaagaaguuccugcagaacuuccugcuguacggcaucgccuucguggagaacgugccccccacccaggagcacaccgagaagcuggccgagagaaucagccugaucagagagaccaucuacggcagaaugugguacuucaccagcgacuucagcagaggcgacaccgccuacaccaagcuggcccuggacagacacaccgacaccaccuacuuccaggagcccugcggcauccagguguuccacugccugaagcacgagggcaccggcggcagaacccugcugguggacggcuucuacgccgccgagcaggugcugcagaaggcccccgaggaguucgagcugcugagcaaggugccccugaagcacgaguacaucgaggacgugggcgagugccacaaccacaugaucggcaucggccccgugcugaacaucuaccccuggaacaaggagcuguaccugaucagacuguucaaggagaagcagaacaccgugaacagacaguggaacagcagccugcagugcgacauccccgagagaauccugaccuacagacacuucgugagcggcaccagcaucgagcacagaggcagccugaucuaa

SEQ ID NO: 24811 - RNA, 1080 nt, Artificial Sequence
  TMOD1__Homo_sapiens__NP_001159588
augagcuacagaagagagcuggagaaguacagagaccuggacgaggacgagauccugggcgcccugaccgaggaggagcugagaacccuggagaacgagcuggacgagcuggaccccgacaacgcccugcugcccgccggccugagacagaaggaccagaccaccaaggcccccaccggccccuucaagagagaggagcugcuggaccaccuggagaagcaggccaaggaguucaaggacagagaggaccuggugcccuacaccggcgagaagagaggcaaggugugggugcccaagcagaagccccuggaccccgugcuggagagcgugacccuggagcccgagcuggaggaggcccuggccaacgccagcgacgccgagcugugcgacaucgccgccauccugggcaugcacacccugaugagcaaccagcaguacuaccaggcccugagcagcagcagcaucaugaacaaggagggccugaacagcgugaucaagcccacccaguacaagcccgugcccgacgaggagcccaacagcaccgacguggaggagacccuggagagaaucaagaacaacgaccccaagcuggaggaggugaaccugaacaacaucagaaacauccccauccccacccugaaggccuacgccgaggcccugaaggagaacagcuacgugaagaaguucagcaucgugggcaccagaagcaacgaccccguggccuacgcccuggccgagaugcugaaggagaacaaggugcugaagacccugaacguggagagcaacuucaucagcggcgccggcauccugagacugguggaggcccugcccuacaacaccagccugguggagaugaagaucgacaaccagagccagccccugggcaacaagguggagauggagaucgugagcaugcuggagaagaacgccacccugcugaaguucggcuaccacuucacccagcagggccccagacugagagccagcaacgccaugaugaacaacaacgaccuggugagaaagagaagacuggccgaccugaccggccccaucauccccaagugcagaagcggcguguaa

SEQ ID NO: 24812 - RNA, 948 nt, Artificial Sequence
  TMOD2__Homo_sapiens__NP_001136357
auggcccugcccuuccagaaggagcuggagaaguacaagaacaucgacgaggacgagcugcugggcaagcugagcgaggaggagcugaagcagcuggagaacgugcuggacgaccuggaccccgagagcgccaugcugcccgccggcuucagacagaaggaccagacccagaaggccgccaccggccccuucgacagagagcaccugcugauguaccuggagaaggaggcccuggagcagaaggacagagaggacuucgugcccuucaccggcgagaagaagggcagaguguucauccccaaggagaagcccaucgagaccagaaaggaggagaaggugacccuggaccccgagcuggaggaggcccuggccagcgccagcgacaccgagcuguacgaccuggccgccgugcugggcgugcacaaccugcugaacaaccccaaguucgacgaggagaccgccaacaacaagggcggcaagggccccgugagaaacguggugaagggcgagaaggugaagcccguguucgaggagccccccaaccccaccaacguggagaucagccugcagcagaugaaggccaacgaccccagccugcaggaggugaaccugaacaacaucaaggccuucgccgacaugcugaaggugaacaagacccugaccagccugaacaucgagagcaacuucaucaccggcaccggcauccuggcccugguggaggcccugaaggagaacgacacccugaccgagaucaagaucgacaaccagagacagcagcugggcaccgccguggagauggagaucgcccagaugcuggaggagaacagcagaauccugaaguucggcuaccaguucaccaagcagggccccagaaccagaguggccgccgccaucaccaagaacaacgaccuggugagaaagaagagaguggaggccgacagaagauaa

SEQ ID NO: 24813 - RNA, 1059 nt, Artificial Sequence
  TMOD3__Homo_sapiens__NP_055362
auggcccugcccuucagaaaggaccuggagaaguacaaggaccuggacgaggacgagcugcugggcaaccugagcgagaccgagcugaagcagcuggagaccgugcuggacgaccuggaccccgagaacgcccugcugcccgccggcuucagacagaagaaccagaccagcaagagcaccaccggccccuucgacagagagcaccugcugagcuaccuggagaaggaggcccuggagcacaaggacagagaggacuacgugcccuacaccggcgagaagaagggcaagaucuucauccccaagcagaagcccgugcagaccuucaccgaggagaaggugagccuggaccccgagcuggaggaggcccugaccagcgccagcgacaccgagcugugcgaccuggccgccauccugggcaugcacaaccugaucaccaacaccaaguucugcaacaucaugggcagcagcaacggcguggaccaggagcacuucagcaacguggugaagggcgagaagauccugcccguguucgacgagccccccaaccccaccaacguggaggagagccugaagagaaccaaggagaacgacgcccaccugguggaggugaaccugaacaacaucaagaacauccccauccccacccugaaggacuucgccaaggcccuggagaccaacacccacgugaagugcuucagccuggccgccaccagaagcaacgaccccguggccaccgccuucgccgagaugcugaaggugaacaagacccugaagagccugaacguggagagcaacuucaucaccggcgugggcauccuggcccugaucgacgcccugagagacaacgagacccuggccgagcugaagaucgacaaccagagacagcagcugggcaccgccguggagcuggagauggccaagaugcuggaggagaacaccaacauccugaaguucggcuaccaguucacccagcagggccccagaaccagagccgccaacgccaucaccaagaacaacgaccuggugagaaagagaagaguggagggcgaccaccaguaa

SEQ ID NO: 24814 - RNA, 1038 nt, Artificial Sequence
  TMOD4__Homo_sapiens__NP_037485
augagcagcuaccagaaggagcuggagaaguacagagacaucgacgaggacgagauccugagaacccugagccccgaggagcuggagcagcuggacugcgagcugcaggagauggaccccgagaacaugcugcugcccgccggccugagacagagagaccagaccaagaagagccccaccggcccccuggacagagaggcccugcugcaguaccuggagcagcaggcccuggaggugaaggagagagacgaccuggugcccuucaccggcgagaagaagggcaagcccuacauccagcccaagagagagauccccgccgaggagcagaucacccuggagcccgagcuggaggaggcccuggcccacgccaccgacgccgagaugugcgacaucgccgccauccuggacauguacacccugaugagcaacaagcaguacuacgacgcccugugcagcggcgagaucugcaacaccgagggcaucagcagcguggugcagcccgacaaguacaagcccgugcccgacgagccccccaaccccaccaacaucgaggagauccugaagagagugagaagcaacgacaaggagcuggaggaggugaaccugaacaacauccaggacauccccauccccaugcugagcgagcugugcgaggccaugaaggccaacaccuacgugagaagcuucagccugguggccaccagaagcggcgaccccaucgccaacgccguggccgacaugcugagagagaacagaagccugcagagccugaacaucgagagcaacuucaucagcagcaccggccugauggccgugcugaaggccgugagagagaacgccacccugaccgagcugagaguggacaaccagagacaguggcccggcgacgccguggagauggagauggccaccgugcuggagcagugccccagcaucgugagauucggcuaccacuucacccagcagggccccagagccagagccgcccaggccaugaccagaaacaacgagcugagaagacagcagaagaagagauaa

SEQ ID NO: 24815 - RNA, 1365 nt, Artificial Sequence
  TMPO__Homo_sapiens__NP_001027454
augcccgaguuccuggaggaccccagcgugcugaccaaggacaagcugaagagcgagcugguggccaacaacgugacccugcccgccggcgagcagagaaaggacguguacgugcagcuguaccugcagcaccugaccgccagaaacagacccccccugcccgccggcaccaacagcaagggcccccccgacuucagcagcgacgaggagagagagcccacccccgugcugggcagcggcgccgccgccgccggcagaagcagagccgccgugggcagaaaggccaccaagaagaccgacaagcccagacaggaggacaaggacgaccuggacgugaccgagcugaccaacgaggaccugcuggaccagcuggugaaguacggcgugaaccccggccccaucgugggcaccaccagaaagcuguacgagaagaagcugcugaagcugagagagcagggcaccgagagcagaagcagcaccccccugcccaccaucagcagcagcgccgagaacaccagacagaacggcagcaacgacagcgacagauacagcgacaacgaggaggacagcaagaucgagcugaagcuggagaagagagagccccugaagggcagagccaagacccccgugacccugaagcagagaagaguggagcacaaccagagcuacagccaggccggcaucaccgagaccgaguggaccagcggcagcagcaagggcggcccccugcaggcccugaccagagagagcaccagaggcagcagaagaacccccagaaagagaguggagaccagcgagcacuucagaaucgacggccccgugaucagcgagagcacccccaucgccgagaccaucauggccagcagcaacgagagccugguggugaacagagugaccggcaacuucaagcacgccagccccauccugcccaucaccgaguucagcgacauccccagaagagcccccaagaagccccugaccagagccgaggugggcgagaagaccgaggagagaagaguggagagagacauccugaaggagauguuccccuacgaggccagcacccccaccggcaucagcgccagcugcagaagacccaucaagggcgccgccggcagaccccuggagcugagcgacuucagaauggaggagagcuucagcagcaaguacgugcccaaguacgugccccuggccgacgugaagagcgagaagaccaagaagggcagaagcauccccguguggaucaagauccugcuguucguggugguggccguguuccuguuccugguguaccaggccauggagaccaaccaggugaaccccuucagcaacuuccugcacguggaccccagaaagagcaacuaa

SEQ ID NO: 24816 - RNA, 1257 nt, Artificial Sequence
  TMPRSS11A__Homo_sapiens__NP_001107859
augauguacagaaccgugggcuucggcaccagaagcagaaaccugaagcccuggaugaucgccgugcugaucgugcugagccugaccgugguggccgugaccaucggccugcuggugcacuuccugguguucgaccagaagaaggaguacuaccacggcagcuucaagauccuggacccccagaucaacaacaacuucggccagagcaacaccuaccagcugaaggaccugagagagaccaccgagaaccugguggacgagaucuucaucgacagcgccuggaagaagaacuacaucaagaaccagguggugagacugacccccgaggaggacggcgugaagguggacgugaucaugguguuccaguuccccagcaccgagcagagagccgugagagagaagaagauccagagcauccugaaccagaagaucagaaaccugagagcccugcccaucaacgccagcagcgugcaggugaacgccaugagcagcagcaccggcgagcugaccgugcaggccagcugcggcaagagaguggugccccugaacgugaacagaaucgccagcggcgugaucgcccccaaggccgccuggcccuggcaggccagccugcaguacgacaacauccaccagugcggcgccacccugaucagcaacaccuggcuggugaccgccgcccacugcuuccagaaguacaagaacccccaccaguggaccgugagcuucggcaccaagaucaaccccccccugaugaagagaaacgugagaagauucaucauccacgagaaguacagaagcgccgccagagaguacgacaucgccguggugcaggugagcagcagagugaccuucagcgacgacaucagacagaucugccugcccgaggccagcgccagcuuccagcccaaccugaccgugcacaucaccggcuucggcgcccuguacuacggcggcgagagccagaacgaccugagagaggccagagugaagaucaucagcgacgacgugugcaagcagccccagguguacggcaacgacaucaagcccggcauguucugcgccggcuacauggagggcaucuacgacgccugcagaggcgacagcggcggcccccuggugaccagagaccugaaggacaccugguaccugaucggcaucgugagcuggggcgacaacugcggccagaaggacaagcccggcguguacacccaggugaccuacuacagaaacuggaucgccagcaagaccggcaucuaa

SEQ ID NO: 24817 - RNA, 1251 nt, Artificial Sequence
  TMPRSS11B__Homo_sapiens__NP_872308
auguacagacacggcaucagcagccagagaagcuggccccuguggaccaccaucuucaucuuccugggcguggccgccauccugggcgugaccaucggccugcuggugcacuuccuggccguggagaagaccuacuacuaccagggcgacuuccacaucagcggcgugaccuacaacgacaacugcgagaacgccgccagccaggccagcaccaaccugagcaaggacaucgagaccaagaugcugaacgccuuccagaacagcagcaucuacaaggaguacgugaagagcgaggugaucaagcugcugcccaacgccaacggcagcaacgugcagcugcagcugaaguucaaguucccccccgccgagggcgugagcaugagaaccaagaucaaggccaagcugcaccagaugcugaagaacaacauggccagcuggaacgccgugcccgccagcaucaagcugauggagaucagcaaggccgccagcgagaugcugaccaacaacugcugcggcagacagguggccaacagcaucaucaccggcaacaagaucgugaacggcaagagcagccuggagggcgccuggcccuggcaggccagcaugcaguggaagggcagacacuacugcggcgccagccugaucagcagcagauggcugcugagcgccgcccacugcuucgccaagaagaacaacagcaaggacuggaccgugaacuucggcaucguggugaacaagcccuacaugaccagaaaggugcagaacaucaucuuccacgagaacuacagcagccccggccugcacgacgacaucgcccuggugcagcuggccgaggaggugagcuucaccgaguacaucagaaagaucugccugcccgaggccaagaugaagcugagcgagaacgacaacgugguggugaccggcuggggcacccuguacaugaacggcagcuuccccgugauccugcaggaggacuuccugaagaucaucgacaacaagaucugcaacgccagcuacgccuacagcggcuucgugaccgacaccaugcugugcgccggcuucaugagcggcgaggccgacgccugccagaacgacagcggcggcccccuggccuaccccgacagcagaaacaucuggcaccuggugggcaucgugagcuggggcgacggcugcggcaagaagaacaagcccggcguguacaccagagugaccagcuacagaaacuggaucaccagcaagaccggccuguaa

SEQ ID NO: 24818 - RNA, 1257 nt, Artificial Sequence
  TMPRSS11D__Homo_sapiens__NP_004253
auguacagacccgccagagugaccagcaccagcagauuccugaaccccuacguggugugcuucaucgugguggccggcguggugauccuggccgugaccaucgcccugcugguguacuuccuggccuucgaccagaagagcuacuucuacagaagcagcuuccagcugcugaacguggaguacaacagccagcugaacagccccgccacccaggaguacagaacccugagcggcagaaucgagagccugaucaccaagaccuucaaggagagcaaccugagaaaccaguucaucagagcccacguggccaagcugagacaggacggcagcggcgugagagccgacguggugaugaaguuccaguucaccagaaacaacaacggcgccagcaugaagagcagaaucgagagcgugcugagacagaugcugaacaacagcggcaaccuggagaucaaccccagcaccgagaucaccagccugaccgaccaggccgccgccaacuggcugaucaacgagugcggcgccggccccgaccugaucacccugagcgagcagagaauccugggcggcaccgaggccgaggagggcagcuggcccuggcaggugagccugagacugaacaacgcccaccacugcggcggcagccugaucaacaacauguggauccugaccgccgcccacugcuucagaagcaacagcaaccccagagacuggaucgccaccagcggcaucagcaccaccuuccccaagcugagaaugagagugagaaacauccugauccacaacaacuacaagagcgccacccacgagaacgacaucgcccuggugagacuggagaacagcgugaccuucaccaaggacauccacagcgugugccugcccgccgccacccagaacaucccccccggcagcaccgccuacgugaccggcuggggcgcccaggaguacgccggccacaccgugcccgagcugagacagggccaggugagaaucaucagcaacgacgugugcaacgccccccacagcuacaacggcgccauccugagcggcaugcugugcgccggcgugccccagggcggcguggacgccugccagggcgacagcggcggcccccuggugcaggaggacagcagaagacugugguucaucgugggcaucgugagcuggggcgaccagugcggccugcccgacaagcccggcguguacaccagagugaccgccuaccuggacuggaucagacagcagaccggcaucuaa

SEQ ID NO: 24819 - RNA, 1272 nt, Artificial Sequence
  TMPRSS11E__Homo_sapiens__NP_054777
augauguacagacccgacguggugagagccagaaagagagugugcugggagcccugggugaucggccuggugaucuucaucagccugaucgugcuggccgugugcaucggccugaccgugcacuacgugagauacaaccagaagaagaccuacaacuacuacagcacccugagcuucaccaccgacaagcuguacgccgaguucggcagagaggccagcaacaacuucaccgagaugagccagagacuggagagcauggugaagaacgccuucuacaagagcccccugagagaggaguucgugaagagccaggugaucaaguucagccagcagaagcacggcgugcuggcccacaugcugcugaucugcagauuccacagcaccgaggaccccgagaccguggacaagaucgugcagcuggugcugcacgagaagcugcaggacgccgugggcccccccaagguggacccccacagcgugaagaucaagaagaucaacaagaccgagaccgacagcuaccugaaccacugcugcggcaccagaagaagcaagacccugggccagagccugagaaucgugggcggcaccgagguggaggagggcgaguggcccuggcaggccagccugcagugggacggcagccacagaugcggcgccacccugaucaacgccaccuggcuggugagcgccgcccacugcuucaccaccuacaagaaccccgccagauggaccgccagcuucggcgugaccaucaagcccagcaagaugaagagaggccugagaagaaucaucgugcacgagaaguacaagcaccccagccacgacuacgacaucagccuggccgagcugagcagccccgugcccuacaccaacgccgugcacagagugugccugcccgacgccagcuacgaguuccagcccggcgacgugauguucgugaccggcuucggcgcccugaagaacgacggcuacagccagaaccaccugagacaggcccaggugacccugaucgacgccaccaccugcaacgagccccaggccuacaacgacgccaucacccccagaaugcugugcgccggcagccuggagggcaagaccgacgccugccagggcgacagcggcggcccccuggugagcagcgacgccagagacaucugguaccuggccggcaucgugagcuggggcgacgagugcgccaagcccaacaagcccggcguguacaccagagugaccgcccugagagacuggaucaccagcaagaccggcaucuaa

SEQ ID NO: 24820 - RNA, 1704 nt, Artificial Sequence
  TMPRSS13__Homo_sapiens__NP_001070731
auggagagagacagccacggcaacgccagccccgccagaacccccagcgccggcgccagccccgcccaggccagccccgccggcaccccccccggcagagccagccccgcccaggccagccccgcccaggccagccccgccggcaccccccccggcagagccagccccgcccaggccagccccgccggcaccccccccggcagagccagccccggcagagccagccccgcccaggccagccccgcccaggccagccccgccagagccagccccgcccuggccagccugagcagaagcagcagcggcagaagcagcagcgccagaagcgccagcgugaccaccagccccaccagaguguaccuggugagagccacccccgugggcgccgugcccaucagaagcagccccgccagaagcgcccccgccaccagagccaccagagagagccccggcaccagccugcccaaguucaccuggagagagggccagaagcagcugccccugaucggcugcgugcugcugcugaucgcccugguggugagccugaucauccuguuccaguucuggcagggccacaccggcaucagauacaaggagcagagagagagcugccccaagcacgccgugagaugcgacggcgugguggacugcaagcugaagagcgacgagcugggcugcgugagauucgacugggacaagagccugcugaagaucuacagcggcagcagccaccaguggcugcccaucugcagcagcaacuggaacgacagcuacagcgagaagaccugccagcagcugggcuucgagagcgcccacagaaccaccgagguggcccacagagacuucgccaacagcuucagcauccugagauacaacagcaccauccaggagagccugcacagaagcgagugccccagccagagauacaucagccugcagugcagccacugcggccugagagccaugaccggcagaaucgugggcggcgcccuggccagcgacagcaaguggcccuggcaggugagccugcacuucggcaccacccacaucugcggcggcacccugaucgacgcccagugggugcugaccgccgcccacugcuucuucgugaccagagagaaggugcuggagggcuggaagguguacgccggcaccagcaaccugcaccagcugcccgaggccgccagcaucgccgagaucaucaucaacagcaacuacaccgacgaggaggacgacuacgacaucgcccugaugagacugagcaagccccugacccugagcgcccacauccaccccgccugccugcccaugcacggccagaccuucagccugaacgagaccugcuggaucaccggcuucggcaagaccagagagaccgacgacaagaccagccccuuccugagagaggugcaggugaaccugaucgacuucaagaagugcaacgacuaccugguguacgacagcuaccugacccccagaaugaugugcgccggcgaccugagaggcggcagagacagcugccagggcgacagcggcggcccccuggugugcgagcagaacaacagaugguaccuggccggcgugaccagcuggggcaccggcugcggccagagaaacaagcccggcguguacaccaaggugaccgaggugcugcccuggaucuacagcaagauggagagcgaggugagauucagaaagagcuaa

SEQ ID NO: 24821 - RNA, 3060 nt, Artificial Sequence
  TMPRSS15__Homo_sapiens__NP_002763
augggcagcaagagaggcaucagcagcagacaccacagccugagcagcuacgagaucauguucgccgcccuguucgccauccugguggugcugugcgccggccugaucgccgugagcugccugaccaucaaggagagccagagaggcgccgcccugggccagagccacgaggccagagccaccuucaagaucaccagcggcgugaccuacaaccccaaccugcaggacaagcugagcguggacuucaaggugcuggccuucgaccugcagcagaugaucgacgagaucuuccugagcagcaaccugaagaacgaguacaagaacagcagagugcugcaguucgagaacggcagcaucaucgugguguucgaccuguucuucgcccagugggugagcgacgagaacgugaaggaggagcugauccagggccuggaggccaacaagagcagccagcuggugaccuuccacaucgaccugaacagcguggacauccuggacaagcugaccaccaccagccaccuggccacccccggcaacgugagcaucgagugccugcccggcagcagccccugcaccgacgcccugaccugcaucaaggccgaccuguucugcgacggcgaggugaacugccccgacggcagcgacgaggacaacaagaugugcgccaccgugugcgacggcagauuccugcugaccggcagcagcggcagcuuccaggccacccacuaccccaagcccagcgagaccagcguggugugccaguggaucaucagagugaaccagggccugagcaucaagcugagcuucgacgacuucaacaccuacuacaccgacauccuggacaucuacgagggcgugggcagcagcaagauccugagagccagcaucugggagaccaaccccggcaccaucagaaucuucagcaaccaggugaccgccaccuuccugaucgagagcgacgagagcgacuacgugggcuucaacgccaccuacaccgccuucaacagcagcgagcugaacaacuacgagaagaucaacugcaacuucgaggacggcuucugcuucugggugcaggaccugaacgacgacaacgagugggagagaauccagggcagcaccuucagccccuucaccggccccaacuucgaccacaccuucggcaacgccagcggcuucuacaucagcacccccaccggccccggcggcagacaggagagagugggccugcugagccugccccuggaccccacccuggagcccgccugccugagcuucugguaccacauguacggcgagaacgugcacaagcugagcaucaacaucagcaacgaccagaacauggagaagaccguguuccagaaggagggcaacuacggcgacaacuggaacuacggccaggugacccugaacgagaccgugaaguucaagguggccuucaacgccuucaagaacaagauccugagcgacaucgcccuggacgacaucagccugaccuacggcaucugcaacggcagccuguaccccgagcccacccuggugcccacccccccccccgagcugcccaccgacugcggcggccccuucgagcugugggagcccaacaccaccuucagcagcaccaacuuccccaacagcuaccccaaccuggccuucugcguguggauccugaacgcccagaagggcaagaacauccagcugcacuuccaggaguucgaccuggagaacaucaacgacgugguggagaucagagacggcgaggaggccgacagccugcugcuggccguguacaccggccccggccccgugaaggacguguucagcaccaccaacagaaugaccgugcugcugaucaccaacgacgugcuggccagaggcggcuucaaggccaacuucaccaccggcuaccaccugggcauccccgagcccugcaaggccgaccacuuccagugcaagaacggcgagugcgugccccuggugaaccugugcgacggccaccugcacugcgaggacggcagcgacgaggccgacugcgugagauucuucaacggcaccaccaacaacaacggccuggugagauucagaauccagagcaucuggcacaccgccugcgccgagaacuggaccacccagaucagcaacgacgugugccagcugcugggccugggcagcggcaacagcagcaagcccaucuucagcaccgacggcggccccuucgugaagcugaacaccgcccccgacggccaccugauccugacccccagccagcagugccugcaggacagccugaucagacugcagugcaaccacaagagcugcggcaagaagcuggccgcccaggacaucacccccaagaucgugggcggcagcaacgccaaggagggcgccuggcccuggguggugggccuguacuacggcggcagacugcugugcggcgccagccuggugagcagcgacuggcuggugagcgccgcccacugcguguacggcagaaaccuggagcccagcaaguggaccgccauccugggccugcacaugaagagcaaccugaccagcccccagaccgugcccagacugaucgacgagaucgugaucaacccccacuacaacagaagaagaaaggacaacgacaucgccaugaugcaccuggaguucaaggugaacuacaccgacuacauccagcccaucugccugcccgaggagaaccagguguucccccccggcagaaacugcagcaucgccggcuggggcaccgugguguaccagggcaccaccgccaacauccugcaggaggccgacgugccccugcugagcaacgagagaugccagcagcagaugcccgaguacaacaucaccgagaacaugaucugcgccggcuacgaggagggcggcaucgacagcugccagggcgacagcggcggcccccugaugugccaggagaacaacagaugguuccuggccggcgugaccagcuucggcuacaagugcgcccugcccaacagacccggcguguacgccagagugagcagauucaccgaguggauccagagcuuccugcacuaa

SEQ ID NO: 24822 - RNA, 1590 nt, Artificial Sequence
  TMPRSS2__Homo_sapiens__NP_001128571
augccccccgccccccccggcggcgagagcggcugcgaggagagaggcgccgccggccacaucgagcacagcagauaccugagccugcuggacgccguggacaacagcaagauggcccugaacagcggcagcccccccgccaucggccccuacuacgagaaccacggcuaccagcccgagaaccccuaccccgcccagcccaccguggugcccaccguguacgaggugcaccccgcccaguacuaccccagccccgugccccaguacgcccccagagugcugacccaggccagcaaccccguggugugcacccagcccaagagccccagcggcaccgugugcaccagcaagaccaagaaggcccugugcaucacccugacccugggcaccuuccuggugggcgccgcccuggccgccggccugcuguggaaguucaugggcagcaagugcagcaacagcggcaucgagugcgacagcagcggcaccugcaucaaccccagcaacuggugcgacggcgugagccacugccccggcggcgaggacgagaacagaugcgugagacuguacggccccaacuucauccugcagguguacagcagccagagaaagagcuggcaccccgugugccaggacgacuggaacgagaacuacggcagagccgccugcagagacaugggcuacaagaacaacuucuacagcagccagggcaucguggacgacagcggcagcaccagcuucaugaagcugaacaccagcgccggcaacguggacaucuacaagaagcuguaccacagcgacgccugcagcagcaaggccguggugagccugagaugcaucgccugcggcgugaaccugaacagcagcagacagagcagaaucgugggcggcgagagcgcccugcccggcgccuggcccuggcaggugagccugcacgugcagaacgugcacgugugcggcggcagcaucaucacccccgaguggaucgugaccgccgcccacugcguggagaagccccugaacaaccccuggcacuggaccgccuucgccggcauccugagacagagcuucauguucuacggcgccggcuaccagguggagaaggugaucagccaccccaacuacgacagcaagaccaagaacaacgacaucgcccugaugaagcugcagaagccccugaccuucaacgaccuggugaagcccgugugccugcccaaccccggcaugaugcugcagcccgagcagcugugcuggaucagcggcuggggcgccaccgaggagaagggcaagaccagcgaggugcugaacgccgccaaggugcugcugaucgagacccagagaugcaacagcagauacguguacgacaaccugaucacccccgccaugaucugcgccggcuuccugcagggcaacguggacagcugccagggcgacagcggcggcccccuggugaccagcaagaacaacaucugguggcugaucggcgacaccagcuggggcagcggcugcgccaaggccuacagacccggcguguacggcaacgugaugguguucaccgacuggaucuacagacagaugagagccgacggcuaa

SEQ ID NO: 24823 - RNA, 1362 nt, Artificial Sequence
  TMPRSS3__Homo_sapiens__NP_001243246
augggcgagaacgacccccccgccguggaggcccccuucagcuucagaagccuguucggccuggacgaccugaagaucagccccguggcccccgacgccgacgccguggccgcccagauccugagccugcugccccugaaguucuuccccaucaucgugaucggcaucaucgcccugauccuggcccuggccaucggccugggcauccacuucgacugcagcggcaaguacagaugcagaagcagcuucaagugcaucgagcugaucgccagaugcgacggcgugagcgacugcaaggacggcgaggacgaguacagaugcgugagagugggcggccagaacgccgugcugcagguguucaccgccgccagcuggaagaccaugugcagcgacgacuggaagggccacuacgccaacguggccugcgcccagcugggcuuccccagcuacgugagcagcgacaaccugagagugagcagccuggagggccaguucagagaggaguucgugagcaucgaccaccugcugcccgacgacaaggugaccgcccugcaccacagcguguacgugagagagggcugcgccagcggccacguggugacccugcagugcaccgccugcggccacagaagaggcuacagcagcagaaucgugggcggcaacaugagccugcugagccaguggcccuggcaggccagccugcaguuccagggcuaccaccugugcggcggcagcgugaucaccccccuguggaucaucaccgccgcccacugcguguacgaccuguaccugcccaagagcuggaccauccaggugggccuggugagccugcuggacaaccccgcccccagccaccugguggagaagaucguguaccacagcaaguacaagcccaagagacugggcaacgacaucgcccugaugaagcuggccggcccccugaccuucaacgagaugauccagcccgugugccugcccaacagcgaggagaacuuccccgacggcaaggugugcuggaccagcggcuggggcgccaccgaggacggcggcgacgccagccccgugcugaaccacgccgccgugccccugaucagcaacaagaucugcaaccacagagacguguacggcggcaucaucagccccagcaugcugugcgccggcuaccugaccggcggcguggacagcugccagggcgacagcggcggcccccuggugugccaggagagaagacuguggaagcuggugggcgccaccagcuucggcaucggcugcgccgaggugaacaagcccggcguguacaccagagugaccagcuuccuggacuggauccacgagcagauggagagagaccugaagaccuaa

SEQ ID NO: 24824 - RNA, 1299 nt, Artificial Sequence
  TMPRSS4__Homo_sapiens__NP_001077416
augcugcaggaccccgacagcgaccagccccugaacagccuggacgugaagccccugagaaagcccagaauccccauggagaccuucagaaaggugggcauccccaucaucaucgcccugcugagccuggccagcaucaucaucgugguggugcugaucaaggugauccuggacaaguacuacuuccugugcggccagccccugcacuucauccccagaaagcagcugugcgacggcgagcuggacugcccccugggcgaggacgaggagcacugcgugaagagcuuccccgagggccccgccguggccgugagacugagcaaggacagaagcacccugcaggugcuggacagcgccaccggcaacugguucagcgccugcuucgacaacuucaccgaggcccuggccgagaccgccugcagacagaugggcuacagcagagccguggagaucggccccgaccaggaccuggacgugguggagaucaccgagaacagccaggagcugagaaugagaaacagcagcggccccugccugagcggcagccuggugagccugcacugccuggccugcggcaagagccugaagacccccagaguggugggcggcgaggaggccagcguggacagcuggcccuggcaggugagcauccaguacgacaagcagcacgugugcggcggcagcauccuggacccccacugggugcugaccgccgcccacugcuucagaaagcacaccgacguguucaacuggaaggugagagccggcagcgacaagcugggcagcuuccccagccuggccguggccaagaucaucaucaucgaguucaaccccauguaccccaaggacaacgacaucgcccugaugaagcugcaguucccccugaccuucagcggcaccgugagacccaucugccugcccuucuucgacgaggagcugacccccgccaccccccuguggaucaucggcuggggcuucaccaagcagaacggcggcaagaugagcgacauccugcugcaggccagcgugcaggugaucgacagcaccagaugcaacgccgacgacgccuaccagggcgaggugaccgagaagaugaugugcgccggcauccccgagggcggcguggacaccugccagggcgacagcggcggcccccugauguaccagagcgaccaguggcacguggugggcaucgugagcuggggcuacggcugcggcggccccagcacccccggcguguacaccaaggugagcgccuaccugaacuggaucuacaacguguggaaggccgagcuguaa

SEQ ID NO: 24825 - RNA, 2436 nt, Artificial Sequence
  TMPRSS6__Homo_sapiens__NP_705837
augcugcugcuguuccacagcaagagaaugcccguggccgaggccccccagguggccggcggccagggcgacggcggcgacggcgaggaggccgagcccgagggcauguucaaggccugcgaggacagcaagagaaaggccagaggcuaccugagacuggugccccuguucgugcugcuggcccugcuggugcuggccagcgccggcgugcugcugugguacuuccugggcuacaaggccgaggugauggugagccagguguacagcggcagccugagagugcugaacagacacuucagccaggaccugaccagaagagagagcagcgccuucagaagcgagaccgccaaggcccagaagaugcugaaggagcugaucaccagcaccagacugggcaccuacuacaacagcagcagcguguacagcuucggcgagggcccccugaccugcuucuucugguucauccugcagauccccgagcacagaagacugaugcugagccccgagguggugcaggcccugcugguggaggagcugcugagcaccgugaacagcagcgccgccgugcccuacagagccgaguacgagguggaccccgagggccuggugauccuggaggccagcgugaaggacaucgccgcccugaacagcacccugggcugcuacagauacagcuacgugggccagggccaggugcugagacugaagggccccgaccaccuggccagcagcugccuguggcaccugcagggccccaaggaccugaugcugaagcugagacuggaguggacccuggccgagugcagagacagacuggccauguacgacguggccggcccccuggagaagagacugaucaccagcguguacggcugcagcagacaggagcccgugguggaggugcuggccagcggcgccaucauggccgugguguggaagaagggccugcacagcuacuacgaccccuucgugcugagcgugcagcccgugguguuccaggccugcgaggugaaccugacccuggacaacagacuggacagccagggcgugcugagcacccccuacuuccccagcuacuacagcccccagacccacugcagcuggcaccugaccgugcccagccuggacuacggccuggcccugugguucgacgccuacgcccugagaagacagaaguacgaccugcccugcacccagggccaguggaccauccagaacagaagacugugcggccugagaauccugcagcccuacgccgagagaauccccgugguggccaccgccggcaucaccaucaacuucaccagccagaucagccugaccggccccggcgugagagugcacuacggccuguacaaccagagcgaccccugccccggcgaguuccugugcagcgugaacggccugugcgugcccgccugcgacggcgugaaggacugccccaacggccuggacgagagaaacugcgugugcagagccaccuuccagugcaaggaggacagcaccugcaucagccugcccaaggugugcgacggccagcccgacugccugaacggcagcgacgaggagcagugccaggagggcgugcccugcggcaccuucaccuuccagugcgaggacagaagcugcgugaagaagcccaacccccagugcgacggcagacccgacugcagagacggcagcgacgaggagcacugcgacugcggccugcagggccccagcagcagaaucgugggcggcgccgugagcagcgagggcgaguggcccuggcaggccagccugcaggugagaggcagacacaucugcggcggcgcccugaucgccgacagaugggugaucaccgccgcccacugcuuccaggaggacagcauggccagcaccgugcuguggaccguguuccugggcaagguguggcagaacagcagauggcccggcgaggugagcuucaaggugagcagacugcugcugcaccccuaccacgaggaggacagccacgacuacgacguggcccugcugcagcuggaccaccccguggugagaagcgccgccgugagacccgugugccugcccgccagaagccacuucuucgagcccggccugcacugcuggaucaccggcuggggcgcccugagagagggcggccccaucagcaacgcccugcagaagguggacgugcagcugaucccccaggaccugugcagcgagguguacagauaccaggugacccccagaaugcugugcgccggcuacagaaagggcaagaaggacgccugccagggcgacagcggcggcccccuggugugcaaggcccugagcggcagaugguuccuggccggccuggugagcuggggccugggcugcggcagacccaacuacuucggcguguacaccagaaucaccggcgugaucagcuggauccagcagguggugaccuaa

SEQ ID NO: 24826 - RNA, 2154 nt, Artificial Sequence
  TMPRSS7__Homo_sapiens__NP_001036040
auguucagaaucaccaacaucgaguuccugcccgaguacagacagaaggagagcagagaguuccugagcgugagcagaaccgugcagcaggugaucaaccugguguacaccaccagcgccuucagcaaguucuacgagcagagcgugguggccgacgugagcaacaacaagggcggccugcuggugcacuucuggaucguguucgugaugcccagagccaagggccacaucuucugcgaggacugcguggccgccauccugaaggacagcauccagaccagcaucaucaacagaaccagcgugggcagccugcagggccuggccguggacauggacagcguggugcugaacgacaagggcugcagccaguacuucuacgccgagcaccugagccugcacuacccccuggagaucagcgccgccagcggcagacugaugugccacuucaagcugguggccaucgugggcuaccugaucagacugagcaucaagagcauccagaucgaggccgacaacugcgugaccgacagccugaccaucuacgacagccugcugcccaucagaagcagcauccuguacagaaucugcgagcccaccagaacccugaugagcuucgugagcaccaacaaccugaugcuggugaccuucaagagcccccacaucagaagacugagcggcaucagagccuacuucgaggugauccccgagcagaagugcgagaacaccgugcuggugaaggacaucaccggcuucgagggcaagaucagcagccccuacuaccccagcuacuacccccccaagugcaagugcaccuggaaguuccagaccagccugagcacccugggcaucgcccugaaguucuacaacuacagcaucaccaagaagagcaugaagggcugcgagcacggcuggugggagaucaacgagcacauguacugcggcagcuacauggaccaccagaccaucuucagagugcccagcccccuggugcacauccagcugcagugcagcagcagacugagcgacaagccccugcuggccgaguacggcagcuacaacaucagccagcccugccccgugggcagcuucagaugcagcagcggccugugcgugccccaggcccagagaugcgacggcgugaacgacugcuucgacgagagcgacgagcuguucugcgugagcccccagcccgccugcaacaccagcagcuucagacagcacggcccccugaucugcgacggcuucagagacugcgagaacggcagagacgagcagaacugcacccagagcauccccugcaacaacagaaccuucaagugcggcaacgacaucugcuucagaaagcagaacgccaagugcgacggcaccguggacugccccgacggcagcgacgaggagggcugcaccugcagcagaagcagcagcgcccugcacagaaucaucggcggcaccgacacccuggagggcggcuggcccuggcaggugagccugcacuucgugggcagcgccuacugcggcgccagcgugaucagcagagaguggcugcugagcgccgcccacugcuuccacggcaacagacugagcgaccccacccccuggaccgcccaccugggcauguacgugcagggcaacgccaaguucgugagccccgugagaagaaucguggugcacgaguacuacaacagccagaccuucgacuacgacaucgcccugcugcagcugagcaucgccuggcccgagacccugaagcagcugauccagcccaucugcaucccccccaccggccagagagugagaagcggcgagaagugcugggugaccggcuggggcagaagacacgaggccgacaacaagggcagccuggugcugcagcaggccgagguggagcugaucgaccagacccugugcgugagcaccuacggcaucaucaccagcagaaugcugugcgccggcaucaugagcggcaagagagacgccugcaagggcgacagcggcggcccccugagcugcagaagaaagagcgacggcaaguggauccugaccggcaucgugagcuggggccacggcagcggcagacccaacuuccccggcguguacaccagagugagcaacuucgugcccuggauccacaaguacgugcccagccugcuguaa

SEQ ID NO: 24827 - RNA, 3180 nt, Artificial Sequence
  TMPRSS9__Homo_sapiens__NP_892018
auggagcccaccguggccgacgugcaccuggugcccagaaccaccaaggaggugcccgcccuggacgccgccugcugcagagccgccagcaucggcgugguggccaccagccugguggugcugacccugggcgugcugcuggccuuccugagcacccagggcuuccacguggaccacaccgccgagcugagaggcaucagauggaccagcagccugagaagagagaccagcgacuaccacagaacccugacccccacccuggaggcccugcugcacuuccugcugagaccccugcagacccugagccugggccuggaggaggagcugcugcagagaggcaucagagccagacugagagagcacggcaucagccuggccgccuacggcaccaucgugagcgccgagcugaccggcagacacaagggcccccuggccgagagagacuucaagagcggcagaugccccggcaacagcuucagcugcggcaacagccagugcgugaccaaggugaaccccgagugcgacgaccaggaggacugcagcgacggcagcgacgaggcccacugcgagugcggccugcagcccgccuggagaauggccggcagaaucgugggcggcauggaggccagccccggcgaguuccccuggcaggccagccugagagagaacaaggagcacuucugcggcgccgccaucaucaacgccagauggcuggugagcgccgcccacugcuucaacgaguuccaggaccccaccaaguggguggccuacgugggcgccaccuaccugagcggcagcgaggccagcaccgugagagcccagguggugcagaucgugaagcacccccuguacaacgccgacaccgccgacuucgacguggccgugcuggagcugaccagcccccugcccuucggcagacacauccagcccgugugccugcccgccgccacccacaucuucccccccagcaagaagugccugaucagcggcuggggcuaccugaaggaggacuuccuggugaagcccgaggugcugcagaaggccaccguggagcugcuggaccaggcccugugcgccagccuguacggccacagccugaccgacagaauggugugcgccggcuaccuggacggcaagguggacagcugccagggcgacagcggcggcccccuggugugcgaggagcccagcggcagauucuuccuggccggcaucgugagcuggggcaucggcugcgccgaggccagaagacccggcguguacgccagagugaccagacugagagacuggauccuggaggccaccaccaaggccagcaugccccuggcccccaccauggcccccgcccccgccgcccccagcaccgccuggcccaccagccccgagagccccguggugagcacccccaccaagagcaugcaggcccugagcaccgugccccuggacugggugaccgugcccaagcugcaggagugcggcgccagacccgccauggagaagcccaccagaguggugggcggcuucggcgccgccagcggcgaggugcccuggcaggugagccugaaggagggcagcagacacuucugcggcgccaccguggugggcgacagauggcugcugagcgccgcccacugcuucaaccacaccaagguggagcaggugagagcccaccugggcaccgccagccugcugggccugggcggcagccccgugaagaucggccugagaagaguggugcugcacccccuguacaaccccggcauccuggacuucgaccuggccgugcuggagcuggccagcccccuggccuucaacaaguacauccagcccgugugccugccccuggccauccagaaguuccccgugggcagaaagugcaugaucagcggcuggggcaacacccaggagggcaacgccaccaagcccgagcugcugcagaaggccagcgugggcaucaucgaccagaagaccugcagcgugcuguacaacuucagccugaccgacagaaugaucugcgccggcuuccuggagggcaagguggacagcugccagggcgacagcggcggcccccuggccugcgaggaggcccccggcguguucuaccuggccggcaucgugagcuggggcaucggcugcgcccaggugaagaagcccggcguguacaccagaaucaccagacugaagggcuggauccuggagaucaugagcagccagccccugcccaugagcccccccagcaccaccagaaugcuggccaccaccagccccagaaccaccgccggccugaccgugcccggcgccacccccagcagacccacccccggcgccgccagcagagugaccggccagcccgccaacagcacccugagcgccgugagcaccaccgccagaggccagacccccuuccccgacgcccccgaggccaccacccacacccagcugcccgacugcggccuggcccccgccgcccugaccagaaucgugggcggcagcgccgccggcagaggcgaguggcccuggcaggugagccuguggcugagaagaagagagcacagaugcggcgccgugcugguggccgagagauggcugcugagcgccgcccacugcuucgacguguacggcgaccccaagcagugggccgccuuccugggcacccccuuccugagcggcgccgagggccagcuggagagaguggccagaaucuacaagcaccccuucuacaaccuguacacccuggacuacgacguggcccugcuggagcuggccggccccgugagaagaagcagacuggugagacccaucugccugcccgagcccgcccccagaccccccgacggcaccagaugcgugaucaccggcuggggcagcgugagagagggcggcagcauggccagacagcugcagaaggccgccgugagacugcugagcgagcagaccugcagaagauucuaccccgugcagaucagcagcagaaugcugugcgccggcuucccccagggcggcguggacagcugcagcggcgacgccggcggcccccuggccugcagagagcccagcggcagaugggugcugaccggcgugaccagcuggggcuacggcugcggcagaccccacuuccccggcguguacaccagaguggccgccgugagaggcuggaucggccagcacauccaggaguaa

SEQ ID NO: 24828 - RNA, 135 nt, Artificial Sequence
  TMSB10__Homo_sapiens__NP_066926
auggccgacaagcccgacaugggcgagaucgccagcuucgacaaggccaagcugaagaagaccgagacccaggagaagaacacccugcccaccaaggagaccaucgagcaggagaagagaagcgagaucagcuaa

SEQ ID NO: 24829 - RNA, 138 nt, Artificial Sequence
  TMSB15B__Homo_sapiens__NP_919305
augagcgacaagcccgaccugagcgagguggagaaguucgacagaagcaagcugaagaagaccaacaccgaggagaagaacacccugcccagcaaggagaccauccagcaggagaaggagugcgugcagaccagcuaa

SEQ ID NO: 24830 - RNA, 135 nt, Artificial Sequence
  TMSB4X__Homo_sapiens__NP_066932
augagcgacaagcccgacauggccgagaucgagaaguucgacaagagcaagcugaagaagaccgagacccaggagaagaacccccugcccagcaaggagaccaucgagcaggagaagcaggccggcgagagcuaa

SEQ ID NO: 24831 - RNA, 2649 nt, Artificial Sequence
  TMTC1__Homo_sapiens__NP_001180380
augguggugaccaccagcgccagaggcggcggcggcgacagaacccccagcagaagaagaggcugcggccuggcccccgccggcgccgccgcccugcuggccggcgccagcugccugugcuacggcagaagccugcagggcgaguucgugcacgacgacgugugggccaucgugaacaaccccgacgugagacccggcgccccccugagauggggcaucuucaccaacgacuucuggggcaagggcauggccgagaacaccagccacaagagcuacagaccccugugcgugcugaccuucaagcugaacaucuuccugaccggcaugaaccccuucuacuuccacgccgugaacaucauccugcacugccuggugacccuggugcugauguacaccugcgacaagaccguguucaagaacagaggccuggccuucgugaccgcccugcuguucgccgugcaccccauccacaccgaggccguggccggcaucgugggcagagccgacgugcuggccugccugcuguuccugcuggccuuccugagcuacaacagaagccuggaccagggcugcgugggcggcagcuuccccagcaccgugagccccuucuuccugcugcugagccuguuccugggcaccugcgccaugcuggugaaggagaccggcaucaccguguucggcgugugccugguguacgaccuguucagccugagcaacaagcaggacaagagcagcaacggcgcccugugccccagaagcccccagcagcccggcagcccccagcccagcagccugcccggccacccccacagagagaacggcaagcagcagagauucccccacaagggcgccuggggcggcugccacagcccccugccccccgagcccaagagcagcggcuuccccgugagccccagagccguguggagcaugaugagauuccugaccuacagcuaccugcuggccuucaacguguggcugcugcuggcccccgugacccugugcuacgacuggcaggugggcagcaucccccugguggagaccaucugggacaugagaaaccuggccaccaucuuccuggccguggugauggcccugcugagccugcacugccuggccgccuucaagagacuggagcacaaggaggugcuggugggccugcuguuccugguguuccccuucauccccgccagcaaccuguucuucagagugggcuucgugguggccgagagagugcuguacaugcccagcaugggcuacugcauccuguucgugcacggccugagcaagcugugcaccuggcugaacagaugcggcgccaccacccugaucgugagcaccgugcugcugcugcugcuguucagcuggaagaccgugaagcagaacgagaucuggcugagcagagagagccuguucagaagcggcgugcagacccugccccacaacgccaaggugcacuacaacuacgccaacuuccugaaggaccagggcagaaacaaggaggccaucuaccacuacagaaccgcccugaagcuguaccccagacacgccagcgcccugaacaaccugggcacccugaccagagacaccgccgaggccaagauguacuaccagagagcccugcagcugcacccccagcacaacagagcccuguucaaccugggcaaccugcugaagagccaggagaagaaggaggaggccaucacccugcugaaggacagcaucaaguacggccccgaguucgccgacgccuacagcagccuggccagccugcuggccgagcaggagagauucaaggaggccgaggagaucuaccagaccggcaucaagaacugccccgacagcagcgaccugcacaacaacuacggcguguuccugguggacaccggccugcccgagaaggccguggcccacuaccagcaggccaucaagcugagccccagccaccacguggccauggugaaccugggcagacuguacagaagccugggcgagaacagcauggccgaggagugguacaagagagcccugcagguggcccacaaggccgagauccugagcccccugggcgcccuguacuacaacaccggcagauacgaggaggcccugcagaucuaccaggaggccgccgcccugcagcccagccagagagagcugagacuggcccuggcccaggugcuggccgugaugggccagaccaaggaggccgagaagaugaccaaccacaucgugagcgaggagaccggcugccuggagugcuacagacugcugagcgccaucuacagcaagcaggagaaccacgacaaggcccuggacgccaucgacaaggcccugcagcugaagcccaaggaccccaaggugaucagcgagcuguucuucaccaagggcaaccagcugagagagcagaaccugcuggacaaggccuucgagagcuacagaguggccgugcagcugaaccccgaccaggcccaggccuggaugaacaugggcggcauccagcacaucaagggcaaguacgugagcgccagagccuacuacgagagagcccugcagcuggugcccgacagcaagcugcugaaggagaaccuggccaagcuggacagacuggagaagagacugcaggaggugagagagaaggaccagaccuaa

SEQ ID NO: 24832 - RNA, 2511 nt, Artificial Sequence
  TMTC2__Homo_sapiens__NP_689801
augaucgccgagcuggugagcagcgcccugggccuggcccuguaccugaacacccugagcgccgacuucugcuacgacgacagcagagccaucaagaccaaccaggaccugcugcccgagacccccuggacccacaucuucuacaacgacuucuggggcacccugcugacccacagcggcagccacaagagcuacagaccccugugcacccugagcuucagacugaaccacgccaucggcggccugaaccccuggagcuaccaccuggugaacgugcugcugcacgccgccgugaccggccuguucaccagcuucagcaagauccugcugggcgacggcuacuggaccuucauggccggccugauguucgccagccaccccauccacaccgaggccguggccggcaucgugggcagagccgacgugggcgccagccuguucuuccugcugagccugcugugcuacaucaagcacugcagcaccagaggcuacagcgccagaaccuggggcugguuccugggcagcggccugugcgccggcugcagcaugcuguggaaggagcagggcgugaccgugcuggccgugagcgccguguacgacguguucguguuccacagacugaagaucaagcagauccugcccaccaucuacaagagaaagaaccugagccuguuccugagcaucagccugcugaucuucuggggcagcagccugcugggcgccagacuguacuggaugggcaacaagccccccagcuucagcaacagcgacaaccccgccgccgacagcgacagccugcugaccagaacccugaccuucuucuaccugcccaccaagaaccuguggcugcugcugugccccgacacccugagcuucgacuggagcauggacgccgugccccugcugaagaccgugugcgacuggagaaaccugcacaccguggccuucuacaccggccugcugcugcuggccuacuacggccugaagagccccagcguggacagagagugcaacggcaagaccgugaccaacggcaagcagaacgccaacggccacagcugccugagcgacguggaguaccagaacagcgagaccaagagcagcuucgccagcaagguggagaacggcaucaagaacgacgugagccagagaacccagcugcccagcaccgagaacaucguggugcugagccugagccugcugaucauccccuucgugcccgccaccaaccuguucuucuacgugggcuucgugaucgccgagagagugcuguacauccccagcaugggcuucugccugcugaucaccgugggcgccagagcccuguacgugaaggugcagaagagauuccugaagagccugaucuucuacgccaccgccacccugaucguguucuacggccugaagaccgccaucagaaacggcgacuggcagaacgaggagaugcuguacagaagcggcaucaaggugaaccccgccaaggccuggggcaaccugggcaacgugcugaagagccagagcaagaucagcgaggccgagagcgccuacagaaacgcccuguacuacagaagcaacauggccgacaugcuguacaaccugggccugcugcugcaggagaacagcagauucgccgaggcccugcacuacuacaagcuggccaucggcagcagacccacccuggccagcgccuaccugaacaccggcaucauccugaugaaccagggcagaaccgaggaggccagaagaaccuuccugaagugcagcgagauccccgacgagaaccugaaggacccccacgcccacaagagcagcgugaccagcugccuguacaaccugggcaagcuguaccacgagcagggccacuacgaggaggcccugagcguguacaaggaggccauccagaagaugcccagacaguucgccccccagagccuguacaacaugaugggcgaggccuacaugagacugagcaagcugcccgaggccgagcacugguacauggagagccugagaagcaagaccgaccacauccccgcccaccugaccuacggcaagcugcuggcccugaccggcagaaagagcgaggccgagaagcuguuccugaaggccaucgagcuggaccccaccaagggcaacugcuacaugcacuacggccaguuccugcuggaggaggccagacugaucgaggccgccgagauggccaagaaggccgccgagcuggacagcaccgaguucgacgugguguucaacgccgcccacaugcugagacaggccagccugaacgaggccgccgagaaguacuacgaccuggccgccagacugagacccaacuaccccgccgcccugaugaaccugggcgccauccugcaccugaacggcagacugcagaaggccgaggccaacuaccugagagcccugcagcugaagcccgacgacgugaucacccagagcaaccugagaaagcuguggaacaucauggagaagcagggccugaagaccagcaagaccuaa

SEQ ID NO: 24833 - RNA, 2745 nt, Artificial Sequence
  TMTC3__Homo_sapiens__NP_861448
auggccaacaucaaccugaaggagaucacccugaucgugggcguggugaccgccugcuacuggaacagccuguucugcggcuucguguucgacgacgugagcgccauccuggacaacaaggaccugcaccccagcaccccccugaagacccuguuccagaacgacuucuggggcacccccaugagcgaggagagaagccacaagagcuacagaccccugaccgugcugaccuucagacugaacuaccugcugagcgagcugaagcccaugagcuaccaccugcugaacaugaucuuccacgccguggugagcgugaucuuccugaaggugugcaagcuguuccuggacaacaagagcagcgugaucgccagccugcuguucgccgugcaccccauccacaccgaggccgugaccggcguggugggcagagccgagcugcugagcagcaucuucuuccuggccgccuuccugagcuacaccagaagcaagggccccgacaacagcaucaucuggacccccaucgcccugaccguguuccugguggccguggccacccugugcaaggagcagggcaucaccguggugggcaucugcugcguguacgagguguucaucgcccagggcuacacccugccccugcugugcaccaccgccggccaguuccugagaggcaagggcagcauccccuucagcaugcugcagacccuggugaagcugaucgugcugauguucagcacccugcugcugguggugaucagagugcaggugauccagagccagcugcccguguucaccagauucgacaaccccgccgccgugagccccacccccaccagacagcugaccuucaacuaccugcugcccgugaacgccuggcugcugcugaaccccagcgagcugugcugcgacuggaccaugggcaccaucccccugaucgagagccugcuggacaucagaaaccuggccaccuucaccuucuucugcuuccugggcaugcugggcguguucagcaucagauacagcggcgacagcagcaagaccgugcugauggcccugugccugauggcccugcccuucauccccgccagcaaccuguucuuccccgugggcuucgugguggccgagagagugcuguacgugcccagcaugggcuucugcauccugguggcccacggcuggcagaagaucagcaccaagagcguguucaagaagcugagcuggaucugccugagcauggugauccugacccacagccugaagaccuuccacagaaacugggacugggagagcgaguacacccuguucaugagcgcccugaaggugaacaagaacaacgccaagcuguggaacaacgugggccacgcccuggagaacgagaagaacuucgagagagcccugaaguacuuccugcaggccacccacgugcagcccgacgacaucggcgcccacaugaacgugggcagaaccuacaagaaccugaacagaaccaaggaggccgaggagagcuacaugauggccaagagccugaugccccagaucauccccggcaagaaguacgccgccagaaucgcccccaaccaccugaacguguacaucaaccuggccaaccugaucagagccaacgagagcagacuggaggaggccgaccagcuguacagacaggccaucagcaugagacccgacuucaagcaggccuacaucagcagaggcgagcugcugcugaagaugaacaagccccugaaggccaaggaggccuaccugaaggcccuggagcuggacagaaacaacgccgaccugugguacaaccuggccaucgugcacaucgagcugaaggagcccaacgaggcccugaagaacuucaacagagcccuggagcugaaccccaagcacaagcuggcccuguucaacagcgccaucgugaugcaggagagcggcgaggugaagcugagacccgaggccagaaagagacugcugagcuacaucaacgaggagccccuggacgccaacggcuacuucaaccugggcaugcuggccauggacgacaagaaggacaacgaggccgagaucuggaugaagaaggccaucaagcugcaggccgacuucagaagcgcccuguucaaccuggcccugcuguacagccagaccgccaaggagcugaaggcccugcccauccuggaggagcugcugagauacuaccccgaccacaucaagggccugauccugaagggcgacauccugaugaaccagaagaaggacauccugggcgccaagaagugcuucgagagaauccuggagauggaccccagcaacgugcagggcaagcacaaccugugcgugguguacuucgaggagaaggaccugcugaaggccgagagaugccugcuggagacccuggcccuggccccccacgaggaguacauccagagacaccugaacaucgugagagacaagaucagcagcagcagcuucaucgagcccaucuuccccaccagcaagaucagcagcguggagggcaagaagauccccaccgagagcgugaaggagaucagaggcgagagcagacagacccagaucgugaagaccagcgacaacaagagccagagcaagagcaacaagcagcugggcaagaacggcgacgaggagaccccccacaagaccaccaaggacaucaaggagaucgagaagaagagaguggccgcccugaagagacuggaggagaucgagagaauccugaacggcgaguaa

SEQ ID NO: 24834 - RNA, 843 nt, Artificial Sequence
  TMX1__Homo_sapiens__NP_110382
auggcccccagcggcagccuggccgugccccuggccgugcuggugcugcugcuguggggcgcccccuggacccacggcagaagaagcaacgugagagugaucaccgacgagaacuggagagagcugcuggagggcgacuggaugaucgaguucuacgcccccuggugccccgccugccagaaccugcagcccgagugggagagcuucgccgaguggggcgaggaccuggaggugaacaucgccaagguggacgugaccgagcagcccggccugagcggcagauucaucaucaccgcccugcccaccaucuaccacugcaaggacggcgaguucagaagauaccagggccccagaaccaagaaggacuucaucaacuucaucagcgacaaggaguggaagagcaucgagcccgugagcagcugguucggccccggcagcgugcugaugagcagcaugagcgcccuguuccagcugagcauguggaucagaaccugccacaacuacuucaucgaggaccugggccugcccguguggggcagcuacaccguguucgcccuggccacccuguucagcggccugcugcugggccugugcaugaucuucguggccgacugccugugccccagcaagagaagaagaccccagcccuaccccuaccccagcaagaagcugcugagcgagagcgcccagccccugaagaagguggaggaggagcaggaggccgacgaggaggacgugagcgaggaggaggccgagagcaaggagggcaccaacaaggacuucccccagaacgccaucagacagagaagccugggccccagccuggccaccgacaagagcuaa

SEQ ID NO: 24835 - RNA, 777 nt, Artificial Sequence
  TMX2__Homo_sapiens__NP_001137484
auggccgugcuggccccccugaucgcccugguguacagcgugcccagacugagcagauggcuggcccagcccuacuaccugcugagcgcccugcugagcgccgccuuccugcuggugagaaagcugcccccccugugccacggccugcccacccagagagaggacggcaaccccugcgacuucgacuggagagagguggagauccugauguuccugagcgccaucgugaugaugaagaacagaagaagcauguuccugaugaccugcaagcccccccuguacaugggccccgaguacaucaaguacuucaacgacaagaccaucgacgaggagcuggagagagacaagagagugaccuggaucguggaguucuucgccaacuggagcaacgacugccagagcuucgcccccaucuacgccgaccugagccugaaguacaacugcaccggccugaacuucggcaagguggacgugggcagauacaccgacgugagcaccagauacaaggugagcaccagcccccugaccaagcagcugcccacccugauccuguuccagggcggcaaggaggccaugagaagaccccagaucgacaagaagggcagagccgugagcuggaccuucagcgaggagaacgugaucagagaguucaaccugaacgagcuguaccagagagccaagaagcugagcaaggccggcgacaacauccccgaggagcagcccguggccagcacccccaccaccgugagcgacggcgagaacaagaaggacaaguaa

SEQ ID NO: 24836 - RNA, 1365 nt, Artificial Sequence
  TMX3__Homo_sapiens__NP_061895
auggccgccuggaagagcuggaccgcccugagacugugcgccaccgugguggugcuggacaugguggugugcaagggcuucguggaggaccuggacgagagcuucaaggagaacagaaacgacgacaucuggcugguggacuucuacgcccccuggugcggccacugcaagaagcuggagcccaucuggaacgaggugggccuggagaugaagagcaucggcagccccgugaaggugggcaagauggacgccaccagcuacagcagcaucgccagcgaguucggcgugagaggcuaccccaccaucaagcugcugaagggcgaccuggccuacaacuacagaggccccagaaccaaggacgacaucaucgaguucgcccacagagugagcggcgcccugaucagaccccugcccagccagcagauguucgagcacaugcagaagagacacagaguguucuucguguacgugggcggcgagagcccccugaaggagaaguacaucgacgccgccagcgagcugaucguguacaccuacuucuucagcgccagcgaggagguggugcccgaguacgugacccugaaggagaugcccgccgugcugguguucaaggacgagaccuacuucguguacgacgaguacgaggacggcgaccugagcagcuggaucaacagagagagauuccagaacuaccuggccauggacggcuuccugcuguacgagcugggcgacaccggcaagcugguggcccuggccgugaucgacgagaagaacaccagcguggagcacaccagacugaagagcaucauccaggagguggccagagacuacagagaccuguuccacagagacuuccaguucggccacauggacggcaacgacuacaucaacacccugcugauggacgagcugaccgugcccaccgugguggugcugaacaccagcaaccagcaguacuuccugcuggacagacagaucaagaacguggaggacauggugcaguucaucaacaacauccuggacggcaccguggaggcccagggcggcgacagcauccugcagagacugaagagaaucguguucgacgccaagagcaccaucgugagcaucuucaagagcagcccccugaugggcugcuuccuguucggccugccccugggcgugaucagcaucaugugcuacggcaucuacaccgccgacaccgacggcggcuacaucgaggagagauacgaggugagcaagagcgagaacgagaaccaggagcagaucgaggagagcaaggagcagcaggagcccagcagcggcggcagcguggugcccaccgugcaggagcccaaggacgugcuggagaagaagaaggacuaa

SEQ ID NO: 24837 - RNA, 6606 nt, Artificial Sequence
  TNC__Homo_sapiens__NP_002151
augggcgccaugacccagcugcuggccggcguguuccuggccuuccuggcccuggccaccgagggcggcgugcugaagaaggugaucagacacaagagacagagcggcgugaacgccacccugcccgaggagaaccagcccgugguguucaaccacguguacaacaucaagcugcccgugggcagccagugcagcguggaccuggagagcgccagcggcgagaaggaccuggccccccccagcgagcccagcgagagcuuccaggagcacaccguggacggcgagaaccagaucguguucacccacagaaucaacauccccagaagagccugcggcugcgccgccgcccccgacgugaaggagcugcugagcagacuggaggagcuggagaaccuggugagcagccugagagagcagugcaccgccggcgccggcugcugccugcagcccgccaccggcagacuggacaccagacccuucugcagcggcagaggcaacuucagcaccgagggcugcggcugcgugugcgagcccggcuggaagggccccaacugcagcgagcccgagugccccggcaacugccaccugagaggcagaugcaucgacggccagugcaucugcgacgacggcuucaccggcgaggacugcagccagcuggccugccccagcgacugcaacgaccagggcaagugcgugaacggcgugugcaucugcuucgagggcuacgccggcgccgacugcagcagagagaucugccccgugcccugcagcgaggagcacggcaccugcguggacggccugugcgugugccacgacggcuucgccggcgacgacugcaacaagccccugugccugaacaacugcuacaacagaggcagaugcguggagaacgagugcgugugcgacgagggcuucaccggcgaggacugcagcgagcugaucugccccaacgacugcuucgacagaggcagaugcaucaacggcaccugcuacugcgaggagggcuucaccggcgaggacugcggcaagcccaccugcccccacgccugccacacccagggcagaugcgaggagggccagugcgugugcgacgagggcuucgccggcguggacugcagcgagaagagaugccccgccgacugccacaacagaggcagaugcguggacggcagaugcgagugcgacgacggcuucaccggcgccgacugcggcgagcugaagugccccaacggcugcagcggccacggcagaugcgugaacggccagugcgugugcgacgagggcuacaccggcgaggacugcagccagcugagaugccccaacgacugccacagcagaggcagaugcguggagggcaagugcgugugcgagcagggcuucaagggcuacgacugcagcgacaugagcugccccaacgacugccaccagcacggcagaugcgugaacggcaugugcgugugcgacgacggcuacaccggcgaggacugcagagacagacagugccccagagacugcagcaacagaggccugugcguggacggccagugcgugugcgaggacggcuucaccggccccgacugcgccgagcugagcugccccaacgacugccacggccagggcagaugcgugaacggccagugcgugugccacgagggcuucaugggcaaggacugcaaggagcagagaugccccagcgacugccacggccagggcagaugcguggacggccagugcaucugccacgagggcuucaccggccuggacugcggccagcacagcugccccagcgacugcaacaaccugggccagugcgugagcggcagaugcaucugcaacgagggcuacagcggcgaggacugcagcgaggugagcccccccaaggaccugguggugaccgaggugaccgaggagaccgugaaccuggccugggacaacgagaugagagugaccgaguaccuggugguguacacccccacccacgagggcggccuggagaugcaguucagagugcccggcgaccagaccagcaccaucauccaggagcuggagcccggcguggaguacuucaucagaguguucgccauccuggagaacaagaagagcauccccgugagcgccagaguggccaccuaccugcccgcccccgagggccugaaguucaagagcaucaaggagaccagcguggagguggagugggacccccuggacaucgccuucgagaccugggagaucaucuucagaaacaugaacaaggaggacgagggcgagaucaccaagagccugagaagacccgagaccagcuacagacagaccggccuggcccccggccaggaguacgagaucagccugcacaucgugaagaacaacaccagaggccccggccugaagagagugaccaccaccagacuggacgcccccagccagaucgaggugaaggacgugaccgacaccaccgcccugaucaccugguucaagccccuggccgagaucgacggcaucgagcugaccuacggcaucaaggacgugcccggcgacagaaccaccaucgaccugaccgaggacgagaaccaguacagcaucggcaaccugaagcccgacaccgaguacgaggugagccugaucagcagaagaggcgacaugagcagcaaccccgccaaggagaccuucaccaccggccuggacgcccccagaaaccugagaagagugagccagaccgacaacagcaucacccuggaguggagaaacggcaaggccgccaucgacagcuacagaaucaaguacgcccccaucagcggcggcgaccacgccgagguggacgugcccaagagccagcaggccaccaccaagaccacccugaccggccugagacccggcaccgaguacggcaucggcgugagcgccgugaaggaggacaaggagagcaaccccgccaccaucaacgccgccaccgagcuggacacccccaaggaccugcaggugagcgagaccgccgagaccagccugacccugcuguggaagaccccccuggccaaguucgacagauacagacugaacuacagccugcccaccggccagugggugggcgugcagcugcccagaaacaccaccagcuacgugcugagaggccuggagcccggccaggaguacaacgugcugcugaccgccgagaagggcagacacaagagcaagcccgccagagugaaggccagcaccgagcaggcccccgagcuggagaaccugaccgugaccgaggugggcugggacggccugagacugaacuggaccgccgccgaccaggccuacgagcacuucaucauccaggugcaggaggccaacaagguggaggccgccagaaaccugaccgugcccggcagccugagagccguggacauccccggccugaaggccgccacccccuacaccgugagcaucuacggcgugauccagggcuacagaacccccgugcugagcgccgaggccagcaccggcgagacccccaaccugggcgagguggugguggccgaggugggcugggacgcccugaagcugaacuggaccgcccccgagggcgccuacgaguacuucuucauccaggugcaggaggccgacaccguggaggccgcccagaaccugaccgugcccggcggccugagaagcaccgaccugcccggccugaaggccgccacccacuacaccaucaccaucagaggcgugacccaggacuucagcaccaccccccugagcguggaggugcugaccgaggaggugcccgacaugggcaaccugaccgugaccgaggugagcugggacgcccugagacugaacuggaccacccccgacggcaccuacgaccaguucaccauccaggugcaggaggccgaccagguggaggaggcccacaaccugaccgugcccggcagccugagaagcauggagauccccggccugagagccggcacccccuacaccgugacccugcacggcgaggugagaggccacagcaccagaccccuggccguggagguggugaccgaggaccugccccagcugggcgaccuggccgugagcgaggugggcugggacggccugagacugaacuggaccgccgccgacaacgccuacgagcacuucgugauccaggugcaggaggugaacaagguggaggccgcccagaaccugacccugcccggcagccugagagccguggacauccccggccuggaggccgccacccccuacagagugagcaucuacggcgugaucagaggcuacagaacccccgugcugagcgccgaggccagcaccgccaaggagcccgagaucggcaaccugaacgugagcgacaucacccccgagagcuucaaccugagcuggauggccaccgacggcaucuucgagaccuucaccaucgagaucaucgacagcaacagacugcuggagaccguggaguacaacaucagcggcgccgagagaaccgcccacaucagcggccugccccccagcaccgacuucaucguguaccugagcggccuggcccccagcaucagaaccaagaccaucagcgccaccgccaccaccgaggcccugccccugcuggagaaccugaccaucagcgacaucaaccccuacggcuucaccgugagcuggauggccagcgagaacgccuucgacagcuuccuggugaccgugguggacagcggcaagcugcuggacccccaggaguucacccugagcggcacccagagaaagcuggagcugagaggccugaucaccggcaucggcuacgaggugauggugagcggcuucacccagggccaccagaccaagccccugagagccgagaucgugaccgaggccgagcccgagguggacaaccugcuggugagcgacgccacccccgacggcuucagacugagcuggaccgccgacgagggcguguucgacaacuucgugcugaagaucagagacaccaagaagcagagcgagccccuggagaucacccugcuggcccccgagagaaccagagacaucaccggccugagagaggccaccgaguacgagaucgagcuguacggcaucagcaagggcagaagaagccagaccgugagcgccaucgccaccaccgccaugggcagccccaaggaggugaucuucagcgacaucaccgagaacagcgccaccgugagcuggagagcccccaccgcccagguggagagcuucagaaucaccuacgugcccaucaccggcggcacccccagcauggugaccguggacggcaccaagacccagaccagacuggugaagcugauccccggcguggaguaccuggugagcaucaucgccaugaagggcuucgaggagagcgagcccgugagcggcagcuucaccaccgcccuggacggccccagcggccuggugaccgccaacaucaccgacagcgaggcccuggccagauggcagcccgccaucgccaccguggacagcuacgugaucagcuacaccggcgagaaggugcccgagaucaccagaaccgugagcggcaacaccguggaguacgcccugaccgaccuggagcccgccaccgaguacacccugagaaucuucgccgagaagggcccccagaagagcagcaccaucaccgccaaguucaccaccgaccuggacagccccagagaccugaccgccaccgaggugcagagcgagaccgcccugcugaccuggagaccccccagagccagcgugaccggcuaccugcugguguacgagagcguggacggcaccgugaaggaggugaucgugggccccgacaccaccagcuacagccuggccgaccugagccccagcacccacuacaccgccaagauccaggcccugaacggcccccugagaagcaacaugauccagaccaucuucaccaccaucggccugcuguaccccuuccccaaggacugcagccaggccaugcugaacggcgacaccaccagcggccuguacaccaucuaccugaacggcgacaaggccgaggcccuggagguguucugcgacaugaccagcgacggcggcggcuggaucguguuccugagaagaaagaacggcagagagaacuucuaccagaacuggaaggccuacgccgccggcuucggcgacagaagagaggaguucuggcugggccuggacaaccugaacaagaucaccgcccagggccaguacgagcugagaguggaccugagagaccacggcgagaccgccuucgccguguacgacaaguucagcgugggcgacgccaagaccagauacaagcugaagguggagggcuacagcggcaccgccggcgacagcauggccuaccacaacggcagaagcuucagcaccuucgacaaggacaccgacagcgccaucaccaacugcgcccugagcuacaagggcgccuucugguacagaaacugccacagagugaaccugaugggcagauacggcgacaacaaccacagccagggcgugaacugguuccacuggaagggccacgagcacagcauccaguucgccgagaugaagcugagacccagcaacuucagaaaccuggagggcagaagaaagagagccuaa

SEQ ID NO: 24838 - RNA, 951 nt, Artificial Sequence
  TNFAIP1__Homo_sapiens__NP_066960
augagcggcgacaccugccugugccccgccagcggcgccaagcccaagcugagcggcuucaagggcggcggccugggcaacaaguacgugcagcugaacgugggcggcagccuguacuacaccaccgugagagcccugaccagacacgacaccaugcugaaggccauguucagcggcagaauggaggugcugaccgacaaggagggcuggauccugaucgacagaugcggcaagcacuucggcaccauccugaacuaccugagagacgacaccaucacccugccccagaacagacaggagaucaaggagcugauggccgaggccaaguacuaccugauccagggccuggugaacaugugccagagcgcccugcaggacaagaaggacagcuaccagcccgugugcaacauccccaucaucaccagccugaaggaggaggagagacugaucgagagcagcaccaagcccguggugaagcugcuguacaacagaagcaacaacaaguacagcuacaccagcaacagcgacgaccaccugcugaagaacaucgagcuguucgacaagcugagccugagauucaacggcagagugcuguucaucaaggacgugaucggcgacgagaucugcugcuggagcuucuacggccagggcagaaagcuggccgaggugugcugcaccagcaucguguacgccaccgagaagaagcagaccaagguggaguuccccgaggccagaaucuacgaggagacccugaacgugcugcuguacgagacccccagagugcccgacaacagccugcuggaggccaccagcagaagcagaagccaggccagccccagcgaggacgaggagaccuucgagcugagagacagagugagaagaauccacgugaagagauacagcaccuacgacgacagacagcugggccaccagagcacccacagagacuaa

SEQ ID NO: 24839 - RNA, 1965 nt, Artificial Sequence
  TNFAIP2__Homo_sapiens__NP_006282
augagcgaggccagcagcgaggaccuggugcccccccuggaggccggcgccgcccccuacagagaggaggaggaggccgccaagaagaagaaggagaagaagaagaagagcaagggccuggccaacguguucugcguguucaccaagggcaagaagaagaagggccagcccagcagcgccgagcccgaggacgccgccggcagcagacagggccuggacggccccccccccaccguggaggagcugaaggccgcccuggagagaggccagcuggaggccgccagaccccugcuggcccuggagagagagcuggccgccgccgccgccgccggcggcgugagcgaggaggagcuggugagaagacagagcaagguggaggcccuguacgagcugcugagagaccaggugcugggcgugcugagaagaccccuggaggccccccccgagagacugagacaggcccuggccgugguggccgagcaggagagagaggacagacaggccgccgccgccggccccggcaccagcggccuggccgccaccagacccagaagauggcugcagcuguggagaagaggcguggccgaggccgccgaggagagaaugggccagagacccgccgccggcgccgaggugcccgagagcguguuccugcaccugggcagaaccaugaaggaggaccuggaggccgugguggagagacugaagccccuguuccccgccgaguucggcgugguggccgccuacgccgagagcuaccaccagcacuucgccgcccaccuggccgccguggcccaguucgagcugugcgagagagacaccuacaugcugcugcugugggugcagaaccuguaccccaacgacaucaucaacagccccaagcuggugggcgagcugcagggcaugggccugggcagccugcugccccccagacagaucagacugcuggaggccaccuuccugagcagcgaggccgccaacgugagagagcugauggacagagcccuggagcuggaggccagaagaugggccgaggacgugcccccccagagacuggacggccacugccacagcgagcuggccaucgacaucauccagaucaccagccaggcccaggccaaggccgagagcaucacccuggaccugggcagccagaucaagagagugcugcugguggagcugcccgccuuccugagaagcuaccagagagccuucaacgaguuccuggagagaggcaagcagcugaccaacuacagagccaacgugaucgccaacaucaacaacugccugagcuucagaaugagcauggagcagaacuggcaggugccccaggacacccugagccugcugcugggcccccugggcgagcugaagagccacggcuucgacacccugcugcagaaccugcacgaggaccugaagccccuguucaagagauucacccacaccagaugggccgcccccguggagacccuggagaacaucaucgccaccguggacaccagacugcccgaguucagcgagcugcagggcugcuucagagaggagcugauggaggcccugcaccugcaccuggugaaggaguacaucauccagcugagcaagggcagacuggugcugaagaccgccgagcagcagcagcagcuggccggcuacauccuggccaacgccgacaccauccagcacuucugcacccagcacggcagccccgccaccuggcugcagcccgcccugcccacccuggccgagaucaucagacugcaggaccccagcgccaucaagaucgagguggccaccuacgccaccugcuaccccgacuucagcaagggccaccugagcgccauccuggccaucaagggcaaccugagcaacagcgaggugaagagaaucagaagcauccuggacgugagcaugggcgcccaggagcccagcagaccccuguucagccugaucaaggugggcuaa

SEQ ID NO: 24840 - RNA, 2373 nt, Artificial Sequence
  TNFAIP3__Homo_sapiens__NP_006281
auggccgagcaggugcugccccaggcccuguaccugagcaacaugagaaaggccgugaagaucagagagagaacccccgaggacaucuucaagcccaccaacggcaucauccaccacuucaagaccaugcacagauacacccuggagauguucagaaccugccaguucugcccccaguucagagagaucauccacaaggcccugaucgacagaaacauccaggccacccuggagagccagaagaagcugaacuggugcagagaggugagaaagcugguggcccugaagaccaacggcgacggcaacugccugaugcacgccaccagccaguacauguggggcgugcaggacaccgaccuggugcugagaaaggcccuguucagcacccugaaggagaccgacaccagaaacuucaaguucagauggcagcuggagagccugaagagccaggaguucguggagaccggccugugcuacgacaccagaaacuggaacgacgagugggacaaccugaucaagauggccagcaccgacacccccauggccagaagcggccugcaguacaacagccuggaggagauccacaucuucgugcugugcaacauccugagaagacccaucaucgugaucagcgacaagaugcugagaagccuggagagcggcagcaacuucgccccccugaaggugggcggcaucuaccugccccugcacuggcccgcccaggagugcuacagauaccccaucgugcugggcuacgacagccaccacuucgugccccuggugacccugaaggacagcggccccgagaucagagccgugccccuggugaacagagacagaggcagauucgaggaccugaaggugcacuuccugaccgaccccgagaacgagaugaaggagaagcugcugaaggaguaccugauggugaucgagauccccgugcagggcugggaccacggcaccacccaccugaucaacgccgccaagcuggacgaggccaaccugcccaaggagaucaaccugguggacgacuacuucgagcuggugcagcacgaguacaagaaguggcaggagaacagcgagcagggcagaagagagggccacgcccagaaccccauggagcccagcgugccccagcugagccugauggacgugaagugcgagacccccaacugccccuucuucaugagcgugaacacccagccccugugccacgagugcagcgagagaagacagaagaaccagaacaagcugcccaagcugaacagcaagcccggccccgagggccugcccggcauggcccugggcgccagcagaggcgaggccuacgagccccuggccuggaaccccgaggagagcaccggcggcccccacagcgccccccccaccgcccccagccccuuccuguucagcgagaccaccgccaugaagugcagaagccccggcugccccuucacccugaacgugcagcacaacggcuucugcgagagaugccacaacgccagacagcugcacgccagccacgcccccgaccacaccagacaccuggaccccggcaagugccaggccugccugcaggacgugaccagaaccuucaacggcaucugcagcaccugcuucaagagaaccaccgccgaggccagcagcagccugagcaccagccugccccccagcugccaccagagaagcaagagcgaccccagcagacuggugagaagccccagcccccacagcugccacagagccggcaacgacgcccccgccggcugccugagccaggccgccagaacccccggcgacagaaccggcaccagcaagugcagaaaggccggcugcguguacuucggcacccccgagaacaagggcuucugcacccugugcuucaucgaguacagagagaacaagcacuucgccgccgccagcggcaaggugagccccaccgccagcagauuccagaacaccauccccugccugggcagagagugcggcacccugggcagcaccauguucgagggcuacugccagaagugcuucaucgaggcccagaaccagagauuccacgaggccaagagaaccgaggagcagcugagaagcagccagagaagagacgugcccagaaccacccagagcaccagcagacccaagugcgccagagccagcugcaagaacauccuggccugcagaagcgaggagcugugcauggagugccagcaccccaaccagagaaugggccccggcgcccacagaggcgagcccgcccccgaggacccccccaagcagagaugcagagcccccgccugcgaccacuucggcaacgccaagugcaacggcuacugcaacgagugcuuccaguucaagcagauguacggcuaa

SEQ ID NO: 24841 - RNA, 834 nt, Artificial Sequence
  TNFAIP6__Homo_sapiens__NP_009046
augaucauccugaucuaccuguuccugcugcugugggaggacacccagggcuggggcuucaaggacggcaucuuccacaacagcaucuggcuggagagagccgccggcguguaccacagagaggccagaagcggcaaguacaagcugaccuacgccgaggccaaggccgugugcgaguucgagggcggccaccuggccaccuacaagcagcuggaggccgccagaaagaucggcuuccacgugugcgccgccggcuggauggccaagggcagagugggcuaccccaucgugaagcccggccccaacugcggcuucggcaagaccggcaucaucgacuacggcaucagacugaacagaagcgagagaugggacgccuacugcuacaacccccacgccaaggagugcggcggcguguucaccgaccccaagcagaucuucaagagccccggcuuccccaacgaguacgaggacaaccagaucugcuacuggcacaucagacugaaguacggccagagaauccaccugagcuuccuggacuucgaccuggaggacgaccccggcugccuggccgacuacguggagaucuacgacagcuacgacgacgugcacggcuucgugggcagauacugcggcgacgagcugcccgacgacaucaucagcaccggcaacgugaugacccugaaguuccugagcgacgccagcgugaccgccggcggcuuccagaucaaguacguggccauggaccccgugagcaagagcagccagggcaagaacaccagcaccaccagcaccggcaacaagaacuuccuggccggcagauucagccaccuguaa

SEQ ID NO: 24842 - RNA, 567 nt, Artificial Sequence
  TNFAIP8__Homo_sapiens__NP_001071122
auggccaccgacguguucaacagcaagaaccuggccgugcaggcccagaagaagauccugggcaagauggugagcaagagcaucgccaccacccugaucgacgacaccagcagcgaggugcuggacgagcuguacagagugaccagagaguacacccagaacaagaaggaggccgagaagaucaucaagaaccugaucaagaccgugaucaagcuggccauccuguacagaaacaaccaguucaaccaggacgagcuggcccugauggagaaguucaagaagaaggugcaccagcuggccaugaccguggugagcuuccaccagguggacuacaccuucgacagaaacgugcugagcagacugcugaacgagugcagagagaugcugcaccagaucauccagagacaccugaccgccaagagccacggcagagugaacaacguguucgaccacuucagcgacugcgaguuccuggccgcccuguacaaccccuucggcaacuucaagccccaccugcagaagcugugcgacggcaucaacaagaugcuggacgaggagaacaucuaa

SEQ ID NO: 24843 - RNA, 555 nt, Artificial Sequence
  TNFAIP8L2__Homo_sapiens__NP_078851
auggagagcuucagcagcaagagccuggcccugcaggccgagaagaagcugcugagcaagauggccggcagaagcguggcccaccuguucaucgacgagaccagcagcgaggugcuggacgagcuguacagagugagcaaggaguacacccacagcagaccccaggcccagagagugaucaaggaccugaucaagguggccaucaagguggccgugcugcacagaaacggcagcuucggccccagcgagcuggcccuggccaccagauucagacagaagcugagacagggcgccaugaccgcccugagcuucggcgagguggacuucaccuucgaggccgccgugcuggccggccugcugaccgagugcagagacgugcugcuggagcugguggagcaccaccugacccccaagagccacggcagaaucagacacguguucgaccacuucagcgaccccggccugcugaccgcccuguacggccccgacuucacccagcaccugggcaagaucugcgacggccugagaaagcugcuggacgagggcaagcuguaa

SEQ ID NO: 24844 - RNA, 879 nt, Artificial Sequence
  TNFAIP8L3__Homo_sapiens__NP_997264
augggcaagcccagacagaaccccagcacccuggugagcacccugugcgaggccgagcccaagggcaagcugugggugaacggcuacgccggcacccagggcaccagagacgccacccugcagaccagacugaucccccugagcuuccaccugcagagaggcaagggccuggccgccccccugagcgcccugagcgcccccagacugcccgagagacccgccgacggcagaguggccguggacgcccagcccgccgccagaagcauggacagcgacagcggcgagcagagcgagggcgagcccgugaccgccgccggccccgacguguucagcagcaagagccuggcccugcaggcccagaagaagauccugagcaagaucgccagcaagaccguggccaacaugcugaucgacgacaccagcagcgagaucuucgacgagcuguacaaggugaccaaggagcacacccacaacaagaaggaggcccacaagaucaugaaggaccugaucaagguggccaucaagaucggcauccuguacagaaacaaccaguucagccaggaggagcuggugaucguggagaaguucagaaagaagcugaaccagaccgccaugaccaucgugagcuucuacgagguggaguacaccuucgacagaaacgugcugagcaaccugcugcacgagugcaaggaccuggugcacgagcuggugcagagacaccugacccccagaacccacggcagaaucaaccacguguucaaccacuucgccgacguggaguuccugagcacccuguacagccuggacggcgacugcagacccaaccugaagagaaucugcgagggcaucaacaagcugcuggacgagaaggugcuguaa

SEQ ID NO: 24845 - RNA, 702 nt, Artificial Sequence
  TNF__Homo_sapiens__NP_000585
augagcaccgagagcaugaucagagacguggagcuggccgaggaggcccugcccaagaagaccggcggcccccagggcagcagaagaugccuguuccugagccuguucagcuuccugaucguggccggcgccaccacccuguucugccugcugcacuucggcgugaucggcccccagagagaggaguuccccagagaccugagccugaucagcccccuggcccaggccgugagaagcagcagcagaacccccagcgacaagcccguggcccacgugguggccaacccccaggccgagggccagcugcaguggcugaacagaagagccaacgcccugcuggccaacggcguggagcugagagacaaccagcugguggugcccagcgagggccuguaccugaucuacagccaggugcuguucaagggccagggcugccccagcacccacgugcugcugacccacaccaucagcagaaucgccgugagcuaccagaccaaggugaaccugcugagcgccaucaagagccccugccagagagagacccccgagggcgccgaggccaagcccugguacgagcccaucuaccugggcggcguguuccagcuggagaagggcgacagacugagcgccgagaucaacagacccgacuaccuggacuucgccgagagcggccagguguacuucggcaucaucgcccuguaa

SEQ ID NO: 24846 - RNA, 1407 nt, Artificial Sequence
  TNFRSF10A__Homo_sapiens__NP_003835
auggcccccccccccgccagagugcaccugggcgccuuccuggccgugacccccaaccccggcagcgccgccagcggcaccgaggccgccgccgccacccccagcaagguguggggcagcagcgccggcagaaucgagcccagaggcggcggcagaggcgcccugcccaccagcaugggccagcacggccccagcgccagagccagagccggcagagcccccggccccagacccgccagagaggccagccccagacugagagugcacaagaccuucaaguucgugguggugggcgugcugcugcagguggugcccagcagcgccgccaccaucaagcugcacgaccagagcaucggcacccagcagugggagcacagcccccugggcgagcugugcccccccggcagccacagaagcgagcaccccggcgccugcaacagaugcaccgagggcgugggcuacaccaacgccagcaacaaccuguucgccugccugcccugcaccgccugcaagagcgacgaggaggagagaagccccugcaccaccaccagaaacaccgccugccagugcaagcccggcaccuucagaaacgacaacagcgccgagaugugcagaaagugcagcagaggcugccccagaggcauggugaaggugaaggacugcacccccuggagcgacaucgagugcgugcacaaggagagcggcaacggccacaacaucugggugauccugguggugacccugguggugccccugcugcugguggccgugcugaucgugugcugcugcaucggcagcggcugcggcggcgaccccaagugcauggacagagugugcuucuggagacugggccugcugagaggccccggcgccgaggacaacgcccacaacgagauccugagcaacgccgacagccugagcaccuucgugagcgagcagcagauggagagccaggagcccgccgaccugaccggcgugaccgugcagagccccggcgaggcccagugccugcugggccccgccgaggccgagggcagccagagaagaagacugcuggugcccgccaacggcgccgaccccaccgagacccugaugcuguucuucgacaaguucgccaacaucgugcccuucgacagcugggaccagcugaugagacagcuggaccugaccaagaacgagaucgacguggugagagccggcaccgccggccccggcgacgcccuguacgccaugcugaugaagugggugaacaagaccggcagaaacgccagcauccacacccugcuggacgcccuggagagaauggaggagagacacgccagagagaagauccaggaccugcugguggacagcggcaaguucaucuaccuggaggacggcaccggcagcgccgugagccuggaguaa

SEQ ID NO: 24847 - RNA, 1323 nt, Artificial Sequence
  TNFRSF10B__Homo_sapiens__NP_003833
auggagcagagaggccagaacgcccccgccgccagcggcgccagaaagagacacggccccggccccagagaggccagaggcgccagacccggccccagagugcccaagacccuggugcuggugguggccgccgugcugcugcuggugagcgccgagagcgcccugaucacccagcaggaccuggccccccagcagagagccgccccccagcagaagagaagcagccccagcgagggccugugcccccccggccaccacaucagcgaggacggcagagacugcaucagcugcaaguacggccaggacuacagcacccacuggaacgaccugcuguucugccugagaugcaccagaugcgacagcggcgagguggagcugagccccugcaccaccaccagaaacaccgugugccagugcgaggagggcaccuucagagaggaggacagccccgagaugugcagaaagugcagaaccggcugccccagaggcauggugaaggugggcgacugcacccccuggagcgacaucgagugcgugcacaaggagagcggcaccaagcacagcggcgaggugcccgccguggaggagaccgugaccagcagccccggcacccccgccagccccugcagccugagcggcaucaucaucggcgugaccguggccgccguggugcugaucguggccguguucgugugcaagagccugcuguggaagaaggugcugcccuaccugaagggcaucugcagcggcggcggcggcgaccccgagagaguggacagaagcagccagagacccggcgccgaggacaacgugcugaacgagaucgugagcauccugcagcccacccaggugcccgagcaggagauggaggugcaggagcccgccgagcccaccggcgugaacaugcugagccccggcgagagcgagcaccugcuggagcccgccgaggccgagagaagccagagaagaagacugcuggugcccgccaacgagggcgaccccaccgagacccugagacagugcuucgacgacuucgccgaccuggugcccuucgacagcugggagccccugaugagaaagcugggccugauggacaacgagaucaagguggccaaggccgaggccgccggccacagagacacccuguacaccaugcugaucaagugggugaacaagaccggcagagacgccagcgugcacacccugcuggacgcccuggagacccugggcgagagacuggccaagcagaagaucgaggaccaccugcugagcagcggcaaguucauguaccuggagggcaacgccgacagcgccaugagcuaa

SEQ ID NO: 24848 - RNA, 780 nt, Artificial Sequence
  TNFRSF10C__Homo_sapiens__NP_003832
auggccagaauccccaagacccugaaguucgugguggugaucguggccgugcugcugcccgugcuggccuacagcgccaccaccgccagacaggaggaggugccccagcagaccguggccccccagcagcagagacacagcuucaagggcgaggagugccccgccggcagccacagaagcgagcacaccggcgccugcaaccccugcaccgagggcguggacuacaccaacgccagcaacaacgagcccagcugcuuccccugcaccgugugcaagagcgaccagaagcacaagagcagcugcaccaugaccagagacaccgugugccagugcaaggagggcaccuucagaaacgagaacagccccgagaugugcagaaagugcagcagaugccccagcggcgaggugcaggugagcaacugcaccagcugggacgacauccagugcguggaggaguucggcgccaacgccaccguggagacccccgccgccgaggagaccaugaacaccagccccggcacccccgcccccgccgccgaggagaccaugaacaccagccccggcacccccgcccccgccgccgaggagaccaugaccaccagccccggcacccccgcccccgccgccgaggagaccaugaccaccagccccggcacccccgcccccgccgccgaggagaccaugaccaccagccccggcacccccgccagcagccacuaccugagcugcaccaucgugggcaucaucgugcugaucgugcugcugaucguguucguguaa

SEQ ID NO: 24849 - RNA, 1161 nt, Artificial Sequence
  TNFRSF10D__Homo_sapiens__NP_003831
augggccuguggggccagagcgugcccaccgccagcagcgccagagccggcagauaccccggcgccagaaccgccagcggcaccagacccuggcugcuggaccccaagauccugaaguucgugguguucaucguggccgugcugcugcccgugagaguggacagcgccaccauccccagacaggacgaggugccccagcagaccguggccccccagcagcagagaagaagccugaaggaggaggagugccccgccggcagccacagaagcgaguacaccggcgccugcaaccccugcaccgagggcguggacuacaccaucgccagcaacaaccugcccagcugccugcugugcaccgugugcaagagcggccagaccaacaagagcagcugcaccaccaccagagacaccgugugccagugcgagaagggcagcuuccaggacaagaacagccccgagaugugcagaaccugcagaaccggcugccccagaggcauggugaaggugagcaacugcacccccagaagcgacaucaagugcaagaacgagagcgccgccagcagcaccggcaagacccccgccgccgaggagaccgugaccaccauccugggcaugcuggccagccccuaccacuaccugaucaucaucguggugcuggugaucauccuggccguggugguggugggcuucagcugcagaaagaaguucaucagcuaccugaagggcaucugcagcggcggcggcggcggccccgagagagugcacagagugcuguucagaagaagaagcugccccagcagagugcccggcgccgaggacaacgccagaaacgagacccugagcaacagauaccugcagcccacccaggugagcgagcaggagauccagggccaggagcuggccgagcugaccggcgugaccguggagcugcccgaggagccccagagacugcuggagcaggccgaggccgagggcugccagagaagaagacugcuggugcccgugaacgacgccgacagcgccgacaucagcacccugcuggacgccagcgccacccuggaggagggccacgccaaggagaccauccaggaccagcuggugggcagcgagaagcuguucuacgaggaggacgaggccggcagcgccaccagcugccuguaa

SEQ ID NO: 24850 - RNA, 900 nt, Artificial Sequence
  TNFRSF11A__Homo_sapiens__NP_001257880
auggcccccagagccagaagaagaagaccccuguucgcccugcugcugcugugcgcccugcuggccagacugcagguggcccugcagaucgccccccccugcaccagcgagaagcacuacgagcaccugggcagaugcugcaacaagugcgagcccggcaaguacaugagcagcaagugcaccaccaccagcgacagcgugugccugcccugcggccccgacgaguaccuggacagcuggaacgaggaggacaagugccugcugcacaaggugugcgacaccggcaaggcccugguggccgugguggccggcaacagcaccacccccagaagaugcgccugcaccgccggcuaccacuggagccaggacugcgagugcugcagaagaaacaccgagugcgcccccggccugggcgcccagcacccccugcagcugaacaaggacaccgugugcaagcccugccuggccggcuacuucagcgacgccuucagcagcaccgacaagugcagacccuggaccaacugcaccuuccugggcaagagaguggagcaccacggcaccgagaagagcgacgccgugugcagcagcagccugcccgccagaaagccccccaacggcaacgugaccggcaacagcaacagcaccuucaucagcagcggccaggugaugaacuucaagggcgacaucaucgugguguacgugagccagaccagccaggagggcgccgccgccgccgccgagcccaugggcagacccgugcaggaggagacccuggccagaagagacagcuucgccggcaacggccccagauuccccgaccccugcggcggccccgagggccugagagagcccgagaaggccagcagacccgugcaggagcagggcggcgccaaggccuaa

SEQ ID NO: 24851 - RNA, 1206 nt, Artificial Sequence
  TNFRSF11B__Homo_sapiens__NP_002537
augaacaaccugcugugcugcgcccugguguuccuggacaucagcaucaaguggaccacccaggagaccuucccccccaaguaccugcacuacgacgaggagaccagccaccagcugcugugcgacaagugcccccccggcaccuaccugaagcagcacugcaccgccaaguggaagaccgugugcgcccccugccccgaccacuacuacaccgacagcuggcacaccagcgacgagugccuguacugcagccccgugugcaaggagcugcaguacgugaagcaggagugcaacagaacccacaacagagugugcgagugcaaggagggcagauaccuggagaucgaguucugccugaagcacagaagcugcccccccggcuucggcguggugcaggccggcacccccgagagaaacaccgugugcaagagaugccccgacggcuucuucagcaacgagaccagcagcaaggcccccugcagaaagcacaccaacugcagcguguucggccugcugcugacccagaagggcaacgccacccacgacaacaucugcagcggcaacagcgagagcacccagaagugcggcaucgacgugacccugugcgaggaggccuucuucagauucgccgugcccaccaaguucacccccaacuggcugagcgugcugguggacaaccugcccggcaccaaggugaacgccgagagcguggagagaaucaagagacagcacagcagccaggagcagaccuuccagcugcugaagcuguggaagcaccagaacaaggaccaggacaucgugaagaagaucauccaggacaucgaccugugcgagaacagcgugcagagacacaucggccacgccaaccugaccuucgagcagcugagaagccugauggagagccugcccggcaagaaggugggcgccgaggacaucgagaagaccaucaaggccugcaagcccagcgaccagauccugaagcugcugagccuguggagaaucaagaacggcgaccaggacacccugaagggccugaugcacgcccugaagcacagcaagaccuaccacuuccccaagaccgugacccagagccugaagaagaccaucagauuccugcacagcuucaccauguacaagcuguaccagaagcuguuccuggagaugaucggcaaccaggugcagagcgugaagaucagcugccuguaa

SEQ ID NO: 24852 - RNA, 390 nt, Artificial Sequence
  TNFRSF12A__Homo_sapiens__NP_057723
auggccagaggcagccugagaagacugcugagacugcuggugcugggccuguggcuggcccugcugagaagcguggccggcgagcaggcccccggcaccgcccccugcagcagaggcagcagcuggagcgccgaccuggacaagugcauggacugcgccagcugcagagccagaccccacagcgacuucugccugggcugcgccgccgccccccccgcccccuucagacugcuguggcccauccugggcggcgcccugagccugaccuucgugcugggccugcugagcggcuuccugguguggagaagaugcagaagaagagagaaguucaccacccccaucgaggagaccggcggcgagggcugccccgccguggcccugauccaguaa

SEQ ID NO: 24853 - RNA, 882 nt, Artificial Sequence
  TNFRSF13B__Homo_sapiens__NP_036584
augagcggccugggcagaagcagaagaggcggcagaagcagaguggaccaggaggagagauucccccagggccuguggaccggcguggccaugagaagcugccccgaggagcaguacugggacccccugcugggcaccugcaugagcugcaagaccaucugcaaccaccagagccagagaaccugcgccgccuucugcagaagccugagcugcagaaaggagcagggcaaguucuacgaccaccugcugagagacugcaucagcugcgccagcaucugcggccagcaccccaagcagugcgccuacuucugcgagaacaagcugagaagccccgugaaccugccccccgagcugagaagacagagaagcggcgagguggagaacaacagcgacaacagcggcagauaccagggccuggagcacagaggcagcgaggccagccccgcccugcccggccugaagcugagcgccgaccagguggcccugguguacagcacccugggccugugccugugcgccgugcugugcugcuuccugguggccguggccugcuuccugaagaagagaggcgaccccugcagcugccagcccagaagcagacccagacagagccccgccaagagcagccaggaccacgccauggaggccggcagccccgugagcaccagccccgagcccguggagaccugcagcuucugcuuccccgagugcagagcccccacccaggagagcgccgugacccccggcacccccgaccccaccugcgccggcagauggggcugccacaccagaaccaccgugcugcagcccugcccccacauccccgacagcggccugggcaucgugugcgugcccgcccaggagggcggccccggcgccuaa

SEQ ID NO: 24854 - RNA, 555 nt, Artificial Sequence
  TNFRSF13C__Homo_sapiens__NP_443177
augagaagaggccccagaagccugagaggcagagacgcccccgcccccacccccugcgugcccgccgagugcuucgaccugcuggugagacacugcguggccugcggccugcugagaacccccagacccaagcccgccggcgccagcagccccgcccccagaaccgcccugcagccccaggagagcgugggcgccggcgccggcgaggccgcccugccccugcccggccugcuguucggcgcccccgcccugcugggccuggcccuggugcuggcccuggugcuggugggccuggugagcuggagaagaagacagagaagacugagaggcgccagcagcgccgaggcccccgacggcgacaaggacgcccccgagccccuggacaaggugaucauccugagccccggcaucagcgacgccaccgcccccgccuggcccccccccggcgaggaccccggcaccaccccccccggccacagcgugcccgugcccgccaccgagcugggcagcaccgagcuggugaccaccaagaccgccggccccgagcagcaguaa

SEQ ID NO: 24855 - RNA, 555 nt, Artificial Sequence
  TNFRSF14__Homo_sapiens__NP_001284534
auggagccccccggcgacuggggccccccccccuggagaagcacccccaagaccgacgugcugagacuggugcuguaccugaccuuccugggcgcccccugcuacgcccccgcccugcccagcugcaaggaggacgaguaccccgugggcagcgagugcugccccaagugcagccccggcuacagagugaaggaggccugcggcgagcugaccggcaccgugugcgagcccugcccccccggcaccuacaucgcccaccugaacggccugagcaagugccugcagugccagaugugcgaccccgccaugggccugagagccagcagaaacugcagcagaaccgagaacgccgugugcggcugcagccccggccacuucugcaucgugcaggacggcgaccacugcgccgccugcagagccuacgccaccagcagccccggccagagagugcagaagggcggcaccgagagccaggacacccugugccagaacugcccccccggcaccuucagccccaacggcacccuggaggagugccagcaccagaccaaguaa

SEQ ID NO: 24856 - RNA, 858 nt, Artificial Sequence
  TNFRSF19__Homo_sapiens__NP_001191388
auggagugcgugcccugcggcgacccccccccccccuacgagccccacugcgccagcaaggugaaccuggugaagaucgccagcaccgccagcagccccagagacaccgcccuggccgccgugaucugcagcgcccuggccaccgugcugcuggcccugcugauccugugcgugaucuacugcaagagacaguucauggagaagaagcccagcuggagccugagaagccaggacauccaguacaacggcagcgagcugagcugcuucgacagaccccagcugcacgaguacgcccacagagccugcugccagugcagaagagacagcgugcagaccugcggccccgugagacugcugcccagcaugugcugcgaggaggccugcagccccaaccccgccacccugggcugcggcgugcacagcgccgccagccugcaggccagaaacgccggccccgccggcgagauggugcccaccuucuucggcagccugacccagagcaucugcggcgaguucagcgacgccuggccccugaugcagaaccccaugggcggcgacaacaucagcuucugcgacagcuaccccgagcugaccggcgaggacauccacagccugaaccccgagcuggagagcagcaccagccuggacagcaacagcagccaggaccuggugggcggcgccgugcccgugcagagccacagcgagaacuucaccgccgccaccgaccugagcagauacaacaacacccugguggagagcgccagcacccaggacgcccugaccaugagaagccagcuggaccaggagagcggcgccgugauccaccccgccacccagaccagccugcaggaggccuaa

SEQ ID NO: 24857 - RNA, 1368 nt, Artificial Sequence
  TNFRSF1A__Homo_sapiens__NP_001056
augggccugagcaccgugcccgaccugcugcugccccuggugcugcuggagcugcuggugggcaucuaccccagcggcgugaucggccuggugccccaccugggcgacagagagaagagagacagcgugugcccccagggcaaguacauccacccccagaacaacagcaucugcugcaccaagugccacaagggcaccuaccuguacaacgacugccccggccccggccaggacaccgacugcagagagugcgagagcggcagcuucaccgccagcgagaaccaccugagacacugccugagcugcagcaagugcagaaaggagaugggccagguggagaucagcagcugcaccguggacagagacaccgugugcggcugcagaaagaaccaguacagacacuacuggagcgagaaccuguuccagugcuucaacugcagccugugccugaacggcaccgugcaccugagcugccaggagaagcagaacaccgugugcaccugccacgccggcuucuuccugagagagaacgagugcgugagcugcagcaacugcaagaagagccuggagugcaccaagcugugccugccccagaucgagaacgugaagggcaccgaggacagcggcaccaccgugcugcugccccuggugaucuucuucggccugugccugcugagccugcuguucaucggccugauguacagauaccagagauggaagagcaagcuguacagcaucgugugcggcaagagcacccccgagaaggagggcgagcuggagggcaccaccaccaagccccuggcccccaaccccagcuucagccccacccccggcuucacccccacccugggcuucagccccgugcccagcagcaccuucaccagcagcagcaccuacacccccggcgacugccccaacuucgccgcccccagaagagagguggccccccccuaccagggcgccgaccccauccuggccaccgcccuggccagcgaccccauccccaacccccugcagaagugggaggacagcgcccacaagccccagagccuggacaccgacgaccccgccacccuguacgccgugguggagaacgugcccccccugagauggaaggaguucgugagaagacugggccugagcgaccacgagaucgacagacuggagcugcagaacggcagaugccugagagaggcccaguacagcaugcuggccaccuggagaagaagaacccccagaagagaggccacccuggagcugcugggcagagugcugagagacauggaccugcugggcugccuggaggacaucgaggaggcccugugcggccccgccgcccugccccccgcccccagccugcugagauaa

SEQ ID NO: 24858 - RNA, 1389 nt, Artificial Sequence
  TNFRSF1B__Homo_sapiens__XP_011540365
auggcccccguggccgugugggccgcccuggccgugggccuggagcugugggccgccgcccacgcccugcccgcccagguggccuucacccccuacgcccccgagcccggcagcaccugcagacugagagaguacuacgaccagaccgcccagaugugcugcagcaagugcagccccggccagcacgccaagguguucugcaccaagaccagcgacaccgugugcgacagcugcgaggacagcaccuacacccagcuguggaacugggugcccgagugccugagcugcggcagcagaugcagcagcgaccagguggagacccaggccugcaccagagagcagaacagaaucugcaccugcagacccggcugguacugcgcccugagcaagcaggagggcugcagacugugcgccccccugagaaagugcagacccggcuucggcguggccagacccggcaccgagaccagcgacguggugugcaagcccugcgcccccggcaccuucagcaacaccaccagcagcaccgacaucugcagaccccaccagaucugcaacgugguggccauccccggcaacgccagcauggacgccgugugcaccagcaccagccccaccagaagcauggcccccggcgccgugcaccugccccagcccgugagcaccagaagccagcacacccagcccacccccgagcccagcaccgcccccagcaccagcuuccugcugcccaugggccccagcccccccgccgagggcagcaccggcgacuucgcccugcccgugggccugaucgugggcgugaccgcccugggccugcugaucaucggcguggugaacugcgugaucaugacccaggugaagaagaagccccugugccugcagagagaggccaaggugccccaccugcccgccgacaaggccagaggcacccagggccccgagcagcagcaccugcugaucaccgcccccagcagcagcagcagcagccuggagagcagcgccagcgcccuggacagaagagcccccaccagaaaccagccccaggcccccggcguggaggccagcggcgccggcgaggccagagccagcaccggcagcagcgccgacagcagccccggcggccacggcacccaggugaacgugaccugcaucgugaacgugugcagcagcagcgaccacagcagccagugcagcagccaggccagcagcaccaugggcgacaccgacagcagccccagcgagagccccaaggacgagcaggugcccuucagcaaggaggagugcgccuucagaagccagcuggagacccccgagacccugcugggcagcaccgaggagaagccccugccccugggcgugcccgacgccggcaugaagcccagcuaa

SEQ ID NO: 24859 - RNA, 1968 nt, Artificial Sequence
  TNFRSF21__Homo_sapiens__NP_055267
augggcaccagccccagcagcagcaccgcccuggccagcugcagcagaaucgccagaagagccaccgccaccaugaucgccggcagccugcugcugcugggcuuccugagcaccaccaccgcccagcccgagcagaaggccagcaaccugaucggcaccuacagacacguggacagagccaccggccaggugcugaccugcgacaagugccccgccggcaccuacgugagcgagcacugcaccaacaccagccugagagugugcagcagcugccccgugggcaccuucaccagacacgagaacggcaucgagaagugccacgacugcagccagcccugccccuggcccaugaucgagaagcugcccugcgccgcccugaccgacagagagugcaccugcccccccggcauguuccagagcaacgccaccugcgccccccacaccgugugccccgugggcuggggcgugagaaagaagggcaccgagaccgaggacgugagaugcaagcagugcgccagaggcaccuucagcgacgugcccagcagcgugaugaagugcaaggccuacaccgacugccugagccagaaccugguggugaucaagcccggcaccaaggagaccgacaacgugugcggcacccugcccagcuucagcagcagcaccagccccagccccggcaccgccaucuuccccagacccgagcacauggagacccacgaggugcccagcagcaccuacgugcccaagggcaugaacagcaccgagagcaacagcagcgccagcgugagacccaaggugcugagcagcauccaggagggcaccgugcccgacaacaccagcagcgccagaggcaaggaggacgugaacaagacccugcccaaccugcagguggugaaccaccagcagggcccccaccacagacacauccugaagcugcugcccagcauggaggccaccggcggcgagaagagcagcacccccaucaagggccccaagagaggccaccccagacagaaccugcacaagcacuucgacaucaacgagcaccugcccuggaugaucgugcuguuccugcugcuggugcugguggugaucguggugugcagcaucagaaagagcagcagaacccugaagaagggccccagacaggaccccagcgccaucguggagaaggccggccugaagaagagcaugacccccacccagaacagagagaaguggaucuacuacugcaacggccacggcaucgacauccugaagcugguggccgcccaggugggcagccaguggaaggacaucuaccaguuccugugcaacgccagcgagagagagguggccgccuucagcaacggcuacaccgccgaccacgagagagccuacgccgcccugcagcacuggaccaucagaggccccgaggccagccuggcccagcugaucagcgcccugagacagcacagaagaaacgacgugguggagaagaucagaggccugauggaggacaccacccagcuggagaccgacaagcuggcccugcccaugagccccagcccccugagccccagccccauccccagccccaacgccaagcuggagaacagcgcccugcugaccguggagcccagcccccaggacaagaacaagggcuucuucguggacgagagcgagccccugcugagaugcgacagcaccagcagcggcagcagcgcccugagcagaaacggcagcuucaucaccaaggagaagaaggacaccgugcugagacaggugagacuggaccccugcgaccugcagcccaucuucgacgacaugcugcacuuccugaaccccgaggagcugagagugaucgaggagaucccccaggccgaggacaagcuggacagacuguucgagaucaucggcgugaagagccaggaggccagccagacccugcuggacagcguguacagccaccugcccgaccugcuguaa

SEQ ID NO: 24860 - RNA, 903 nt, Artificial Sequence
  TNFRSF6B__Homo_sapiens__NP_003814
augagagcccuggagggccccggccugagccugcugugccuggugcuggcccugcccgcccugcugcccgugcccgccgugagaggcguggccgagacccccaccuaccccuggagagacgccgagaccggcgagagacuggugugcgcccagugcccccccggcaccuucgugcagagacccugcagaagagacagccccaccaccugcggccccugcccccccagacacuacacccaguucuggaacuaccuggagagaugcagauacugcaacgugcugugcggcgagagagaggaggaggccagagccugccacgccacccacaacagagccugcagaugcagaaccggcuucuucgcccacgccggcuucugccuggagcacgccagcugcccccccggcgccggcgugaucgcccccggcacccccagccagaacacccagugccagcccugcccccccggcaccuucagcgccagcagcagcagcagcgagcagugccagccccacagaaacugcaccgcccugggccuggcccugaacgugcccggcagcagcagccacgacacccugugcaccagcugcaccggcuucccccugagcaccagagugcccggcgccgaggagugcgagagagccgugaucgacuucguggccuuccaggacaucagcaucaagagacugcagagacugcugcaggcccuggaggcccccgagggcuggggccccacccccagagccggcagagccgcccugcagcugaagcugagaagaagacugaccgagcugcugggcgcccaggacggcgcccugcuggugagacugcugcaggcccugagaguggccagaaugcccggccuggagagaagcgugagagagagauuccugcccgugcacuaa

SEQ ID NO: 24861 - RNA, 1785 nt, Artificial Sequence
  TNFRSF8__Homo_sapiens__XP_011540743
augagagugcugcuggccgcccugggccugcuguuccugggcgcccugagagccuucccccaggacagacccuucgaggacaccugccacggcaaccccagccacuacuacgacaaggccgugagaagaugcugcuacagaugccccaugggccuguuccccacccagcagugcccccagagacccaccgacugcagaaagcagugcgagcccgacuacuaccuggacgaggccgacagaugcaccgccugcgugaccugcagcagagacgaccugguggagaagacccccugcgccuggaacagcagcagagugugcgagugcagacccggcauguucugcagcaccagcgccgugaacagcugcgccagaugcuucuuccacagcgugugccccgccggcaugaucgugaaguuccccggcaccgcccagaagaacaccgugugcgagcccgccagccccggcgugagccccgccugcgccagccccgagaacugcaaggagcccagcagcggcaccaucccccaggccaagcccacccccgugagccccgccaccagcagcgccagcaccaugcccgugagaggcggcaccagacuggcccaggaggccgccagcaagcugaccagagcccccgacagccccagcagcgugggcagacccagcagcgaccccggccugagccccacccagcccugccccgagggcagcggcgacugcagaaagcagugcgagcccgacuacuaccuggacgaggccggcagaugcaccgccugcgugagcugcagcagagacgaccugguggagaagacccccugcgccuggaacagcagcagaaccugcgagugcagacccggcaugaucugcgccaccagcgccaccaacagcugcgccagaugcgugcccuaccccaucugcgccgccgagaccgugaccaagccccaggacauggccgagaaggacaccaccuucgaggcccccccccugggcacccagcccgacugcaaccccacccccgagaacggcgaggcccccgccagcaccagccccacccagagccugcugguggacagccaggccagcaagacccugcccauccccaccagcgcccccguggcccugagcagcaccggcaagcccgugcuggacgccggccccgugcuguucugggugauccuggugcugguggugguggugggcagcagcgccuuccugcugugccacagaagagccugcagaaagagaaucagacagaagcugcaccugugcuaccccgugcagaccagccagcccaagcuggagcugguggacagcagacccagaagaagcagcacccugagaagcggcgccagcgugaccgagcccguggccgaggagagaggccugaugagccagccccugauggagaccugccacagcgugggcgccgccuaccuggagagccugccccugcaggacgccagccccgccggcggccccagcagccccagagaccugcccgagcccagagugagcaccgagcacaccaacaacaagaucgagaagaucuacaucaugaaggccgacaccgugaucgugggcaccgugaaggccgagcugcccgagggcagaggccuggccggccccgccgagcccgagcuggaggaggagcuggaggccgaccacaccccccacuaccccgagcaggagaccgagcccccccugggcagcugcagcgacgugaugcugagcguggaggaggagggcaaggaggacccccugcccaccgccgccagcggcaaguaa

SEQ ID NO: 24862 - RNA, 306 nt, Artificial Sequence
  TNFSF10__Homo_sapiens__NP_001177871
auggccaugauggaggugcagggcggccccagccugggccagaccugcgugcugaucgugaucuucaccgugcugcugcagagccugugcguggccgugaccuacguguacuucaccaacgagcugaagcagaugcaggacaaguacagcaagagcggcaucgccugcuuccugaaggaggacgacagcuacugggaccccaacgacgaggagagcaugaacagccccugcuggcaggugaaguggcagcugagacagcuggugagaaagacccccagaaugaagagacugugggccgccaaguaa

SEQ ID NO: 24863 - RNA, 954 nt, Artificial Sequence
  TNFSF11__Homo_sapiens__NP_003692
augagaagagccagcagagacuacaccaaguaccugagaggcagcgaggagaugggcggcggccccggcgccccccacgagggcccccugcacgccccccccccccccgccccccaccagccccccgccgccagcagaagcauguucguggcccugcugggccugggccugggccagguggugugcagcguggcccuguucuucuacuucagagcccagauggaccccaacagaaucagcgaggacggcacccacugcaucuacagaauccugagacugcacgagaacgccgacuuccaggacaccacccuggagagccaggacaccaagcugauccccgacagcugcagaagaaucaagcaggccuuccagggcgccgugcagaaggagcugcagcacaucgugggcagccagcacaucagagccgagaaggccaugguggacggcagcuggcuggaccuggccaagagaagcaagcuggaggcccagcccuucgcccaccugaccaucaacgccaccgacauccccagcggcagccacaaggugagccugagcagcugguaccacgacagaggcugggccaagaucagcaacaugaccuucagcaacggcaagcugaucgugaaccaggacggcuucuacuaccuguacgccaacaucugcuucagacaccacgagaccagcggcgaccuggccaccgaguaccugcagcugaugguguacgugaccaagaccagcaucaagauccccagcagccacacccugaugaagggcggcagcaccaaguacuggagcggcaacagcgaguuccacuucuacagcaucaacgugggcggcuucuucaagcugagaagcggcgaggagaucagcaucgaggugagcaaccccagccugcuggaccccgaccaggacgccaccuacuucggcgccuucaaggugagagacaucgacuaa

SEQ ID NO: 24864 - RNA, 750 nt, Artificial Sequence
  TNFSF12__Homo_sapiens__NP_003800
auggccgccagaagaagccagagaagaagaggcagaagaggcgagcccggcaccgcccugcuggugccccuggcccugggccugggccuggcccuggccugccugggccugcugcuggccguggugagccugggcagcagagccagccugagcgcccaggagcccgcccaggaggagcugguggccgaggaggaccaggaccccagcgagcugaacccccagaccgaggagagccaggaccccgcccccuuccugaacagacuggugagacccagaagaagcgcccccaagggcagaaagaccagagccagaagagccaucgccgcccacuacgaggugcaccccagacccggccaggacggcgcccaggccggcguggacggcaccgugagcggcugggaggaggccagaaucaacagcagcagcccccugagauacaacagacagaucggcgaguucaucgugaccagagccggccuguacuaccuguacugccaggugcacuucgacgagggcaaggccguguaccugaagcuggaccugcugguggacggcgugcuggcccugagaugccuggaggaguucagcgccaccgccgccagcagccugggcccccagcugagacugugccaggugagcggccugcuggcccugagacccggcagcagccugagaaucagaacccugcccugggcccaccugaaggccgcccccuuccugaccuacuucggccuguuccaggugcacuaa

SEQ ID NO: 24865 - RNA, 993 nt, Artificial Sequence
  TNFSF12-TNFSF13__Homo_sapiens__NP_742086
auggccgccagaagaagccagagaagaagaggcagaagaggcgagcccggcaccgcccugcuggugccccuggcccugggccugggccuggcccuggccugccugggccugcugcuggccguggugagccugggcagcagagccagccugagcgcccaggagcccgcccaggaggagcugguggccgaggaggaccaggaccccagcgagcugaacccccagaccgaggagagccaggaccccgcccccuuccugaacagacuggugagacccagaagaagcgcccccaagggcagaaagaccagagccagaagagccaucgccgcccacuacgaggugcaccccagacccggccaggacggcgcccaggccggcguggacggcaccgugagcggcugggaggaggccagaaucaacagcagcagcccccugagauacaacagacagaucggcgaguucaucgugaccagagccggccuguacuaccuguacugccagagcagcgacgcccuggaggccugggagaacggcgagagaagcagaaagagaagagccgugcugacccagaagcagaagaagcagcacagcgugcugcaccuggugcccaucaacgccaccagcaaggacgacagcgacgugaccgaggugauguggcagcccgcccugagaagaggcagaggccugcaggcccagggcuacggcgugagaauccaggacgccggcguguaccugcuguacagccaggugcuguuccaggacgugaccuucaccaugggccagguggugagcagagagggccagggcagacaggagacccuguucagaugcaucagaagcaugcccagccaccccgacagagccuacaacagcugcuacagcgccggcguguuccaccugcaccagggcgacauccugagcgugaucauccccagagccagagccaagcugaaccugagcccccacggcaccuuccugggcuucgugaagcuguaa

SEQ ID NO: 24866 - RNA, 801 nt, Artificial Sequence
  TNFSF13B__Homo_sapiens__NP_001139117
auggacgacagcaccgagagagagcagagcagacugaccagcugccugaagaagagagaggagaugaagcugaaggagugcgugagcauccugcccagaaaggagagccccagcgugagaagcagcaaggacggcaagcugcuggccgccacccugcugcuggcccugcugagcugcugccugaccguggugagcuucuaccagguggccgcccugcagggcgaccuggccagccugagagccgagcugcagggccaccacgccgagaagcugcccgccggcgccggcgcccccaaggccggccuggaggaggcccccgccgugaccgccggccugaagaucuucgagccccccgcccccggcgagggcaacagcagccagaacagcagaaacaagagagccgugcagggccccgaggagaccggcagcuacaccuucgugcccuggcugcugagcuucaagagaggcagcgcccuggaggagaaggagaacaagauccuggugaaggagaccggcuacuucuucaucuacggccaggugcuguacaccgacaagaccuacgccaugggccaccugauccagagaaagaaggugcacguguucggcgacgagcugagccuggugacccuguucagaugcauccagaacaugcccgagacccugcccaacaacagcugcuacagcgccggcaucgccaagcuggaggagggcgacgagcugcagcuggccauccccagagagaacgcccagaucagccuggacggcgacgugaccuucuucggcgcccugaagcugcuguaa

SEQ ID NO: 24867 - RNA, 669 nt, Artificial Sequence
  TNFSF13__Homo_sapiens__NP_001185552
augcccgccagcagccccuuccugcuggcccccaagggcccccccggcaacaugggcggccccgugagagagcccgcccugagcguggcccuguggcugagcuggggcgccgcccugggcgccguggccugcgccauggcccugcugacccagcagaccgagcugcagagccugagaagagaggugagcagacugcagggcaccggcggccccagccagaacggcgagggcuaccccuggcagagccugcccgagcagcacagcgugcugcaccuggugcccaucaacgccaccagcaaggacgacagcgacgugaccgaggugauguggcagcccgcccugagaagaggcagaggccugcaggcccagggcuacggcgugagaauccaggacgccggcguguaccugcuguacagccaggugcuguuccaggacgugaccuucaccaugggccagguggugagcagagagggccagggcagacaggagacccuguucagaugcaucagaagcaugcccagccaccccgacagagccuacaacagcugcuacagcgccggcguguuccaccugcaccagggcgacauccugagcgugaucauccccagagccagagccaagcugaaccugagcccccacggcaccuuccugggcuucgugaagcuguaa

SEQ ID NO: 24868 - RNA, 723 nt, Artificial Sequence
  TNFSF14__Homo_sapiens__NP_003798
auggaggagagcguggugagacccagcguguucgugguggacggccagaccgacauccccuucaccagacugggcagaagccacagaagacagagcugcagcguggccagagugggccugggccugcugcugcugcugaugggcgccggccuggccgugcagggcugguuccugcugcagcugcacuggagacugggcgagauggugaccagacugcccgacggccccgccggcagcugggagcagcugauccaggagagaagaagccacgaggugaaccccgccgcccaccugaccggcgccaacagcagccugaccggcagcggcggcccccugcugugggagacccagcugggccuggccuuccugagaggccugagcuaccacgacggcgcccugguggugaccaaggccggcuacuacuacaucuacagcaaggugcagcugggcggcgugggcugcccccugggccuggccagcaccaucacccacggccuguacaagagaacccccagauaccccgaggagcuggagcugcuggugagccagcagagccccugcggcagagccaccagcagcagcagaguguggugggacagcagcuuccugggcggcguggugcaccuggaggccggcgagaaggugguggugagagugcuggacgagagacuggugagacugagagacggcaccagaagcuacuucggcgccuucaugguguaa

SEQ ID NO: 24869 - RNA, 579 nt, Artificial Sequence
  TNFSF15__Homo_sapiens__NP_001191273
augcagcugaccaagggcagacugcacuucagccacccccugagccacaccaagcacaucagccccuucgugaccgacgccccccugagagccgacggcgacaagcccagagcccaccugaccguggugagacagacccccacccagcacuucaagaaccaguuccccgcccugcacugggagcacgagcugggccuggccuucaccaagaacagaaugaacuacaccaacaaguuccugcugauccccgagagcggcgacuacuucaucuacagccaggugaccuucagaggcaugaccagcgagugcagcgagaucagacaggccggcagacccaacaagcccgacagcaucaccguggugaucaccaaggugaccgacagcuaccccgagcccacccagcugcugaugggcaccaagagcgugugcgaggugggcagcaacugguuccagcccaucuaccugggcgccauguucagccugcaggagggcgacaagcugauggugaacgugagcgacaucagccugguggacuacaccaaggaggacaagaccuucuucggcgccuuccugcuguaa

SEQ ID NO: 24870 - RNA, 600 nt, Artificial Sequence
  TNFSF18__Homo_sapiens__NP_005083
augacccugcaccccagccccaucaccugcgaguuccuguucagcaccgcccugaucagccccaagaugugccugagccaccuggagaacaugccccugagccacagcagaacccagggcgcccagagaagcagcuggaagcuguggcuguucugcagcaucgugaugcugcuguuccugugcagcuucagcuggcugaucuucaucuuccugcagcuggagaccgccaaggagcccugcauggccaaguucggcccccugcccagcaaguggcagauggccagcagcgagccccccugcgugaacaaggugagcgacuggaagcuggagauccugcagaacggccuguaccugaucuacggccagguggcccccaacgccaacuacaacgacguggcccccuucgaggugagacuguacaagaacaaggacaugauccagacccugaccaacaagagcaagauccagaacgugggcggcaccuacgagcugcacgugggcgacaccaucgaccugaucuucaacagcgagcaccaggugcugaagaacaacaccuacuggggcaucauccugcuggccaacccccaguucaucagcuaa

SEQ ID NO: 24871 - RNA, 402 nt, Artificial Sequence
  TNFSF4__Homo_sapiens__NP_001284491
auggugagccacagauaccccagaauccagagcaucaaggugcaguucaccgaguacaagaaggagaagggcuucauccugaccagccagaaggaggacgagaucaugaaggugcagaacaacagcgugaucaucaacugcgacggcuucuaccugaucagccugaagggcuacuucagccaggaggugaacaucagccugcacuaccagaaggacgaggagccccuguuccagcugaagaaggugagaagcgugaacagccugaugguggccagccugaccuacaaggacaagguguaccugaacgugaccaccgacaacaccagccuggacgacuuccacgugaacggcggcgagcugauccugauccaccagaaccccggcgaguucugcgugcuguaa

SEQ ID NO: 24872 - RNA, 705 nt, Artificial Sequence
  TNFSF8__Homo_sapiens__NP_001235
auggaccccggccugcagcaggcccugaacggcauggccccccccggcgacaccgccaugcacgugcccgccggcagcguggccagccaccugggcaccaccagcagaagcuacuucuaccugaccaccgccacccuggcccugugccugguguucaccguggccaccaucauggugcugguggugcagagaaccgacagcauccccaacagccccgacaacgugccccugaagggcggcaacugcagcgaggaccugcugugcauccugaagagagcccccuucaagaagagcugggccuaccugcagguggccaagcaccugaacaagaccaagcugagcuggaacaaggacggcauccugcacggcgugagauaccaggacggcaaccuggugauccaguuccccggccuguacuucaucaucugccagcugcaguuccuggugcagugccccaacaacagcguggaccugaagcuggagcugcugaucaacaagcacaucaagaagcaggcccuggugaccgugugcgagagcggcaugcagaccaagcacguguaccagaaccugagccaguuccugcuggacuaccugcaggugaacaccaccaucagcgugaacguggacaccuuccaguacaucgacaccagcaccuucccccuggagaacgugcugagcaucuuccuguacagcaacagcgacuaa

SEQ ID NO: 24873 - RNA, 765 nt, Artificial Sequence
  TNFSF9__Homo_sapiens__NP_003802
auggaguacgccagcgacgccagccuggaccccgaggcccccuggccccccgcccccagagccagagccugcagagugcugcccugggcccugguggccggccugcugcugcugcugcugcuggccgccgccugcgccguguuccuggccugccccugggccgugagcggcgccagagccagccccggcagcgccgccagccccagacugagagagggccccgagcugagccccgacgaccccgccggccugcuggaccugagacagggcauguucgcccagcugguggcccagaacgugcugcugaucgacggcccccugagcugguacagcgaccccggccuggccggcgugagccugaccggcggccugagcuacaaggaggacaccaaggagcuggugguggccaaggccggcguguacuacguguucuuccagcuggagcugagaagagugguggccggcgagggcagcggcagcgugagccuggcccugcaccugcagccccugagaagcgccgccggcgccgccgcccuggcccugaccguggaccugccccccgccagcagcgaggccagaaacagcgccuucggcuuccagggcagacugcugcaccugagcgccggccagagacugggcgugcaccugcacaccgaggccagagccagacacgccuggcagcugacccagggcgccaccgugcugggccuguucagagugacccccgagauccccgccggccugcccagccccagaagcgaguaa

SEQ ID NO: 24874 - RNA, 4059 nt, Artificial Sequence
  TNIK__Homo_sapiens__NP_001155032
auggccagcgacagccccgccagaagccuggacgagaucgaccugagcgcccugagagaccccgccggcaucuucgagcugguggagcuggugggcaacggcaccuacggccagguguacaagggcagacacgugaagaccggccagcuggccgccaucaaggugauggacgugaccggcgacgaggaggaggagaucaagcaggagaucaacaugcugaagaaguacagccaccacagaaacaucgccaccuacuacggcgccuucaucaagaagaacccccccggcauggacgaccagcuguggcuggugauggaguucugcggcgccggcagcgugaccgaccugaucaagaacaccaagggcaacacccugaaggaggaguggaucgccuacaucugcagagagauccugagaggccugagccaccugcaccagcacaaggugauccacagagacaucaagggccagaacgugcugcugaccgagaacgccgaggugaagcugguggacuucggcgugagcgcccagcuggacagaaccgugggcagaagaaacaccuucaucggcacccccuacuggauggcccccgaggugaucgccugcgacgagaaccccgacgccaccuacgacuucaagagcgaccuguggagccugggcaucaccgccaucgagauggccgagggcgcccccccccugugcgacaugcaccccaugagagcccuguuccugauccccagaaaccccgcccccagacugaagagcaagaaguggagcaagaaguuccagagcuucaucgagagcugccuggugaagaaccacagccagagacccgccaccgagcagcugaugaagcaccccuucaucagagaccagcccaacgagagacaggugagaauccagcugaaggaccacaucgacagaaccaagaagaagagaggcgagaaggacgagaccgaguacgaguacagcggcagcgaggaggaggaggaggagaacgacagcggcgagcccagcagcauccugaaccugcccggcgagagcacccugagaagagacuuccugagacugcagcuggccaacaaggagagaagcgaggcccugagaagacagcagcuggagcagcagcagagagagaacgaggagcacaagagacagcugcuggccgagagacagaagagaaucgaggagcagaaggagcagagaagaagacuggaggagcagcagagaagagagaaggagcugagaaagcagcaggagagagagcagagaagacacuacgaggagcagaugagaagagaggaggagagaagaagagccgagcacgagcaggaguacaucagaagacagcuggaggaggagcagagacagcuggagauccugcagcagcagcugcugcacgagcaggcccugcugcuggaguacaagagaaagcagcuggaggagcagagacaggccgagagacugcagagacagcugaagcaggagagagacuaccuggugagccugcagcaccagagacaggagcagagacccguggagaagaagccccuguaccacuacaaggagggcaugagccccagcgagaagcccgccugggccaaggagguggaggagagaagcagacugaacagacagagcagccccgccaugccccacaagguggccaacagaaucagcgaccccaaccugccccccagaagcgagagcuucagcaucagcggcgugcagcccgccagaaccccccccaugcugagacccguggacccccagaucccccaccugguggccgugaagagccagggccccgcccugaccgccagccagagcgugcacgagcagcccaccaagggccugagcggcuuccaggaggcccugaacgugaccagccacagaguggagaugcccagacagaacagcgaccccaccagcgagaaccccccccugcccaccagaaucgagaaguucgacagaagcagcuggcugagacaggaggaggacaucccccccaaggugccccagagaaccaccagcaucagccccgcccuggccagaaagaacagccccggcaacggcagcgcccugggccccagacugggcagccagcccaucagagccagcaaccccgaccugagaagaaccgagcccauccuggagagcccccugcagagaaccagcagcggcagcagcagcagcagcagcacccccagcagccagcccagcagccagggcggcagccagcccggcagccaggccggcagcagcgagagaaccagagugagagccaacagcaagagcgagggcagccccgugcugccccacgagcccgccaaggugaagcccgaggagagcagagacaucaccagacccagcagacccgccgaccugaccgcccuggccaaggagcugagagagcugagaaucgaggagaccaacagacccaugaagaaggugaccgacuacagcagcagcagcgaggagagcgagagcagcgaggaggaggaggaggacggcgagagcgagacccacgacggcaccguggccgugagcgacauccccagacugauccccaccggcgcccccggcagcaacgagcaguacaacgugggcauggugggcacccacggccuggagaccagccacgccgacagcuucagcggcagcaucagcagagagggcacccugaugaucagagagaccagcggcgagaagaagagaagcggccacagcgacagcaacggcuucgccggccacaucaaccugcccgaccuggugcagcagagccacagccccgccggcacccccaccgagggccugggcagagugagcacccacagccaggagauggacagcggcaccgaguacggcaugggcagcagcaccaaggccagcuucacccccuucguggaccccagaguguaccagaccagccccaccgacgaggacgaggaggacgaggagagcagcgccgccgcccuguucaccagcgagcugcugagacaggagcaggccaagcugaacgaggccagaaagaucagcguggugaacgugaaccccaccaacaucagaccccacagcgacacccccgagaucagaaaguacaagaagagauucaacagcgagauccugugcgccgcccuguggggcgugaaccugcuggugggcaccgagaacggccugaugcugcuggacagaagcggccagggcaagguguacaaccugaucaacagaagaagauuccagcagauggacgugcuggagggccugaacgugcuggugaccaucagcggcaagaagaacaagcugagaguguacuaccugagcuggcugagaaacagaauccugcacaacgaccccgagguggagaagaagcagggcuggaucaccgugggcgaccuggagggcugcauccacuacaagguggugaaguacgagagaaucaaguuccuggugaucgcccugaagaacgccguggagaucuacgccugggcccccaagcccuaccacaaguucauggccuucaagagcuucgccgaccugcagcacaagccccugcugguggaccugaccguggaggagggccagagacugaaggugaucuucggcagccacaccggcuuccacgugaucgacguggacagcggcaacagcuacgacaucuacauccccagccacauccagggcaacaucaccccccacgccaucgugauccugcccaagaccgacggcauggagaugcuggugugcuacgaggacgagggcguguacgugaacaccuacggcagaaucaccaaggacguggugcugcaguggggcgagaugcccaccagcguggccuacauccacagcaaccagaucaugggcuggggcgagaaggccaucgagaucagaagcguggagaccggccaccuggacggcguguucaugcacaagagagcccagagacugaaguuccugugcgagagaaacgacaagguguucuucgccagcgugagaagcggcggcagcagccagguguucuucaugacccugaacagaaacagcaugaugaacugguaa

SEQ ID NO: 24875 - RNA, 1752 nt, Artificial Sequence
  TNIP1__Homo_sapiens__NP_001239315
auggaggccaccagacugagacagaaggccgaggagcuggugaaggacaacgagcugcugcccccccccagccccagccugggcagcuucgacccccuggccgagcugaccggcaaggacagcaacgugaccgccagccccaccgcccccgccugccccagcgacaagcccgcccccgugcagaagccccccagcagcggcaccagcagcgaguucgagguggugacccccgaggagcagaacagccccgagagcagcagccacgccaacgccauggcccugggcccccugcccagagaggacggcaaccugaugcugcaccugcagagacuggagaccacccugagcgugugcgccgaggagcccgaccacggccagcuguucacccaccugggcagaauggcccuggaguucaacagacuggccagcaaggugcacaagaacgagcagagaaccagcauccugcagacccugugcgagcagcugagaaaggagaacgaggcccugaaggccaagcuggacaagggccuggagcagagagaccaggccgccgagagacugagagaggagaaccuggagcugaagaagcugcugaugagcaacggcaacaaggagggcgccagcggcagacccggcagccccaagauggagggcaccggcaagaaggccguggccggccagcagcaggccagcgugaccgccggcaaggugcccgaggugguggcccugggcgccgccgagaagaaggugaagaugcuggagcagcagagaagcgagcugcuggaggugaacaagcagugggaccagcacuucagaagcaugaagcagcaguacgagcagaagaucaccgagcugagacagaagcuggccgaccugcagaagcaggugaccgaccuggaggccgagagagagcagaagcagagagacuucgacagaaagcugcugcuggccaagagcaagaucgagauggaggagaccgacaaggagcagcugaccgccgaggccaaggagcugagacagaaggugaaguaccugcaggaccagcugagcccccugaccagacagagagaguaccaggagaaggagauccagagacugaacaaggcccuggaggaggcccugagcauccagaccccccccagcagcccccccaccgccuucggcagccccgagggcgccggcgcccugcugagaaagcaggagcuggugacccagaacgagcugcugaagcagcaggugaagaucuucgaggaggacuuccagagagagagaagcgacagagagagaaugaacgaggagaaggaggagcugaagaagcagguggagaagcugcaggcccaggugacccugagcaacgcccagcugaaggccuucaaggacgaggagaaggccagagaggcccugagacagcagaagagaaaggccaaggccagcggcgagagauaccacguggagccccaccccgagcaccugugcggcgccuaccccuacgccuacccccccaugcccgccauggugccccaccacggcuucgaggacuggagccagaucagauacccccccccccccauggccauggagcacccccccccccugcccaacagcagacuguuccaccugcccgaguacaccuggagacugcccugcggcggcgugagaaaccccaaccagagcagccaggugauggacccccccaccgccagacccaccgagcccgagagccccaagaacgacagagagggcccccaguaa

SEQ ID NO: 24876 - RNA, 969 nt, Artificial Sequence
  TNIP2__Homo_sapiens__NP_001154999
augcagcagcugcugagccagccccagcacgagagagagaaggagguggugcugcugagaagaagcauggccgagggcgagagagccagagccgccagcgacgugcugugcagaagccuggccaacgagacccaccagcugagaagaacccugaccgccaccgcccacaugugccagcaccuggccaagugccuggacgagagacagcacgcccagagaaacgugggcgagagaagccccgaccagagcgagcacaccgacggccacaccagcgugcagagcgugaucgagaagcugcaggaggagaacagacugcugaagcagaaggugacccacguggaggaccugaacgccaaguggcagagauacaacgccagcagagacgaguacgugagaggccugcacgcccagcugagaggccugcagaucccccacgagcccgagcugaugagaaaggagaucagcagacugaacagacagcuggaggagaagaucaacgacugcgccgaggugaagcaggagcuggccgccagcagaaccgccagagacgccgcccuggagagagugcagaugcuggagcagcagauccuggccuacaaggacgacuucaugagcgagagagccgacagagagagagcccagagcagaauccaggagcuggaggagaagguggccagccugcugcaccaggugagcuggagacaggacagcagagagcccgacgccggcagaauccacgccggcagcaagaccgccaaguaccuggccgccgacgcccuggagcugauggugcccggcggcuggagacccggcaccggcagccagcagcccgagccccccgccgagggcggccaccccggcgccgcccagagaggccagggcgaccugcagugcccccacugccugcagugcuucagcgacgagcagggcgaggagcugcugagacacguggccgagugcugccaguaa

SEQ ID NO: 24877 - RNA, 1110 nt, Artificial Sequence
  TNIP3__Homo_sapiens__NP_001122315
augaacaagaacgagaagcacgacgacaagcuggugauguucaccaaccagagcgaggacagcgagagaugcgagagcauggagcuggacaagaagauccaggaccugaucgagagaaacgccagcccccaccccaagagauucacccccgaggccaugcccacccacagaaaccugugcagccugaagacccccggcaagaccgccagcauggcccacuucgugcagggcaccagcagaaugaucgccgccgagagcagcaccgagcacaaggagugcgccgagcccagcaccagaaagaaccugaugaacagccuggagcagaagaucagaugccuggagaagcagagaaaggagcugcuggaggugaaccagcagugggaccagcaguucagaagcaugaaggagcuguacgagagaaagguggccgagcugaagaccaagcuggacgccgccgagagauuccugagcaccagagagaaggacccccaccagagacagagaaaggacgacagacagagagaggacgacagacagagagaccugaccagagacagacugcagagagaggagaaggagaaggagagacugaacgaggagcugcacgagcugaaggaggagaacaagcugcugaagggcaagaacacccuggccaacaaggagaaggagcacuacgagugcgagaucaagagacugaacaaggcccugcaggacgcccugaacaucaagugcagcuucagcgaggacugccugagaaagagcagaguggaguucugccacgaggagaugagaaccgagauggaggugcugaagcagcaggugcagaucuacgaggaggacuucaagaaggagagaagcgacagagagagacugaaccaggagaaggaggagcugcagcagaucaacgagaccagccagagccagcugaacagacugaacagccagaucaaggccugccagauggagaaggagaagcuggagaagcagcugaagcagauguacugcccccccugcaacugcggccugguguuccaccugcaggaccccugggugcccaccggccccggcgccgugcagaagcagagagagcaccccguguacccccaguaa

SEQ ID NO: 24878 - RNA, 1986 nt, Artificial Sequence
  TNK1__Homo_sapiens__XP_011522347
augcugcccgaggccggcagccuguggcugcugaagcugcugagagacauccagcuggcccaguucuacuggcccauccuggaggagcugaacgugaccagacccgagcacuucgacuucgugaagcccgaggaccuggacggcaucggcaugggcagacccgcccagagaagacugagcgaggcccugaagagacugagaagcggccccaagagcaagaacuggguguacaagauccugggcggcuucgcccccgagcacaaggagcccacccugcccagcgacagccccagacaccugcccgagcccgagggcggccugaagugccugauccccgagggcgccgugugcagaggcgagcugcugggcagcggcugcuucggcguggugcacagaggccuguggacccugcccagcggcaagagcgugcccguggccgugaagagccugagagugggccccgagggccccaugggcaccgagcugggcgacuuccugagagaggugagcgugaugaugaaccuggagcacccccacgugcugagacugcacggccuggugcugggccagccccugcagauggugauggagcuggccccccugggcagccugcacgccagacugaccgcccccgcccccacccccccccugcugguggcccugcugugccuguuccugagacagcuggccggcgccauggccuaccugggcgccagaggccuggugcacagagaccuggccaccagaaaccugcugcuggccagccccagaaccaucaagguggccgacuucggccuggugagaccccugggcggcgccagaggcagauacgugaugggcggccccagacccauccccuacgccuggugcgcccccgagagccugagacacggcgccuucagcagcgccagcgacguguggauguucggcgugacccugugggagauguucagcggcggcgaggagcccugggccggcgugccccccuaccugauccugcagagacuggaggacagagccagacugcccagacccccccugugcagcagagcccuguacagccuggcccugagaugcugggccccccaccccgccgacagacccagcuucagccaccuggagggccugcugcaggaggccggccccagcgaggccugcugcgugagagacgugaccgagcccggcgcccugagaauggagaccggcgaccccaucaccgugaucgagggcagccccgacagcaccaucuggaagggccagaacggcagaaccuucaaggugggcagcuuccccgccagcgccgugacccuggccgacgccggcggccugcccgccaccagacccgugcacagaggcacccccgccagaggcgaccagcaccccggcagcaucgacggcgacagaaagaaggccaaccugugggacgccccccccgccagaggccagagaagaaacaugccccuggagagaaugaagggcaucagcagaagccuggagagcgugcugagccugggccccagacccaccggcggcggcagcagcccccccgagaucagacaggccagagccgugccccagggcccccccggccugccccccagacccccccugagcagcagcagcccccagcccagccagcccagcagagagagacugcccuggcccaagagaaagcccccccacaaccaccccaugggcaugcccggcgccagaaaggccgccgcccugagcggcggccugcugagcgaccccgagcugcagagaaagaucauggagguggagcugagcgugcacggcgugacccaccaggagugccagaccgcccugggcgccaccggcggcgacguggugagcgccaucagaaaccugaagguggaccagcuguuccaccugagcagcagaagcagagccgacugcuggagaauccuggagcacuaccagugggaccugagcgccgccagcagauacgugcuggccagacccuaa

SEQ ID NO: 24879 - RNA, 3261 nt, Artificial Sequence
  TNK2__Homo_sapiens__NP_001010938
augcuggaggccagaccccccagaacccagggcagcgacgccgccggcgccgccgccggcagaggccugagagcccugcugcugagccugaccgccgccgccggcaucuggggcagcaugggcgagagaagcgccuaccagagacuggccggcggcgaggagggcccccagagacugggcggcggcagaaugcagcccgaggagggcaccggcuggcugcuggagcugcugagcgaggugcagcugcagcaguacuuccugagacugagagacgaccugaacgugaccagacugagccacuucgaguacgugaagaacgaggaccuggagaagaucggcaugggcagacccggccagagaagacugugggaggccgugaagagaagaaaggcccugugcaagagaaagagcuggaugagcaagguguucagcggcaagagacuggaggccgaguuccccccccaccacagccagagcaccuucagaaagaccagccccgcccccggcggccccgccggcgagggcccccugcagagccugaccugccugaucggcgagaaggaccugagacugcuggagaagcugggcgacggcagcuucggcguggugagaagaggcgagugggacgcccccagcggcaagaccgugagcguggccgugaagugccugaagcccgacgugcugagccagcccgaggccauggacgacuucaucagagaggugaacgccaugcacagccuggaccacagaaaccugaucagacuguacggcguggugcugaccccccccaugaagauggugaccgagcuggccccccugggcagccugcuggacagacugagaaagcaccagggccacuuccugcugggcacccugagcagauacgccgugcagguggccgagggcaugggcuaccuggagagcaagagauucauccacagagaccuggccgccagaaaccugcugcuggccaccagagaccuggugaagaucggcgacuucggccugaugagagcccugccccagaacgacgaccacuacgugaugcaggagcacagaaaggugcccuucgccuggugcgcccccgagagccugaagaccagaaccuucagccacgccagcgacaccuggauguucggcgugacccugugggagauguucaccuacggccaggagcccuggaucggccugaacggcagccagauccugcacaagaucgacaaggagggcgagagacugcccagacccgaggacugcccccaggacaucuacaacgugauggugcagugcugggcccacaagcccgaggacagacccaccuucguggcccugagagacuuccugcuggaggcccagcccaccgacaugagagcccugcaggacuucgaggagcccgacaagcugcacauccagaugaacgacgugaucaccgugaucgagggcagagccgagaacuacugguggagaggccagaacaccagaacccugugcgugggccccuuccccagaaacguggugaccagcguggccggccugagcgcccaggacaucagccagccccugcagaacagcuucauccacaccggccacggcgacagcgaccccagacacugcuggggcuuccccgacagaaucgacgagcuguaccugggcaaccccauggacccccccgaccugcugagcguggagcugagcaccagcagacccccccagcaccugggcggcgugaagagagagcccccccccagacccccccagcccgccuucuucacccagaagcccaccuacgaccccgugagcgaggaccaggacccccugagcagcgacuucaagagacugggccugagaaagcccggccugcccagaggccuguggcuggccaagcccagcgccagagugcccggcaccaaggccagcagaggcagcggcgccgaggugacccugaucgacuucggcgaggagcccguggugcccgcccugagacccugcgcccccagccuggcccagcuggccauggacgccugcagccugcuggacgagacccccccccagagccccaccagagcccugcccagaccccugcaccccacccccgugguggacugggacgccagaccccugccccccccccccgccuacgacgacguggcccaggacgaggacgacuucgagaucugcagcaucaacagcacccuggugggcgccggcgugcccgccggccccagccagggccagaccaacuacgccuucgugcccgagcaggccagacccccccccccccuggaggacaaccuguuccugcccccccagggcggcggcaagccccccagcagcgcccagaccgccgagaucuuccaggcccugcagcaggagugcaugagacagcugcaggcccccgccggcagccccgcccccagccccagccccggcggcgacgacaagccccaggugccccccagagugcccaucccccccagacccaccagaccccacgugcagcugagccccgccccccccggcgaggaggagaccagccaguggcccggccccgccagcccccccagagugccccccagagagccccugagcccccagggcagcagaacccccagcccccuggugccccccggcagcagcccccugccccccagacugagcagcagccccggcaagaccaugcccaccacccagagcuucgccagcgaccccaaguacgccaccccccaggugauccaggcccccggccccagagccggccccugcauccugcccaucgugagagacggcaagaaggugagcagcacccacuacuaccugcugcccgagagacccagcuaccuggagagauaccagagauuccugagagaggcccagagccccgaggagcccaccccccugcccgugccccugcugcugcccccccccagcacccccgcccccgccgcccccaccgccaccgugagacccaugccccaggccgcccuggaccccaaggccaacuucagcaccaacaacagcaaccccggcgccagaccccccccccccagagccaccgccagacugccccagagaggcugccccggcgacggccccgaggccggcagacccgccgacaagauccagaugguggagcagcuguucggccugggccugagacccagaggcgagugccacaaggugcuggagauguucgacuggaaccuggagcaggccggcugccaccugcugggcagcuggggccccgcccaccacaagagauaa

SEQ ID NO: 24880 - RNA, 3501 nt, Artificial Sequence
  TNKS2__Homo_sapiens__NP_079511
augagcggcagaagaugcgccggcggcggcgccgccugcgccagcgccgccgccgaggccguggagcccgccgccagagagcuguucgaggccugcagaaacggcgacguggagagagugaagagacuggugacccccgagaaggugaacagcagagacaccgccggcagaaagagcaccccccugcacuucgccgccggcuucggcagaaaggacgugguggaguaccugcugcagaacggcgccaacgugcaggccagagacgacggcggccugaucccccugcacaacgccugcagcuucggccacgccgagguggugaaccugcugcugagacacggcgccgaccccaacgccagagacaacuggaacuacaccccccugcacgaggccgccaucaagggcaagaucgacgugugcaucgugcugcugcagcacggcgccgagcccaccaucagaaacaccgacggcagaaccgcccuggaccuggccgaccccagcgccaaggccgugcugaccggcgaguacaagaaggacgagcugcuggagagcgccagaagcggcaacgaggagaagaugauggcccugcugaccccccugaacgugaacugccacgccagcgacggcagaaagagcaccccccugcaccuggccgccggcuacaacagagugaagaucgugcagcugcugcugcagcacggcgccgacgugcacgccaaggacaagggcgaccuggugccccugcacaacgccugcagcuacggccacuacgaggugaccgagcugcuggugaagcacggcgccugcgugaacgccauggaccuguggcaguucaccccccugcacgaggccgccagcaagaacagaguggaggugugcagccugcugcugagcuacggcgccgaccccacccugcugaacugccacaacaagagcgccaucgaccuggcccccaccccccagcugaaggagagacuggccuacgaguucaagggccacagccugcugcaggccgccagagaggccgacgugaccagaaucaagaagcaccugagccuggagauggugaacuucaagcacccccagacccacgagaccgcccugcacugcgccgccgccagccccuaccccaagagaaagcagaucugcgagcugcugcugagaaagggcgccaacaucaacgagaagaccaaggaguuccugaccccccugcacguggccagcgagaaggcccacaacgacgugguggaggugguggugaagcacgaggccaaggugaacgcccuggacaaccugggccagaccagccugcacagagccgccuacugcggccaccugcagaccugcagacugcugcugagcuacggcugcgaccccaacaucaucagccugcagggcuucaccgcccugcagaugggcaacgagaacgugcagcagcugcugcaggagggcaucagccugggcaacagcgaggccgacagacagcugcuggaggccgccaaggccggcgacguggagaccgugaagaagcugugcaccgugcagagcgugaacugcagagacaucgagggcagacagagcaccccccugcacuucgccgccggcuacaacagagugagcgugguggaguaccugcugcagcacggcgccgacgugcacgccaaggacaagggcggccuggugccccugcacaacgccugcagcuacggccacuacgagguggccgagcugcuggugaagcacggcgccguggugaacguggccgaccuguggaaguucaccccccugcacgaggccgccgccaagggcaaguacgagaucugcaagcugcugcugcagcacggcgccgaccccaccaagaagaacagagacggcaacaccccccuggaccuggugaaggacggcgacaccgacauccaggaccugcugagaggcgacgccgcccugcuggacgccgccaagaagggcugccuggccagagugaagaagcugagcagccccgacaacgugaacugcagagacacccagggcagacacagcaccccccugcaccuggccgccggcuacaacaaccuggagguggccgaguaccugcugcagcacggcgccgacgugaacgcccaggacaagggcggccugaucccccugcacaacgccgccagcuacggccacguggacguggccgcccugcugaucaaguacaacgccugcgugaacgccaccgacaagugggccuucaccccccugcacgaggccgcccagaagggcagaacccagcugugcgcccugcugcuggcccacggcgccgaccccacccugaagaaccaggagggccagaccccccuggaccuggugagcgccgacgacgugagcgcccugcugaccgccgccaugccccccagcgcccugcccagcugcuacaagccccaggugcugaacggcgugagaagccccggcgccaccgccgacgcccugagcagcggccccagcagccccagcagccugagcgccgccagcagccuggacaaccugagcggcagcuucagcgagcugagcagcguggugagcagcagcggcaccgagggcgccagcagccuggagaagaaggaggugcccggcguggacuucagcaucacccaguucgugagaaaccugggccuggagcaccugauggacaucuucgagagagagcagaucacccuggacgugcugguggagaugggccacaaggagcugaaggagaucggcaucaacgccuacggccacagacacaagcugaucaagggcguggagagacugaucagcggccagcagggccugaaccccuaccugacccugaacaccagcggcagcggcaccauccugaucgaccugagccccgacgacaaggaguuccagagcguggaggaggagaugcagagcaccgugagagagcacagagacggcggccacgccggcggcaucuucaacagauacaacauccugaagauccagaaggugugcaacaagaagcugugggagagauacacccacagaagaaaggaggugagcgaggagaaccacaaccacgccaacgagagaaugcuguuccacggcagccccuucgugaacgccaucauccacaagggcuucgacgagagacacgccuacaucggcggcauguucggcgccggcaucuacuucgccgagaacagcagcaagagcaaccaguacguguacggcaucggcggcggcaccggcugccccgugcacaaggacagaagcugcuacaucugccacagacagcugcuguucugcagagugacccugggcaagagcuuccugcaguucagcgccaugaagauggcccacagcccccccggccaccacagcgugaccggcagacccagcgugaacggccuggcccuggccgaguacgugaucuacagaggcgagcaggccuaccccgaguaccugaucaccuaccagaucaugagacccgagggcaugguggacggcuaa

SEQ ID NO: 24881 - RNA, 3984 nt, Artificial Sequence
  TNKS__Homo_sapiens__NP_003738
auggccgccagcagaagaagccagcaccaccaccaccaccaccagcagcagcugcagcccgcccccggcgccagcgcccccccccccccccccccccccccccugagccccggccuggcccccggcaccacccccgccagccccaccgccagcggccuggcccccuucgccagccccagacacggccuggcccugcccgagggcgacggcagcagagacccccccgacagacccagaagccccgaccccguggacggcaccagcugcugcagcaccaccagcaccaucugcaccguggccgccgcccccguggugcccgccgugagcaccagcagcgccgccggcguggcccccaaccccgccggcagcggcagcaacaacagccccagcagcagcagcagccccaccagcagcagcagcagcagccccagcagccccggcagcagccuggccgagagccccgaggccgccggcgugagcagcaccgccccccugggccccggcgccgccggccccggcaccggcgugcccgccgugagcggcgcccugagagagcugcuggaggccugcagaaacggcgacgugagcagagugaagagacugguggacgccgccaacgugaacgccaaggacauggccggcagaaagagcagcccccugcacuucgccgccggcuucggcagaaaggacgugguggagcaccugcugcagaugggcgccaacgugcacgccagagacgacggcggccugaucccccugcacaacgccugcagcuucggccacgccgagguggugagccugcugcugugccagggcgccgaccccaacgccagagacaacuggaacuacaccccccugcacgaggccgccaucaagggcaagaucgacgugugcaucgugcugcugcagcacggcgccgaccccaacaucagaaacaccgacggcaagagcgcccuggaccuggccgaccccagcgccaaggccgugcugaccggcgaguacaagaaggacgagcugcuggaggccgccagaagcggcaacgaggagaagcugauggcccugcugaccccccugaacgugaacugccacgccagcgacggcagaaagagcaccccccugcaccuggccgccggcuacaacagagugagaaucgugcagcugcugcugcagcacggcgccgacgugcacgccaaggacaagggcggccuggugccccugcacaacgccugcagcuacggccacuacgaggugaccgagcugcugcugaagcacggcgccugcgugaacgccauggaccuguggcaguucaccccccugcacgaggccgccagcaagaacagaguggaggugugcagccugcugcugagccacggcgccgaccccacccuggugaacugccacggcaagagcgccguggacauggcccccacccccgagcugagagagagacugaccuacgaguucaagggccacagccugcugcaggccgccagagaggccgaccuggccaaggugaagaagacccuggcccuggagaucaucaacuucaagcagccccagagccacgagaccgcccugcacugcgccguggccagccugcaccccaagagaaagcaggugaccgagcugcugcugagaaagggcgccaacgugaacgagaagaacaaggacuucaugaccccccugcacguggccgccgagagagcccacaacgacgugauggaggugcugcacaagcacggcgccaagaugaacgcccuggacacccugggccagaccgcccugcacagagccgcccuggccggccaccugcagaccugcagacugcugcugagcuacggcagcgaccccagcaucaucagccugcagggcuucaccgccgcccagaugggcaacgaggccgugcagcagauccugagcgagagcacccccaucagaaccagcgacguggacuacagacugcuggaggccagcaaggccggcgaccuggagaccgugaagcagcugugcagcagccagaacgugaacugcagagaccuggagggcagacacagcaccccccugcacuucgccgccggcuacaacagagugagcgugguggaguaccugcugcaccacggcgccgacgugcacgccaaggacaagggcggccuggugccccugcacaacgccugcagcuacggccacuacgagguggccgagcugcuggugagacacggcgccagcgugaacguggccgaccuguggaaguucaccccccugcacgaggccgccgccaagggcaaguacgagaucugcaagcugcugcugaagcacggcgccgaccccaccaagaagaacagagacggcaacaccccccuggaccuggugaaggagggcgacaccgacauccaggaccugcugagaggcgacgccgcccugcuggacgccgccaagaagggcugccuggccagagugcagaagcugugcacccccgagaacaucaacugcagagacacccagggcagaaacagcaccccccugcaccuggccgccggcuacaacaaccuggagguggccgaguaccugcuggagcacggcgccgacgugaacgcccaggacaagggcggccugaucccccugcacaacgccgccagcuacggccacguggacaucgccgcccugcugaucaaguacaacaccugcgugaacgccaccgacaagugggccuucaccccccugcacgaggccgcccagaagggcagaacccagcugugcgcccugcugcuggcccacggcgccgaccccaccaugaagaaccaggagggccagaccccccuggaccuggccaccgccgacgacaucagagcccugcugaucgacgccaugccccccgaggcccugcccaccugcuucaagccccaggccaccguggugagcgccagccugaucagccccgccagcacccccagcugccugagcgccgccagcagcaucgacaaccugaccggcccccuggccgagcuggccgugggcggcgccagcaacgccggcgacggcgccgccggcaccgagagaaaggagggcgagguggccggccuggacaugaacaucagccaguuccugaagagccugggccuggagcaccugagagacaucuucgagaccgagcagaucacccuggacgugcuggccgacaugggccacgaggagcugaaggagaucggcaucaacgccuacggccacagacacaagcugaucaagggcguggagagacugcugggcggccagcagggcaccaaccccuaccugaccuuccacugcgugaaccagggcaccauccugcuggaccuggcccccgaggacaaggaguaccagagcguggaggaggagaugcagagcaccaucagagagcacagagacggcggcaacgccggcggcaucuucaacagauacaacgugaucagaauccagaagguggugaacaagaagcugagagagagauucugccacagacagaaggaggugagcgaggagaaccacaaccaccacaacgagagaaugcuguuccacggcagccccuucaucaacgccaucauccacaagggcuucgacgagagacacgccuacaucggcggcauguucggcgccggcaucuacuucgccgagaacagcagcaagagcaaccaguacguguacggcaucggcggcggcaccggcugccccacccacaaggacagaagcugcuacaucugccacagacagaugcuguucugcagagugacccugggcaagagcuuccugcaguucagcaccaugaagauggcccacgccccccccggccaccacagcgugaucggcagacccagcgugaacggccuggccuacgccgaguacgugaucuacagaggcgagcaggccuaccccgaguaccugaucaccuaccagaucaugaagcccgaggcccccagccagaccgccaccgccgccgagcagaagaccuaa

SEQ ID NO: 24882 - RNA, 954 nt, Artificial Sequence
  TNMD__Homo_sapiens__NP_071427
auggccaagaacccccccgagaacugcgaggacugccacauccugaacgccgaggccuucaagagcaagaagaucugcaagagccugaagaucugcggccugguguucggcauccuggcccugacccugaucgugcuguucuggggcagcaagcacuucuggcccgaggugcccaagaaggccuacgacauggagcacaccuucuacagcaacggcgagaagaagaagaucuacauggagaucgaccccgugaccagaaccgagaucuucagaagcggcaacggcaccgacgagacccuggaggugcacgacuucaagaacggcuacaccggcaucuacuucgugggccugcagaagugcuucaucaagacccagaucaaggugauccccgaguucagcgagcccgaggaggagaucgacgagaacgaggagaucaccaccaccuucuucgagcagagcgugaucugggugcccgccgagaagcccaucgagaacagagacuuccugaagaacagcaagauccuggagaucugcgacaacgugaccauguacuggaucaaccccacccugaucagcgugagcgagcugcaggacuucgaggaggagggcgaggaccugcacuuccccgccaacgagaagaagggcaucgagcagaacgagcaguggguggugccccaggugaagguggagaagaccagacacgccagacaggccagcgaggaggagcugcccaucaacgacuacaccgagaacggcaucgaguucgaccccaugcuggacgagagaggcuacugcugcaucuacugcagaagaggcaacagauacugcagaagagugugcgagccccugcugggcuacuaccccuaccccuacugcuaccagggcggcagagugaucugcagagugaucaugcccugcaacugguggguggccagaaugcugggcagaguguaa

SEQ ID NO: 24883 - RNA, 486 nt, Artificial Sequence
  TNNC1__Homo_sapiens__NP_003271
auggacgacaucuacaaggccgccguggagcagcugaccgaggagcagaagaacgaguucaaggccgccuucgacaucuucgugcugggcgccgaggacggcugcaucagcaccaaggagcugggcaaggugaugagaaugcugggccagaaccccacccccgaggagcugcaggagaugaucgacgagguggacgaggacggcagcggcaccguggacuucgacgaguuccuggugaugauggugagaugcaugaaggacgacagcaagggcaagagcgaggaggagcugagcgaccuguucagaauguucgacaagaacgccgacggcuacaucgaccuggacgagcugaagaucaugcugcaggccaccggcgagaccaucaccgaggacgacaucgaggagcugaugaaggacggcgacaagaacaacgacggcagaaucgacuacgacgaguuccuggaguucaugaagggcguggaguaa

SEQ ID NO: 24884 - RNA, 3900 nt, Artificial Sequence
  TNN__Homo_sapiens__NP_071376
augagccugcaggagauguucagauuccccaugggccugcugcugggcagcgugcugcugguggccagcgcccccgccacccuggagccccccggcugcagcaacaaggagcagcaggugaccgugagccacaccuacaagaucgacgugcccaagagcgcccuggugcagguggacgccgacccccagccccugagcgacgacggcgccagccugcuggcccugggcgaggccagagaggagcagaacaucaucuucagacacaacaucagacugcagaccccccagaaggacugcgagcuggccggcagcgugcaggaccugcuggccagagugaagaagcuggaggaggagaugguggagaugaaggagcagugcagcgcccagagaugcugccagggcgugaccgaccugagcagacacugcagcggccacggcaccuucagccuggagaccugcagcugccacugcgaggagggcagagagggccccgccugcgagagacuggccugccccggcgccugcagcggccacggcagaugcguggacggcagaugccugugccacgagcccuacgugggcgccgacugcggcuaccccgccugccccgagaacugcagcggccacggcgagugcgugagaggcgugugccagugccacgaggacuucaugagcgaggacugcagcgagaagagaugccccggcgacugcagcggccacggcuucugcgacaccggcgagugcuacugcgaggagggcuucaccggccuggacugcgcccagguggugaccccccagggccugcagcugcugaagaacaccgaggacagccugcuggugagcugggagcccagcagccagguggaccacuaccugcugagcuacuacccccugggcaaggagcugagcggcaagcagauccaggugcccaaggagcagcacagcuacgagauccugggccugcugcccggcaccaaguacaucgugacccugagaaacgugaagaacgaggugagcagcagcccccagcaccugcuggccaccaccgaccuggccgugcugggcaccgccugggugaccgacgagaccgagaacagccuggacguggagugggagaaccccagcaccgagguggacuacuacaagcugagauacggccccaugaccggccaggagguggccgaggugaccgugcccaagagcagcgaccccaagagcagauacgacaucaccggccugcaccccggcaccgaguacaagaucaccguggugcccaugagaggcgagcuggagggcaagcccauccugcugaacggcagaaccgagaucgacagccccaccaacguggugaccgacagagugaccgaggacaccgccaccgugagcugggaccccgugcaggccgugaucgacaaguacguggugagauacaccagcgccgacggcgacaccaaggagauggccgugcacaaggacgagagcagcaccgugcugaccggccugaagcccggcgaggccuacaagguguacgugugggccgagagaggcaaccagggcagcaagaaggccgacaccaacgcccugaccgagaucgacagccccgccaaccuggugaccgacagagugaccgagaacaccgccaccaucagcugggaccccgugcaggccaccaucgacaaguacguggugagauacaccagcgccgacgaccaggagaccagagaggugcuggugggcaaggagcagagcagcaccgugcugaccggccugagacccggcguggaguacaccgugcacgugugggcccagaagggcgacagagagagcaagaaggccgacaccaacgcccccaccgacaucgacagccccaagaaccuggugaccgacagagugaccgagaacauggccaccgugagcugggaccccgugcaggccgccaucgacaaguacguggugagauacaccagcgccggcggcgagaccagagaggugcccgugggcaaggagcagagcagcaccgugcugaccggccugagacccggcauggaguacauggugcacgugugggcccagaagggcgaccaggagagcaagaaggccgacaccaaggcccagaccgacaucgacagcccccagaaccuggugaccgacagagugaccgagaacauggccaccgugagcugggaccccgugagagccaccaucgacagauacguggugagauacaccagcgccaaggacggcgagaccagagaggugcccgugggcaaggagcagagcagcaccgugcugaccggccugagacccggcguggaguacaccgugcacgugugggcccagaagggcgcccaggagagcaagaaggccgacaccaaggcccagaccgacaucgacagcccccagaaccuggugaccgacugggugaccgagaacaccgccaccgugagcugggaccccgugcaggccaccaucgacagauacguggugcacuacaccagcgccaacggcgagaccagagaggugcccgugggcaaggagcagagcagcaccgugcugaccggccugagacccggcauggaguacaccgugcacgugugggcccagaagggcaaccaggagagcaagaaggccgacaccaaggcccagaccgagaucgacggccccaagaaccuggugaccgacugggugaccgagaacauggccaccgugagcugggaccccgugcaggccaccaucgacaaguacauggugagauacaccagcgccgacggcgagaccagagaggugcccgugggcaaggagcacagcagcaccgugcugaccggccugagacccggcauggaguacauggugcacgugugggcccagaagggcgcccaggagagcaagaaggccgacaccaaggcccagaccgagcuggacccccccagaaaccugagacccagcgccgugacccagagcggcggcauccugaccuggaccccccccagcgcccagauccacggcuacauccugaccuaccaguuccccgacggcaccgugaaggagaugcagcugggcagagaggaccagagauucgcccugcagggccuggagcagggcgccaccuaccccgugagccugguggccuucaagggcggcagaagaagcagaaacgugagcaccacccugagcaccgugggcgccagauucccccaccccagcgacugcagccaggugcagcagaacagcaacgccgccagcggccuguacaccaucuaccugcacggcgacgccagcagaccccugcagguguacugcgacauggagaccgacggcggcggcuggaucguguuccagagaagaaacaccggccagcuggacuucuucaagagauggagaagcuacguggagggcuucggcgaccccaugaaggaguucuggcugggccuggacaagcugcacaaccugaccaccggcacccccgccagauacgaggugagaguggaccugcagaccgccaacgagagcgccuacgccaucuacgacuucuuccagguggccagcagcaaggagagauacaagcugaccgugggcaaguacagaggcaccgccggcgacgcccugaccuaccacaacggcuggaaguucaccaccuucgacagagacaacgacaucgcccugagcaacugcgcccugacccaccacggcggcuggugguacaagaacugccaccuggccaaccccaacggcagauacggcgagaccaagcacagcgagggcgugaacugggagcccuggaagggccacgaguucagcauccccuacguggagcugaagaucagaccccacggcuacagcagagagcccgugcugggcagaaagaagagaacccugagaggcagacugagaaccuucuaa

SEQ ID NO: 24885 - RNA, 564 nt, Artificial Sequence
  TNNI1__Homo_sapiens__NP_003272
augcccgagguggagagaaagcccaagaucaccgccagcagaaagcugcugcugaagagccugaugcuggccaaggccaaggagugcugggagcaggagcacgaggagagagaggccgagaaggugagauaccuggccgagagaauccccacccugcagaccagaggccugagccugagcgcccugcaggaccugugcagagagcugcacgccaagguggaggugguggacgaggagagauacgacaucgaggccaagugccugcacaacaccagagagaucaaggaccugaagcugaaggugauggaccugagaggcaaguucaagagacccccccugagaagagugagagugagcgccgacgccaugcugagagcccugcugggcagcaagcacaaggugagcauggaccugagagccaaccugaagagcgugaagaaggaggacaccgagaaggagagacccguggaggugggcgacuggagaaagaacguggaggccaugagcggcauggagggcagaaagaagauguucgacgccgccaagagccccaccagccaguaa

SEQ ID NO: 24886 - RNA, 549 nt, Artificial Sequence
  TNNI2__Homo_sapiens__NP_001139313
augagccagugcaagaagagaaacagagccaucaccgccagaagacagcaccugaagagcgugaugcugcagaucgccgccaccgagcuggagaaggaggagagcagaagagaggccgagaagcagaacuaccuggccgagcacugccccccccugcacauccccggcagcaugagcgaggugcaggagcugugcaagcagcugcacgccaagaucgacgccgccgaggaggagaaguacgacauggaggugagagugcagaagaccagcaaggagcuggaggacaugaaccagaagcuguucgaccugagaggcaaguucaagagacccccccugagaagagugagaaugagcgccgacgccaugcugaaggcccugcugggcagcaagcacaaggugugcauggaccugagagccaaccugaagcaggugaagaaggaggacaccgagaaggagagagaccugagagacgugggcgacuggagaaagaacaucgaggagaagagcggcauggagggcagaaagaagauguucgagagcgagagcuaa

SEQ ID NO: 24887 - RNA, 633 nt, Artificial Sequence
  TNNI3__Homo_sapiens__NP_000354
auggccgacggcagcagcgacgccgccagagagcccagacccgcccccgcccccaucagaagaagaagcagcaacuacagagccuacgccaccgagccccacgccaagaagaagagcaagaucagcgccagcagaaagcugcagcugaagacccugcugcugcagaucgccaagcaggagcuggagagagaggccgaggagagaagaggcgagaagggcagagcccugagcaccagaugccagccccuggagcuggccggccugggcuucgccgagcugcaggaccugugcagacagcugcacgccagaguggacaagguggacgaggagagauacgacaucgaggccaaggugaccaagaacaucaccgagaucgccgaccugacccagaagaucuucgaccugagaggcaaguucaagagacccacccugagaagagugagaaucagcgccgacgccaugaugcaggcccugcugggcgccagagccaaggagagccuggaccugagagcccaccugaagcaggugaagaaggaggacaccgagaaggagaacagagaggugggcgacuggagaaagaacaucgacgcccugagcggcauggagggcagaaagaagaaguucgagagcuaa

SEQ ID NO: 24888 - RNA, 756 nt, Artificial Sequence
  TNNT1__Homo_sapiens__NP_001278703
augagcgacaccgaggagcaggaguacgaggaggagcagcccgaggaggaggccgccgaggaggaggaggaggaggaggagagacccaagcccagcagacccguggugcccccccugaucccccccaagauccccgagggcgagagaguggacuucgacgacauccacagaaagagaauggagaaggaccugcuggagcugcagacccugaucgacgugcacuucgagcagagaaagaaggaggaggaggagcugguggcccugaaggagagaaucgagagaagaagaagcgagagagccgagcagcagagauucagaaccgagaaggagagagagagacaggccaagcuggccgaggagaagaugagaaaggaggaggaggaggccaagaagagagccgaggacgacgccaagaagaagaaggugcugagcaacaugggcgcccacuucggcggcuaccuggugaaggccgagcagaagagaggcaagagacagaccggcagagagaugaaggugagaauccugagcgagagaaagaagccccuggacaucgacuacaugggcgaggagcagcugagagagaaggcccaggagcugagcgacuggauccaccagcuggagagcgagaaguucgaccugauggccaagcugaagcagcagaaguacgagaucaacgugcuguacaacagaaucagccacgcccagaaguucagaaagggcgccggcaagggcagagugggcggcagauggaaguaa

SEQ ID NO: 24889 - RNA, 867 nt, Artificial Sequence
  TNNT2__Homo_sapiens__NP_001001430
augagcgacaucgaggaggugguggaggaguacgaggaggaggagcaggaggaggccgccguggaggagcaggaggaggccgccgaggaggacgccgaggccgaggccgagaccgaggagaccagagccgaggaggacgaggaggaggaggaggccaaggaggccgaggacggccccauggaggagagcaagcccaagcccagaagcuucaugcccaaccuggugccccccaagauccccgacggcgagagaguggacuucgacgacauccacagaaagagaauggagaaggaccugaacgagcugcaggcccugaucgaggcccacuucgagaacagaaagaaggaggaggaggagcuggugagccugaaggacagaaucgagagaagaagagccgagagagccgagcagcagagaaucagaaacgagagagagaaggagagacagaacagacuggccgaggagagagccagaagagaggaggaggagaacagaagaaaggccgaggacgaggccagaaagaagaaggcccugagcaacaugaugcacuucggcggcuacauccagaagcaggcccagaccgagagaaagagcggcaagagacagaccgagagagagaagaagaagaagauccuggccgagagaagaaaggugcuggccaucgaccaccugaacgaggaccagcugagagagaaggccaaggagcuguggcagagcaucuacaaccuggaggccgagaaguucgaccugcaggagaaguucaagcagcagaaguacgagaucaacgugcugagaaacagaaucaacgacaaccagaaggugagcaagaccagaggcaaggccaaggugaccggcagauggaaguaa

SEQ ID NO: 24890 - RNA, 753 nt, Artificial Sequence
  TNNT3__Homo_sapiens__NP_001036245
augagcgacgaggagguggagcagguggaggagcaguacgaggaggaggaggaggcccaggaggaggaggaggugcaggaggaggagaagcccagacccaagcugaccgcccccaagauccccgagggcgagaagguggacuucgacgacauccagaagaagagacagaacaaggaccugauggagcugcaggcccugaucgacagccacuucgaggccagaaagaaggaggaggaggagcugguggcccugaaggagagaaucgagaagagaagagccgagagagccgagcagcagagaaucagagccgagaaggagagagagagacagaacagacuggccgaggagaaggccagaagagaggaggaggacgccaagagaagagccgaggacgaccugaagaagaagaaggcccugagcagcaugggcgccaacuacagcagcuaccuggccaaggccgaccagaagagaggcaagaagcagaccgccagagagaugaagaagaagauccuggccgagagaagaaagccccugaacaucgaccaccugggcgaggacaagcugagagacaaggccaaggagcugugggagacccugcaccagcuggagaucgacaaguucgaguucggcgagaagcugaagagacagaaguacgacaucaugaacgugagagccagagugcagaugcuggccaaguucagcaagaaggccggcacccccgccaagggcaaggugggcggcagauggaaguaa

SEQ ID NO: 24891 - RNA, 168 nt, Artificial Sequence
  TNP1__Homo_sapiens__NP_003275
augagcaccagcagaaagcugaagagccacggcaugagaagaagcaagagcagaagcccccacaagggcgugaagagaggcggcagcaagagaaaguacagaaagggcaaccugaagagcagaaagagaggcgacgacgccaacagaaacuacagaagccaccuguaa

SEQ ID NO: 24892 - RNA, 417 nt, Artificial Sequence
  TNP2__Homo_sapiens__NP_005416
auggacacccagacccacagccugcccaucacccacacccagcugcacagcaacagccagccccagagcagaaccugcaccagacacugccagaccuucagccagagcugcagacagagccacagaggcagcagaagccagagcagcagccagagccccgccagccacagaaaccccaccggcgcccacagcagcagcggccaccagagccagagccccaacaccagccccccccccaagagacacaagaagaccaugaacagccaccacagccccaugagacccaccauccugcacugcagaugccccaagaacagaaagaaccuggagggcaagcugaagaagaagaagauggccaagagaauccagcagguguacaagaccaagaccagaagcagcggcuggaagagcaacuaa

SEQ ID NO: 24893 - RNA, 2697 nt, Artificial Sequence
  TNPO1__Homo_sapiens__NP_002261
auggugugggacagacagaccaagauggaguacgaguggaagcccgacgagcagggccugcagcagauccugcagcugcugaaggagagccagagccccgacaccaccauccagagaaccgugcagcagaagcuggagcagcugaaccaguaccccgacuucaacaacuaccugaucuucgugcugaccaagcugaagagcgaggacgagcccaccagaagccugagcggccugauccugaagaacaacgugaaggcccacuuccagaacuuccccaacggcgugaccgacuucaucaagagcgagugccugaacaacaucggcgacagcagcccccugaucagagccaccgugggcauccugaucaccaccaucgccagcaagggcgagcugcagaacuggcccgaccugcugcccaagcugugcagccugcuggacagcgaggacuacaacaccugcgagggcgccuucggcgcccugcagaagaucugcgaggacagcgccgagauccuggacagcgacgugcuggacagaccccugaacaucaugauccccaaguuccugcaguucuucaagcacagcagccccaagaucagaagccacgccguggccugcgugaaccaguucaucaucagcagaacccaggcccugaugcugcacaucgacagcuucaucgagaaccuguucgcccuggccggcgacgaggagcccgaggugagaaagaacgugugcagagcccuggugaugcugcuggaggugagaauggacagacugcugccccacaugcacaacaucguggaguacaugcugcagagaacccaggaccaggacgagaacguggcccuggaggccugcgaguucuggcugacccuggccgagcagcccaucugcaaggacgugcuggugagacaccugcccaagcugauccccgugcuggugaacggcaugaaguacagcgacaucgacaucauccugcugaagggcgacguggaggaggacgagaccauccccgacagcgagcaggacaucagacccagauuccacagaagcagaaccguggcccagcagcacgacgaggacggcaucgaggaggaggacgacgacgacgacgagaucgacgacgacgacaccaucagcgacuggaaccugagaaagugcagcgccgccgcccuggacgugcuggccaacguguacagagacgagcugcugccccacauccugccccugcugaaggagcugcuguuccaccacgaguggguggugaaggagagcggcauccuggugcugggcgccaucgccgagggcugcaugcagggcaugauccccuaccugcccgagcugaucccccaccugauccagugccugagcgacaagaaggcccuggugagaagcaucaccugcuggacccugagcagauacgcccacuggguggugagccagccccccgacaccuaccugaagccccugaugaccgagcugcugaagagaauccuggacagcaacaagagagugcaggaggccgccugcagcgccuucgccacccuggaggaggaggccugcaccgagcuggugcccuaccuggccuacauccuggacacccugguguucgccuucagcaaguaccagcacaagaaccugcugauccuguacgacgccaucggcacccuggccgacagcgugggccaccaccugaacaagcccgaguacauccagaugcugaugcccccccugauccagaaguggaacaugcugaaggacgaggacaaggaccuguucccccugcuggagugccugagcagcguggccaccgcccugcagagcggcuuccugcccuacugcgagcccguguaccagagaugcgugaaccuggugcagaagacccuggcccaggccaugcugaacaacgcccagcccgaccaguacgaggcccccgacaaggacuucaugaucguggcccuggaccugcugagcggccuggccgagggccugggcggcaacaucgagcagcugguggccagaagcaacauccugacccugauguaccagugcaugcaggacaagaugcccgaggugagacagagcagcuucgcccugcugggcgaccugaccaaggccugcuuccagcacgugaagcccugcaucgccgacuucaugcccauccugggcaccaaccugaaccccgaguucaucagcgugugcaacaacgccaccugggccaucggcgagaucagcauccagaugggcaucgagaugcagcccuacauccccauggugcugcaccagcugguggagaucaucaacagacccaacacccccaagacccugcuggagaacaccgccaucaccaucggcagacugggcuacgugugcccccaggagguggcccccaugcugcagcaguucaucagacccuggugcaccagccugagaaacaucagagacaacgaggagaaggacagcgccuucagaggcaucugcaccaugaucagcgugaaccccagcggcgugauccaggacuucaucuucuucugcgacgccguggccagcuggaucaaccccaaggacgaccugagagacauguucugcaagauccugcacggcuucaagaaccaggugggcgacgagaacuggagaagauucagcgaccaguucccccugccccugaaggagagacuggccgccuucuacggcguguaa

SEQ ID NO: 24894 - RNA, 2664 nt, Artificial Sequence
  TNPO2__Homo_sapiens__NP_001129667
auggacuggcagcccgacgagcagggccugcagcaggugcugcagcugcugaaggacagccagagccccaacaccgccacccagagaaucgugcaggacaagcugaagcagcugaaccaguuccccgacuucaacaacuaccugaucuucgugcugaccagacugaagagcgaggacgagcccaccagaagccugagcggccugauccugaagaacaacgugaaggcccacuaccagagcuuccccccccccguggccgacuucaucaagcaggagugccugaacaacaucggcgacgccagcagccugaucagagccaccaucggcauccugaucaccaccaucgccagcaagggcgagcugcagauguggcccgagcugcugccccagcugugcaaccugcugaacagcgaggacuacaacaccugcgagggcgccuucggcgcccugcagaagaucugcgaggacagcagcgagcugcuggacagcgacgcccugaacagaccccugaacaucaugauccccaaguuccugcaguucuucaagcacugcagccccaagaucagaagccacgccaucgccugcgugaaccaguucaucauggacagagcccaggcccugauggacaacaucgacaccuucaucgagcaccuguucgcccuggccguggacgacgaccccgaggugagaaagaacgugugcagagcccuggugaugcugcuggaggugagaaucgacagacugaucccccacaugcacagcaucauccaguacaugcugcagagaacccaggaccacgacgagaacguggcccuggaggccugcgaguucuggcugacccuggccgagcagcccaucugcaaggaggugcuggccagccaccuggugcagcugauccccauccuggugaacggcaugaaguacagcgagaucgacaucauccugcugaagggcgacguggaggaggacgaggccgugcccgacagcgagcaggacaucaagcccagauuccacaagagcagaaccgugacccugccccacgaggccgagagacccgacggcagcgaggacgccgaggacgacgacgacgacgacgcccugagcgacuggaaccugagaaagugcagcgccgccgcccuggacgugcuggccaacguguucagagaggagcugcugccccaccugcugccccugcugaagggccugcuguuccaccccgaguggguggugaaggagagcggcauccuggugcugggcgccaucgccgagggcugcaugcagggcauggugcccuaccugcccgagcugaucccccaccugauccagugccugagcgacaagaaggcccuggugagaagcaucgccugcuggacccugagcagauacgcccacuggguggugagccagccccccgacaugcaccugaagccccugaugaccgagcugcugaagagaauccuggacggcaacaagagagugcaggaggccgccugcagcgccuucgccacccuggaggaggaggccugcaccgagcuggugcccuaccugagcuacauccuggacacccugguguucgccuucggcaaguaccagcacaagaaccugcugauccuguacgacgccaucggcacccuggccgacagcgugggccaccaccugaaccagcccgaguacauccagaagcugaugcccccccugauccagaaguggaacgagcugaaggacgaggacaaggaccuguucccccugcuggagugccugagcagcguggccaccgcccugcagagcggcuuccugcccuacugcgagcccguguaccagagaugcgugacccuggugcagaagacccuggcccaggccaugauguacacccagcaccccgagcaguacgaggcccccgacaaggacuucaugaucguggcccuggaccugcugagcggccuggccgagggccugggcggccacguggagcagcugguggccagaagcaacaucaugacccugcuguuccagugcaugcaggacagcaugcccgaggugagacagagcagcuucgcccugcugggcgaccugaccaaggccugcuucauccacgugaagcccugcaucgccgaguucaugcccauccugggcaccaaccugaaccccgaguucaucagcgugugcaacaacgccaccugggccaucggcgagaucugcaugcagaugggcgccgagaugcagcccuacgugcagauggugcugaacaaccugguggagaucaucaacagacccaacacccccaagacccugcuggagaacaccgccaucaccaucggcagacugggcuacgugugcccccaggagguggcccccaugcugcagcaguucaucagacccuggugcaccagccugagaaacaucagagacaacgaggagaaggacagcgccuucagaggcaucugcaugaugaucggcgugaaccccggcggcguggugcaggacuucaucuucuucugcgacgccguggccagcugggugagccccaaggacgaccugagagacauguucuacaagauccugcacggcuucaaggaccaggugggcgaggacaacuggcagcaguucagcgagcaguuccccccccugcugaaggagagacuggccgccuucuacggcguguaa

SEQ ID NO: 24895 - RNA, 2580 nt, Artificial Sequence
  TNPO3__Homo_sapiens__NP_001177957
auggagggcgccaagcccacccugcagcugguguaccaggccgugcaggcccuguaccacgaccccgaccccagcggcaaggagagagccagcuucuggcugggcgagcugcagagaagcgugcacgccugggagaucagcgaccagcugcugcagaucagacaggacguggagagcugcuacuucgccgcccagaccaugaagaugaagauccagaccagcuucuacgagcugcccaccgacagccacgccagccugagagacagccugcugacccacauccagaaccugaaggaccugagccccgugaucgugacccagcuggcccuggccaucgccgaccuggcccugcagaugcccagcuggaagggcugcgugcagacccugguggagaaguacagcaacgacgugaccagccugcccuuccugcuggagauccugaccgugcugcccgaggaggugcacagcagaagccugagaaucggcgccaacagaagaaccgagaucaucgaggaccuggccuucuacagcagcaccguggugagccugcugaugaccugcguggagaaggccggcaccgacgagaagaugcugaugaagguguucagaugccugggcagcugguucaaccugggcgugcuggacagcaacuucauggccaacaacaagcugcuggcccugcuguucgaggugcugcagcaggacaagaccagcagcaaccugcacgaggccgccagcgacugcgugugcagcgcccuguacgccaucgagaacguggagaccaaccugccccuggccaugcagcuguuccagggcgugcugacccuggagaccgccuaccacauggccguggccagagaggaccuggacaaggugcugaacuacugcagaaucuucaccgagcugugcgagaccuuccuggagaagaucgugugcacccccggccagggccugggcgaccugagaacccuggagcugcugcugaucugcgccggccacccccaguacgaggugguggagaucagcuucaacuucugguacagacugggcgagcaccuguacaagaccaacgacgaggugauccacggcaucuucaaggccuacauccagagacugcugcacgcccuggccagacacugccagcuggagcccgaccacgagggcgugcccgaggagaccgacgacuucggcgaguucagaaugagagugagcgaccuggugaaggaccugaucuuccugaucggcagcauggagugcuucgcccagcuguacagcacccugaaggagggcaacccccccugggaggugaccgaggccgugcuguucaucauggccgccaucgccaagagcguggaccccgagaacaaccccacccugguggaggugcuggagggcguggugagacugcccgagaccgugcacaccgccgugagauacaccagcaucgagcuggugggcgagaugagcgaggugguggacagaaacccccaguuccugggcaccgcccuggugcuggccagacugccccuggacaagaucaccgagugccugagcgagcugugcagcgugcaggugauggcccugaagaagcugcugagccaggagcccagcaacggcaucagcagcgaccccaccguguuccuggacagacuggccgugaucuucagacacaccaaccccaucguggagaacggccagacccaccccugccagaaggugauccaggagaucuggcccgugcugagcgagacccugaacaagcacagagccgacaacagaaucguggagagaugcugcagaugccugagauucgccgugagaugcgugggcaagggcagcgccgcccugcugcagccccuggugacccagauggugaacguguaccacgugcaccagcacagcugcuuccuguaccugggcagcauccugguggacgaguacggcauggaggagggcugcagacagggccugcuggacaugcugcaggcccugugcauccccaccuuccagcugcuggagcagcagaacggccugcagaaccaccccgacaccguggacgaccuguucagacuggccaccagauucauccagagaagccccgugacccugcugagaagccagguggugauccccauccugcagugggccaucgccagcaccacccuggaccacagagacgccaacugcagcgugaugagauuccugagagaccugauccacaccggcguggccaacgaccacgaggaggacuucgagcugagaaaggagcugaucggccaggugaugaaccagcugggccagcagcuggugagccagcugcugcacaccugcugcuucugccugccccccuacacccugcccgacguggccgaggugcugugggagaucaugcagguggacagacccaccuucugcagauggcuggagaacagccugaagggccugcccaaggagaccaccgugggcgccgugaccgugacccacaagcagcugaccgacuuccacaagcaggugaccagcgccgaggagugcaagcaggugugcugggcccugagagacuucaccagacuguucagauaa

SEQ ID NO: 24896 - RNA, 8907 nt, Artificial Sequence
  TNRC18__Homo_sapiens__NP_001073964
auggacggcagagacuucggcccccagagaagcgugcacggccccccccccccccugcugagcggccuggccauggacagccacagagugggcgccgccaccgccggcagacugcccgccagcggccugcccggcccccugccccccggcaaguacauggccggccugaaccugcacccccaccccggcgaggccuuccugggcagcuucguggccagcggcaugggccccagcgccagcagccacggcagccccgugccccugcccagcgaccugagcuucagaagccccacccccagcaaccugcccauggugcagcugugggccgcccacgcccacgagggcuucagccaccugcccagcggccuguaccccagcuaccugcaccugaaccaccuggagccccccagcagcggcagcccccugcugagccagcugggccagcccagcaucuucgacacccagaagggccagggccccggcggcgacggcuucuaccugcccaccgccggcgcccccggcagccugcacagccacgcccccagcgccagaacccccggcggcggccacagcagcggcgcccccgccaagggcagcagcagcagagacggccccgccaaggagagagccggcagaggcggcgagccccccccccuguucggcaagaaggaccccagagccagaggcgaggaggccagcggccccagaggcgugguggaccugacccaggaggccagagccgagggcagacaggacagaggcccccccagacuggccgagagacugagccccuuccuggccgagagcaagaccaagaacgccgcccugcagcccagcgugcugaccaugugcaacggcggcgccggcgacgugggccugcccgcccugguggccgaggccggcagaggcggcgccaaggaggccgccagacaggacgagggcgccagacugcugagaagaaccgagacccugcugcccggccccagacccugccccagcccccugccccccccccccgccccccccaagggcccccccgccccccccgccgccacccccgccggcguguacaccguguucagagagcagggcagagagcacagagugguggcccccaccuucgugcccagcguggaggccuucgacgagagacccggccccauccagaucgccagccaggccagagacgccagagccagagagagagaggccggcagacccggcgugcugcaggccccccccggcagccccagaccccuggacagacccgagggccugagagagaagaacagcgugaucagaagccugaagagacccccccccgccgacgcccccaccgugagagccaccagagccagccccgaccccagagccuacgugcccgccaaggagcugcugaagcccgaggccgaccccagacccugcgagagagcccccagaggccccgccggccccgccgcccagcaggccgccaagcuguucggccuggagcccggcagacccccccccaccggccccgagcacaaguggaagcccuucgagcugggcaacuucgccgccacccagauggccgugcuggccgcccagcaccaccacagcagagccgaggaggaggccgccgugguggccgccagcagcagcaagaaggccuaccuggaccccggcgccgugcugcccagaagcgccgccaccugcggcagacccguggccgacaugcacagcgccgcccacggcagcggcgaggccagcgccaugcagagccugaucaaguacagcggcagcuucgccagagacgccguggccgugagacccggcggcugcggcaagaagagccccuucggcggccugggcaccaugaagcccgagcccgcccccaccagcgccggcgccagcagagcccaggccagacugccccacagcggcggccccgccgccggcggcggcagacagcugaagagagaccccgagagacccgagagcgccaaggccuucggcagagagggcagcggcgcccagggcgaggccgaggugagacacccccccgugggcaucgccguggccguggccagacagaaggacagcggcggcagcggcagacugggccccggccugguggaccaggagagaagccugagccugagcaacgugaagggccacggcagagccgacgaggacugcguggacgacagagccagacacagagaggagagacugcugggcgccagacuggacagagaccaggagaagcugcugagagagagcaaggagcuggccgaccuggccagacugcaccccaccagcugcgcccccaacggccugaaccccaaccugauggugaccggcggccccgcccuggccggcagcggcagauggagcgccgaccccgccgcccaccuggccacccaccccuggcugcccagaagcggcaacgccagcauguggcuggccggccaccccuacggccugggcccccccagccugcaccagggcauggcccccgccuucccccccggccugggcggcagccugcccagcgccuaccaguucgugagagacccccagagcggccagcugguggugauccccagcgaccaccugccccacuucgccgagcugauggagagagccaccgugcccccccuguggcccgcccuguacccccccggcagaagcccccugcaccacgcccagcagcugcagcuguucagccagcagcacuuccugagacagcaggaguuccuguaccugcagcagcaggccgcccaggcccuggagcugcagagaagcgcccagcuggugcaggagagacugaaggcccaggagcacagagccgagauggaggagaagggcagcaagagaggccuggaggccgccggcaaggccggccuggccaccgccggccccggccugcugcccagaaagccccccggccuggccgccggccccgccggcaccuacggcaaggccgugagccccccccccagccccagagccagccccguggccgcccugaaggccaaggugauccagaagcuggaggacgugagcaagccccccgccuacgccuaccccgccacccccagcagccaccccaccagccccccccccgccagccccccccccacccccggcaucaccagaaaggaggaggcccccgagaacgugguggagaagaaggaccuggagcuggagaaggaggcccccagccccuuccaggcccuguucagcgacaucccccccagauaccccuuccaggcccugcccccccacuacggcagacccuaccccuuccugcugcagcccaccgccgccgccgacgccgacggccuggcccccgacgugccccugcccgccgacggccccgagagacuggcccugagccccgaggacaagcccaucagacugagccccagcaagaucaccgagccccugagagagggccccgaggaggagccccuggccgagagagaggugaaggccgagguggaggacauggacgagggccccaccgagcugcccccccuggagagcccccugccccugcccgccgccgaggccauggccacccccagccccgccggcggcugcggcggcggccugcuggaggcccaggcccugagcgccaccggccagagcugcgccgagcccagcgagugccccgacuucguggagggccccgagcccagaguggacagccccggcagaaccgagcccugcaccgccgcccuggaccugggcgugcagcugacccccgagacccugguggaggccaaggaggagcccguggaggugcccguggccgugcccgugguggaggccgugcccgaggagggccuggcccagguggcccccagcgagagccagcccacccuggagaugagcgacugcgacgugcccgccggcgagggccagugccccagccuggagccccaggaggccgugcccgugcugggcagcaccugcuuccuggaggaggccagcagcgaccaguuccugcccagccuggaggacccccuggccggcaugaacgcccuggccgccgccgccgagcugccccaggccagaccccugcccagccccggcgccgccggcgcccaggcccuggagaagcuggaggccgccgagagccuggugcuggagcagagcuuccugcacggcaucacccugcugagcgagaucgccgagcuggagcuggagagaagaagccaggagaugggcggcgccgagagagcccugguggccagacccagccuggagagccugcuggccgccggcagccacaugcugagagaggugcuggacggccccgugguggacccccugaagaaccugagacugcccagagagcugaagcccaacaagaaguacagcuggaugagaaagaaggaggagagaauguacgccaugaagagcagccuggaggacauggacgcccuggagcuggacuucagaaugagacuggccgaggugcagagacaguacaaggagaagcagagagagcuggugaagcugcagagaagaagagacagcgaggacagaagagaggagccccacagaagccuggccagaagaggccccggcagacccagaaagagaacccacgcccccagcgcccugagcccccccagaaagagaggcaagagcggccacagcagcggcaagcugagcagcaagagccugcugaccagcgacgacuacgagcugggcgccggcaucagaaagagacacaagggcagcgaggaggagcacgacgcccugaucggcaugggcaaggccagaggcagaaaccagaccugggacgagcacgaggccagcagcgacuucaucagccagcugaagaucaagaagaagaagauggccagcgaccaggagcagcuggccagcaagcuggacaaggcccugagccugaccaagcaggacaagcugaagagccccuucaaguucagcgacagcgccggcggcaagagcaagaccagcggcggcugcggcagauaccugacccccuacgacagccugcugggcaagaacagaaaggcccuggccaagggccugggccugagccugaagagcagcagagagggcaagcacaagagagccgccaagaccagaaagauggaggugggcuucaaggccagaggccagcccaagagcgcccacagccccuucgccagcgaggugagcagcuacagcuacaacaccgacagcgaggaggacgaggaguuccugaaggacgaguggcccgcccagggccccagcagcagcaagcugacccccagccugcugugcagcaugguggccaagaacagcaaggccgccggcggccccaagcugaccaagagaggccuggccgcccccagaacccugaagcccaagcccgccaccagcagaaagcagcccuucugccugcugcugagagaggccgaggccagaagcagcuucagcgacagcagcgaggagagcuucgaccaggacgagagcagcgaggaggaggacgaggaggaggagcuggaggaggaggacgaggccagcggcggcggcuacagacugggcgccagagagagagcccugagccccggccuggaggagagcggccugggccugcuggccagauucgccgccagcgcccugcccagccccaccgugggccccagccugagcguggugcagcuggaggccaagcagaaggccagaaagaaggaggagagacagagccugcugggcaccgaguucgaguacaccgacagcgagagcgaggugaaggugagaaagagaagccccgccggccugcugagacccaagaagggccugggcgagcccggccccagccuggccgcccccacccccggcgccagaggccccgaccccagcagccccgacaaggccaagcuggccguggagaagggcagaaaggccagaaagcugagaggccccaaggagcccggcuucgaggccggccccgaggccagcgacgacgaccuguggaccagaagaagaagcgagagaaucuuccugcacgacgccagcgccgccgcccccgcccccgugagcaccgcccccgccaccaagaccagcagaugcgccaagggcggcccccugagccccagaaaggacgccggcagagccaaggacagaaaggaccccagaaagaagaagaagggcaaggaggccggccccggcgccggccugcccccccccagagcccccgcccugcccagcgaggccagagccccccacgccagcagccugaccgccgccaagagaagcaaggccaaggccaagggcaaggaggugaagaaggagaacagaggcaagggcggcgccgugagcaagcugauggagagcauggccgccgaggaggacuucgagcccaaccaggacagcagcuucagcgaggacgagcaccugcccagaggcggcgccguggagagaccccugacccccgcccccagaagcugcaucaucgacaaggacgagcugaaggacggccugagagugcugauccccauggacgacaagcugcuguacgccggccacgugcagaccgugcacagccccgacaucuacagaguggugguggagggcgagagaggcaacagaccccacaucuacugccuggagcagcugcugcaggaggccaucaucgacgugagacccgccagcaccagauuccugccccagggcaccagaaucgccgccuacuggagccagcaguacagaugccuguaccccggcaccguggugagaggccugcuggaccuggaggacgacggcgaccugaucaccguggaguucgacgacggcgacaccggcagaaucccccugagccacaucagacugcugccccccgacuacaagauccagugcgccgagcccagccccgcccugcuggugcccagcgccaagagaagaagcagaaagaccagcaaggacaccggcgagggcaaggacggcggcaccgccggcagcgaggagcccggcgccaaggccagaggcagaggcagaaagcccagcgccaaggccaagggcgacagagccgccacccuggaggagggcaaccccaccgacgaggugcccagcaccccccuggcccuggagcccagcagcacccccggcagcaagaagagcccccccgagcccguggacaagagagccaaggcccccaaggccagacccgcccccccccagcccagccccgccccccccgccuucaccagcugccccgcccccgagcccuucgccgagcugcccgcccccgccaccagccuggcccccgccccccugaucaccaugcccgccaccagacccaagcccaagaaggccagagccgccgaggagagcggcgccaagggccccagaagacccggcgaggaggccgagcugcuggugaagcuggaccacgagggcgugaccagccccaagagcaagaaggccaaggaggcccugcugcugagagaggaccccggcgccggcggcuggcaggagcccaagagccugcugagccugggcagcuacccccccgccgccggcagcagcgagcccaaggcccccuggcccaaggccaccgacggcgaccuggcccaggagcccggccccggccugaccuucgaggacagcggcaaccccaagagccccgacaaggcccaggccgagcaggacggcgccgaggagagcgagagcagcagcagcagcagcagcggcagcagcagcagcagcagcagcagcagcagcagcggcagcgagaccgagggcgaggaggagggcgacaagaacggcgacggcggcugcggcaccggcggcagaaacugcagcgccgccagcagcagagccgccagccccgccagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcaccaccgacgaggacagcagcugcagcagcgacgacgaggccgcccccgcccccaccgccggccccagcgcccaggccgcccugcccaccaaggccaccaagcaggccggcaaggccagacccagcgcccacagccccggcaagaagacccccgccccccagccccaggccccccccccccagcccacccagccccugcagcccaaggcccaggccggcgccaagagcagacccaagaagagagagggcgugcaccugcccaccaccaaggagcuggccaagagacagagacugcccagcguggagaacagacccaagaucgccgccuuccugcccgccagacagcuguggaagugguucggcaagcccacccagagaagaggcaugaagggcaaggccagaaagcuguucuacaaggccaucgugagaggcaaggagaugaucagaaucggcgacugcgccguguuccugagcgccggcagacccaaccugcccuacaucggcagaauccagagcaugugggagagcuggggcaacaacaugguggugagagugaagugguucuaccaccccgaggagaccagccccggcaagcaguuccaccagggccagcacugggaccagaagagcagcagaagccugcccgccgcccugagagugagcagccagagaaaggacuucauggagagagcccuguaccagagcagccacguggacgagaacgacgugcagaccgugagccacaagugccugguggugggccuggagcaguacgagcagaugcugaagaccaagaaguaccaggacagcgagggccuguacuaccuggccggcaccuacgagcccaccaccggcaugaucuucagcaccgacggcgugcccgugcugugcuaa

SEQ ID NO: 24897 - RNA, 5889 nt, Artificial Sequence
  TNRC6A__Homo_sapiens__NP_055309
augagagagcuggaggccaaggccaccaaggacguggagagaaaccugagcagagaccuggugcaggaggaggagcagcugauggaggagaagaagaagaagaaggacgacaagaagaagaaggaggccgcccagaagaaggccaccgagcagaagaucaaggugcccgagcagaucaagcccagcgugagccagccccagcccgccaacagcaacaacggcaccagcaccgccaccagcaccaacaacaacgccaagagagccaccgccaacaaccagcagccccagcagcagcagcagcagcagcagccccagcagcagcagccccagcagcagccccagccccagccccagcagcagcagccccagcagcagccccaggcccugcccagauaccccagagaggugccccccagauucagacaccaggagcacaagcagcugcugaagagaggccagcacuuccccgugaucgccgccaaccugggcagcgccgugaaggugcugaacagccagagcgagagcagcgcccugaccaaccagcagccccagaacaacggcgaggugcagaacagcaagaaccagagcgacaucaaccacagcaccagcggcagccacuacgagaacagccagagaggccccgugagcagcaccagcgacagcagcaccaacugcaagaacgccguggugagcgaccugagcgagaaggaggccuggcccagcgcccccggcagcgaccccgagcuggccagcgagugcauggacgccgacagcgccagcagcagcgagagcgagagaaacaucaccaucauggccagcggcaacaccggcggcgagaaggacggccugagaaacagcaccggccugggcagccagaacaaguucguggugggcagcagcagcaacaacgugggccacggcagcagcaccggccccuggggcuucagccacggcgccaucaucagcaccugccaggugagcguggacgcccccgagagcaagagcgagagcagcaacaacagaaugaacgccuggggcaccgugagcagcagcagcaacggcggccugaaccccagcacccugaacagcgccagcaaccacggcgccuggcccgugcuggagaacaacggccuggcccugaagggccccgugggcagcggcagcagcggcaucaacauccagugcagcaccaucggccagaugcccaacaaccagagcaucaacagcaaggugagcggcggcagcacccacggcaccuggggcagccugcaggagaccugcgagagcgaggugagcggcacccagaaggugagcuucagcggccagccccagaacaucaccaccgagaugaccggccccaacaacaccaccaacuucaugaccagcagccugcccaacagcggcagcgugcagaacaacgagcugcccagcagcaacaccggcgccuggagagugagcaccaugaaccacccccagaugcaggcccccagcggcaugaacggcaccagccugagccaccugagcaacggcgagagcaagagcggcggcagcuacggcaccaccuggggcgccuacggcagcaacuacagcggcgacaagugcagcggccccaacggccaggccaacggcgacaccgugaacgccacccugaugcagcccggcgugaacggccccaugggcaccaacuuccaggugaacaccaacaagggcggcggcgugugggagagcggcgccgccaacagccagagcaccagcuggggcagcggcaacggcgccaacagcggcggcagcagaagaggcuggggcacccccgcccagaacaccggcaccaaccugcccagcguggaguggaacaagcugcccagcaaccagcacagcaacgacagcgccaacggcaacggcaagaccuucaccaacggcuggaagagcaccgaggaggaggaccagggcagcgccaccagccagaccaacgagcagagcagcgugugggccaagaccggcggcaccguggagagcgacggcagcaccgagagcaccggcagacuggaggagaagggcaccggcgagagccagagcagagacagaagaaagaucgaccagcacacccugcugcagagcaucgugaacagaaccgaccuggaccccagagugcugagcaacagcggcuggggccagacccccaucaagcagaacaccgccugggacaccgagaccagccccagaggcgagagaaagaccgacaacggcaccgaggccuggggcagcagcgccacccagaccuucaacagcggcgccugcaucgacaagaccagccccaacggcaacgacaccagcagcgugagcggcuggggcgaccccaagcccgcccugagauggggcgacagcaagggcagcaacugccagggcggcugggaggacgacagcgccgccaccggcauggugaagagcaaccaguggggcaacugcaaggaggagaaggccgccuggaacgacagccagaagaacaagcagggcuggggcgacggccagaagagcagccagggcuggagcgugagcgccagcgacaacuggggcgagaccagcagaaacaaccacuggggcgaggccaacaagaagagcagcagcggcggcagcgacagcgacagaagcgugagcggcuggaacgagcugggcaagaccagcagcuucaccuggggcaacaacaucaaccccaacaacagcagcggcugggacgagagcagcaagcccacccccagccagggcuggggcgacccccccaagagcaaccagagccugggcuggggcgacagcagcaagcccgugagcagccccgacuggaacaagcagcaggacaucgugggcagcuggggcaucccccccgccaccggcaagccccccggcaccggcuggcugggcggccccauccccgcccccgccaaggaggaggagcccaccggcugggaggagcccagccccgagagcaucagaagaaagauggagaucgacgacggcaccagcgccuggggcgaccccagcaaguacaacuacaagaacgugaacauguggaacaagaacgugcccaacggcaacagcagaagcgaccagcaggcccaggugcaccagcugcugacccccgccagcgccaucagcaacaaggaggccagcagcggcagcggcuggggcgagcccuggggcgagcccagcacccccgccaccaccguggacaacggcaccagcgccuggggcaagcccaucgacagcggccccagcuggggcgagcccaucgccgccgccagcagcaccagcaccuggggcagcagcagcgugggcccccaggcccugagcaagagcggccccaagagcaugcaggacggcuggugcggcgacgacaugccccugcccggcaacagacccaccggcugggaggaggaggaggacguggagaucggcauguggaacagcaacagcagccaggagcugaacagcagccugaacuggccccccuacaccaagaagaugagcagcaagggccugagcggcaagaagagaagaagagagagaggcaugaugaagggcggcaacaagcaggaggaggccuggaucaaccccuucgugaagcaguucagcaacaucagcuucagcagagacagccccgaggagaacgugcagagcaacaagauggaccugagcggcggcaugcugcaggacaagagaauggagaucgacaagcacagccugaacaucggcgacuacaacagaaccgugggcaagggccccggcagcagaccccagaucagcaaggagagcagcauggagagaaaccccuacuucgacaaggacggcaucguggccgacgagagccagaacaugcaguucaugagcagccagagcaugaagcugccccccagcaacagcgcccugcccaaccaggcccugggcagcaucgccggccugggcaugcagaaccugaacagcgugagacagaacggcaaccccagcauguucggcgugggcaacaccgccgcccagcccagaggcaugcagcagccccccgcccagccccugagcagcagccagcccaaccugagagcccaggugccccccccccugcugagcccccaggugcccgugagccugcugaaguacgcccccaacaacggcggccugaacccccuguucggcccccagcagguggccaugcugaaccagcugagccagcugaaccagcugagccagaucagccagcugcagagacugcuggcccagcagcagagagcccagagccagagaagcgugcccagcggcaacagaccccagcaggaccagcagggcagaccccugagcgugcagcagcagaugaugcagcagagcagacagcuggaccccaaccugcuggugaagcagcagaccccccccagccagcagcagccccugcaccagcccgccaugaagagcuuccuggacaacgugaugccccacaccacccccgagcugcagaagggccccagccccaucaacgccuucagcaacuuccccaucggccugaacagcaaccugaacgugaacauggacaugaacagcaucaaggagccccagagcagacugagaaaguggaccaccguggacagcaucagcgugaacaccagccuggaccagaacagcagcaagcacggcgccaucagcagcggcuucagacuggaggagagccccuucgugcccuacgacuucaugaacagcagcaccagccccgccagcccccccggcagcaucggcgacggcuggcccagagccaagagccccaacggcagcagcagcgugaacuggccccccgaguucagacccggcgagcccuggaagggcuaccccaacaucgaccccgagaccgaccccuacgugacccccggcagcgugaucaacaaccugagcaucaacaccgugagagagguggaccaccugagagacagaaacagcggcagcagcagcagccugaacaccacccugcccagcaccagcgccuggagcagcaucagagccagcaacuacaacgugccccugagcagcaccgcccagagcaccagcgccagaaacagcgacagcaagcugaccuggagccccggcagcgugaccaacaccagccuggcccacgagcuguggaaggugccccugccccccaagaacaucaccgcccccagcagacccccccccggccugaccggccagaagcccccccugagcaccugggacaacagcccccugagaaucggcggcggcuggggcaacagcgacgccagauacacccccggcagcagcuggggcgagagcagcagcggcagaaucaccaacuggcuggugcugaagaaccugaccccccagaucgacggcagcacccugagaacccugugcaugcagcacggcccccugaucaccuuccaccugaaccugccccacggcaacgcccuggugagauacagcagcaaggaggagguggugaaggcccagaagagccugcacaugugcgugcugggcaacaccaccauccuggccgaguucgccagcgaggaggagaucagcagauucuucgcccagagccagagccugacccccagccccggcuggcagagccugggcagcagccagagcagacugggcagccuggacugcagccacagcuucagcagcagaaccgaccugaaccacuggaacggcgccggccugagcggcaccaacugcggcgaccugcacggcaccagccuguggggcaccccccacuacagcaccagccuguggggcccccccagcagcagcgaccccagaggcaucagcagccccagccccaucaacgccuuccugagcguggaccaccugggcggcggcggcgagagcauguaa

SEQ ID NO: 24898 - RNA, 3090 nt, Artificial Sequence
  TNRC6B__Homo_sapiens__NP_001020014
augcagaccaacgagggcgaggugagcgaggagagcagcagcaagguggagcaggaggacuucgugauggagggccacggcaagacccccccccccggcgaggagagcaagcaggagaaggagcaggagagagaggagcagcugauggaggacaagaagagaaagaaggaggacaagaagaagaaggaggccacccagaaggugaccgagcagaagaccaaggugcccgaggugaccaagcccagccugagccagcccaccgccgccagccccaucggcagcagccccagcccccccgugaacggcggcaacaacgccaagagaguggccgugcccaacggccagccccccagcgccgccagauacaugcccagagaggugccccccagauucagaugccagcaggaccacaaggugcugcugaagagaggccagccccccccccccagcugcaugcugcugggcggcggcgccggccccccccccugcaccgcccccggcgccaaccccaacaacgcccaggugaccggcgcccugcugcagagcgagagcggcaccgcccccguguggagcaagagcaccccccccgcccccgacaacggcaccagcgccuggggcgagcccaacgagagcagccccggcuggggcgagauggacgacaccggcgccagcaccaccggcuggggcaacacccccgccaacgcccccaacgccaugaagcccaacagcaagagcaugcaggacggcuggggcgagagcgacggccccgugaccggcgccagacaccccagcugggaggaggaggaggacggcggcguguggaacaccaccggcagccagggcagcgccagcagccacaacagcgccagcuggggccagggcggcaagaagcagaugaagugcagccugaagggcggcaacaacgacagcuggaugaacccccuggccaagcaguucagcaacaugggccugcugagccagaccgaggacaaccccagcagcaagauggaccugagcgugggcagccugagcgacaagaaguucgacguggacaagagagccaugaaccugggcgacuucaacgacaucaugagaaaggacagaagcggcuucagaccccccaacagcaaggacaugggcaccaccgacagcggccccuacuucgagaagggcggcagccacggccuguucggcaacagcaccgcccagagcagaggccugcacacccccgugcagccccugaacagcagccccagccugagagcccaggugcccccccaguucaucagcccccaggugagcgccagcaugcugaagcaguuccccaacagcggccugagccccggccuguucaacgugggcccccagcugagcccccagcagaucgccaugcugagccagcugccccagaucccccaguuccagcuggccugccagcugcugcugcagcagcagcagcagcagcagcugcugcagaaccagagaaagaucagccaggccgugagacagcagcaggagcagcagcuggccagaauggugagcgcccugcagcagcagcagcagcagcagcagagacagcccggcaugaagcacagccccagccaccccgugggccccaagccccaccuggacaacauggugcccaacgcccugaacgugggccugcccgaccugcagaccaagggccccauccccggcuacggcagcggcuucagcagcggcggcauggacuacggcauggugggcggcaaggaggccggcaccgagagcagauucaagcaguggaccagcaugauggagggccugcccagcguggccacccaggaggccaacaugcacaagaacggcgccaucguggcccccggcaagaccagaggcggcagccccuacaaccaguucgacaucauccccggcgacacccugggcggccacaccggccccgccggcgacagcuggcugcccgccaagagcccccccaccaacaagaucggcagcaagagcagcaacgccagcuggccccccgaguuccagcccggcgugcccuggaagggcauccagaacaucgaccccgagagcgaccccuacgugacccccggcagcgugcugggcggcaccgccaccagccccaucguggacaccgaccaccagcugcugagagacaacaccaccggcagcaacagcagccugaacaccagccugcccagccccggcgccuggcccuacagcgccagcgacaacagcuucaccaacgugcacagcaccagcgccaaguuccccgacuacaagagcaccuggagccccgaccccaucggccacaaccccacccaccugagcaacaagauguggaagaaccacaucagcagcagaaacaccaccccccugcccagacccccccccggccugaccaaccccaagcccagcagccccuggagcagcaccgcccccagaagcgugagaggcuggggcacccaggacagcagacuggccagcgccagcaccuggagcgacggcggcagcgugagacccagcuacuggcuggugcugcacaaccugaccccccagaucgacggcagcacccugagaaccaucugcaugcagcacggcccccugcugaccuuccaccugaaccugacccagggcaccgcccugaucagauacagcaccaagcaggaggccgccaaggcccagaccgcccugcacaugugcgugcugggcaacaccaccauccuggccgaguucgccaccgacgacgaggugagcagauuccuggcccaggcccagccccccacccccgccgccacccccagcgcccccgccgccggcuggcagagccuggagaccggccagaaccagagcgaccccgugggccccgcccugaaccuguucggcggcagcaccggccugggccaguggagcagcagcgccggcggcagcagcggcgccgaccuggccggcgccagccuguggggcccccccaacuacagcagcagccuguggggcgugcccaccguggaggacccccacagaaugggcagccccgccccccugcugcccggcgaccugcugggcggcggcagcgacagcaucuaa

SEQ ID NO: 24899 - RNA, 4077 nt, Artificial Sequence
  TNR__Homo_sapiens__XP_011508249
augggcgccgacggcgagaccguggugcugaagaacaugcugaucggcaucaaccugauccugcugggcagcaugaucaagcccagcgagugccagcuggaggugaccaccgagagagugcagagacagagcguggaggaggagggcggcaucgccaacuacaacaccagcagcaaggagcagcccgugguguucaaccacguguacaacaucaacgugccccuggacaaccugugcagcagcggccuggaggccagcgccgagcaggaggugagcgccgaggacgagacccuggccgaguacaugggccagaccagcgaccacgagagccaggugaccuucacccacagaaucaacuuccccaagaaggccugccccugcgccagcagcgcccaggugcugcaggagcugcugagcagaaucgagaugcuggagagagaggugagcgugcugagagaccagugcaacgccaacugcugccaggagagcgccgccaccggccagcuggacuacaucccccacugcagcggccacggcaacuucagcuucgagagcugcggcugcaucugcaacgagggcugguucggcaagaacugcagcgagcccuacugcccccugggcugcagcagcagaggcgugugcguggacggccagugcaucugcgacagcgaguacagcggcgacgacugcagcgagcugagaugccccaccgacugcagcagcagaggccugugcguggacggcgagugcgugugcgaggagcccuacaccggcgaggacugcagagagcugagaugccccggcgacugcagcggcaagggcagaugcgccaacggcaccugccugugcgaggagggcuacgugggcgaggacugcggccagagacagugccugaacgccugcagcggcagaggccagugcgaggagggccugugcgugugcgaggagggcuaccagggccccgacugcagcgccguggccccccccgaggaccugagaguggccggcaucagcgacagaagcaucgagcuggagugggacggccccauggccgugaccgaguacgugaucagcuaccagcccaccgcccugggcggccugcagcugcagcagagagugcccggcgacuggagcggcgugaccaucaccgagcuggagcccggccugaccuacaacaucagcguguacgccgugaucagcaacauccugagccugcccaucaccgccaagguggccacccaccugagcaccccccagggccugcaguucaagaccaucaccgagaccaccguggaggugcagugggagcccuucagcuucagcuucgacggcugggagaucagcuucauccccaagaacaacgagggcggcgugaucgcccaggugcccagcgacgugaccagcuucaaccagaccggccugaagcccggcgaggaguacaucgugaacgugguggcccugaaggagcaggccagaagcccccccaccagcgccagcgugagcaccgugaucgacggccccacccagauccuggugagagacgugagcgacaccguggccuucguggaguggaucccccccagagccaagguggacuucauccugcugaaguacggccuggugggcggcgagggcggcagaaccaccuucagacugcagcccccccugagccaguacagcgugcaggcccugagacccggcagcagauacgaggugagcgugagcgccgugagaggcaccaacgagagcgacagcgccaccacccaguucaccaccgagaucgacgcccccaagaaccugagagugggcagcagaaccgccaccagccuggaccuggagugggacaacagcgaggccgaggugcaggaguacaaggugguguacagcacccuggccggcgagcaguaccacgaggugcuggugcccagaggcaucggccccaccaccagagccacccugaccgaccuggugcccggcaccgaguacggcgugggcaucagcgccgugaugaacagccagcagagcgugcccgccaccaugaacgccagaaccgagcuggacagccccagagaccugauggugaccgccagcagcgagaccagcaucagccugaucuggaccaaggccagcggccccaucgaccacuacagaaucaccuucacccccagcagcggcaucgccagcgaggugaccgugcccaaggacagaaccagcuacacccugaccgaccuggagcccggcgccgaguacaucaucagcgugaccgccgagagaggcagacagcagagccuggagagcaccguggacgccuucaccggcuucagacccaucagccaccugcacuucagccacgugaccagcagcagcgugaacaucaccuggagcgaccccagcccccccgccgacagacugauccugaacuacagccccagagacgaggaggaggagaugauggaggugagccuggacgccaccaagagacacgccgugcugaugggccugcagcccgccaccgaguacaucgugaaccugguggccgugcacggcaccgugaccagcgagcccaucgugggcagcaucaccaccggcaucgacccccccaaggacaucaccaucagcaacgugaccaaggacagcgugauggugagcuggagcccccccguggccagcuucgacuacuacagagugagcuacagacccacccaggugggcagacuggacagcagcguggugcccaacaccgugaccgaguucaccaucaccagacugaaccccgccaccgaguacgagaucagccugaacagcgugagaggcagagaggagagcgagagaaucugcacccuggugcacaccgccauggacaaccccguggaccugaucgccaccaacaucacccccaccgaggcccugcugcaguggaaggcccccgugggcgagguggagaacuacgugaucgugcugacccacuucgccguggccggcgagaccauccugguggacggcgugagcgaggaguucagacugguggaccugcugcccagcacccacuacaccgccaccauguacgccaccaacggcccccugaccagcggcaccaucagcaccaacuucagcacccugcuggacccccccgccaaccugaccgccagcgaggugaccagacagagcgcccugaucagcuggcagccccccagagccgagaucgagaacuacgugcugaccuacaagagcaccgacggcagcagaaaggagcugaucguggacgccgaggacaccuggaucagacuggagggccugcuggagaacaccgacuacaccgugcugcugcaggccgcccaggacaccaccuggagcagcaucaccagcaccgccuucaccaccggcggcagaguguucccccacccccaggacugcgcccagcaccugaugaacggcgacacccugagcggcguguaccccaucuuccugaacggcgagcugagccagaagcugcagguguacugcgacaugaccaccgacggcggcggcuggaucguguuccagagaagacagaacggccagaccgacuucuucagaaagugggccgacuacagagugggcuucggcaacguggaggacgaguucuggcugggccuggacaacauccacagaaucaccagccagggcagauacgagcugagaguggacaugagagacggccaggaggccgccuucgccagcuacgacagauucagcguggaggacagcagaaaccuguacaagcugagaaucggcagcuacaacggcaccgccggcgacagccugagcuaccaccagggcagacccuucagcaccgaggacagagacaacgacguggccgugaccaacugcgccaugagcuacaagggcgccuggugguacaagaacugccacagaaccaaccugaacggcaaguacggcgagagcagacacagccagggcaucaacugguaccacuggaagggccacgaguucagcauccccuucguggagaugaagaugagacccuacaaccacagacugauggccggcagaaagagacagagccugcaguucuaa

SEQ ID NO: 24900 - RNA, 5208 nt, Artificial Sequence
  TNS1__Homo_sapiens__NP_072174
augagcgugagcagaaccauggaggacagcugcgagcuggaccugguguacgugaccgagagaaucaucgccgugagcuuccccagcaccgccaacgaggagaacuucagaagcaaccugagagagguggcccagaugcugaagagcaagcacggcggcaacuaccugcuguucaaccugagcgagagaagacccgacaucaccaagcugcacgccaaggugcuggaguucggcuggcccgaccugcacacccccgcccuggagaagaucugcagcaucugcaaggccauggacaccuggcugaacgccgacccccacaacgugguggugcugcacaacaagggcaacagaggcagaaucggcguggugaucgccgccuacaugcacuacagcaacaucagcgccagcgccgaccaggcccuggacagauucgccaugaagagauucuacgaggacaagaucgugcccaucggccagcccagccagagaagauacgugcacuacuucagcggccugcugagcggcagcaucaagaugaacaacaagccccuguuccugcaccacgugaucaugcacggcauccccaacuucgagagcaagggcggcugcagacccuuccugagaaucuaccaggccaugcagcccguguacaccagcggcaucuacaacauccccggcgacagccagaccagcgugugcaucaccaucgagcccggccugcugcugaagggcgacauccugcugaagugcuaccacaagaaguucagaagccccgccagagacgugaucuucagagugcaguuccacaccugcgccauccacgaccugggcgugguguucggcaaggaggaccuggacgacgccuucaaggacgacagauuccccgaguacggcaagguggaguucguguucagcuacggccccgagaagauccagggcauggagcaccuggagaacggccccagcgugagcguggacuacaacaccagcgacccccugaucagaugggacagcuacgacaacuucagcggccacagagacgacggcauggaggagguggugggccacacccagggcccccuggacggcagccuguacgccaaggugaagaagaaggacagccugcacggcagcaccggcgccgugaacgccaccagacccacccugagcgccacccccaaccacguggagcacacccugagcgugagcagcgacagcggcaacagcaccgccagcaccaagaccgacaagaccgacgagcccgugcccggcgccagcagcgccaccgccgcccugagcccccaggagaagagagagcuggacagacugcugagcggcuucggccuggagagagagaagcagggcgccauguaccacacccagcaccugagaagcagacccgccggcggcagcgccgugcccagcagcggcagacacguggugcccgcccaggugcacgugaacggcggcgcccuggccagcgagagagagaccgacauccuggacgacgagcugcccaaccaggacggccacagcgccggcagcaugggcacccugagcagccuggacggcgugaccaacaccagcgagggcggcuaccccgaggcccugagcccccugaccaacggccuggacaagagcuaccccauggagcccauggugaacggcggcggcuaccccuacgagagcgccagcagagccggccccgcccacgccggccacaccgcccccaugagacccagcuacagcgcccaggagggccuggccggcuaccagagagagggcccccaccccgccuggccccagcccgugaccaccagccacuacgcccacgaccccagcggcauguucagaagccagagcuucagcgaggccgagccccagcugccccccgcccccgugagaggcggcagcagcagagaggccgugcagagaggccugaacagcuggcagcagcagcagcagcagcagcagcagcccagacccccccccagacagcaggagagagcccaccuggagagccugguggccagcagacccagcccccagccccuggccgagacccccauccccagccugcccgaguuccccagagccgccagccagcaggagaucgagcagagcaucgagacccugaacaugcugaugcuggaccuggagcccgccagcgccgccgccccccugcacaagagccagagcgugcccggcgccuggcccggcgccagcccccugagcagccagccccugagcggcagcagcagacagagccacccccugacccagagcagaagcggcuacauccccagcggccacagccugggcacccccgagcccgcccccagagccagccuggagagcgugccccccggcagaagcuacagccccuacgacuaccagcccugccuggccggccccaaccaggacuuccacagcaagagccccgccagcagcagccugcccgccuuccugcccaccacccacagcccccccggcccccagcagccccccgccagccugcccggccugaccgcccagccccugcugagccccaaggaggccaccagcgaccccagcagaacccccgaggaggagccccugaaccuggagggccugguggcccacagaguggccggcgugcaggccagagagaagcagcccgccgagccccccgccccccugagaagaagagccgccagcgacggccaguacgagaaccagagccccgaggccaccagccccagaagccccggcgugagaagccccgugcagugcgugagccccgagcuggcccugaccaucgcccugaaccccggcggcagacccaaggagccccaccugcacagcuacaaggaggccuucgaggagauggagggcaccagccccagcagccccccccccagcggcgugagaagcccccccggccuggccaagaccccccugagcgcccugggccugaagccccacaaccccgccgacauccugcugcaccccaccggcgugaccagaagaagaauccagcccgaggaggacgagggcaaggugguggugagacugagcgaggagcccagaagcuacguggagagcguggccagaaccgccguggccggccccagagcccaggacagcgagcccaagagcuucagcgcccccgccacccaggccuacggccacgagaucccccugagaaacggcacccugggcggcagcuucgugagccccagcccccugagcaccagcagccccauccugagcgccgacagcaccagcgugggcagcuuccccagcggcgagagcagcgaccagggccccagaacccccacccagccccugcuggagagcggcuucagaagcggcagccugggccagcccagccccagcgcccagagaaacuaccagagcagcagcccccugcccaccgugggcagcagcuacagcagccccgacuacagccugcagcacuucagcagcagccccgagagccaggccagagcccaguucagcguggccggcgugcacaccgugcccggcagcccccaggccagacacagaaccgugggcaccaacaccccccccagccccggcuucggcuggagagccaucaaccccagcauggccgcccccagcagccccagccugagccaccaccagaugaugggcccccccggcaccggcuuccacggcagcaccgugagcagcccccagagcagcgccgccaccacccccggcagccccagccugugcagacaccccgccggcguguaccaggugagcggccugcacaacaagguggccaccacccccggcagccccagccugggcagacaccccggcgcccaccagggcaaccuggccagcggccugcacagcaacgccaucgccagccccggcagccccagccugggcagacaccugggcggcagcggcagcguggugcccggcagccccugccuggacagacacguggccuacggcggcuacagcacccccgaggacagaagacccacccugagcagacagagcagcgccagcggcuaccaggcccccagcacccccagcuuccccgugagccccgccuacuaccccggccugagcagccccgccaccagccccagccccgacagcgccgccuucagacagggcagccccacccccgcccugcccgagaagagaagaaugagcgugggcgacagagccggcagccugcccaacuacgccaccaucaacggcaaggugagcagccccguggccagcggcaugagcagccccagcggcggcagcaccgugagcuucagccacacccugcccgacuucagcaaguacagcaugcccgacaacagccccgagaccagagccaaggugaaguucgugcaggacaccagcaaguacugguacaagcccgagaucagcagagagcaggccaucgcccugcugaaggaccaggagcccggcgccuucaucaucagagacagccacagcuucagaggcgccuacggccuggccaugaaggugagcagccccccccccaccaucaugcagcagaacaagaagggcgacaugacccacgagcuggugagacacuuccugaucgagaccggccccagaggcgugaagcugaagggcugccccaacgagcccaacuucggcagccugagcgcccugguguaccagcacagcaucaucccccuggcccugcccugcaagcuggugauccccaacagagaccccaccgacgagagcaaggacagcagcggccccgccaacagcaccgccgaccugcugaagcagggcgccgccugcaacgugcuguucgugaacagcguggacauggagagccugaccggcccccaggccaucagcaaggccaccagcgagacccuggccgccgaccccacccccgccgccaccaucgugcacuucaaggugagcgcccagggcaucacccugaccgacaaccagagaaagcuguucuucagaagacacuacccccugaacaccgugaccuucugcgaccuggacccccaggagagaaaguggaugaagaccgagggcggcgcccccgccaagcuguucggcuucguggccagaaagcagggcagcaccaccgacaacgccugccaccuguucgccgagcuggaccccaaccagcccgccagcgccaucgugaacuucgugagcaaggugaugcugaacgccggccagaagagauaa

SEQ ID NO: 24901 - RNA, 4260 nt, Artificial Sequence
  TNS2__Homo_sapiens__NP_056134
auggacggcggcggcgugugcgugggcagaggcgaccugcugagcagcccccaggcccugggccagcugcugagaaaggagagcagacccagaagagccaugaagcccagaaaggccgagccccacagcuucagagagaagguguucagaaagaagccccccgugugcgccgugugcaaggugaccaucgacggcaccggcgugagcugcagagugugcaagguggccacccacagaaagugcgaggccaaggugaccagcgccugccaggcccugccccccguggagcugagaagaaacaccgcccccgugagaagaaucgagcaccugggcagcaccaagagccugaaccacagcaagcagagaagcacccugcccagaagcuucagccuggacccccugauggagagaagaugggaccuggaccugaccuacgugaccgagagaauccuggccgccgccuuccccgccagacccgacgagcagagacacagaggccaccugagagagcuggcccacgugcugcagagcaagcacagagacaaguaccugcuguucaaccugagcgagaagagacacgaccugaccagacugaaccccaaggugcaggacuucggcuggcccgagcugcacgcccccccccuggacaagcugugcagcaucugcaaggccauggagaccuggcugagcgccgacccccagcacgugguggugcuguacugcaagggcaacaagggcaagcugggcgugaucgugagcgccuacaugcacuacagcaagaucagcgccggcgccgaccaggcccuggccacccugaccaugagaaaguucugcgaggacaagguggccaccgagcugcagcccagccagagaagauacaucagcuacuucagcggccugcugagcggcagcaucagaaugaacagcagcccccuguuccugcacuacgugcugauccccaugcugcccgccuucgagcccggcaccggcuuccagcccuuccugaagaucuaccagagcaugcagcugguguacaccagcggcguguaccacaucgccggccccggcccccagcagcugugcaucagccuggagcccgcccugcugcugaagggcgacgugauggugaccugcuaccacaagggcggcagaggcaccgacagaacccugguguucagagugcaguuccacaccugcaccauccacggcccccagcugaccuuccccaaggaccagcuggacgaggccuggaccgacgagagauuccccuuccaggccagcguggaguucguguucagcagcagccccgagaagaucaagggcagcacccccagaaacgaccccagcgugagcguggacuacaacaccaccgagcccgccgugagaugggacagcuacgagaacuucaaccagcaccacgaggacagcguggacggcagccugacccacaccagaggcccccuggacggcagccccuacgcccaggugcagagaccccccagacagaccccccccgcccccagccccgagcccccccccccccccaugcugagcgugagcagcgacagcggccacagcagcacccugaccaccgagcccgccgccgagagccccggcagacccccccccaccgccgccgagagacaggagcuggacagacugcugggcggcugcggcguggccagcggcggcagaggcgccggcagagagaccgccauccuggacgacgaggagcagcccaccgugggcggcggcccccaccugggcguguaccccggccacagacccggccugagcagacacugcagcugcagacagggcuacagagagcccugcggcgugcccaacggcggcuacuacagacccgagggcacccuggagagaagaagacuggccuacggcggcuacgagggcagcccccagggcuacgccgaggccagcauggagaagagaagacugugcagaagccugagcgagggccuguaccccuacccccccgagaugggcaagcccgccaccggcgacuucggcuacagagcccccggcuacagagagguggugauccuggaggaccccggccugcccgcccuguaccccugccccgccugcgaggagaagcuggcccugcccaccgccgcccuguacggccugagacuggagagagaggccggcgagggcugggccagcgaggccggcaagccccugcugcaccccgugagacccggccacccccugccccugcugcugcccgccugcggccaccaccacgcccccaugcccgacuacagcugccugaagccccccaaggccggcgaggagggccacgagggcugcagcuacaccaugugccccgagggcagauacggccaccccggcuaccccgcccuggugaccuacagcuacggcggcgccgugcccagcuacugccccgccuacggcagagugccccacagcugcggcagccccggcgagggcagaggcuaccccagccccggcgcccacagccccagagccggcagcaucagccccggcagcccccccuacccccagagcagaaagcugagcuacgagauccccaccgaggagggcggcgacagauacccccugcccggccaccuggccagcgccggcccccuggccagcgccgagagccuggagcccgugagcuggagagagggccccagcggccacagcacccugcccagaagccccagagacgcccccugcagcgccagcagcgagcugagcggccccagcaccccccugcacaccagcagccccgugcagggcaaggagagcaccagaagacaggacaccagaagccccaccagcgcccccacccagagacugagccccggcgaggcccugccccccgugagccaggccggcaccggcaaggcccccgagcugcccagcggcagcggccccgagccccuggcccccagccccgugagccccaccuucccccccagcagccccagcgacuggccccaggagagaagccccggcggccacagcgacggcgccagccccagaagccccgugcccaccacccugcccggccugagacacgcccccuggcagggccccagaggcccccccgacagccccgacggcagcccccugacccccgugcccagccagaugcccuggcugguggccagccccgagcccccccagagcagccccacccccgccuucccccuggccgccagcuacgacaccaacggccugagccagcccccccugcccgagaagagacaccugcccggccccggccagcagcccggccccuggggccccgagcaggccagcagccccgccagaggcaucagccaccacgugaccuucgccccccugcugagcgacaacgugccccagacccccgagccccccacccaggagagccagagcaacgugaaguucgugcaggacaccagcaaguucugguacaagccccaccugagcagagaccaggccaucgcccugcugaaggacaaggaccccggcgccuuccugaucagagacagccacagcuuccagggcgccuacggccuggcccugaagguggccacccccccccccagcgcccagcccuggaagggcgaccccguggagcagcuggugagacacuuccugaucgagaccggccccaagggcgugaagaucaagggcugccccagcgagcccuacuucggcagccugagcgcccuggugagccagcacagcaucagccccaucagccugcccugcugccugagaauccccagcaaggacccccuggaggagacccccgaggcccccgugcccaccaacaugagcaccgccgccgaccugcugagacagggcgccgccugcagcgugcuguaccugaccagcguggagaccgagagccugaccggcccccaggccguggccagagccagcagcgccgcccugagcugcagccccagacccacccccgccguggugcacuucaaggugagcgcccagggcaucacccugaccgacaaccagagaaagcuguucuucagaagacacuaccccgugaacagcaucaccuucagcagcaccgacccccaggacagaagauggaccaaccccgacggcaccaccagcaagaucuucggcuucguggccaagaagcccggcagccccugggagaacgugugccaccuguucgccgagcuggaccccgaccagcccgccggcgccaucgugaccuucaucaccaaggugcugcugggccagagaaaguaa

SEQ ID NO: 24902 - RNA, 4686 nt, Artificial Sequence
  TNS3__Homo_sapiens__XP_011513778
augugcagcagacagagaagcggcuucggcugcaucaccaacugguggaagaugggcaccagacaccccgcccaccccgcccagcccgaggagcugaccagcagccugcacgccuucaagaacaaggccuucaagaagagcaaggugugcggcgugugcaagcagaucaucgacggccagggcaucagcugcagagccugcaaguacagcugccacaagaagugcgaggccaagguggugauccccugcggcgugcaggugagacuggagcaggcccccggcagcagcacccugagcagcagccugugcagagacaagccccugagacccgugauccugagccccaccauggaggagggccacggccuggaccugaccuacaucaccgagagaaucaucgccgugagcuuccccgccggcugcagcgaggagagcuaccugcacaaccugcaggaggugaccagaaugcugaagagcaagcacggcgacaacuaccuggugcugaaccugagcgagaagagauacgaccugaccaagcugaaccccaagaucauggacgugggcuggcccgagcugcacgcccccccccuggacaagaugugcaccaucugcaaggcccaggagagcuggcugaacagcaaccugcagcacgugguggugauccacugcagaggcggcaagggcagaaucggcguggugaucagcagcuacaugcacuucaccaacgugagcgccagcgccgaccaggcccuggacagauucgccaugaagaaguucuacgacgacaaggugagcgcccugaugcagcccagccagaagagauacgugcaguuccugagcggccugcugagcggcagcgugaagaugaacgccagcccccuguuccugcacuucgugauccugcacggcacccccaacuucgacaccggcggcgugugcagacccuuccugaagcuguaccaggccaugcagcccguguacaccagcggcaucuacaacgugggccccgagaaccccagcagaaucugcaucgugaucgagcccgcccagcugcugaagggcgacgugauggugaagugcuaccacaagaaguacagaagcgccaccagagacgugaucuucagacugcaguuccacaccggcgccgugcagggcuacggccugguguucggcaaggaggaccuggacaacgccagcaaggacgacagauuccccgacuacggcaagguggagcugguguucagcgccacccccgagaagauccagggcagcgagcaccuguacaacgaccacggcgugaucguggacuacaacaccaccgacccccugaucagaugggacagcuacgagaaccugagcgccgacggcgaggugcugcacacccagggccccguggacggcagccuguacgccaaggugagaaagaagagcagcagcgaccccggcauccccggcggcccccaggccauccccgccaccaacagccccgaccacagcgaccacacccugagcgugagcagcgacagcggccacagcaccgccagcgccagaaccgacaagaccgaggagagacuggcccccggcaccagaagaggccugagcgcccaggagaaggccgagcuggaccagcugcugagcggcuucggccuggaggaccccggcagcagccugaaggagaugaccgacgccagaagcaaguacagcggcaccagacacguggugcccgcccaggugcacgugaacggcgacgccgcccugaaggacagagagaccgacauccuggacgacgagaugccccaccacgaccugcacagcguggacagccugggcacccugagcagcagcgagggcccccagagcgcccaccugggccccuucaccugccacaagagcagccagaacagccugcugagcgacggcuucggcagcaacgugggcgaggacccccagggcacccuggugcccgaccugggccugggcauggacggccccuacgagagagagagaaccuucggcagcagagagcccaagcagccccagccccugcugagaaagcccagcgugagcgcccagaugcaggccuacggccagagcagcuacagcacccagaccugggugagacagcagcagauggugguggcccaccaguacagcuucgcccccgacggcgaggccagacuggugagcagaugccccgccgacaaccccggccuggugcaggcccagcccagagugccccugacccccaccagaggcaccagcagcagaguggccgugcagagaggcgugggcagcggcccccacccccccgacacccagcagcccagccccagcaaggccuucaagcccagauuccccggcgaccagguggugaacggcgccggccccgagcugagcaccggccccagccccggcagccccacccuggacaucgaccagagcaucgagcagcugaacagacugauccuggagcuggaccccaccuucgagcccauccccacccacaugaacgcccugggcagccaggccaacggcagcgugagccccgacagcgugggcggcggccugagagccagcagcagacugcccgacaccggcgagggccccagcagagccaccggcagacagggcagcagcgccgagcagccccugggcggcagacugagaaagcugagccugggccaguacgacaacgacgccggcggccagcugcccuucagcaagugcgccuggggcaaggccggcguggacuacgcccccaaccugccccccuuccccagccccgccgacgugaaggagaccaugacccccggcuacccccaggaccuggacaucaucgacggcagaauccugagcagcaaggagagcaugugcagcacccccgccuuccccgugagccccgagacccccuacgugaagaccgcccugagacacccccccuucagcccccccgagcccccccugagcagccccgccagccagcacaagggcggcagagagcccagaagcugccccgagacccugacccacgccgugggcaugagcgagagccccaucggccccaagagcaccaugcugagagccgacgccagcagcacccccagcuuccagcaggccuucgccagcagcugcaccaucagcagcaacggccccggccagagaagagagagcagcagcagcgccgagagacaguggguggagagcagccccaagcccauggugagccugcugggcagcggcagacccaccggcagcccccugagcgccgaguucagcggcaccagaaaggacagccccgugcugagcugcuucccccccagcgagcugcaggcccccuuccacagccacgagcugagccuggccgagccccccgacagccuggccccccccagcagccaggccuuccugggcuucggcaccgcccccgugggcagcggccugccccccgaggaggaccugggcgcccugcuggccaacagccacggcgccagccccacccccagcaucccccugaccgccaccggcgccgccgacaacggcuuccugagccacaacuuccugaccguggcccccggccacagcagccaccacagccccggccugcagggccagggcgugacccugcccggccagcccccccugcccgagaagaagagagccagcgagggcgacagaagccugggcagcgugagccccagcagcagcggcuucagcagcccccacagcggcagcaccaucagcauccccuuccccaacgugcugcccgacuucagcaaggccagcgaggccgccagcccccugcccgacagccccggcgacaagcuggugaucgugaaguucgugcaggacaccagcaaguucugguacaaggccgacaucagcagagagcaggccaucgccaugcugaaggacaaggagcccggcagcuucaucgugagagacagccacagcuucagaggcgccuacggccuggccaugaagguggccacccccccccccagcgugcugcagcugaacaagaaggccggcgaccuggccaacgagcuggugagacacuuccugaucgagugcacccccaagggcgugagacugaagggcugcagcaacgagcccuacuucggcagccugaccgcccuggugugccagcacagcaucaccccccuggcccugcccugcaagcugcugauccccgagagagacccccuggaggagaucgccgagagcagcccccagaccgccgccaacagcgccgccgagcugcugaagcagggcgccgccugcaacgugugguaccugaacagcguggagauggagagccugaccggccaccaggccauccagaaggcccugagcaucacccuggugcaggagcccccccccgugagcaccguggugcacuucaaggugagcgcccagggcaucacccugaccgacaaccagagaaagcuguucuucagaagacacuaccccgugaacagcgugaucuucugcgcccuggacccccaggacagaaaguggaucaaggacggccccagcagcaagguguucggcuucguggccagaaagcagggcagcgccaccgacaacgugugccaccuguucgccgagcacgaccccgagcagcccgccagcgccaucgugaacuucgugagcaaggugaugaucggcagccccaagaagguguaa

SEQ ID NO: 24903 - RNA, 2148 nt, Artificial Sequence
  TNS4__Homo_sapiens__NP_116254
augagccaggugaugagcagcccccugcuggccggcggccacgccgugagccuggcccccugcgacgagcccagaagaacccugcaccccgcccccagccccagccugcccccccagugcagcuacuacaccaccgagggcuggggcgcccaggcccugauggcccccgugcccugcaugggcccccccggcagacugcagcaggccccccagguggaggccaaggccaccugcuuccugcccagccccggcgagaaggcccugggcacccccgaggaccuggacagcuacaucgacuucagccuggagagccugaaccagaugauccuggagcuggaccccaccuuccagcugcugccccccggcaccggcggcagccaggccgagcuggcccagagcaccaugagcaugagaaagaaggaggagagcgaggcccuggacaucaaguacaucgaggugaccagcgccagaagcagaugccacgacggcccccagcacugcagcagccccagcgugaccccccccuucggcagccugagaagcggcggccugcugcugagcagagacgugcccagagagaccagaagcagcagcgagagccugaucuucagcggcaaccagggcagaggccaccagagaccccugccccccagcgagggccugagccccagaccccccaacagccccagcaucagcauccccugcaugggcagcaaggccagcagcccccacggccugggcagcccccugguggccagccccagacuggagaagagacugggcggccuggccccccagagaggcagcagaaucagcgugcugagcgccagccccgugagcgacgugagcuacauguucggcagcagccagagccugcugcacagcagcaacagcagccaccagagcagcagcagaagccuggagagccccgccaacagcagcagcagccugcacagccugggcagcgugagccugugcaccagacccagcgacuuccaggcccccagaaaccccacccugaccaugggccagcccagaaccccccacagccccccccuggccaaggagcacgccagcagcugcccccccagcaucaccaacagcaugguggacauccccaucgugcugaucaacggcugccccgagcccggcagcagccccccccagagaacccccggccaccagaacagcgugcagcccggcgccgccagccccagcaaccccugccccgccaccagaagcaacagccagacccugagcgacgcccccuucaccaccugccccgagggccccgccagagacaugcagcccaccaugaaguucgugauggacaccagcaaguacugguucaagcccaacaucaccagagagcaggccaucgagcugcugagaaaggaggagcccggcgccuucgugaucagagacagcagcagcuacagaggcagcuucggccuggcccugaaggugcaggaggugcccgccagcgcccagagcagacccggcgaggacagcaacgaccugaucagacacuuccugaucgagagcagcgccaagggcgugcaccugaagggcgccgacgaggagcccuacuucggcagccugagcgccuucgugugccagcacagcaucauggcccuggcccugcccugcaagcugaccaucccccagagagagcugggcggcgccgacggcgccagcgacagcaccgacagccccgccagcugccagaagaagagcgccggcugccacacccuguaccugagcagcgugagcguggagacccugaccggcgcccuggccgugcagaaggccaucagcaccaccuucgagagagacauccugcccacccccaccguggugcacuucaaggugaccgagcagggcaucacccugaccgacgugcagagaaagguguucuucagaagacacuacccccugaccacccugagauucugcggcauggaccccgagcagagaaaguggcagaaguacugcaagcccagcuggaucuucggcuucguggccaagagccagaccgagccccaggagaacgugugccaccuguucgccgaguacgacauggugcagcccgccagccaggugaucggccuggugaccgcccugcugcaggacgccgagagaauguaa

SEQ ID NO: 24904 - RNA, 12729 nt, Artificial Sequence
  TNXB__Homo_sapiens__NP_061978
augaugcccgcccaguacgcccugaccagcagccuggugcugcuggugcugcugagcaccgccagagccggccccuucagcagcagaagcaacgugacccugcccgcccccagaccccccccccagcccggcggccacaccgugggcgccggcgugggcagccccagcagccagcuguacgagcacaccguggagggcggcgagaagcaggugguguucacccacagaaucaaccugccccccagcaccggcugcggcugcccccccggcaccgagccccccgugcuggccagcgaggugcaggcccugagagugagacuggagauccuggaggagcuggugaagggccugaaggagcagugcaccggcggcugcugccccgccagcgcccaggccggcaccggccagaccgacgugagaacccugugcagccugcacggcguguucgaccugagcagaugcaccugcagcugcgagcccggcuggggcggccccaccugcagcgaccccaccgacgccgagaucccccccagcagcccccccagcgccagcggcagcugccccgacgacugcaacgaccagggcagaugcgugagaggcagaugcgugugcuuccccggcuacaccggccccagcugcggcuggcccagcugccccggcgacugccagggcagaggcagaugcgugcagggcgugugcgugugcagagccggcuucagcggccccgacugcagccagagaagcugccccagaggcugcagccagagaggcagaugcgagggcggcagaugcgugugcgaccccggcuacaccggcgacgacugcggcaugagaagcugccccagaggcugcagccagagaggcagaugcgagaacggcagaugcgugugcaaccccggcuacaccggcgaggacugcggcgugagaagcugccccagaggcugcagccagagaggcagaugcaaggacggcagaugcgugugcgaccccggcuacaccggcgaggacugcggcaccagaagcugccccugggacugcggcgagggcggcagaugcguggacggcagaugcgugugcuggcccggcuacaccggcgaggacugcagcaccagaaccugccccagagacugcagaggcagaggcagaugcgaggacggcgagugcaucugcgacaccggcuacagcggcgacgacugcggcgugagaagcugccccggcgacugcaaccagagaggcagaugcgaggacggcagaugcgugugcuggcccggcuacaccggcaccgacugcggcagcagagccugccccagagacugcagaggcagaggcagaugcgagaacggcgugugcgugugcaacgccggcuacagcggcgaggacugcggcgugagaagcugccccggcgacugcagaggcagaggcagaugcgagagcggcagaugcaugugcuggcccggcuacaccggcagagacugcggcaccagagccugccccggcgacugcagaggcagaggcagaugcguggacggcagaugcgugugcaaccccggcuucaccggcgaggacugcggcagcagaagaugccccggcgacugcagaggccacggccugugcgaggacggcgugugcgugugcgacgccggcuacagcggcgaggacugcagcaccagaagcugccccggcggcugcagaggcagaggccagugccuggacggcagaugcgugugcgaggacggcuacagcggcgaggacugcggcgugagacagugccccaacgacugcagccagcacggcgugugccaggacggcgugugcaucugcugggagggcuacgugagcgaggacugcagcaucagaaccugccccagcaacugccacggcagaggcagaugcgaggagggcagaugccugugcgaccccggcuacaccggccccaccugcgccaccagaaugugccccgccgacugcagaggcagaggcagaugcgugcagggcgugugccugugccacgugggcuacggcggcgaggacugcggccaggaggagccccccgccagcgccugccccggcggcugcggccccagagagcugugcagagccggccagugcgugugcguggagggcuucagaggccccgacugcgccauccagaccugccccggcgacugcagaggcagaggcgagugccacgacggcagcugcgugugcaaggacggcuacgccggcgaggacugcggcgaggaggugcccaccaucgagggcaugagaaugcaccugcuggaggagaccaccgugagaaccgaguggacccccgcccccggccccguggacgccuacgagauccaguucauccccaccaccgagggcgccagcccccccuucaccgccagagugcccagcagcgccagcgccuacgaccagagaggccuggcccccggccaggaguaccaggugaccgugagagcccugagaggcaccagcuggggccugcccgccagcaagaccaucaccaccaugaucgacggcccccaggaccugagagugguggccgugacccccaccacccuggagcugggcuggcugagaccccaggccgagguggacagauucguggugagcuacgugagcgccggcaaccagagagugagacuggaggugccccccgaggccgacggcacccugcugaccgaccugaugcccggcguggaguacguggugaccgugaccgccgagagaggcagagccgugagcuaccccgccagcgugagagccaacaccggcagcagcccccugggccugcugggcaccaccgacgagcccccccccagcggccccagcaccacccagggcgcccaggccccccugcugcagcagagaccccaggagcugggcgagcugagagugcugggcagagacgagaccggcagacugagagugguguggaccgcccagcccgacaccuucgccuacuuccagcugagaaugagagugcccgagggccccggcgcccacgaggaggugcugcccggcgacgugagacaggcccuggugcccccccccccccccggcacccccuacgagcugagccugcacggcgugccccccggcggcaagcccagcgaccccaucaucuaccagggcaucauggacaaggacgaggagaagcccggcaagagcagcggcccccccagacugggcgagcugaccgugaccgacagaaccagcgacagccugcugcugagauggaccgugcccgagggcgaguucgacagcuucgugauccaguacaaggacagagacggccagccccagguggugcccguggagggcccccagagaagcgccgugaucaccagccuggaccccggcagaaaguacaaguucgugcuguacggcuucgugggcaagaagagacacggcccccugguggccgaggccaagauccugccccagagcgaccccagccccggcacccccccccaccugggcaaccugugggugaccgaccccacccccgacagccugcaccugagcuggaccgugcccgagggccaguucgacaccuucauggugcaguacagagacagagacggcagaccccagguggugcccguggagggccccgagagaagcuucguggugagcagccuggaccccgaccacaaguacagauucacccuguucggcaucgccaacaagaagagauacggcccccugaccgccgacggcaccaccgcccccgagagaaaggaggagccccccagacccgaguuccuggagcagccccugcugggcgagcugaccgugaccggcgugacccccgacagccugagacugagcuggaccguggcccagggccccuucgacagcuucauggugcaguacaaggacgcccagggccagccccaggccgugcccguggccggcgacgagaacgaggugaccgugcccggccuggaccccgacagaaaguacaagaugaaccuguacggccugagaggcagacagagagugggccccgagagcgugguggccaagaccgccccccaggaggacguggacgagacccccagccccaccgagcugggcaccgaggcccccgagagccccgaggagccccugcugggcgagcugaccgugaccggcagcagccccgacagccugagccuguucuggaccgugccccagggcagcuucgacagcuucaccgugcaguacaaggacagagacggcagacccagagccgugagagugggcggcaaggagagcgaggugaccgugggcggccuggagcccggccacaaguacaagaugcaccuguacggccugcacgagggccagagagugggccccgugagcgccgugggcgugaccgccccccagcaggaggagaccccccccgccaccgagagcccccuggagcccagacugggcgagcugaccgugaccgacgugacccccaacagcgugggccugagcuggaccgugcccgagggccaguucgacagcuucaucgugcaguacaaggacaaggacggccagccccagguggugcccguggccgccgaccagagagaggugaccguguacaaccuggagcccgagagaaaguacaagaugaacauguacggccugcacgacggccagagaaugggcccccugagcguggugaucgugaccgccccccugccccccgcccccgccaccgaggccagcaagcccccccuggagcccagacugggcgagcugaccgugaccgacaucacccccgacagcgugggccugagcuggaccgugcccgagggcgaguucgacagcuucguggugcaguacaaggacagagacggccagccccagguggugcccguggccgccgaccagagagaggugaccauccccgaccuggagcccagcagaaaguacaaguuccugcuguucggcauccaggacggcaagagaagaagccccgugagcguggaggccaagaccguggccagaggcgacgccagccccggcgccccccccagacugggcgagcugugggugaccgaccccacccccgacagccugagacugagcuggaccgugcccgagggccaguucgacagcuucguggugcaguucaaggacaaggacggcccccagguggugcccguggagggccacgagagaagcgugaccgugaccccccuggacgccggcagaaaguacagauuccugcuguacggccugcugggcaagaagagacacggcccccugaccgccgacggcaccaccgaggccagaagcgccauggacgacaccggcaccaagagaccccccaagcccagacugggcgaggagcugcaggugaccaccgugacccagaacagcgugggccugagcuggaccgugcccgagggccaguucgacagcuucguggugcaguacaaggacagagacggccagccccagguggugcccguggagggcagccugagagaggugagcgugcccggccuggaccccgcccacagauacaagcugcugcuguacggccugcaccacggcaagagagugggccccaucagcgccguggccaucaccgccggcagagaggagaccgagaccgagaccaccgcccccaccccccccgcccccgagccccaccugggcgagcugaccguggaggaggccaccagccacacccugcaccugagcuggauggugaccgagggcgaguucgacagcuucgagauccaguacaccgacagagacggccagcugcagauggugagaaucggcggcgacagaaacgacaucacccugagcggccuggagagcgaccacagauaccuggugacccuguacggcuucagcgacggcaagcacgugggccccgugcacguggaggcccugaccgugcccgaggaggagaagcccagcgagccccccaccgccacccccgagccccccaucaagcccagacugggcgagcugaccgugaccgacgccacccccgacagccugagccugagcuggaccgugcccgagggccaguucgaccacuuccuggugcaguacagaaacggcgacggccagcccaaggccgugagagugcccggccacgaggagggcgugaccaucagcggccuggagcccgaccacaaguacaagaugaaccuguacggcuuccacggcggccagagaaugggccccgugagcguggugggcgugaccgccgccgaggaggagacccccagccccaccgagcccagcauggaggcccccgagcccgccgaggagccccugcugggcgagcugaccgugaccggcagcagccccgacagccugagccugagcuggaccgugccccagggcagauucgacagcuucaccgugcaguacaaggacagagacggcagaccccagguggugagagugggcggcgaggagagcgaggugaccgugggcggccuggagcccggcagaaaguacaagaugcaccuguacggccugcacgagggcagaagagugggccccgugagcgccgugggcgugaccgcccccgaggaggagagccccgacgccccccuggccaagcugagacugggccagaugaccgugagagacaucaccagcgacagccugagccugagcuggaccgugcccgagggccaguucgaccacuuccuggugcaguucaagaacggcgacggccagcccaaggccgugagagugcccggccacgaggacggcgugaccaucagcggccuggagcccgaccacaaguacaagaugaaccuguacggcuuccacggcggccagagagugggccccgugagcgccgugggccugaccgcccccggcaaggacgaggagauggcccccgccagcaccgagccccccacccccgagccccccaucaagcccagacuggaggagcugaccgugaccgacgccacccccgacagccugagccugagcuggaccgugcccgagggccaguucgaccacuuccuggugcaguacaagaacggcgacggccagcccaaggccaccagagugcccggccacgaggacagagugaccaucagcggccuggagcccgacaacaaguacaagaugaaccuguacggcuuccacggcggccagagagugggccccgugagcgccaucggcgugaccgccgccgaggaggagacccccagccccaccgagcccagcauggaggcccccgagccccccgaggagccccugcugggcgagcugaccgugaccggcagcagccccgacagccugagccugagcuggaccgugccccagggcagauucgacagcuucaccgugcaguacaaggacagagacggcagaccccagguggugagagugggcggcgaggagagcgaggugaccgugggcggccuggagcccggcagaaaguacaagaugcaccuguacggccugcacgagggcagaagagugggccccgugagcaccgugggcgugaccgccccccaggaggacguggacgagacccccagccccaccgagcccggcaccgaggcccccggcccccccgaggagccccugcugggcgagcugaccgugaccggcagcagccccgacagccugagccugagcuggaccgugccccagggcagauucgacagcuucaccgugcaguacaaggacagagacggcagaccccaggccgugagagugggcggccaggagagcaaggugaccgugagaggccuggagcccggcagaaaguacaagaugcaccuguacggccugcacgagggcagaagacugggccccgugagcgccgugggcgugaccgaggacgaggccgagaccacccaggccgugcccaccaugacccccgagccccccaucaagcccagacugggcgagcugaccaugaccgacgccacccccgacagccugagccugagcuggaccgugcccgagggccaguucgaccacuuccuggugcaguacagaaacggcgacggccagcccaaggccgugagagugcccggccacgaggacggcgugaccaucagcggccuggagcccgaccacaaguacaagaugaaccuguacggcuuccacggcggccagagagugggccccaucagcgugaucggcgugaccgccgccgaggaggagacccccagccccaccgagcugagcaccgaggcccccgagccccccgaggagccccugcugggcgagcugaccgugaccggcagcagccccgacagccugagccugagcuggaccaucccccagggccacuucgacagcuucaccgugcaguacaaggacagagacggcagaccccaggugaugagagugagaggcgaggagagcgaggugaccgugggcggccuggagcccggcagaaaguacaagaugcaccuguacggccugcacgagggcagaagagugggccccgugagcaccgugggcgugaccgaggacgaggccgagaccacccaggccgugcccaccaccacccccgagccccccaacaagcccagacugggcgagcugaccgugaccgacgccacccccgacagccugagccugagcuggauggugcccgagggccaguucgaccacuuccuggugcaguacagaaacggcgacggccagcccaagguggugagagugcccggccacgaggacggcgugaccaucagcggccuggagcccgaccacaaguacaagaugaaccuguacggcuuccacggcggccagagagugggccccaucagcgugaucggcgugaccgccgccgaggaggagacccccgcccccaccgagcccagcaccgaggcccccgagccccccgaggagccccugcugggcgagcugaccgugaccggcagcagccccgacagccugagccugagcuggaccaucccccagggcagauucgacagcuucaccgugcaguacaaggacagagacggcagaccccagguggugagagugagaggcgaggagagcgaggugaccgugggcggccuggagcccggcugcaaguacaagaugcaccuguacggccugcacgagggccagagagugggccccgugagcgccgugggcgugaccgcccccaaggacgaggccgagaccacccaggccgugcccaccaugacccccgagccccccaucaagcccagacugggcgagcugaccgugaccgacgccacccccgacagccugagccugagcuggauggugcccgagggccaguucgaccacuuccuggugcaguacagaaacggcgacggccagcccaaggccgugagagugcccggccacgaggacggcgugaccaucagcggccuggagcccgaccacaaguacaagaugaaccuguacggcuuccacggcggccagagagugggccccgugagcgccaucggcgugaccgaggaggagacccccagccccaccgagcccagcaccgaggcccccgaggcccccgaggagccccugcugggcgagcugaccgugaccggcagcagccccgacagccugagccugagcuggaccgugccccagggcagauucgacagcuucaccgugcaguacaaggacagagacggccagccccagguggugagagugagaggcgaggagagcgaggugaccgugggcggccuggagcccggcagaaaguacaagaugcaccuguacggccugcacgagggccagagagugggccccgugagcaccgugggcaucaccgccccccugcccaccccccugcccguggagcccagacugggcgagcuggccguggccgccgugaccagcgacagcgugggccugagcuggaccguggcccagggccccuucgacagcuuccuggugcaguacagagacgcccagggccagccccaggccgugcccgugagcggcgaccugagagccguggccgugagcggccuggaccccgccagaaaguacaaguuccugcuguucggccugcagaacggcaagagacacggccccgugcccguggaggccagaaccgcccccgacaccaagcccagccccagacugggcgagcugaccgugaccgacgccacccccgacagcgugggccugagcuggaccgugcccgagggcgaguucgacagcuucguggugcaguacaaggacaaggacggcagacugcagguggugcccguggccgccaaccagagagaggugaccgugcagggccuggagcccagcagaaaguacagauuccugcuguacggccugagcggcagaaagagacugggccccaucagcgccgacagcaccaccgccccccuggagaaggagcugcccccccaccugggcgagcugaccguggccgaggagaccagcagcagccugagacugagcuggaccguggcccagggccccuucgacagcuucguggugcaguacagagacaccgacggccagcccagagccgugcccguggccgccgaccagagaaccgugaccguggaggaccuggagcccggcaagaaguacaaguuccugcuguacggccugcugggcggcaagagacugggccccgugagcgcccugggcaugaccgcccccgaggaggacacccccgcccccgagcuggcccccgaggcccccgagccccccgaggagcccagacugggcgugcugaccgugaccgacaccacccccgacagcaugagacugagcuggagcguggcccagggccccuucgacagcuucguggugcaguacgaggacaccaacggccagccccaggcccugcugguggacggcgaccagagcaagauccugaucagcggccuggagcccagcacccccuacagauuccugcuguacggccugcacgagggcaagagacugggcccccugagcgccgagggcaccaccggccuggcccccgccggccagaccagcgaggagagcagacccagacugagccagcugagcgugaccgacgugaccaccagcagccugagacugaacugggaggccccccccggcgccuucgacagcuuccugcugagauucggcgugcccagccccagcacccuggagccccaccccagaccccugcugcagagagagcugauggugcccggcaccagacacagcgccgugcugagagaccugagaagcggcacccuguacagccugacccuguacggccugagaggcccccacaaggccgacagcauccagggcaccgccagaacccugagccccgugcuggagagccccagagaccugcaguucagcgagaucagagagaccagcgccaaggugaacuggaugcccccccccagcagagccgacagcuucaaggugagcuaccagcuggccgacggcggcgagccccagagcgugcagguggacggccaggccagaacccagaagcugcagggccugauccccggcgccagauacgaggugaccguggugagcgugagaggcuucgaggagagcgagccccugaccggcuuccugaccaccgugcccgacggccccacccagcugagagcccugaaccugaccgagggcuucgccgugcugcacuggaagcccccccagaaccccguggacaccuacgacgugcaggugaccgcccccggcgcccccccccugcaggccgagacccccggcagcgccguggacuacccccugcacgaccuggugcugcacaccaacuacaccgccaccgugagaggccugagaggccccaaccugaccagccccgccagcaucaccuucaccaccggccuggaggcccccagagaccuggaggccaaggaggugacccccagaaccgcccugcugaccuggaccgagccccccgugagacccgccggcuaccugcugagcuuccacacccccggcggccagaaccaggagauccugcugcccggcggcaucaccagccaccagcugcugggccuguuccccagcaccagcuacaacgccagacugcaggccauguggggccagagccugcugccccccgugagcaccagcuucaccaccggcggccugagaauccccuuccccagagacugcggcgaggagaugcagaacggcgccggcgccagcagaaccagcaccaucuuccugaacggcaacagagagagaccccugaacguguucugcgacauggagaccgacggcggcggcuggcugguguuccagagaagaauggacggccagaccgacuucuggagagacugggaggacuacgcccacggcuucggcaacaucagcggcgaguucuggcugggcaacgaggcccugcacagccugacccaggccggcgacuacagcaugagaguggaccugagagccggcgacgaggccguguucgcccaguacgacagcuuccacguggacagcgccgccgaguacuacagacugcaccuggagggcuaccacggcaccgccggcgacagcaugagcuaccacagcggcagcguguucagcgccagagacagagaccccaacagccugcugaucagcugcgccgugagcuacagaggcgccuggugguacagaaacugccacuacgccaaccugaacggccuguacggcagcaccguggaccaccagggcgugagcugguaccacuggaagggcuucgaguucagcgugcccuucaccgagaugaagcugagacccagaaacuucagaagccccgccggcggcggcuaa

SEQ ID NO: 24905 - RNA, 1038 nt, Artificial Sequence
  TOB1__Homo_sapiens__NP_001230806
augcagcuggagauccagguggcccugaacuucaucaucagcuaccuguacaacaagcugcccagaagaagagugaacaucuucggcgaggagcuggagagacugcugaagaagaaguacgagggccacugguaccccgagaagcccuacaagggcagcggcuucagaugcauccacaucggcgagaagguggaccccgugaucgagcaggccagcaaggagagcggccuggacaucgacgacgugagaggcaaccugccccaggaccugagcguguggaucgaccccuucgaggugagcuaccagaucggcgagaagggccccgugaaggugcuguacguggacgacaacaacgagaacggcugcgagcuggacaaggagaucaagaacagcuucaaccccgaggcccagguguucaugcccaucagcgaccccgccagcagcgugagcagcagccccagcccccccuucggccacagcgccgccgugagccccaccuucaugcccagaagcacccagccccugaccuucaccaccgccaccuucgccgccaccaaguucggcagcaccaagaugaagaacagcggcagaagcaacaagguggccagaaccagccccaucaaccugggccugaacgugaacgaccugcugaagcagaaggccaucagcagcagcaugcacagccuguacggccugggccugggcagccagcagcagccccagcagcagcagcagcccgcccagcccccccccccccccccccccccccagcagcagcagcagcagaagaccagcgcccugagccccaacgccaaggaguucaucuuccccaacaugcagggccagggcagcagcaccaacggcauguuccccggcgacagcccccugaaccugagcccccugcaguacagcaacgccuucgacguguucgccgccuacggcggccugaacgagaagagcuucguggacggccugaacuucagccugaacaacaugcaguacagcaaccagcaguuccagcccgugauggccaacuaa

SEQ ID NO: 24906 - RNA, 1035 nt, Artificial Sequence
  TOB2__Homo_sapiens__NP_057356
augcagcuggagaucaagguggcccugaacuucaucaucagcuaccuguacaacaagcugcccagaagaagagccgaccuguucggcgaggagcuggagagacugcugaagaagaaguacgagggccacugguaccccgagaagccccugaagggcagcggcuucagaugcgugcacaucggcgagaugguggaccccgugguggagcuggccgccaagagaagcggccuggccguggaggacgugagagccaacgugcccgaggagcugagcguguggaucgaccccuucgaggugagcuaccagaucggcgagaagggcgccgugaaggugcuguaccuggacgacagcgagggcugcggcgcccccgagcuggacaaggagaucaagagcagcuucaaccccgacgcccagguguucgugcccaucggcagccaggacagcagccugagcaacagccccagccccagcuucggccagagccccagccccaccuucauccccagaagcgcccagcccaucaccuucaccaccgccagcuucgccgccaccaaguucggcagcaccaagaugaagaagggcggcggcgccgccagcggcggcggcguggccagcagcggcgccggcggccagcagcccccccagcagcccagaauggccagaagccccaccaacagccugcugaagcacaagagccugagccugagcaugcacagccugaacuucaucaccgccaaccccgccccccagagccagcugagccccaacgccaaggaguucguguacaacggcggcggcagccccagccuguucuucgacgccgccgacggccagggcagcggcacccccggccccuucggcggcagcggcgccggcaccugcaacagcagcagcuucgacauggcccagguguucggcggcggcgccaacagccuguuccuggagaagacccccuucguggagggccugagcuacaaccugaacaccaugcaguaccccagccagcaguuccagcccguggugcuggccaacuaa

SEQ ID NO: 24907 - RNA, 825 nt, Artificial Sequence
  TOLLIP__Homo_sapiens__NP_061882
auggccaccaccgugagcacccagagaggccccguguacaucggcgagcugccccaggacuuccugagaaucacccccacccagcagcagagacaggugcagcuggacgcccaggccgcccagcagcugcaguacggcggcgccgugggcaccgugggcagacugaacaucaccguggugcaggccaagcuggccaagaacuacggcaugaccagaauggaccccuacugcagacugagacugggcuacgccguguacgagacccccaccgcccacaacggcgccaagaaccccagauggaacaaggugauccacugcaccgugccccccggcguggacagcuucuaccuggagaucuucgacgagagagccuucagcauggacgacagaaucgccuggacccacaucaccauccccgagagccugagacagggcaagguggaggacaagugguacagccugagcggcagacagggcgacgacaaggagggcaugaucaaccuggugaugagcuacgcccugcugcccgccgccauggugaugcccccccagcccguggugcugaugcccaccguguaccagcagggcgugggcuacgugcccaucaccggcaugcccgccgugugcagccccggcauggugcccguggcccugccccccgccgccgugaacgcccagcccagaugcagcgaggaggaccugaaggccauccaggacauguuccccaacauggaccaggaggugaucagaagcgugcuggaggcccagagaggcaacaaggacgccgccaucaacagccugcugcagaugggcgaggagcccuaa

SEQ ID NO: 24908 - RNA, 1383 nt, Artificial Sequence
  TOM1__Homo_sapiens__NP_001129201
auggagaucugcgacaucaucaacgagaccgaggagggccccaaggacgcccugagagccgugaagaagagaaucgugggcaacaagaacuuccacgaggugaugcuggcccugaccgugcuggagaccugcgugaagaacugcggccacagauuccacgugcugguggccagccaggacuucguggagagcgugcuggugagaaccauccugcccaagaacaacccccccaccaucgugcacgacaaggugcugaaccugauccagagcugggccgacgccuucagaagcagccccgaccugaccggcguggugaccaucuacgaggaccugagaagaaagggccuggaguuccccaugaccgaccuggacaugcugagccccauccacaccccccagagaaccguguucaacagcgagacccagagcggccaggacagcgugggcaccgacagcagccagcaggaggacagcggccagcacgccgccccccugcccgccccccccauccugagcggcgacacccccaucgcccccacccccgagcagaucggcaagcugagaagcgagcuggagauggugagcggcaacgugagagugaugagcgagaugcugaccgagcuggugcccacccaggccgagcccgccgaccuggagcugcugcaggagcugaacagaaccugcagagccaugcagcagagagugcuggagcugaucccccagaucgccaacgagcagcugaccgaggagcugcugaucgugaacgacaaccugaacaacguguuccugagacacgagagauucgagagauucagaaccggccagaccaccaaggcccccagcgaggccgagcccgccgccgaccugaucgacaugggccccgaccccgccgccaccggcaaccugagcagccagcuggccggcaugaaccugggcagcagcagcgugagagccggccugcagagccuggaggccagcggcagacuggaggacgaguucgacauguucgcccugaccagaggcagcagccuggccgaccagagaaaggaggugaaguacgaggccccccaggccaccgacggccuggccggcgcccuggacgccagacagcagagcaccggcgccauccccgugacccaggccugccugauggaggacaucgagcaguggcugagcaccgacgugggcaacgacgccgaggagcccaagggcgugaccagcgagggcaaguucgacaaguuccuggaggagagagccaaggccgccgacagacugcccaaccugagcagccccagcgccgagggcccccccggcccccccagcggccccgcccccagaaagaagacccaggagaaggacgacgacaugcuguucgcccuguaa

SEQ ID NO: 24909 - RNA, 1431 nt, Artificial Sequence
  TOM1L1__Homo_sapiens__NP_005477
auggccuucggcaagagccacagagaccccuacgccaccagcgugggccaccugaucgagaaggccaccuucgccggcgugcagaccgaggacuggggccaguucaugcacaucugcgacaucaucaacaccacccaggacggccccaaggacgccgugaaggcccugaagaagagaaucagcaagaacuacaaccacaaggagauccagcugacccugagccugaucgacaugugcgugcagaacugcggccccagcuuccagagccugaucgugaagaaggaguucgugaaggagaaccuggugaagcugcugaaccccagauacaaccugccccuggacauccagaacagaauccugaacuucaucaagaccuggagccagggcuuccccggcggcguggacgugagcgaggugaaggagguguaccuggaccuggugaagaagggcgugcaguucccccccagcgaggccgaggccgagaccgccagacaggagaccgcccagaucagcagcaacccccccaccagcgugcccaccgcccccgcccugagcagcgugaucgcccccaagaacagcaccgugacccuggugcccgagcagaucggcaagcugcacagcgagcuggacauggugaagaugaacgugagagugaugagcgccauccugauggagaacacccccggcagcgagaaccacgaggacaucgagcugcugcagaagcuguacaagaccggcagagagaugcaggagagaaucauggaccugcugguggugguggagaacgaggacgugaccguggagcugauccaggugaacgaggaccugaacaacgccauccugggcuacgagagauucaccagaaaccagcagagaauccuggagcagaacaagaaccagaaggaggccaccaacaccaccagcgagcccagcgcccccagccaggaccugcuggaccugagccccagccccagaaugcccagagccacccugggcgagcugaacaccaugaacaaccagcugagcggccugaacuucagccugcccagcagcgacgugaccaacaaccugaagcccagccugcacccccagaugaaccugcuggcccuggagaacaccgagaucccccccuucgcccagagaaccagccagaaccugaccagcagccacgccuacgacaacuuccuggagcacagcaacagcguguuccugcagcccgugagccugcagaccaucgccgccgcccccagcaaccagagccugcccccccugcccagcaaccaccccgccaugaccaagagcgaccugcagccccccaacuacuacgaggugauggaguucgacccccuggcccccgccgugaccaccgaggccaucuacgaggagaucgacgcccaccagcacaagggcgcccagaacgacggcgacuaa

SEQ ID NO: 24910 - RNA, 438 nt, Artificial Sequence
  TOMM20__Homo_sapiens__NP_055580
auggugggcagaaacagcgccaucgccgccggcgugugcggcgcccuguucaucggcuacugcaucuacuucgacagaaagagaagaagcgaccccaacuucaagaacagacugagagagagaagaaagaagcagaagcuggccaaggagagagccggccugagcaagcugcccgaccugaaggacgccgaggccgugcagaaguucuuccuggaggagauccagcugggcgaggagcugcuggcccagggcgaguacgagaagggcguggaccaccugaccaacgccaucgccgugugcggccagccccagcagcugcugcaggugcugcagcagacccugcccccccccguguuccagaugcugcugaccaagcugcccaccaucagccagagaaucgugagcgcccagagccuggccgaggacgacguggaguaa

SEQ ID NO: 24911 - RNA, 930 nt, Artificial Sequence
  TOMM34__Homo_sapiens__NP_006800
auggcccccaaguuccccgacagcguggaggagcugagagccgccggcaacgagagcuucagaaacggccaguacgccgaggccagcgcccuguacggcagagcccugagagugcugcaggcccagggcagcagcgaccccgaggaggagagcgugcuguacagcaacagagccgccugccaccugaaggacggcaacugcagagacugcaucaaggacugcaccagcgcccuggcccuggugcccuucagcaucaagccccugcugagaagagccagcgccuacgaggcccuggagaaguaccccauggccuacguggacuacaagaccgugcugcagaucgacgacaacgugaccagcgccguggagggcaucaacagaaugaccagagcccugauggacagccugggccccgaguggagacugaagcugcccagcaucccccuggugcccgugagcgcccagaagagauggaacagccugcccagcgagaaccacaaggagauggccaagagcaagagcaaggagaccaccgccaccaagaacagagugcccagcgccggcgacguggagaaggccagagugcugaaggaggagggcaacgagcuggugaagaagggcaaccacaagaaggccaucgagaaguacagcgagagccugcugugcagcaaccuggagagcgccaccuacagcaacagagcccugugcuaccuggugcugaagcaguacaccgaggccgugaaggacugcaccgaggcccugaagcuggacggcaagaacgugaaggccuucuacagaagagcccaggcccacaaggcccugaaggacuacaagagcagcuucgccgacaucagcaaccugcugcagaucgagcccagaaacggccccgcccagaagcugagacaggaggugaagcagaaccugcacuaa

SEQ ID NO: 24912 - RNA, 1086 nt, Artificial Sequence
  TOMM40__Homo_sapiens__NP_001122389
augggcaacgugcuggccgccagcagcccccccgccggccccccccccccccccgcccccgcccuggugggccugcccccccccccccccagcccccccggcuucacccugcccccccugggcggcagccugggcgccggcaccagcaccagcagaagcagcgagagaacccccggcgccgccaccgccagcgccagcggcgccgccgaggacggcgccugcggcugccugcccaaccccggcaccuucgaggagugccacagaaagugcaaggagcuguuccccauccagauggagggcgugaagcugaccgugaacaagggccugagcaaccacuuccaggugaaccacaccguggcccugagcaccaucggcgagagcaacuaccacuucggcgugaccuacgugggcaccaagcagcugagccccaccgaggccuuccccgugcuggugggcgacauggacaacagcggcagccugaacgcccaggugauccaccagcugggccccggccugagaagcaagauggccauccagacccagcagagcaaguucgugaacuggcagguggacggcgaguacagaggcagcgacuucaccgccgccgugacccugggcaaccccgacgugcuggugggcagcggcauccugguggcccacuaccugcagagcaucacccccugccuggcccugggcggcgagcugguguaccacagaagacccggcgaggagggcaccgugaugagccuggccggcaaguacacccugaacaacuggcuggccaccgugacccugggccaggccggcaugcacgccaccuacuaccacaaggccagcgaccagcugcaggugggcguggaguucgaggccagcaccagaaugcaggacaccagcgugagcuucggcuaccagcuggaccugcccaaggccaaccugcuguucaagggcagcguggacagcaacuggaucgugggcgccacccuggagaagaagcugcccccccugccccugacccuggcccugggcgccuuccugaaccacagaaagaacaaguuccagugcggcuucggccugaccaucggcuaa

SEQ ID NO: 24913 - RNA, 1827 nt, Artificial Sequence
  TOMM70A__Homo_sapiens__NP_055635
auggccgccagcaagcccguggaggccgccgugguggccgccgccgugcccagcagcggcagcggcgugggcggcggcggcaccgccggccccggcaccggcggccugcccagauggcagcuggcccuggccgugggcgccccccugcugcugggcgccggcgccaucuaccuguggagcagacagcagagaagaagagaggccagaggcagaggcgacgccagcggccugaagagaaacagcgagagaaagacccccgagggcagagccagccccgcccccggcagcggccaccccgagggccccggcgcccaccuggacaugaacagccuggacagagcccaggccgccaagaacaagggcaacaaguacuucaaggccggcaaguacgagcaggccauccagugcuacaccgaggccaucagccugugccccaccgagaagaacguggaccugagcaccuucuaccagaacagagccgccgccuucgagcagcugcagaaguggaaggagguggcccaggacugcaccaaggccguggagcugaaccccaaguacgugaaggcccuguucagaagagccaaggcccacgagaagcuggacaacaagaaggagugccuggaggacgugaccgccgugugcauccuggagggcuuccagaaccagcagagcaugcugcuggccgacaaggugcugaagcugcugggcaaggagaaggccaaggagaaguacaagaacagagagccccugaugcccagcccccaguucaucaagagcuacuucagcagcuucaccgacgacaucaucagccagcccaugcugaagggcgagaagagcgacgaggacaaggacaaggagggcgaggcccuggaggugaaggagaacagcggcuaccugaaggccaagcaguacauggaggaggagaacuacgacaagaucaucagcgagugcagcaaggagaucgacgccgagggcaaguacauggccgaggcccugcugcugagagccaccuucuaccugcugaucggcaacgccaacgccgccaagcccgaccuggacaaggugaucagccugaaggaggccaacgugaagcugagagccaacgcccugaucaagagaggcagcauguacaugcagcagcagcagccccugcugagcacccaggacuucaacauggccgccgacaucgacccccagaacgccgacguguaccaccacagaggccagcugaagauccugcuggaccagguggaggaggccguggccgacuucgacgagugcaucagacugagacccgagagcgcccuggcccaggcccagaagugcuucgcccuguacagacaggccuacaccggcaacaacagcagccagauccaggccgccaugaagggcuucgaggaggugaucaagaaguuccccagaugcgccgagggcuacgcccuguacgcccaggcccugaccgaccagcagcaguucggcaaggccgacgagauguacgacaagugcaucgaccuggagcccgacaacgccaccaccuacgugcacaagggccugcugcagcugcaguggaagcaggaccuggacagaggccuggagcugaucagcaaggccaucgagaucgacaacaagugcgacuucgccuacgagaccaugggcaccaucgaggugcagagaggcaacauggagaaggccaucgacauguucaacaaggccaucaaccuggccaagagcgagauggagauggcccaccuguacagccugugcgacgccgcccacgcccagaccgagguggccaagaaguacggccugaagccccccacccuguaa

SEQ ID NO: 24914 - RNA, 4137 nt, Artificial Sequence
  TONSL__Homo_sapiens__NP_038460
augagccuggagagagagcugagacagcugagcaaggccaaggccaaggcccagagagccggccagagaagagaggaggccgcccugugccaccagcugggcgagcugcuggccggccacggcagauacgccgaggcccuggagcagcacuggcaggagcugcagcugagagagagagccgacgacccccugggcugcgccguggcccacagaaagaucggcgagagacuggccgagauggaggacuaccccgccgcccugcagcaccagcaccaguaccuggagcuggcccacagccugagaaaccacaccgagcugcagagagccugggccaccaucggcagaacccaccuggacaucuacgaccacugccagagcagagacgcccugcugcaggcccaggccgccuucgagaagagccuggccaucguggacgaggagcuggagggcacccuggcccagggcgagcugaacgagaugagaaccagacuguaccugaaccugggccugaccuucgagagccugcagcagaccgcccugugcaacgacuacuucagaaagagcaucuuccuggccgagcagaaccaccuguacgaggaccuguucagagccagauacaaccugggcaccauccacuggagagccggccagcacagccaggccaugagaugccuggagggcgccagagagugcgcccacaccaugagaaagagauucauggagagcgagugcugcguggugaucgcccaggugcugcaggaccugggcgacuuccuggccgccaagagagcccugaagaaggccuacagacugggcagccagaagcccgugcagagagccgccaucugccagaaccugcagcacgugcuggccguggugagacugcagcagcagcuggaggaggccgagggcagagacccccagggcgccauggugaucugcgagcagcugggcgaccuguucagcaaggccggcgacuuccccagagccgccgaggccuaccagaagcagcugagauucgccgagcugcuggacagacccggcgccgagagagccaucauccacgugagccuggccaccacccugggcgacaugaaggaccaccacggcgccgugagacacuacgaggaggagcugagacugagaagcggcaacgugcuggaggaggccaagaccuggcugaacaucgcccugagcagagaggaggccggcgacgccuacgagcugcuggcccccugcuuccagaaggcccugagcugcgcccagcaggcccagagaccccagcugcagagacaggugcugcagcaccugcacaccgugcagcugagacugcagccccaggaggcccccgagaccgagaccagacugagagagcugagcguggccgaggacgaggacgaggaggaggaggccgaggaggccgccgccaccgccgagagcgaggcccuggaggccggcgagguggagcugagcgagggcgaggacgacaccgacggccugaccccccagcuggaggaggacgaggagcugcagggccaccugggcagaagaaagggcagcaaguggaacagaagaaacgacaugggcgagacccugcugcacagagccugcaucgagggccagcugagaagagugcaggaccuggugagacagggccacccccugaaccccagagacuacugcggcuggaccccccugcacgaggccugcaacuacggccaccuggagaucgugagauuccugcuggaccacggcgccgccguggacgaccccggcggccagggcugcgagggcaucaccccccugcacgacgcccugaacugcggccacuucgagguggccgagcugcugcuggagagaggcgccagcgugacccugagaaccagaaagggccugagcccccuggagacccugcagcagugggugaagcuguacagaagagaccuggaccuggagaccagacagaaggccagagccauggagaugcugcugcaggccgccgccagcggccaggacccccacagcagccaggccuuccacacccccagcagccugcuguucgaccccgagaccagccccccccugagccccugccccgagccccccagcaacagcaccagacugcccgaggccagccaggcccacgugagagugagccccggccaggccgcccccgccauggccagacccagaagaagcagacacggccccgccagcagcagcagcagcagcgagggcgaggacagcgccggccccgccagacccagccagaagagacccagaugcagcgccaccgcccagagaguggccgccuggacccccggccccgccagcaacagagaggccgccaccgccagcaccagcagagccgccuaccaggccgccaucagaggcgugggcagcgcccagagcagacugggccccggcccccccagaggccacagcaaggcccuggccccccaggccgcccugauccccgaggaggagugccuggccggcgacuggcuggagcuggacaugccccugaccagaagcagaagacccagacccagaggcaccggcgacaacagaagacccagcagcaccagcggcagcgacagcgaggagagcagacccagagccagagccaagcaggugagacugaccugcaugcagagcugcagcgcccccgugaacgccggccccagcagccuggccagcgagccccccggcagccccagcacccccagagugagcgagcccagcggcgacagcagcgccgccggccagccccugggccccgccccccccccccccaucagagugagagugcaggugcaggaccaccuguuccugauccccgugccccacagcagcgacacccacagcguggccuggcuggccgagcaggccgcccagagauacuaccagaccugcggccugcugcccagacugacccugagaaaggagggcgcccugcuggccccccaggaccugauccccgacgugcugcagagcaacgacgaggugcuggccgaggugaccagcugggaccugcccccccugaccgacagauacagaagagccugccagagccugggccagggcgagcaccagcaggugcugcaggccguggagcugcagggccugggccugagcuucagcgccugcagccuggcccuggaccaggcccagcugaccccccugcugagagcccugaagcugcacaccgcccugagagagcugagacuggccggcaacagacugggcgacaagugcguggccgagcugguggccgcccugggcaccaugcccagccuggcccugcuggaccugagcagcaaccaccugggccccgagggccugagacagcuggccaugggccugcccggccaggccacccugcagagccuggaggagcuggaccugagcaugaacccccugggcgacggcugcggccagagccuggccagccugcugcacgccugcccccugcugagcacccugagacugcaggccugcggcuucggccccagcuucuuccugagccaccagaccgcccugggcagcgccuuccaggacgccgagcaccugaagacccugagccugagcuacaacgcccugggcgcccccgcccuggccagaacccugcagagccugcccgccggcacccugcugcaccuggagcugagcagcguggccgccggcaagggcgacagcgaccugauggagcccguguucagauaccuggccaaggagggcugcgcccuggcccaccugacccugagcgccaaccaccugggcgacaaggccgugagagaccugugcagaugccugagccugugccccagccugaucagccuggaccugagcgccaaccccgagaucagcugcgccagccuggaggagcugcugagcacccugcagaagagaccccagggccugagcuuccugggccugagcggcugcgccgugcagggcccccugggccugggccugugggacaagaucgccgcccagcugagagagcugcagcugugcagcagaagacugugcgccgaggacagagacgcccugagacagcugcagcccagcagacccggccccggcgagugcacccuggaccacggcagcaagcuguucuucagaagacuguaa

SEQ ID NO: 24915 - RNA, 2298 nt, Artificial Sequence
  TOP1__Homo_sapiens__NP_003277
augagcggcgaccaccugcacaacgacagccagaucgaggccgacuucagacugaacgacagccacaagcacaaggacaagcacaaggacagagagcacagacacaaggagcacaagaaggagaaggacagagagaagagcaagcacagcaacagcgagcacaaggacagcgagaagaagcacaaggagaaggagaagaccaagcacaaggacggcagcagcgagaagcacaaggacaagcacaaggacagagacaaggagaagagaaaggaggagaaggugagagccagcggcgacgccaagaucaagaaggagaaggagaacggcuucagcagccccccccagaucaaggacgagcccgaggacgacggcuacuucgugccccccaaggaggacaucaagccccugaagagacccagagacgaggacgacgccgacuacaagcccaagaagaucaagaccgaggacaccaagaaggagaagaagagaaagcuggaggaggaggaggacggcaagcugaagaagcccaagaacaaggacaaggacaagaaggugcccgagcccgacaacaagaagaagaagcccaagaaggaggaggagcagaaguggaaguggugggaggaggagagauaccccgagggcaucaaguggaaguuccuggagcacaagggccccguguucgccccccccuacgagccccugcccgagaacgugaaguucuacuacgacggcaaggugaugaagcugagccccaaggccgaggagguggccaccuucuucgccaagaugcuggaccacgaguacaccaccaaggagaucuucagaaagaacuucuucaaggacuggagaaaggagaugaccaacgaggagaagaacaucaucaccaaccugagcaagugcgacuucacccagaugagccaguacuucaaggcccagaccgaggccagaaagcagaugagcaaggaggagaagcugaagaucaaggaggagaacgagaagcugcugaaggaguacggcuucugcaucauggacaaccacaaggagagaaucgccaacuucaagaucgagccccccggccuguucagaggcagaggcaaccaccccaagaugggcaugcugaagagaagaaucaugcccgaggacaucaucaucaacugcagcaaggacgccaaggugcccagccccccccccggccacaaguggaaggaggugagacacgacaacaaggugaccuggcuggugagcuggaccgagaacauccagggcagcaucaaguacaucaugcugaaccccagcagcagaaucaagggcgagaaggacuggcagaaguacgagaccgccagaagacugaagaagugcguggacaagaucagaaaccaguacagagaggacuggaagagcaaggagaugaaggugagacagagagccguggcccuguacuucaucgacaagcuggcccugagagccggcaacgagaaggaggagggcgagaccgccgacaccgugggcugcugcagccugagaguggagcacaucaaccugcaccccgagcuggacggccaggaguacgugguggaguucgacuuccugggcaaggacagcaucagauacuacaacaaggugcccguggagaagagaguguucaagaaccugcagcuguucauggagaacaagcagcccgaggacgaccuguucgacagacugaacaccggcauccugaacaagcaccugcaggaccugauggagggccugaccgccaagguguucagaaccuacaacgccagcaucacccugcagcagcagcugaaggagcugaccgcccccgacgagaacauccccgccaagauccugagcuacaacagagccaacagagccguggccauccugugcaaccaccagagagccccccccaagaccuucgagaagagcaugaugaaccugcagaccaagaucgacgccaagaaggagcagcuggccgacgccagaagagaccugaagagcgccaaggccgacgccaaggugaugaaggacgccaagaccaagaaggugguggagagcaagaagaaggccgugcagagacuggaggagcagcugaugaagcuggaggugcaggccaccgacagagaggagaacaagcagaucgcccugggcaccagcaagcugaacuaccuggaccccagaaucaccguggccuggugcaagaaguggggcgugcccaucgagaagaucuacaacaagacccagagagagaaguucgccugggccaucgacauggccgacgaggacuacgaguucuaa

SEQ ID NO: 24916 - RNA, 4596 nt, Artificial Sequence
  TOP2A__Homo_sapiens__NP_001058
auggaggugagcccccugcagcccgugaacgagaacaugcaggugaacaagaucaagaagaacgaggacgccaagaagagacugagcguggagagaaucuaccagaagaagacccagcuggagcacauccugcugagacccgacaccuacaucggcagcguggagcuggugacccagcagauguggguguacgacgaggacgugggcaucaacuacagagaggugaccuucgugcccggccuguacaagaucuucgacgagauccuggugaacgccgccgacaacaagcagagagaccccaagaugagcugcaucagagugaccaucgaccccgagaacaaccugaucagcaucuggaacaacggcaagggcauccccgugguggagcacaagguggagaagauguacgugcccgcccugaucuucggccagcugcugaccagcagcaacuacgacgacgacgagaagaaggugaccggcggcagaaacggcuacggcgccaagcugugcaacaucuucagcaccaaguucaccguggagaccgccagcagagaguacaagaagauguucaagcagaccuggauggacaacaugggcagagccggcgagauggagcugaagcccuucaacggcgaggacuacaccugcaucaccuuccagcccgaccugagcaaguucaagaugcagagccuggacaaggacaucguggcccugauggugagaagagccuacgacaucgccggcagcaccaaggacgugaagguguuccugaacggcaacaagcugcccgugaagggcuucagaagcuacguggacauguaccugaaggacaagcuggacgagaccggcaacagccugaaggugauccacgagcaggugaaccacagaugggaggugugccugaccaugagcgagaagggcuuccagcagaucagcuucgugaacagcaucgccaccagcaagggcggcagacacguggacuacguggccgaccagaucgugaccaagcugguggacguggugaagaagaagaacaagggcggcguggccgugaaggcccaccaggugaagaaccacauguggaucuucgugaacgcccugaucgagaaccccaccuucgacagccagaccaaggagaacaugacccugcagcccaagagcuucggcagcaccugccagcugagcgagaaguucaucaaggccgccaucggcugcggcaucguggagagcauccugaacugggugaaguucaaggcccaggugcagcugaacaagaagugcagcgccgugaagcacaacagaaucaagggcauccccaagcuggacgacgccaacgacgccggcggcagaaacagcaccgagugcacccugauccugaccgagggcgacagcgccaagacccuggccgugagcggccugggcguggugggcagagacaaguacggcguguucccccugagaggcaagauccugaacgugagagaggccagccacaagcagaucauggagaacgccgagaucaacaacaucaucaagaucgugggccugcaguacaagaagaacuacgaggacgaggacagccugaagacccugagauacggcaagaucaugaucaugaccgaccaggaccaggacggcagccacaucaagggccugcugaucaacuucauccaccacaacuggcccagccugcugagacacagauuccuggaggaguucaucacccccaucgugaaggugagcaagaacaagcaggagauggccuucuacagccugcccgaguucgaggaguggaagagcagcacccccaaccacaagaaguggaaggugaaguacuacaagggccugggcaccagcaccagcaaggaggccaaggaguacuucgccgacaugaagagacacagaauccaguucaaguacagcggccccgaggacgacgccgccaucagccuggccuucagcaagaagcagaucgacgacagaaaggaguggcugaccaacuucauggaggacagaagacagagaaagcugcugggccugcccgaggacuaccuguacggccagaccaccaccuaccugaccuacaacgacuucaucaacaaggagcugauccuguucagcaacagcgacaacgagagaagcauccccagcaugguggacggccugaagcccggccagagaaaggugcuguucaccugcuucaagagaaacgacaagagagaggugaagguggcccagcuggccggcagcguggccgagaugagcagcuaccaccacggcgagaugagccugaugaugaccaucaucaaccuggcccagaacuucgugggcagcaacaaccugaaccugcugcagcccaucggccaguucggcaccagacugcacggcggcaaggacagcgccagccccagauacaucuucaccaugcugagcagccuggccagacugcuguucccccccaaggacgaccacacccugaaguuccuguacgacgacaaccagagaguggagcccgagugguacauccccaucauccccauggugcugaucaacggcgccgagggcaucggcaccggcuggagcugcaagauccccaacuucgacgugagagagaucgugaacaacaucagaagacugauggacggcgaggagccccugcccaugcugcccagcuacaagaacuucaagggcaccaucgaggagcuggcccccaaccaguacgugaucagcggcgagguggccauccugaacagcaccaccaucgagaucagcgagcugcccgugagaaccuggacccagaccuacaaggagcaggugcuggagcccaugcugaacggcaccgagaagacccccccccugaucaccgacuacagagaguaccacaccgacaccaccgugaaguucguggugaagaugaccgaggagaagcuggccgaggccgagagagugggccugcacaagguguucaagcugcagaccagccugaccugcaacagcauggugcuguucgaccacgugggcugccugaagaaguacgacaccgugcuggacauccugagagacuucuucgagcugagacugaaguacuacggccugagaaaggaguggcugcugggcaugcugggcgccgagagcgccaagcugaacaaccaggccagauucauccuggagaagaucgacggcaagaucaucaucgagaacaagcccaagaaggagcugaucaaggugcugauccagagaggcuacgacagcgaccccgugaaggccuggaaggaggcccagcagaaggugcccgacgaggaggagaacgaggagagcgacaacgagaaggagaccgagaagagcgacagcgugaccgacagcggccccaccuucaacuaccugcuggacaugccccugugguaccugaccaaggagaagaaggacgagcugugcagacugagaaacgagaaggagcaggagcuggacacccugaagagaaagagccccagcgaccuguggaaggaggaccuggccaccuucaucgaggagcuggaggccguggaggccaaggagaagcaggacgagcaggugggccugcccggcaagggcggcaaggccaagggcaagaagacccagauggccgaggugcugcccagccccagaggccagagagugauccccagaaucaccaucgagaugaaggccgaggccgagaagaagaacaagaagaagaucaagaacgagaacaccgagggcagcccccaggaggacggcguggagcuggagggccugaagcagagacuggagaagaagcagaagagagagcccggcaccaagaccaagaagcagaccacccuggccuucaagcccaucaagaagggcaagaagagaaaccccuggagcgacagcgagagcgacagaagcagcgacgagagcaacuucgacgugccccccagagagaccgagcccagaagagccgccaccaagaccaaguucaccauggaccuggacagcgacgaggacuucagcgacuucgacgagaagaccgacgacgaggacuucgugcccagcgacgccagcccccccaagaccaagaccagccccaagcugagcaacaaggagcugaagccccagaagagcguggugagcgaccuggaggccgacgacgugaagggcagcgugccccugagcagcagcccccccgccacccacuuccccgacgagaccgagaucaccaaccccgugcccaagaagaacgugaccgugaagaagaccgccgccaagagccagagcagcaccagcaccaccggcgccaagaagagagccgcccccaagggcaccaagagagaccccgcccugaacagcggcgugagccagaagcccgaccccgccaagaccaagaacagaagaaagagaaagcccagcaccagcgacgacagcgacagcaacuucgagaagaucgugagcaaggccgugaccagcaagaagagcaagggcgagagcgacgacuuccacauggacuucgacagcgccguggcccccagagccaagagcgugagagccaagaagcccaucaaguaccuggaggagagcgacgaggacgaccuguucuaa

SEQ ID NO: 24917 - RNA, 4866 nt, Artificial Sequence
  TOP2B__Homo_sapiens__NP_001059
auggccaagagcggcggcugcggcgccggcgccggcgugggcggcggcaacggcgcccugaccugggugaacaacgccgccaagaaggaggagagcgagaccgccaacaagaacgacagcagcaagaagcugagcguggagagaguguaccagaagaagacccagcuggagcacauccugcugagacccgacaccuacaucggcagcguggagccccugacccaguucauguggguguacgacgaggacgugggcaugaacugcagagaggugaccuucgugcccggccuguacaagaucuucgacgagauccuggugaacgccgccgacaacaagcagagagacaagaacaugaccugcaucaaggugagcaucgaccccgagagcaacaucaucagcaucuggaacaacggcaagggcauccccgugguggagcacaagguggagaagguguacgugcccgcccugaucuucggccagcugcugaccagcagcaacuacgacgacgacgagaagaaggugaccggcggcagaaacggcuacggcgccaagcugugcaacaucuucagcaccaaguucaccguggagaccgccugcaaggaguacaagcacagcuucaagcagaccuggaugaacaacaugaugaagaccagcgaggccaagaucaagcacuucgacggcgaggacuacaccugcaucaccuuccagcccgaccugagcaaguucaagauggagaagcuggacaaggacaucguggcccugaugaccagaagagccuacgaccuggccggcagcugcagaggcgugaaggugauguucaacggcaagaagcugcccgugaacggcuucagaagcuacguggaccuguacgugaaggacaagcuggacgagaccggcguggcccugaaggugauccacgagcuggccaacgagagaugggacgugugccugacccugagcgagaagggcuuccagcagaucagcuucgugaacagcaucgccaccaccaagggcggcagacacguggacuacgugguggaccagguggugggcaagcugaucgagguggugaagaagaagaacaaggccggcgugagcgugaagcccuuccaggugaagaaccacaucuggguguucaucaacugccugaucgagaaccccaccuucgacagccagaccaaggagaacaugacccugcagcccaagagcuucggcagcaagugccagcugagcgagaaguucuucaaggccgccagcaacugcggcaucguggagagcauccugaacugggugaaguucaaggcccagacccagcugaacaagaagugcagcagcgugaaguacagcaagaucaagggcauccccaagcuggacgacgccaacgacgccggcggcaagcacagccuggagugcacccugauccugaccgagggcgacagcgccaagagccuggccgugagcggccugggcgugaucggcagagacagauacggcguguucccccugagaggcaagauccugaacgugagagaggccagccacaagcagaucauggagaacgccgagaucaacaacaucaucaagaucgugggccugcaguacaagaagagcuacgacgacgccgagagccugaagacccugagauacggcaagaucaugaucaugaccgaccaggaccaggacggcagccacaucaagggccugcugaucaacuucauccaccacaacuggcccagccugcugaagcacggcuuccuggaggaguucaucacccccaucgugaaggccagcaagaacaagcaggagcugagcuucuacagcauccccgaguucgacgaguggaagaagcacaucgagaaccagaaggccuggaagaucaaguacuacaagggccugggcaccagcaccgccaaggaggccaaggaguacuucgccgacauggagagacacagaauccuguucagauacgccggccccgaggacgacgccgccaucacccuggccuucagcaagaagaagaucgacgacagaaaggaguggcugaccaacuucauggaggacagaagacagagaagacugcacggccugcccgagcaguuccuguacggcaccgccaccaagcaccugaccuacaacgacuucaucaacaaggagcugauccuguucagcaacagcgacaacgagagaagcauccccagccugguggacggcuucaagcccggccagagaaaggugcuguucaccugcuucaagagaaacgacaagagagaggugaagguggcccagcuggccggcagcguggccgagaugagcgccuaccaccacggcgagcaggcccugaugaugaccaucgugaaccuggcccagaacuucgugggcagcaacaacaucaaccugcugcagcccaucggccaguucggcaccagacugcacggcggcaaggacgccgccagccccagauacaucuucaccaugcugagcacccuggccagacugcuguuccccgccguggacgacaaccugcugaaguuccuguacgacgacaaccagagaguggagcccgagugguacauccccaucauccccauggugcugaucaacggcgccgagggcaucggcaccggcugggccugcaagcugcccaacuacgacgccagagagaucgugaacaacgugagaagaaugcuggacggccuggacccccaccccaugcugcccaacuacaagaacuucaagggcaccauccaggagcugggccagaaccaguacgccgugagcggcgagaucuucgugguggacagaaacaccguggagaucaccgagcugcccgugagaaccuggacccagguguacaaggagcaggugcuggagcccaugcugaacggcaccgacaagacccccgcccugaucagcgacuacaaggaguaccacaccgacaccaccgugaaguucguggugaagaugaccgaggagaagcuggcccaggccgaggccgccggccugcacaagguguucaagcugcagaccacccugaccugcaacagcauggugcuguucgaccacaugggcugccugaagaaguacgagaccgugcaggacauccugaaggaguucuucgaccugagacugagcuacuacggccugagaaaggaguggcuggugggcaugcugggcgccgagagcaccaagcugaacaaccaggccagauucauccuggagaagauccagggcaagaucaccaucgagaacagaagcaagaaggaccugauccagaugcuggugcagagaggcuacgagagcgaccccgugaaggccuggaaggaggcccaggagaaggccgccgaggaggacgagacccagaaccagcacgacgacagcagcagcgacagcggcacccccagcggccccgacuucaacuacauccugaacaugagccuguggagccugaccaaggagaagguggaggagcugaucaagcagagagacgccaagggcagagaggugaacgaccugaagagaaagagccccagcgaccuguggaaggaggaccuggccgccuucguggaggagcuggacaagguggagagccaggagagagaggacgugcuggccggcaugagcggcaaggccaucaagggcaaggugggcaagcccaaggugaagaagcugcagcuggaggagaccaugcccagccccuacggcagaagaaucauccccgagaucaccgccaugaaggccgacgccagcaagaagcugcugaagaagaagaagggcgaccuggacaccgccgccgugaagguggaguucgacgaggaguucagcggcgcccccguggagggcgccggcgaggaggcccugacccccagcgugcccaucaacaagggccccaagcccaagagagagaagaaggagcccggcaccagagugagaaagacccccaccagcagcggcaagcccagcgccaagaaggugaagaagagaaaccccuggagcgacgacgagagcaagagcgagagcgaccuggaggagaccgagcccguggugauccccagagacagccugcugagaagagccgccgccgagagacccaaguacaccuucgacuucagcgaggaggaggacgacgacgccgacgacgacgacgacgacaacaacgaccuggaggagcugaaggugaaggccagccccaucaccaacgacggcgaggacgaguucgugcccagcgacggccuggacaaggacgaguacaccuucagccccggcaagagcaaggccacccccgagaagagccugcacgacaagaagagccaggacuucggcaaccuguucagcuuccccagcuacagccagaagagcgaggacgacagcgccaaguucgacagcaacgaggaggacagcgccagcguguucagccccagcuucggccugaagcagaccgacaaggugcccagcaagaccguggccgccaagaagggcaagcccagcagcgacaccgugcccaagcccaagagagcccccaagcagaagaaggugguggaggccgugaacagcgacagcgacagcgaguucggcauccccaagaagaccaccacccccaagggcaagggcagaggcgccaagaagagaaaggccagcggcagcgagaacgagggcgacuacaaccccggcagaaagaccagcaagaccaccagcaagaagcccaagaagaccagcuucgaccaggacagcgacguggacaucuuccccagcgacuuccccaccgagccccccagccugcccagaaccggcagagccagaaaggaggugaaguacuucgccgagagcgacgaggaggaggacgacguggacuucgccauguucaacuaa

SEQ ID NO: 24918 - RNA, 3006 nt, Artificial Sequence
  TOP3A__Homo_sapiens__NP_004609
augaucuuccccguggccagauacgcccugagauggcugagaagacccgaggacagagccuucagcagagccgccauggagauggcccugagaggcgugagaaaggugcugugcguggccgagaagaacgacgccgccaagggcaucgccgaccugcugagcaacggcagaaugagaagaagagagggccugagcaaguucaacaagaucuacgaguucgacuaccaccuguacggccagaacgugaccauggugaugaccagcgugagcggccaccugcuggcccacgacuuccagaugcaguucagaaaguggcagagcugcaacccccuggugcuguucgaggccgagaucgagaaguacugccccgagaacuucguggacaucaagaagacccuggagagagagaccagacagugccaggcccuggugaucuggaccgacugcgacagagagggcgagaacaucggcuucgagaucauccacgugugcaaggccgugaagcccaaccugcaggugcugagagccagauucagcgagaucaccccccacgccgugagaaccgccugcgagaaccugaccgagcccgaccagagagugagcgacgccguggacgugagacaggagcuggaccugagaaucggcgccgccuucaccagauuccagacccugagacugcagagaaucuuccccgaggugcuggccgagcagcugaucagcuacggcagcugccaguuccccacccugggcuucgugguggagagauucaaggccauccaggccuucgugcccgagaucuuccacagaaucaaggugacccacgaccacaaggacggcaucguggaguucaacuggaagagacacagacuguucaaccacaccgccugccuggugcuguaccagcugugcguggaggaccccauggccaccgugguggaggugagaagcaagcccaagagcaaguggagaccccaggcccuggacaccguggagcuggagaagcuggccagcagaaagcugagaaucaacgccaaggagaccaugagaaucgccgagaagcuguacacccagggcuacaucagcuaccccagaaccgagaccaacaucuuccccagagaccugaaccugaccgugcugguggagcagcagacccccgaccccagauggggcgccuucgcccagagcauccuggagagaggcggccccacccccagaaacggcaacaagagcgaccaggcccacccccccauccaccccaccaaguacaccaacaaccugcagggcgacgagcagagacuguacgaguucaucgugagacacuuccuggccugcugcagccaggacgcccagggccaggagaccaccguggagaucgacaucgcccaggagagauucguggcccacggccugaugauccuggccagaaacuaccuggacguguaccccuacgaccacuggagcgacaagauccugcccguguacgagcagggcagccacuuccagcccagcaccguggagaugguggacggcgagaccagcccccccaagcugcugaccgaggccgaccugaucgcccugauggagaagcacggcaucggcaccgacgccacccacgccgagcacaucgagaccaucaaggccagaauguacgugggccugacccccgacaagagauuccugcccggccaccugggcaugggccugguggagggcuacgacagcaugggcuacgagaugagcaagcccgaccugagagccgagcuggaggccgaccugaagcugaucugcgacggcaagaaggacaaguucguggugcugagacagcaggugcagaaguacaagcagguguucaucgaggccguggccaaggccaagaagcuggacgaggcccuggcccaguacuucggcaacggcaccgagcuggcccagcaggaggacaucuaccccgccaugcccgagcccaucagaaagugcccccagugcaacaaggacauggugcugaagaccaagaagaacggcggcuucuaccugagcugcaugggcuuccccgagugcagaagcgccguguggcugcccgacagcgugcuggaggccagcagagacagcagcgugugccccgugugccagccccaccccguguacagacugaagcugaaguucaagagaggcagccugccccccaccaugccccuggaguucgugugcugcaucggcggcugcgacgacacccugagagagauccuggaccugagauucagcggcggcccccccagagccagccagcccagcggcagacugcaggccaaccagagccugaacagaauggacaacagccagcacccccagcccgccgacagcagacagaccggcagcagcaaggcccuggcccagacccugcccccccccaccgccgccggcgagagcaacagcgugaccugcaacugcggccaggaggccgugcugcugaccgugagaaaggagggccccaacagaggcagacaguucuucaagugcaacggcggcagcugcaacuucuuccugugggccgacagccccaaccccggcgccggcggcccccccgcccuggccuacagaccccugggcgccagccugggcugcccccccggccccggcauccaccugggcggcuucggcaaccccggcgacggcagcggcagcggcaccagcugccugugcagccagcccagcgugaccagaaccgugcagaaggacggccccaacaagggcagacaguuccacaccugcgccaagcccagagagcagcagugcggcuucuuccaguggguggacgagaacaccgcccccggcaccagcggcgcccccagcuggaccggcgacagaggcagaacccuggagagcgaggccagaagcaagagacccagagccagcagcagcgacaugggcagcaccgccaagaagcccagaaagugcagccugugccaccagcccggccacaccagacccuucugcccccagaacagauaa

SEQ ID NO: 24919 - RNA, 2589 nt, Artificial Sequence
  TOP3B__Homo_sapiens__NP_001269042
augaagaccgugcugaugguggccgagaagcccagccuggcccagagcaucgccaagauccugagcagaggcagccugagcagccacaagggccugaacggcgccugcagcgugcacgaguacaccggcaccuucgccggccagcccgugagauucaagaugaccagcgugugcggccacgugaugacccuggacuuccugggcaaguacaacaagugggacaagguggaccccgccgagcuguucagccaggcccccaccgagaagaaggaggccaaccccaagcugaacauggugaaguuccugcagguggagggcagaggcugcgacuacaucgugcuguggcuggacugcgacaaggagggcgagaacaucugcuucgaggugcuggacgccgugcugcccgugaugaacaaggcccacggcggcgagaagaccguguucagagccagauucagcagcaucaccgacaccgacaucugcaacgccauggccugccugggcgagcccgaccacaacgaggcccugagcguggacgccagacaggagcuggaccugagaaucggcugcgccuucaccagauuccagaccaaguacuuccagggcaaguacggcgaccuggacagcagccugaucagcuucggccccugccagacccccacccugggcuucugcguggagagacacgacaagauccagagcuucaagcccgagaccuacugggugcugcaggccaaggugaacaccgacaaggacagaagccugcugcuggacugggacagagugagaguguucgacagagagaucgcccagauguuccugaacaugaccaagcuggagaaggaggcccagguggaggccaccagcagaaaggagaaggccaagcagagaccccuggcccugaacaccguggagaugcugagaguggccagcagcagccugggcaugggcccccagcacgccaugcagaccgccgagagacuguacacccagggcuacaucagcuaccccagaaccgagaccacccacuaccccgagaacuucgaccugaagggcagccugagacagcaggccaaccaccccuacugggccgacaccgugaagagacugcuggccgagggcaucaacagacccagaaagggccacgacgccggcgaccacccccccaucacccccaugaagagcgccaccgaggccgagcugggcggcgacgccuggagacuguacgaguacaucaccagacacuucaucgccaccgugagccacgacugcaaguaccugcagagcaccaucagcuucagaaucggccccgagcuguucaccugcagcggcaagaccgugcugagccccggcuucaccgaggugaugcccuggcagagcgugccccuggaggagagccugcccaccugccagagaggcgacgccuuccccgugggcgaggugaagaugcuggagaagcagaccaacccccccgacuaccugaccgaggccgagcugaucacccugauggagaagcacggcaucggcaccgacgccagcauccccgugcacaucaacaacaucugccagagaaacuacgugaccguggagagcggcagaagacugaagcccaccaaccugggcaucgugcuggugcacggcuacuacaagaucgacgccgagcuggugcugcccaccaucagaagcgccguggagaagcagcugaaccugaucgcccagggcaaggccgacuacagacaggugcugggccacacccuggacguguucaagagaaaguuccacuacuucguggacagcaucgccggcauggacgagcugauggaggugagcuucagcccccuggccgccaccggcaagccccugagcagaugcggcaagugccacagauucaugaaguacauccaggccaagcccagcagacugcacugcagccacugcgacgagaccuacacccugccccagaacggcaccaucaagcuguacaaggagcugagaugcccccuggacgacuucgagcuggugcuguggagcagcggcagcagaggcaagagcuacccccugugccccuacugcuacaaccacccccccuucagagacaugaagaagggcaugggcugcaacgagugcacccaccccagcugccagcacagccugagcaugcugggcaucggccagugcguggagugcgagagcggcgugcuggugcuggaccccaccagcggccccaaguggaagguggccugcaacaagugcaacgugguggcccacugcuucgagaacgcccacagagugagagugagcgccgacaccugcagcgugugcgaggccgcccugcuggacguggacuucaacaaggccaagagcccccugcccggcgacgagacccagcacaugggcugcguguucugcgaccccguguuccaggagcugguggagcugaagcacgccgccagcugccaccccaugcacagaggcggccccggcagaagacagggcagaggcagaggcagagccagaagaccccccggcaagcccaaccccagaagacccaaggacaagaugagcgcccuggccgccuacuucguguaa

SEQ ID NO: 24920 - RNA, 4569 nt, Artificial Sequence
  TOPBP1__Homo_sapiens__NP_008958
augagcagaaacgacaaggagcccuucuucgugaaguuccugaagagcagcgacaacagcaagugcuucuucaaggcccuggagagcaucaaggaguuccagagcgaggaguaccugcagaucaucaccgaggaggaggcccugaagaucaaggagaacgacagaagccuguacaucugcgaccccuucagcggcgugguguucgaccaccugaagaagcugggcugcagaaucgugggcccccagguggugaucuucugcaugcaccaccagagaugcgugcccagagccgagcaccccguguacaacauggugaugagcgacgugaccaucagcugcaccagccuggagaaggagaagagagaggaggugcacaaguacgugcagaugaugggcggcagaguguacagagaccugaacgugagcgugacccaccugaucgccggcgaggugggcagcaagaaguaccugguggccgccaaccugaagaagcccauccugcugcccagcuggaucaagacccugugggagaagagccaggagaagaagaucaccagauacaccgacaucaacauggaggacuucaagugccccaucuuccugggcugcaucaucugcgugaccggccugugcggccuggacagaaaggaggugcagcagcugaccgugaagcacggcggccaguacaugggccagcugaagaugaacgagugcacccaccugaucgugcaggagcccaagggccagaaguacgagugcgccaagagauggaacgugcacugcgugaccacccagugguucuucgacagcaucgagaagggcuucugccaggacgagagcaucuacaagaccgagcccagacccgaggccaagaccaugcccaacagcagcacccccaccagccagaucaacaccaucgacagcagaacccugagcgacgugagcaacaucagcaacaucaacgccagcugcgugagcgagagcaucugcaacagccugaacagcaagcuggagcccacccuggagaaccuggagaaccuggacgugagcgccuuccaggcccccgaggaccugcuggacggcugcagaaucuaccugugcggcuucagcggcagaaagcuggacaagcugagaagacugaucaacagcggcggcggcgugagauucaaccagcugaacgaggacgugacccacgugaucgugggcgacuacgacgacgagcugaagcaguucuggaacaagagcgcccacagaccccacguggugggcgccaaguggcugcuggagugcuucagcaagggcuacaugcugagcgaggagcccuacauccacgccaacuaccagcccguggagauccccgugagccacaagcccgagagcaaggccgcccugcugaagaagaagaacagcagcuucagcaagaaggacuucgcccccagcgagaagcacgagcaggccgacgaggaccugcugagccaguacgagaacggcagcagcaccgugguggaggccaagaccagcgaggccagacccuucaacgacagcacccacgccgagccccugaacgacagcacccacaucagccugcaggaggagaaccagagcagcgugagccacugcgugcccgacgugagcaccaucaccgaggagggccuguucagccagaagagcuuccuggugcugggcuucagcaacgagaacgagagcaacaucgccaacaucaucaaggagaacgccggcaagaucaugagccugcugagcagaaccguggccgacuacgccguggugccccugcugggcugcgagguggaggccaccgugggcgagguggugaccaacaccuggcuggugaccugcaucgacuaccagacccuguucgaccccaagagcaacccccuguucacccccgugcccgugaugaccggcaugaccccccuggaggacugcgugaucagcuucagccagugcgccggcgccgagaaggagagccugaccuuccuggccaaccugcugggcgccagcgugcaggaguacuucgugagaaagagcaacgccaagaagggcauguucgccagcacccaccugauccugaaggagagaggcggcagcaaguacgaggccgccaagaaguggaaccugcccgccgugaccaucgccuggcugcuggagaccgccagaaccggcaagagagccgacgagagccacuuccugaucgagaacagcaccaaggaggagagaagccuggagaccgagaucaccaacggcaucaaccugaacagcgacaccgccgagcaccccggcaccagacugcagacccacagaaagaccguggugaccccccuggacaugaacagauuccagagcaaggccuucagagccguggugagccagcacgccagacagguggccgccagccccgccgugggccagccccugcagaaggagcccagccugcaccuggacacccccagcaaguuccugagcaaggacaagcuguucaagcccagcuucgacgugaaggacgcccuggccgcccuggagacccccggcagacccagccagcagaagagaaagcccagcaccccccugagcgaggugaucgugaagaaccugcagcuggcccuggccaacagcagcagaaacgccguggcccugagcgccagcccccagcugaaggaggcccagagcgagaaggaggaggcccccaagccccugcacaaggugguggugugcgugagcaagaagcugagcaagaagcagagcgagcugaacggcaucgccgccagccugggcgccgacuacagauggagcuucgacgagaccgugacccacuucaucuaccagggcagacccaacgacaccaacagagaguacaagagcgugaaggagagaggcgugcacaucgugagcgagcacuggcugcuggacugcgcccaggagugcaagcaccugcccgagagccuguacccccacaccuacaaccccaagaugagccuggacaucagcgccgugcaggacggcagacugugcaacagcagacugcugagcgccgugagcagcaccaaggacgacgagcccgacccccugauccuggaggagaacgacguggacaacauggccaccaacaacaaggagagcgcccccagcaacggcagcggcaagaacgacagcaagggcgugcugacccagacccuggagaugagagagaacuuccagaagcagcugcaggagaucaugagcgccaccagcaucgugaagccccagggccagagaaccagccugagcagaagcggcugcaacagcgccagcagcacccccgacagcaccagaagcgccagaagcggcagaagcagagugcuggaggcccugagacagagcagacagaccgugcccgacgugaacaccgagcccagccagaacgagcagaucaucugggacgaccccaccgccagagaggagagagccagacuggccagcaaccugcaguggcccagcugccccacccaguacagcgagcugcagguggacauccagaaccuggaggacagccccuuccagaagccccugcacgacagcgagaucgccaagcaggccgugugcgaccccggcaacaucagagugaccgaggcccccaagcaccccaucagcgaggagcuggagacccccaucaaggacagccaccugauccccaccccccaggcccccagcaucgccuucccccuggccaacccccccguggccccccaccccagagagaagaucaucaccaucgaggagacccacgaggagcugaagaagcaguacaucuuccagcugagcagccugaacccccaggagagaaucgacuacugccaccugaucgagaagcugggcggccuggugaucgagaagcagugcuucgaccccaccugcacccacaucguggugggccacccccugagaaacgagaaguaccuggccagcguggccgccggcaagugggugcugcacagaagcuaccuggaggccugcagaaccgccggccacuucgugcaggaggaggacuacgaguggggcagcagcagcauccuggacgugcugaccggcaucaacgugcagcagagaagacuggcccuggccgccaugagauggagaaagaagauccagcagagacaggagagcggcaucguggagggcgccuucagcggcuggaaggugauccugcacguggaccagagcagagaggccggcuucaagagacugcugcagagcggcggcgccaaggugcugcccggccacagcgugccccuguucaaggaggccacccaccuguucagcgaccugaacaagcugaagcccgacgacagcggcgugaacaucgccgaggccgccgcccagaacguguacugccugagaaccgaguacaucgccgacuaccugaugcaggagagccccccccacguggagaacuacugccugcccgaggccaucagcuucauccagaacaacaaggagcugggcaccggccugagccagaagagaaaggcccccaccgagaagaacaagaucaagagacccagagugcacuaa

SEQ ID NO: 24921 - RNA, 2943 nt, Artificial Sequence
  TOPORS__Homo_sapiens__NP_001182551
augaucauggccagcgccgccaaggaguucaagauggacaacuucagccccaaggccggcaccagcaagcugcagcagaccgugcccgccgacgccagccccgacagcaagugccccaucugccuggacagauucgacaacgugagcuaccuggacagaugccugcacaaguucugcuucagaugcgugcaggaguggagcaagaacaaggccgagugcccccugugcaagcagcccuucgacagcaucuuccacagcgugagagccgaggacgacuucaaggaguacgugcugagacccagcuacaacggcagcuucgugacccccgacagaagauucagauacagaaccacccugaccagagagagaaacgccagcguguacagccccagcggccccgugaacagaagaaccaccaccccccccgacagcggcgugcuguucgagggccugggcaucagcaccagacccagagacguggagaucccccaguucaugagacagaucgccgugagaagacccaccaccgccgacgagagaagccugagaaagauccaggagcaggacaucaucaacuucagaagaacccuguacagagccggcgccagagugagaaacaucgaggacggcggcagauacagagacaucagcgccgaguucuucagaagaaaccccgccugccugcacagacuggugcccuggcugaagagagagcugaccgugcuguucggcgcccacggcagccuggugaacaucgugcagcacaucaucaugagcaacgugaccagauacgaccuggagagccaggccuucgugagcgaccugagacccuuccugcugaacagaaccgagcacuucauccacgaguucaucagcuucgccagaagccccuucaacauggccgccuucgaccagcacgccaacuacgacugccccgcccccagcuacgaggagggcagccacagcgacagcagcgugaucaccaucagccccgacgaggccgagacccaggagcuggacaucaacguggccaccgugagccaggcccccugggacgacgagacccccggccccagcuacagcagcagcgagcaggugcacgugaccaugagcagccugcugaacaccagcgacagcagcgacgaggagcuggugaccggcggcgccaccagccagauccagggcgugcagaccaacgacgaccugaacaacgacagcgacgacagcagcgacaacugcgugaucgugggcuucgugaagccccuggccgagagaacccccgagcugguggagcugagcagcgacagcgaggaccugggcagcuacgagaagauggagaccgugaagacccaggagcaggagcagagcuacagcagcggcgacagcgacgugagcagaugcagcagcccccacagcgugcugggcaaggacgagcagaucaacaagggccacugcgacagcagcaccagaaucaagagcaagaaggaggagaagagaagcaccagccugagcagccccagaaaccugaacagcagcgugagaggcgacagaguguacagccccuacaaccacagacacagaaagagaggcagaagcagaagcagcgacagcagaagccagagcagaagcggccacgaccagaagaaccacagaaagcaccacggcaagaagagaaugaagagcaagagaagcagaagcagagagagcagcagacccagaggcagaagagacaagaagagaagcagaaccagagacagcagcuggagcagaagaagccagacccugagccugagcagcgagagcaccagcagaagcagaagcagaagcagcgaccacggcaagagaagaagcagaagcagaaacagagacagauacuaccugagaaacaacuacggcagcagauacaagugggaguacaccuacuacagcagaaacaaggacagagacggcuacgagagcagcuacagaagaagaacccugagcagagcccacuacagcagacagagcagcagccccgaguucagagugcagagcuucagcgagagaaccaacgccagaaagaagaacaaccacagcgagagaaaguacuacuacuacgagagacacagaagcagaagccugagcagcaacagaagcagaaccgccagcaccggcaccgacagagugagaaacgagaagcccggcggcaagagaaaguacaagaccagacaccuggagggcaccaacgagguggcccagcccagcagagaguucgccagcaaggccaaggacagccacuaccagaagagcagcagcaagcuggacggcaacuacaagaacgagagcgacaccuucagcgacagcagaagcagcgacagagagaccaagcacaagagaagaaagagaaagaccagaagccugagcguggagaucguguacgagggcaaggccaccgacaccaccaagcaccacaagaagaagaagaagaagcacaagaagaagcacaagaagcaccacggcgacaacgccagcagaagccccguggugaucaccaucgacagcgacagcgacaaggacagcgaggugaaggaggacaccgagugcgacaacagcggcccccaggacccccugcagaacgaguuccuggcccccagccuggagcccuucgagaccaaggacguggugaccaucgaggccgaguucggcgugcuggacaaggagugcgacaucgccacccugagcaacaaccugaacaacgccaacaagaccguggacaacauccccccccuggccgccagcguggagcagacccuggacgugagagaggagagcaccuucgugagcgaccuggagaaccagcccagcaacaucgugagccugcagaccgagcccagcagacagcugcccagccccagaaccagccugaugagcgugugccugggcagagacugcgacaugagcuaa

SEQ ID NO: 24922 - RNA, 999 nt, Artificial Sequence
  TOR1A__Homo_sapiens__NP_000104
augaagcugggcagagccgugcugggccugcugcugcuggcccccagcguggugcaggccguggagcccaucagccugggccuggcccuggccggcgugcugaccggcuacaucuaccccagacuguacugccuguucgccgagugcugcggccagaagagaagccugagcagagaggcccugcagaaggaccuggacgacaaccuguucggccagcaccuggccaagaagaucauccugaacgccguguucggcuucaucaacaaccccaagcccaagaagccccugacccugagccugcacggcuggaccggcaccggcaagaacuucgugagcaagaucaucgccgagaacaucuacgagggcggccugaacagcgacuacgugcaccuguucguggccacccugcacuucccccacgccagcaacaucacccuguacaaggaccagcugcagcuguggaucagaggcaacgugagcgccugcgccagaagcaucuucaucuucgacgagauggacaagaugcacgccggccugaucgacgccaucaagcccuuccuggacuacuacgaccugguggacggcgugagcuaccagaaggccauguucaucuuccugagcaacgccggcgccgagagaaucaccgacguggcccuggacuucuggagaagcggcaagcagagagaggacaucaagcugaaggacaucgagcacgcccugagcgugagcguguucaacaacaagaacagcggcuucuggcacagcagccugaucgacagaaaccugaucgacuacuucgugcccuuccugccccuggaguacaagcaccugaagaugugcaucagaguggagaugcagagcagaggcuacgagaucgacgaggacaucgugagcagaguggccgaggagaugaccuucuuccccaaggaggagagaguguucagcgacaagggcugcaagaccguguucaccaagcuggacuacuacuacgacgacuaa

SEQ ID NO: 24923 - RNA, 1752 nt, Artificial Sequence
  TOR1AIP1__Homo_sapiens__NP_056417
auggccggcgacggcagaagagccgaggccgugagagagggcuggggcguguacgugacccccagagcccccaucagagagggcagaggcagacuggccccccagaacggcggcagcagcgacgcccccgccuacagaaccccccccagcagacagggcagaagagaggugagauucagcgacgagccccccgagguguacggcgacuucgagccccugguggccaaggagagaagccccgugggcaagagaaccagacuggaggaguucagaagcgacagcgccaaggaggaggugagagagagcgccuacuaccugagaagcagacagagaagacagcccagaccccaggagaccgaggagaugaagaccagaagaaccaccagacugcagcagcagcacagcgagcagcccccccugcagcccagccccgugaugaccagaagaggccugagagacagccacagcagcgaggaggacgaggccagcagccagaccgaccugagccagaccaucagcaagaagaccgugagaagcauccaggaggcccccgugagcgaggaccuggugaucagacugagaagacccccccugagauaccccagauacgaggccaccagcgugcagcagaaggugaacuucagcgaggagggcgagaccgaggaggacgaccaggacagcagccacagcagcgugaccaccgugaaggccagaagcagagacagcgacgagagcggcgacaagaccaccagaagcagcagccaguacaucgagagcuucuggcagagcagccagagccagaacuucaccgcccacgacaagcagcccagcgugcugagcagcggcuaccagaagaccccccaggagugggccccccagaccgccagaaucagaaccagaaugcagaacgacagcauccugaagagcgagcugggcaaccagagccccagcaccagcagcagacaggugaccggccagccccagaacgccagcuucgugaagagaaacagaugguggcugcugccccugaucgccgcccuggccagcggcagcuucugguucuucagcacccccgagguggagaccaccgccgugcaggaguuccagaaccagaugaaccagcugaagaacaaguaccagggccaggacgagaagcuguggaagagaagccagaccuuccuggagaagcaccugaacagcagccaccccagaagccagcccgccauccugcugcugaccgccgccagagacgccgaggaggcccugagaugccugagcgagcagaucgccgacgccuacagcagcuucagaagcgugagagccaucagaaucgacggcaccgacaaggccacccaggacagcgacaccgugaagcuggagguggaccaggagcugagcaacggcuucaagaacggccagaacgccgccguggugcacagauucgagagcuuccccgccggcagcacccugaucuucuacaaguacugcgaccacgagaacgccgccuucaaggacguggcccuggugcugaccgugcugcuggaggaggagacccugggcaccagccugggccugaaggagguggaggagaaggugagagacuuccugaaggugaaguucaccaacagcaacacccccaacagcuacaaccacauggaccccgacaagcugaacggccuguggagcagaaucagccaccuggugcugcccgugcagcccgagaacgcccugaagagaggcaucugccuguaa

SEQ ID NO: 24924 - RNA, 396 nt, Artificial Sequence
  TOR1AIP2__Homo_sapiens__NP_071742
auguucagcgacaacagccacugccccgacugcggccagcagugguuccccagccuggagcugggccacuggcuguaccagaccgagcugguggagaacgagugcuaccagguguuccuggacagaaucaacagagccgacuacugccccgagugcuaccccgacaaccccgccaacagaagccuggugcugcccuggagcuucccccuggagugggccccccagaaccugaccagauggaccuucgagaaggccugccaccccuuccugcugggccccccccuggugagaaagagaauccacgacagcagaguggccggcuucaaccccgcccugcagcugauccugaccagaaccgacaagacccugaacaagaagcugggccagaacaaguaa

SEQ ID NO: 24925 - RNA, 1011 nt, Artificial Sequence
  TOR1B__Homo_sapiens__NP_055321
augcugagagccggcuggcugagaggcgccgccgcccuggcccugcugcuggccgccagagugguggccgccuucgagcccaucaccgugggccuggccaucggcgccgccagcgccaucaccggcuaccugagcuacaacgacaucuacugcagauucgccgagugcugcagagaggagagaccccugaacgccagcgcccugaagcuggaccuggaggagaagcuguucggccagcaccuggccaccgaggugaucuucaaggcccugaccggcuucagaaacaacaagaaccccaagaagccccugacccugagccugcacggcugggccggcaccggcaagaacuucgugagccagaucguggccgagaaccugcaccccaagggccugaagagcaacuucgugcaccuguucgugagcacccugcacuucccccacgagcagaagaucaagcuguaccaggaccagcugcagaaguggaucagaggcaacgugagcgccugcgccaacagcguguucaucuucgacgagauggacaagcugcaccccggcaucaucgacgccaucaagcccuuccuggacuacuacgagcagguggacggcgugagcuacagaaaggccaucuucaucuuccugagcaacgccggcggcgaccugaucaccaagaccgcccuggacuucuggagagccggcagaaagagagaggacauccagcugaaggaccuggagcccgugcugagcgugggcguguucaacaacaagcacagcggccuguggcacagcggccugaucgacaagaaccugaucgacuacuucauccccuuccugccccuggaguacagacacgugaagaugugcgugagagccgagaugagagccagaggcagcgccaucgacgaggacaucgugaccagaguggccgaggagaugaccuucuuccccagagacgagaagaucuacagcgacaagggcugcaagaccgugcagagcagacuggacuuccacuaa

SEQ ID NO: 24926 - RNA, 966 nt, Artificial Sequence
  TOR2A__Homo_sapiens__NP_001078816
auggccgccgccaccagaggcugcagacccuggggcagccugcugggccugcugggccuggugagcgccgccgccgccgccugggaccuggccagccugagaugcacccugggcgccuucugcgagugcgacuucagacccgaccugcccggccuggagugcgaccuggcccagcaccuggccggccagcaccuggccaaggcccugguggugaaggcccugaaggccuucgugagagaccccgcccccaccaagccccuggugcugagccugcacggcuggaccggcaccggcaagagcuacgugagcagccugcuggcccacuaccuguuccagggcggccugagaagccccagagugcaccacuucagccccgugcugcacuucccccaccccagccacaucgagagauacaagaaggaccugaagagcugggugcagggcaaccugaccgccugcggcagaagccuguuccuguucgacgagauggacaagaugccccccggccugauggaggugcugagacccuuccugggcagcagcugggugguguacggcaccaacuacagaaaggccaucuucaucuucaucagcaacaccggcggcgagcagaucaaccagguggcccuggaggccuggagaagcagaagagacagagaggagauccugcugcaggagcuggagcccgugaucagcagagccgugcuggacaacccccaccacggcuucagcaacagcggcaucauggaggagagacugcuggacgccguggugcccuuccugccccugcagagacaccacgugagacacugcgugcugaacgagcuggcccagcugggccuggagcccagagacgagguggugcaggccgugcuggacagcaccaccuucuuccccgaggacgagcagcuguucagcagcaacggcugcaagaccguggccagcagaaucgccuucuuccuguaa

SEQ ID NO: 24927 - RNA, 1395 nt, Artificial Sequence
  TOX2__Homo_sapiens__NP_001092266
augagcgacggcaaccccgagcugcugagcaccagccagaccuacaacggccagagcgagaacaacgaggacuacgagaucccccccaucaccccccccaaccugcccgagcccagccugcugcaccugggcgaccacgaggccagcuaccacagccugugccacggccugacccccaacggccugcugcccgccuacagcuaccaggccauggaccugcccgccaucauggugagcaacaugcuggcccaggacagccaccugcugagcggccagcugcccaccauccaggagauggugcacagcgagguggccgccuacgacagcggcagacccggcccccugcugggcagacccgccaugcuggccagccacaugagcgcccugagccagagccagcugaucagccagaugggcaucagaagcagcaucgcccacagcagccccagcccccccggcagcaagagcgccacccccagccccagcagcagcacccaggaggaggagagcgaggugcacuucaagaucagcggcgagaagagacccagcgccgaccccggcaagaaggccaagaaccccaagaagaagaagaagaaggaccccaacgagccccagaagcccgugagcgccuacgcccuguucuucagagacacccaggccgccaucaagggccagaaccccagcgccaccuucggcgacgugagcaagaucguggccagcaugugggacagccugggcgaggagcagaagcaggccuacaagagaaagaccgaggccgccaagaaggaguaccugaaggcccuggccgccuacagagccagccuggugagcaagagcagccccgaccagggcgagaccaagagcacccaggccaacccccccgccaagaugcugccccccaagcagcccauguacgccaugcccggccuggccagcuuccugacccccagcgaccugcaggccuucagaagcggcgccagccccgccagccuggccagaacccugggcagcaagagccugcugcccggccugagcgccagccccccccccccccccagcuucccccugagccccacccugcaccagcagcugagccugcccccccacgcccagggcgcccugcugagcccccccgugagcaugagccccgccccccagccccccgugcugcccacccccauggcccugcaggugcagcuggccaugagccccagcccccccggcccccaggacuucccccacaucagcgaguuccccagcagcagcggcagcugcagccccggccccagcaaccccaccagcagcggcgacugggacagcagcuaccccagcggcgagugcggcaucagcaccugcagccugcugcccagagacaagagccuguaccugaccuaa

SEQ ID NO: 24928 - RNA, 1731 nt, Artificial Sequence
  TOX3__Homo_sapiens__NP_001073899
auggacgugagauucuaccccgccgccgccggcgaccccgccagccuggacuucgcccagugccugggcuacuacggcuacagcaaguucggcaacaacaacaacuacaugaacauggccgaggccaacaacgccuucuucgccgccagcgagcagaccuuccacacccccagccugggcgacgaggaguucgagaucccccccaucacccccccccccgagagcgaccccgcccugggcaugcccgacgugcugcugcccuuccaggcccugagcgacccccugcccagccagggcagcgaguucaccccccaguuccccccccagagccuggaccugcccagcaucaccaucagcagaaaccugguggagcaggacggcgugcugcacagcagcggccugcacauggaccagagccacacccaggugagccaguacagacaggaccccagccugaucaugagaagcaucgugcacaugaccgacgccgccagaagcggcgugaugccccccgcccagcugaccaccaucaaccagagccagcugagcgcccagcugggccugaaccugggcggcgccagcaugccccacaccagccccagcccccccgccagcaagagcgccacccccagccccagcagcagcaucaacgaggaggacgccgacgaggccaacagagccaucggcgagaagagagccgcccccgacagcggcaagaagcccaagacccccaagaagaagaagaagaaggaccccaacgagccccagaagcccgugagcgccuacgcccuguucuucagagacacccaggccgccaucaagggccagaaccccaacgccaccuucggcgaggugagcaagaucguggccagcaugugggacagccugggcgaggagcagaagcagguguacaagagaaagaccgaggccgccaagaaggaguaccugaaggcccuggccgccuacagagccagccuggugagcaaggccgccgccgagagcgccgaggcccagaccaucagaagcgugcagcagacccuggccagcaccaaccugaccagcagccugcugcugaacaccccccugagccagcacggcaccgugagcgccagcccccagacccugcagcagagccugcccagaagcaucgcccccaagccccugaccaugagacugcccaugaaccagaucgugaccagcgugaccaucgccgccaacaugcccagcaacaucggcgccccccugaucagcagcaugggcaccaccauggugggcagcgcccccagcacccaggugagccccagcgugcagacccagcagcaccagaugcagcugcagcagcagcagcagcagcagcagcagcagaugcagcagaugcagcagcagcagcugcagcagcaccagaugcaccagcagauccagcagcagaugcagcagcagcacuuccagcaccacaugcagcagcaccugcagcagcagcagcagcaccugcagcagcagaucaaccagcagcagcugcagcagcagcugcagcagagacugcagcugcagcagcugcagcacaugcagcaccagagccagcccagccccagacagcacagccccguggccagccagaucaccagccccauccccgccaucggcagcccccagcccgccagccagcagcaccagagccagauccagagccagacccagacccaggugcugagccaggugagcaucuucuaa

SEQ ID NO: 24929 - RNA, 1797 nt, Artificial Sequence
  TOX4__Homo_sapiens__NP_001290452
auggagaccuuccacacccccagccugggcgacgaggaguucgagaucccccccaucagccuggacagcgaccccagccuggccgugagcgacguggugggccacuucgacgaccuggccgaccccagcagcagccaggacggcagcuucagcgcccaguacggcgugcagacccuggacaugcccgugggcaugacccacggccugauggagcagggcggcggccugcugagcggcggccugaccauggaccuggaccacagcaucggcacccaguacagcgccaacccccccgugaccaucgacgugcccaugaccgacaugaccagcggccugaugggccacagccagcugaccaccaucgaccagagcgagcugagcagccagcugggccugagccugggcggcggcaccauccugccccccgcccagagccccgaggacagacugagcaccacccccagccccaccagcagccugcacgaggacggcguggaggacuucagaagacagcugcccagccagaagaccguggugguggaggccggcaagaagcagaaggcccccaagaagagaaagaagaaggaccccaacgagccccagaagcccgugagcgccuacgcccuguucuucagagacacccaggccgccaucaagggccagaaccccaacgccaccuucggcgaggugagcaagaucguggccagcaugugggacagccugggcgaggagcagaagcagguguacaagagaaagaccgaggccgccaagaaggaguaccugaaggcccuggccgccuacaaggacaaccaggagugccaggccaccguggagaccguggagcuggaccccgccccccccagccagacccccagccccccccccauggccaccguggaccccgccagccccgcccccgccagcaucgagccccccgcccugagccccagcaucguggugaacagcacccugagcagcuacguggccaaccaggccagcagcggcgccggcggccagcccaacaucaccaagcugaucaucaccaagcagaugcugcccagcagcaucaccaugagccagggcggcauggugaccgugauccccgccaccguggugaccagcagaggccugcagcugggccagaccagcaccgccaccauccagcccagccagcaggcccagaucgugaccagaagcgugcugcaggccgccgccgccgccgccgccgccgccagcaugcagcugcccccccccagacugcagccccccccccugcagcagaugccccagccccccacccagcagcaggugaccauccugcagcagccccccccccugcaggccaugcagcagccccccccccagaaggugagaaucaaccugcagcagcagccccccccccugcagaucaagagcgugccccugcccacccugaagaugcagaccacccuggugccccccaccguggagagcagccccgagagacccaugaacaacagccccgaggcccacaccguggaggcccccagccccgagaccaucugcgagaugaucaccgacguggugcccgagguggagagccccagccagauggacguggagcuggugagcggcagccccguggcccugagcccccagcccagaugcgugagaagcggcugcgagaacccccccaucgugagcaaggacugggacaacgaguacugcagcaacgagugcguggugaagcacugcagagacguguuccuggccuggguggccagcagaaacagcaacaccgugguguucgugaaguaa

SEQ ID NO: 24930 - RNA, 1581 nt, Artificial Sequence
  TOX__Homo_sapiens__NP_055544
auggacgugagauucuaccccccccccgcccagcccgccgccgcccccgacgcccccugccugggccccagccccugccuggaccccuacuacugcaacaaguucgacggcgagaacauguacaugagcaugaccgagcccagccaggacuacgugcccgccagccagagcuaccccggccccagccuggagagcgaggacuucaacaucccccccaucaccccccccagccugcccgaccacagccuggugcaccugaacgagguggagagcggcuaccacagccugugccaccccaugaaccacaacggccugcugcccuuccacccccagaacauggaccugcccgagaucaccgugagcaacaugcugggccaggacggcacccugcugagcaacagcaucagcgugaugcccgacaucagaaaccccgagggcacccaguacagcagccacccccagauggccgccaugagacccagaggccagcccgccgacaucagacagcagcccggcaugaugccccacggccagcugaccaccaucaaccagagccagcugagcgcccagcugggccugaacaugggcggcagcaacgugccccacaacagccccagcccccccggcagcaagagcgccacccccagccccagcagcagcgugcacgaggacgagggcgacgacaccagcaagaucaacggcggcgagaagagacccgccagcgacaugggcaagaagcccaagacccccaagaagaagaagaagaaggaccccaacgagccccagaagcccgugagcgccuacgcccuguucuucagagacacccaggccgccaucaagggccagaaccccaacgccaccuucggcgaggugagcaagaucguggccagcaugugggacggccugggcgaggagcagaagcagguguacaagaagaagaccgaggccgccaagaaggaguaccugaagcagcuggccgccuacagagccagccuggugagcaagagcuacagcgagcccguggacgugaagaccagccagcccccccagcugaucaacagcaagcccagcguguuccacggccccagccaggcccacagcgcccuguaccugagcagccacuaccaccagcagcccggcaugaacccccaccugaccgccaugcaccccagccugcccagaaacaucgcccccaagcccaacaaccagaugcccgugaccgugagcaucgccaacauggccgugagccccccccccccccugcagaucagccccccccugcaccagcaccugaacaugcagcagcaccagccccugaccaugcagcagccccugggcaaccagcugcccaugcaggugcagagcgcccugcacagccccaccaugcagcagggcuucacccugcagcccgacuaccagaccaucaucaaccccaccagcaccgccgcccagguggugacccaggccauggaguacgugagaagcggcugcagaaacccccccccccagcccguggacuggaacaacgacuacugcagcagcggcggcaugcagagagacaaggcccuguaccugaccuaa

SEQ ID NO: 24931 - RNA, 363 nt, Artificial Sequence
  TP53AIP1__Homo_sapiens__NP_001182123
augggcagcagcagcgaggccagcuucagaagcgcccaggccagcugcagcggcgccagaagacagggccugggcagaggcgaccagaaccugagcgugaugccccccaacggcagagcccagacccacacccccggcugggugagcgacccccuggugcugggcgcccaggugcacggcggcugcagaggcaucgaggcccugagcgugagcagcggcagcuggagcagcgccaccguguggauccugaccggccugagcagacccuuccugcccggcgccaccgugcugagagacagaccccugggcagcgccuucgagcugagcuacgaccagaagaaggccccccugagacugcaguaa

SEQ ID NO: 24932 - RNA, 5928 nt, Artificial Sequence
  TP53BP1__Homo_sapiens__NP_001135451
augcccggcgagcagauggaccccaccggcagccagcuggacagcgacuucagccagcaggacacccccugccugaucaucgaggacagccagcccgagagccaggugcuggaggacgacagcggcagccacuucagcaugcugagcagacaccugcccaaccugcagacccacaaggagaaccccgugcuggacguggugagcaaccccgagcagaccgccggcgaggagagaggcgacggcaacagcggcuucaacgagcaccugaaggagaacaagguggccgaccccguggacagcagcaaccuggacaccugcggcagcaucagccaggugaucgagcagcugccccagcccaacagaaccagcagcgugcugggcaugagcguggagagcgcccccgccguggaggaggagaagggcgaggagcuggagcagaaggagaaggagaaggaggaggacaccagcggcaacaccacccacagccugggcgccgaggacaccgccagcagccagcugggcuucggcgugcuggagcugagccagagccaggacguggaggagaacaccgugcccuacgagguggacaaggagcagcugcagagcgugaccaccaacagcggcuacaccagacugagcgacguggacgccaacaccgccaucaagcacgaggagcagagcaacgaggacauccccaucgccgagcagagcagcaaggacauccccgugaccgcccagcccagcaaggacgugcacguggugaaggagcagaaccccccccccgccagaagcgaggacaugcccuucagccccaaggccagcguggccgccauggaggccaaggagcagcugagcgcccaggagcugauggagagcggccugcagauccagaagagccccgagcccgaggugcugagcacccaggaggaccuguucgaccagagcaacaagaccgugagcagcgacggcugcagcacccccagcagagaggagggcggcugcagccuggccagcacccccgccaccacccugcaccugcugcagcugagcggccagagaagccuggugcaggacagccugagcaccaacagcagcgaccugguggcccccagccccgacgccuucagaagcacccccuucaucgugcccagcagccccaccgagcaggagggcagacaggacaagcccauggacaccagcgugcugagcgaggagggcggcgagcccuuccagaagaagcugcagagcggcgagcccguggagcuggagaaccccccccugcugcccgagagcaccgugagcccccaggccagcacccccaucagccagagcacccccguguucccccccggcagccugcccauccccagccagccccaguucagccacgacaucuucauccccagccccagccuggaggagcagagcaacgacggcaagaaggacggcgacaugcacagcagcagccugaccguggagugcagcaagaccagcgagaucgagcccaagaacagccccgaggaccugggccugagccugaccggcgacagcugcaagcugaugcugagcaccagcgaguacagccagagccccaagauggagagccugagcagccacagaaucgacgaggacggcgagaacacccagaucgaggacaccgagcccaugagccccgugcugaacagcaaguucgugcccgccgagaacgacagcauccugaugaaccccgcccaggacggcgaggugcagcugagccagaacgacgacaagaccaagggcgacgacaccgacaccagagacgacaucagcauccuggccaccggcugcaagggcagagaggagaccguggccgaggacgugugcaucgaccugaccugcgacagcggcagccaggccgugcccagccccgccaccagaagcgaggcccugagcagcgugcuggaccaggaggaggccauggagaucaaggagcaccaccccgaggagggcagcagcggcagcgagguggaggagauccccgagacccccugcgagagccagggcgaggagcugaaggaggagaacauggagagcgugccccugcaccugagccugaccgagacccagagccagggccugugccugcagaaggagaugcccaagaaggagugcagcgaggccauggagguggagaccagcgugaucagcaucgacagcccccagaagcuggccauccuggaccaggagcuggagcacaaggagcaggaggccugggaggaggccaccagcgaggacagcagcguggugaucguggacgugaaggagcccagccccagaguggacgugagcugcgagccccuggagggcguggagaagugcagcgacagccagagcugggaggacaucgcccccgagaucgagcccugcgccgagaacagacuggacaccaaggaggagaagagcguggaguacgagggcgaccugaagagcggcaccgccgagaccgagcccguggagcaggacagcagccagcccagccugccccuggugagagccgacgacccccugagacuggaccaggagcugcagcagccccagacccaggagaagaccagcaacagccugaccgaggacagcaagauggccaacgccaagcagcugagcagcgacgccgaggcccagaagcugggcaagcccagcgcccacgccagccagagcuucugcgagagcagcagcgagacccccuuccacuucacccugcccaaggagggcgacaucauccccccccugaccggcgccacccccccccugaucggccaccugaagcuggagcccaagagacacagcacccccaucggcaucagcaacuaccccgagagcaccaucgccaccagcgacgugaugagcgagagcaugguggagacccacgaccccauccugggcagcggcaagggcgacagcggcgccgcccccgacguggacgacaagcugugccugagaaugaagcuggugagccccgagaccgaggccagcgaggagagccugcaguucaaccuggagaagcccgccaccggcgagagaaagaacggcagcaccgccguggccgagagcguggccagcccccagaagaccaugagcgugcugagcugcaucugcgaggccagacaggagaacgaggccagaagcgaggacccccccaccacccccaucagaggcaaccugcugcacuuccccagcagccagggcgaggaggagaaggagaagcuggagggcgaccacaccaucagacagagccagcagcccaugaagcccaucagccccgugaaggaccccgugagccccgccagccagaagauggugauccagggccccagcagcccccagggcgaggccauggugaccgacgugcuggaggaccagaaggagggcagaagcaccaacaaggagaaccccagcaaggcccugaucgagagacccagccagaacaacaucggcauccagaccauggagugcagccugagagugcccgagaccgugagcgccgccacccagaccaucaagaacgugugcgagcagggcaccagcaccguggaccagaacuucggcaagcaggacgccaccgugcagaccgagagaggcagcggcgagaagcccgugagcgcccccggcgacgacaccgagagccugcacagccagggcgaggaggaguucgacaugccccagcccccccacggccacgugcugcacagacacaugagaaccaucagagaggugagaacccuggugaccagagugaucaccgacguguacuacguggacggcaccgagguggagagaaaggugaccgaggagaccgaggagcccaucguggagugccaggagugcgagaccgaggugagccccagccagaccggcggcagcagcggcgaccugggcgacaucagcagcuucagcagcaaggccagcagccugcacagaaccagcagcggcaccagccugagcgccaugcacagcagcggcagcagcggcaagggcgccggcccccugagaggcaagaccagcggcaccgagcccgccgacuucgcccugcccagcagcagaggcggccccggcaagcugagccccagaaagggcgugagccagaccggcacccccgugugcgaggaggacggcgacgccggccugggcaucagacagggcggcaaggcccccgugacccccagaggcagaggcagaagaggcagaccccccagcagaaccaccggcaccagagagaccgccgugcccggcccccugggcaucgaggacaucagccccaaccugagccccgacgacaagagcuucagcagaguggugcccagagugcccgacagcaccagaagaaccgacgugggcgccggcgcccugagaagaagcgacagccccgagauccccuuccaggccgccgccggccccagcgacggccuggacgccagcagccccggcaacagcuucgugggccugagagugguggccaaguggagcagcaacggcuacuucuacagcggcaagaucaccagagacgugggcgccggcaaguacaagcugcuguucgacgacggcuacgagugcgacgugcugggcaaggacauccugcugugcgaccccaucccccuggacaccgaggugaccgcccugagcgaggacgaguacuucagcgccggcguggugaagggccacagaaaggagagcggcgagcuguacuacagcaucgagaaggagggccagagaaagugguacaagagaauggccgugauccugagccuggagcagggcaacagacugagagagcaguacggccugggccccuacgaggccgugaccccccugaccaaggccgccgacaucagccuggacaaccugguggagggcaagagaaagagaagaagcaacgugagcagccccgccacccccaccgccagcagcagcagcagcaccacccccaccagaaagaucaccgagagccccagagccagcaugggcgugcugagcggcaagagaaagcugaucaccagcgaggaggagagaagccccgccaagagaggcagaaagagcgccaccgugaagcccgugggcgccggcgaguucgugagccccugcgagagcggcgacaacaccggcgagcccagcgcccuggaggagcagagaggcccccugccccugaacaagacccuguuccugggcuacgccuuccugcugaccauggccaccaccagcgacaagcuggccagcagaagcaagcugcccgacggccccaccggcagcagcgaggaggaggaggaguuccuggagaucccccccuucaacaagcaguacaccgagagccagcugagagccggcgccggcuacauccuggaggacuucaacgaggcccagugcaacaccgccuaccagugccugcugaucgccgaccagcacugcagaaccagaaaguacuuccugugccuggccagcggcauccccugcgugagccacgugugggugcacgacagcugccacgccaaccagcugcagaacuacagaaacuaccugcugcccgccggcuacagccuggaggagcagagaauccuggacuggcagcccagagagaaccccuuccagaaccugaaggugcugcuggugagcgaccagcagcagaacuuccuggagcuguggagcgagauccugaugaccggcggcgccgccagcgugaagcagcaccacagcagcgcccacaacaaggacaucgcccugggcguguucgacgugguggugaccgaccccagcugccccgccagcgugcugaagugcgccgaggcccugcagcugcccguggugagccaggagugggugauccagugccugaucgugggcgagagaaucggcuucaagcagcaccccaaguacaagcacgacuacgugagccacuaa

SEQ ID NO: 24933 - RNA, 3405 nt, Artificial Sequence
  TP53BP2__Homo_sapiens__NP_001026855
augagauucggcagcaagaugaugcccauguuccugaccguguaccugagcaacaacgagcagcacuucaccgaggugcccgugacccccgagaccaucugcagagacgugguggaccugugcaaggagcccggcgagagcgacugccaccuggccgagguguggugcggcagcgagagacccguggccgacaacgagagaauguucgacgugcugcagagauucggcagccagagaaacgaggugagauucuuccugagacacgagagaccccccggcagagacaucgugagcggccccagaagccaggaccccagccugaagagaaacggcgugaaggugcccggcgaguacagaagaaaggagaacggcgugaacagccccagaauggaccugacccuggccgagcugcaggagauggccagcagacagcagcagcagaucgaggcccagcagcagcugcuggccaccaaggagcagagacugaaguuccugaagcagcaggaccagagacagcagcagcagguggccgagcaggagaagcugaagagacugaaggagaucgccgagaaccaggaggccaagcugaagaaggugagagcccugaagggccacguggagcagaagagacugagcaacggcaagcugguggaggagaucgagcagaugaacaaccuguuccagcagaagcagagagagcuggugcuggccgugagcaagguggaggagcugaccagacagcuggagaugcugaagaacggcagaaucgacagccaccacgacaaccagagcgccguggccgagcuggacagacuguacaaggagcugcagcugagaaacaagcugaaccaggagcagaacgccaagcugcagcagcagagagagugccugaacaagagaaacagcgagguggccgugauggacaagagagugaacgagcugagagacagacuguggaagaagaaggccgcccugcagcagaaggagaaccugcccgugagcagcgacggcaaccugccccagcaggccgccagcgcccccagcagaguggccgccgugggccccuacauccagagcagcaccaugcccagaaugcccagcagacccgagcugcuggugaagcccgcccugcccgacggcagccuggugauccaggccagcgagggccccaugaagauccagacccugcccaacaugagaagcggcgccgccagccagaccaagggcagcaagauccaccccgugggccccgacuggagccccagcaacgccgaccuguuccccagccagggcagcgccagcgugccccagagcaccggcaacgcccuggaccagguggacgacggcgaggugccccugagagagaaggagaagaaggugagacccuucagcauguucgacgccguggaccagagcaacgccccccccagcuucggcacccugagaaagaaccagagcagcgaggacauccugagagacgcccagguggccaacaagaacguggccaaggugcccccccccgugcccaccaagcccaagcagaucaaccugcccuacuucggccagaccaaccagccccccagcgacaucaagcccgacggcagcagccagcagcugagcaccguggugcccagcaugggcaccaagcccaagcccgccggccagcagcccagagugcugcugagccccagcauccccagcgugggccaggaccagacccugagccccggcagcaagcaggagagcccccccgccgccgccgugagacccuucaccccccagcccagcaaggacacccugcugccccccuucagaaagccccagaccguggccgccagcagcaucuacagcauguacacccagcagcaggcccccggcaagaacuuccagcaggccgugcagagcgcccugaccaagacccacaccagaggcccccacuucagcagcguguacggcaagcccgugaucgccgccgcccagaaccagcagcagcaccccgagaacaucuacagcaacagccagggcaagcccggcagccccgagcccgagaccgagcccgugagcagcgugcaggagaaccacgagaacgagagaauccccagaccccugagccccaccaagcugcugcccuuccugagcaaccccuacagaaaccagagcgacgccgaccuggaggcccugagaaagaagcugagcaacgcccccagaccccugaagaagagaagcagcaucaccgagcccgagggccccaacggccccaacauccagaagcugcuguaccagagaaccaccaucgccgccauggagaccaucagcgugcccagcuaccccagcaagagcgccagcgugaccgccagcagcgagagccccguggagauccagaaccccuaccugcacguggagcccgagaaggagguggugagccuggugcccgagagccugagccccgaggacgugggcaacgccagcaccgagaacagcgacaugcccgcccccagccccggccuggacuacgagcccgagggcgugcccgacaacagccccaaccugcagaacaaccccgaggagcccaaccccgaggccccccacgugcuggacguguaccuggaggaguacccccccuacccccccccccccuaccccagcggcgagcccgagggccccggcgaggacagcgugagcaugagaccccccgagaucaccggccaggugagccugccccccggcaagagaaccaaccugagaaagaccggcagcgagagaaucgcccacggcaugagagugaaguucaacccccuggcccugcugcuggacagcagccuggagggcgaguucgaccuggugcagagaaucaucuacgagguggacgaccccagccugcccaacgacgagggcaucaccgcccugcacaacgccgugugcgccggccacaccgagaucgugaaguuccuggugcaguucggcgugaacgugaacgccgccgacagcgacggcuggaccccccugcacugcgccgccagcugcaacaacgugcaggugugcaaguuccugguggagagcggcgccgccguguucgccaugaccuacagcgacaugcagaccgccgccgacaagugcgaggagauggaggagggcuacacccagugcagccaguuccuguacggcgugcaggagaagaugggcaucaugaacaagggcgugaucuacgcccugugggacuacgagccccagaacgacgacgagcugcccaugaaggagggcgacugcaugaccaucauccacagagaggacgaggacgagaucgagugguggugggccagacugaacgacaaggagggcuacgugcccagaaaccugcugggccuguaccccagaaucaagcccagacagagaagccuggccuaa

SEQ ID NO: 24934 - RNA, 1182 nt, Artificial Sequence
  TP53__Homo_sapiens__NP_000537
auggaggagccccagagcgaccccagcguggagcccccccugagccaggagaccuucagcgaccuguggaagcugcugcccgagaacaacgugcugagcccccugcccagccaggccauggacgaccugaugcugagccccgacgacaucgagcagugguucaccgaggaccccggccccgacgaggcccccagaaugcccgaggccgccccccccguggcccccgcccccgccgcccccacccccgccgcccccgcccccgcccccagcuggccccugagcagcagcgugcccagccagaagaccuaccagggcagcuacggcuucagacugggcuuccugcacagcggcaccgccaagagcgugaccugcaccuacagccccgcccugaacaagauguucugccagcuggccaagaccugccccgugcagcuguggguggacagcacccccccccccggcaccagagugagagccauggccaucuacaagcagagccagcacaugaccgagguggugagaagaugcccccaccacgagagaugcagcgacagcgacggccuggcccccccccagcaccugaucagaguggagggcaaccugagaguggaguaccuggacgacagaaacaccuucagacacagcgugguggugcccuacgagccccccgaggugggcagcgacugcaccaccauccacuacaacuacaugugcaacagcagcugcaugggcggcaugaacagaagacccauccugaccaucaucacccuggaggacagcagcggcaaccugcugggcagaaacagcuucgaggugagagugugcgccugccccggcagagacagaagaaccgaggaggagaaccugagaaagaagggcgagccccaccacgagcugccccccggcagcaccaagagagcccugcccaacaacaccagcagcagcccccagcccaagaagaagccccuggacggcgaguacuucacccugcagaucagaggcagagagagauucgagauguucagagagcugaacgaggcccuggagcugaaggacgcccaggccggcaaggagcccggcggcagcagagcccacagcagccaccugaagagcaagaagggccagagcaccagcagacacaagaagcugauguucaagaccgagggccccgacagcgacuaa

SEQ ID NO: 24935 - RNA, 570 nt, Artificial Sequence
  TP53I11__Homo_sapiens__NP_001245253
auggccgccaagcagccccccccccugaugaagaagcacagccagaccgaccuggugagcagacugaagaccagaaagauccugggcgugggcggcgaggacgacgacggcgaggugcacagaagcaagaucagccaggugcugggcaacgagaucaaguucaccaucagagagccccugggccugagaguguggcaguucgugagcgccgugcuguucagcggcaucgccaucauggcccuggccuuccccgaccagcuguacgacgccguguucgacggcgcccaggugaccagcaagacccccaucagacuguacggcggcgcccugcugagcaucagccugaucauguggaacgcccuguacaccgccgagaaggugaucaucagauggacccugcugaccgaggccugcuacuucggcgugcaguuccugguggugaccgccacccuggccgagaccggccugaugagccugggcauccugcugcugcuggugagcagacugcuguucguggugaucagcaucuacuacuacuaccaggugggcagaagacccaagaaggccuaa

SEQ ID NO: 24936 - RNA, 1182 nt, Artificial Sequence
  TP53I13__Homo_sapiens__NP_612358
auggccccccccccccccagcccccagcugcugcugcuggccgcccuggccagacugcugggccccagcgaggugauggccggccccgccgaggaggccggcgcccacugccccgagagccuguggccccugcccccccaggugagccccagagugaccuacaccagagugagccccggccaggccgaggacgugaccuuccuguaccaccccugcgcccaccccuggcugaagcugcagcuggcccugcuggccuacgccugcauggccaaccccagccugacccccgacuucagccugacccaggacagaccccuggugcugaccgccuggggccuggcccuggagauggccuggguggagcccgccugggccgcccacuggcugaugagaagaagaagaagaaagcagagaaagaagaaggccuggaucuacugcgagagccugagcggccccgcccccagcgagcccacccccggcagaggcagacugugcagaagaggcugcgugcaggcccuggcccuggccuucgcccugagaagcuggagaccccccggcaccgaggugaccagccagggccccagacagcccagcagcagcggcgccaagagaagaagacugagagccgcccugggcccccagcccaccagaagcgcccugagauuccccagcgccagccccggcagccugaaggccaagcagagcauggccggcauccccggcagagagagcaacgcccccagcgugcccaccgugagccugcugcccggcgcccccggcggcaacgccagcagcagaaccgaggcccaggugcccaacggccagggcagccccggcggcugcgugugcagcagccaggccagccccgcccccagagccgccgccccccccagagccgccagaggccccacccccagaaccgaggaggccgccugggccgccauggcccugaccuuccugcuggugcugcugacccuggccacccugugcaccagacugcacagaaacuucagaagaggcgagagcaucuacuggggccccaccgccgacagccaggacaccguggccgccgugcugaagagaagacugcugcagcccagcagaagagugaagagaagcagaagaagaccccugcugccccccacccccgacagcggccccgagggcgagagcagcgaguaa

SEQ ID NO: 24937 - RNA, 747 nt, Artificial Sequence
  TP53I3__Homo_sapiens__NP_001193731
augcuggccgugcacuucgacaagcccggcggccccgagaaccuguacgugaaggagguggccaagcccagccccggcgagggcgaggugcugcugaagguggccgccagcgcccugaacagagccgaccugaugcagagacagggccaguacgaccccccccccggcgccagcaacauccugggccuggaggccagcggccacguggccgagcugggccccggcugccagggccacuggaagaucggcgacaccgccauggcccugcugcccggcggcggccaggcccaguacgugaccgugcccgagggccugcugaugcccauccccgagggccugacccugacccaggccgccgccauccccgaggccuggcugaccgccuuccagcugcugcaccuggugggcaacgugcaggccggcgacuacgugcugauccacgccggccugagcggcgugggcaccgccgccauccagcugaccagaauggccggcgccaucccccuggugaccgccggcagccagaagaagcugcagauggccgagaagcugggcgccgccgccggcuucaacuacaagaaggaggacuucagcgaggccacccugaaguucaccaaggugcaggccaacgccggcgagugcuuccacggcgccaacagcgccagccugcugcacggcggcccccccaccagcgccgccggcagcggccagaaccugcccagcgacagaaaccccggcggccccuaa

SEQ ID NO: 24938 - RNA, 495 nt, Artificial Sequence
  TP53INP1__Homo_sapiens__NP_001129205
auguuccagagacugaacaagauguucgugggcgaggugagcagcagcagcaaccaggagcccgaguucaacgagaaggaggacgacgaguggauccugguggacuucaucgacaccugcaccggcuucagcgccgaggaggaggaggaggaggaggacaucagcgaggagagccccaccgagcaccccagcguguucagcugccugcccgccagccuggagugccuggccgacaccagcgacagcugcuuccugcaguucgagagcugccccauggaggagagcugguucaucacccccccccccugcuucaccgccggcggccugaccaccaucaagguggagaccagccccauggagaaccugcugaucgagcaccccagcaugagcguguacgccgugcacaacagcugccccggccugagcgaggccaccagaggcaccgacgagcugcacagccccagcagccccagagccagaaagagcugccuguaa

SEQ ID NO: 24939 - RNA, 663 nt, Artificial Sequence
  TP53INP2__Homo_sapiens__NP_067025
auguuccagagacugagcagccuguucuucagcacccccagcccccccgaggaccccgacugccccagagccuucgugagcgaggaggacgagguggacggcuggcugaucaucgaccugcccgacagcuacgccgccccccccagccccggcgccgcccccgcccccgccggcagacccccccccgcccccagccugauggacgagagcugguucgugaccccccccgccugcuucaccgccgagggccccggccugggccccgccagacugcagagcagcccccuggaggaccugcugaucgagcaccccagcaugagcguguacgugaccggcagcaccaucgugcuggagcccggcagccccagcccccugcccgacgccgcccugcccgacggcgaccugagcgagggcgagcugacccccgccagaagagagcccagagccgccagacacgccgccccccugcccgccagagccgcccugcuggagaaggccggccaggugagaagacugcagagagccagacagagagccgagagacacgcccugagcgccaaggccgugcagagacagaacagagccagagagagcagacccagaagaagcaagaaccagagcagcuucaucuaccagcccugccagagacaguucaacuacuaa

SEQ ID NO: 24940 - RNA, 762 nt, Artificial Sequence
  TP53RK__Homo_sapiens__NP_291028
auggccgccgccagagccaccacccccgccgacggcgaggagcccgcccccgaggccgaggcccuggccgccgccagagagagaagcagcagauuccugagcggccuggagcuggugaagcagggcgccgaggccagaguguucagaggcagauuccagggcagagccgccgugaucaagcacagauuccccaagggcuacagacaccccgcccuggaggccagacugggcagaagaagaaccgugcaggaggccagagcccugcugagaugcagaagagccggcaucagcgcccccgugguguucuucguggacuacgccagcaacugccuguacauggaggagaucgagggcagcgugaccgugagagacuacauccagagcaccauggagaccgagaagaccccccagggccugagcaaccuggccaagaccaucggccaggugcuggccagaaugcacgacgaggaccugauccacggcgaccugaccaccagcaacaugcugcugaagcccccccuggagcagcugaacaucgugcugaucgacuucggccugagcuucaucagcgcccugcccgaggacaagggcguggaccuguacgugcuggagaaggccuuccugagcacccaccccaacaccgagaccguguucgaggccuuccugaagagcuacagcaccagcagcaagaaggccagacccgugcugaagaagcuggacgaggugagacugagaggcagaaagagaagcauggugggcuaa

SEQ ID NO: 24941 - RNA, 375 nt, Artificial Sequence
  TP53TG3C__Homo_sapiens__NP_001192188
augagagccagccccugcaucagccagcccgccgccagcuggcaccccagacccagcgcccugagacccaccgccggcagcggccccgacaccagaacccccggcaccguggaggacggcagcgcccccugccccgccuucagaagccccgccgugagccccugcggcgaggagcccugcugcuuccagaucagccccgccgaggagacccuggagcugggcagacuggugagccccggcaacugcgacacccugagccccagagccgccggcuucuacgccugccacgugagaagccugauccccugcagaagcaccaagggcagauggccccugaccgccagcgccgccggccugagcagcuucagcggcuaa

SEQ ID NO: 24942 - RNA, 1668 nt, Artificial Sequence
  TP63__Homo_sapiens__NP_001108450
augaacuucgagaccagcagaugcgccacccugcaguacugccccgaccccuacauccagagauucguggagacccccgcccacuucagcuggaaggagagcuacuacagaagcaccaugagccagagcacccagaccaacgaguuccugagccccgagguguuccagcacaucugggacuuccuggagcagcccaucugcagcgugcagcccaucgaccugaacuucguggacgagcccagcgaggacggcgccaccaacaagaucgagaucagcauggacugcaucagaaugcaggacagcgaccugagcgaccccauguggccccaguacaccaaccugggccugcugaacagcauggaccagcagauccagaacggcagcagcagcaccagccccuacaacaccgaccacgcccagaacagcgugaccgcccccagccccuacgcccagcccagcagcaccuucgacgcccugagccccagccccgccauccccagcaacaccgacuaccccggcccccacagcuucgacgugagcuuccagcagagcagcaccgccaagagcgccaccuggaccuacagcaccgagcugaagaagcuguacugccagaucgccaagaccugccccauccagaucaaggugaugaccccccccccccagggcgccgugaucagagccaugcccguguacaagaaggccgagcacgugaccgagguggugaagagaugccccaaccacgagcugagcagagaguucaacgagggccagaucgccccccccagccaccugaucagaguggagggcaacagccacgcccaguacguggaggaccccaucaccggcagacagagcgugcuggugcccuacgagcccccccaggugggcaccgaguucaccaccgugcuguacaacuucaugugcaacagcagcugcgugggcggcaugaacagaagacccauccugaucaucgugacccuggagaccagagacggccaggugcugggcagaagaugcuucgaggccagaaucugcgccugccccggcagagacagaaaggccgacgaggacagcaucagaaagcagcaggugagcgacagcaccaagaacggcgacggcaccaagagacccuucagacagaacacccacggcauccagaugaccagcaucaagaagagaagaagccccgacgacgagcugcuguaccugcccgugagaggcagagagaccuacgagaugcugcugaagaucaaggagagccuggagcugaugcaguaccugccccagcacaccaucgagaccuacagacagcagcagcagcagcagcaccagcaccugcugcagaagcagaccagcauccagagccccagcagcuacggcaacagcagccccccccugaacaagaugaacagcaugaacaagcugcccagcgugagccagcugaucaacccccagcagagaaacgcccugacccccaccaccauccccgacggcaugggcgccaacauccccaugaugggcacccacaugcccauggccggcgacaugaacggccugagccccacccaggcccugccccccccccugagcaugcccagcaccagccacugcaccccccccccccccuaccccaccgacugcagcaucgugagaaucuggcagguguaa

SEQ ID NO: 24943 - RNA, 1911 nt, Artificial Sequence
  TP73__Homo_sapiens__XP_011540366
auggcccagagcaccgccaccagccccgacggcggcaccaccuucgagcaccuguggagcagccuggagcccgacagcaccuacuucgaccugccccagagcagcagaggcaacaacgagguggugggcggcaccgacagcagcauggacguguuccaccuggagggcaugaccaccagcgugauggcccaguucaaccugcugagcagcaccauggaccagaugagcagcagagccgccagcgccagccccuacacccccgagcacgccgccagcgugcccacccacagccccuacgcccagcccagcagcaccuucgacaccaugagccccgcccccgugauccccagcaacaccgacuaccccggcccccaccacuucgaggugaccuuccagcagagcagcaccgccaagagcgccaccuggaccuacagcccccugcugaagaagcuguacugccagaucgccaagaccugccccauccagaucaaggugagcaccccccccccccccggcaccgccaucagagccaugcccguguacaagaaggccgagcacgugaccgacguggugaagagaugccccaaccacgagcugggcagagacuucaacgagggccagagcgcccccgccagccaccugaucagaguggagggcaacaaccugagccaguacguggacgaccccgugaccggcagacagagcgugguggugcccuacgagcccccccaggugggcaccgaguucaccaccauccuguacaacuucaugugcaacagcagcugcgugggcggcaugaacagaagacccauccugaucaucaucacccuggagaugagagacggccaggugcugggcagaagaagcuucgagggcagaaucugcgccugccccggcagagacagaaaggccgacgaggaccacuacagagagcagcaggcccugaacgagagcagcgccaagaacggcgccgccagcaagagagccuucaagcagagcccccccgccgugcccgcccugggcgccggcgugaagaagagaagacacggcgacgaggacaccuacuaccugcaggugagaggcagagagaacuucgagauccugaugaagcugaaggagagccuggagcugauggagcuggugccccagccccugguggacagcuacagacagcagcagcagcugcugcagagacccagccaccugcagccccccagcuacggccccgugcugagccccaugaacaaggugcacggcggcaugaacaagcugcccagcgugaaccagcuggugggccagccccccccccacagcagcgccgccacccccaaccugggccccgugggccccggcaugcugaacaaccacggccacgccgugcccgccaacggcgagaugagcagcagccacagcgcccagagcauggugagcggcagccacugcaccccccccccccccuaccacgccgaccccagccuggugagcuuccugaccggccugggcugccccaacugcaucgaguacuucaccagccagggccugcagagcaucuaccaccugcagaaccugaccaucgaggaccugggcgcccugaagauccccgagcaguacagaaugaccaucuggagaggccugcaggaccugaagcagggccacgacuacagcaccgcccagcagcugcugagaagcagcaacgccgccaccaucagcaucggcggcagcggcgagcugcagagacagagagugauggaggccgugcacuucagagugagacacaccaucaccauccccaacagaggcggccccggcggcggccccgacgagugggccgacuucggcuucgaccugcccgacugcaaggccagaaagcagcccaucaaggaggaguucaccgaggccgagauccacuaa

SEQ ID NO: 24944 - RNA, 1263 nt, Artificial Sequence
  TPBG__Homo_sapiens__XP_011534399
augcccggcggcugcagcagaggccccgccgccggcgacggcagacugagacuggccagacuggcccuggugcugcugggcugggugagcagcagcagccccaccagcagcgccagcagcuucagcagcagcgcccccuuccuggccagcgccgugagcgcccagcccccccugcccgaccagugccccgcccugugcgagugcagcgaggccgccagaaccgugaagugcgugaacagaaaccugaccgaggugcccaccgaccugcccgccuacgugagaaaccuguuccugaccggcaaccagcuggccgugcugcccgccggcgccuucgccagaagacccccccuggccgagcuggccgcccugaaccugagcggcagcagacuggacgaggugagagccggcgccuucgagcaccugcccagccugagacagcuggaccugagccacaacccccuggccgaccugagccccuucgccuucagcggcagcaacgccagcgugagcgcccccagcccccugguggagcugauccugaaccacaucgugccccccgaggacgagagacagaacagaagcuucgagggcauggugguggccgcccugcuggccggcagagcccugcagggccugagaagacuggagcuggccagcaaccacuuccuguaccugcccagagacgugcuggcccagcugcccagccugagacaccuggaccugagcaacaacagccuggugagccugaccuacgugagcuucagaaaccugacccaccuggagagccugcaccuggaggacaacgcccugaaggugcugcacaacggcacccuggccgagcugcagggccugccccacaucagaguguuccuggacaacaaccccugggugugcgacugccacauggccgacauggugaccuggcugaaggagaccgagguggugcagggcaaggacagacugaccugcgccuaccccgagaagaugagaaacagagugcugcuggagcugaacagcgccgaccuggacugcgaccccauccugccccccagccugcagaccagcuacguguuccugggcaucgugcuggcccugaucggcgccaucuuccugcuggugcuguaccugaacagaaagggcaucaagaaguggaugcacaacaucagagacgccugcagagaccacauggagggcuaccacuacagauacgagaucaacgccgaccccagacugaccaaccugagcagcaacagcgacguguaa

SEQ ID NO: 24945 - RNA, 2667 nt, Artificial Sequence
  TPCN1__Homo_sapiens__NP_001137291
auggagagcugcuacaucgcccaggccggccuggagcugcugggcagcagcagcagccccacccugaccagccagagcgccgagaucaccgaggacgccagcaacggcggcgugagcgagcagcaccccuggcccagcggcuucgagagagagcugaagcccgagaccaucagcagccccggcuaccacauccugagagccaccggcgaggagaacauggccgugagccuggacgacgacgugccccugauccugacccuggacgagggcggcagcgccccccuggcccccagcaacggccugggccaggaggagcugcccagcaagaacggcggcagcuacgccauccacgacagccaggcccccagccugagcagcggcggcgagagcagccccagcagccccgcccacaacugggagaugaacuaccaggaggccgccaucuaccugcaggagggcgagaacaacgacaaguucuucacccaccccaaggacgccaaggcccuggccgccuaccuguucgcccacaaccaccuguucuaccugauggagcuggccaccgcccugcugcugcugcugcugagccugugcgaggcccccgccgugcccgcccugagacugggcaucuacgugcacgccacccuggagcuguucgcccugaugguggugguguucgagcugugcaugaagcugagauggcugggccugcacaccuucaucagacacaagagaaccauggugaagaccagcgugcugguggugcaguucguggaggccaucguggugcuggugagacagaugagccacgugagagugaccagagcccugagaugcaucuuccugguggacugcagauacugcggcggcgugagaagaaaccugagacagaucuuccagagccugccccccuucauggacauccugcugcugcugcuguucuucaugaucaucuucgccauccugggcuucuaccuguucagccccaaccccagcgaccccuacuucagcacccuggagaacagcaucgugagccuguucgugcugcugaccaccgccaacuuccccgacgugaugaugcccagcuacagcagaaaccccuggagcugcguguucuucaucguguaccugagcaucgagcuguacuucaucaugaaccugcugcuggccgugguguucgacaccuucaacgacaucgagaagagaaaguucaagagccugcugcugcacaagagaaccgccauccagcacgccuacagacugcugaucagccagagaagacccgccggcaucagcuacagacaguucgagggccugaugagauucuacaagcccagaaugagcgccagagagagauaccugaccuucaaggcccugaaccagaacaacaccccccugcugagccugaaggacuucuacgacaucuacgagguggccgcccugaaguggaaggccaagaagaacagagagcacugguucgacgagcugcccagaaccgcccugcugaucuucaagggcaucaacauccuggugaagagcaaggccuuccaguacuucauguaccuggugguggccgugaacggcguguggauccugguggagaccuucaugcugaagggcggcaacuucuucagcaagcacgugcccuggagcuaccugguguuccugaccaucuacggcguggagcuguuccugaagguggccggccugggccccguggaguaccugagcagcggcuggaaccuguucgacuucagcgugaccguguucgccuuccugggccugcuggcccuggcccugaacauggagcccuucuacuucaucguggugcugagaccccugcagcugcugagacuguucaagcugaaggagagauacagaaacgugcuggacaccauguucgagcugcugcccagaauggccagccugggccugacccugcugaucuucuacuacagcuucgccaucgugggcauggaguucuucugcggcaucguguuccccaacugcugcaacaccagcaccguggccgacgccuacagauggagaaaccacaccgugggcaacagaaccgugguggaggagggcuacuacuaccugaacaacuucgacaacauccugaacagcuucgugacccuguucgagcugaccguggugaacaacugguacaucaucauggagggcgugaccagccagaccagccacuggagcagacuguacuucaugaccuucuacaucgugaccaugguggugaugaccaucaucguggccuucauccuggaggccuucguguucagaaugaacuacagcagaaagaaccaggacagcgagguggacggcggcaucacccuggagaaggagaucagcaaggaggagcugguggccgugcuggagcuguacagagaggccagaggcgccagcagcgacgugaccagacugcuggagacccugagccagauggagagauaccagcagcacagcaugguguuccugggcagaagaagcagaaccaagagcgaccugagccugaagauguaccaggaggagauccaggagugguacgaggagcacgccagagagcaggagcagcagagacagcugagcagcagcgccgcccccgccgcccagcagccccccggcagcagacagagaagccagaccgugaccuaa

SEQ ID NO: 24946 - RNA, 2259 nt, Artificial Sequence
  TPCN2__Homo_sapiens__NP_620714
auggccgagccccaggccgagagcgagccccugcugggcggcgccagaggcggcggcggcgacuggcccgccggccugaccaccuacagaagcauccaggugggccccggcgccgccgccagaugggaccugugcaucgaccaggccgugguguucaucgaggacgccauccaguacagaagcaucaaccacagaguggacgccagcagcauguggcuguacagaagauacuacagcaacgugugccagagaacccugagcuucaccaucuuccugauccuguuccuggccuucaucgagacccccagcagccugaccagcaccgccgacgugagauacagagccgcccccugggagccccccugcggccugaccgagagcguggaggugcugugccugcugguguucgccgccgaccugagcgugaagggcuaccuguucggcugggcccacuuccagaagaaccuguggcugcugggcuaccugguggugcugguggugagccugguggacuggaccgugagccugagccuggugugccacgagccccugagaaucagaagacugcugagacccuucuuccugcugcagaacagcagcaugaugaagaagacccugaagugcaucagauggagccugcccgagauggccagcgugggccugcugcuggccauccaccugugccuguucaccauguucggcaugcugcuguucgccggcggcaagcaggacgacggccaggacagagagagacugaccuacuuccagaaccugcccgagagccugaccagccugcuggugcugcugaccaccgccaacaaccccgacgugaugauccccgccuacagcaagaacagagccuacgccaucuucuucaucguguucaccgugaucggcagccuguuccugaugaaccugcugaccgccaucaucuacagccaguucagaggcuaccugaugaagagccugcagaccagccuguucagaagaagacugggcaccagagccgccuucgaggugcugagcagcauggugggcgagggcggcgccuucccccaggccgugggcgugaagccccagaaccugcugcaggugcugcagaaggugcagcuggacagcagccacaagcaggccaugauggagaaggugagaagcuacggcagcgugcugcugagcgccgaggaguuccagaagcuguucaacgagcuggacagaagcguggugaaggagcacccccccagacccgaguaccagagccccuuccugcagagcgcccaguuccuguucggccacuacuacuucgacuaccugggcaaccugaucgcccuggccaaccuggugagcaucugcguguuccuggugcuggacgccgacgugcugcccgccgagagagacgacuucauccugggcauccugaacugcguguucaucguguacuaccugcuggagaugcugcugaagguguucgcccugggccugagaggcuaccugagcuaccccagcaacguguucgacggccugcugaccguggugcugcuggugcuggagaucagcacccuggccguguacagacugccccaccccggcuggagacccgagauggugggccugcugagccugugggacaugaccagaaugcugaacaugcugaucguguucagauuccugagaaucauccccagcaugaagcugauggccgugguggccagcaccgugcugggccuggugcagaacaugagagccuucggcggcauccugguggugguguacuacguguucgccaucaucggcaucaaccuguucagaggcgugaucguggcccugcccggcaacagcagccuggcccccgccaacggcagcgcccccugcggcagcuucgagcagcuggaguacugggccaacaacuucgacgacuucgccgccgcccuggugacccuguggaaccugaugguggugaacaacuggcagguguuccuggacgccuacagaagauacagcggccccuggagcaagaucuacuucgugcugugguggcuggugagcagcgugaucugggugaaccuguuccuggcccugauccuggagaacuuccugcacaagugggaccccagaagccaccugcagccccuggccggcacccccgaggccaccuaccagaugaccguggagcugcuguucagagacauccuggaggagcccggcgaggacgagcugaccgagagacugagccagcacccccaccuguggcugugcagauaa

SEQ ID NO: 24947 - RNA, 675 nt, Artificial Sequence
  TPD52__Homo_sapiens__NP_001020423
auggacugcagagagauggaccuguacgaggacuaccagagccccuucgacuucgacgccggcgugaacaagagcuaccuguaccugagccccagcggcaacagcagcccccccggcagccccacccugcagaaguucggccugcugagaaccgaccccgugcccgaggagggcgaggacguggccgccaccaucagcgccaccgagacccugagcgaggaggagcaggaggagcugagaagagagcuggccaagguggaggaggagauccagacccugagccaggugcuggccgccaaggagaagcaccuggccgagaucaagagaaagcugggcaucaacagccugcaggagcugaagcagaacaucgccaagggcuggcaggacgugaccgccaccagcgccuacaagaagaccagcgagacccugagccaggccggccagaaggccagcgccgccuucagcagcgugggcagcgugaucaccaagaagcuggaggacgugaagaacagccccaccuucaagagcuucgaggagaagguggagaaccugaagagcaaggugggcggcaccaagcccgccggcggcgacuucggcgaggugcugaacagcgccgccaacgccagcgccaccaccaccgagccccugcccgagaagacccaggagagccuguaa

SEQ ID NO: 24948 - RNA, 435 nt, Artificial Sequence
  TPD52L1__Homo_sapiens__NP_001003396
auggaggcccaggcccagggccugcuggagaccgagccccugcagggcaccgacgaggacgccguggccagcgccgacuucagcagcaugcugagcgaggaggagaaggaggagcugaaggccgagcuggugcagcuggaggacgagaucaccacccugagacaggugcugagcgccaaggagagacaccugguggagaucaagcagaagcugggcaugaaccugaugaacgagcugaagcagaacuucagcaagagcuggcacgacaugcagaccaccaccgccuacaagaagacccacgagacccugagccacgccggccagaaggccaccgccgccuucagcaacgugggcaccgccaucagcaagaaguucggcgacaugagcuacagcaucagacacagcaucagcaugcccgccaugagaagaaaguaa

SEQ ID NO: 24949 - RNA, 492 nt, Artificial Sequence
  TPD52L2__Homo_sapiens__NP_001230821
auggacagcgccggccagggcguggccgccagaacccccgccguggagggccugaccgaggccgaggaggaggagcugagagccgagcugaccaagguggaggaggagaucgugacccugagacaggugcuggccgccaaggagagacacugcggcgagcugaagagaagacugggccugagcacccugggcgagcugaagcagaaccugagcagaagcuggcacgacgugcaggugagcagcgccuacaagaagacccaggagacccugagccaggccggccagaagaccagcgccgcccugagcaccgugggcagcgccaucagcagaaagcugggcgacaugagaaacagcgccaccuucaagagcuucgaggacagagugggcaccaucaagagcaagguggugggcgacagagagaacggcagcgacaaccugcccagcagcgccggcagcggcgacaagccccugagcgaccccgcccccuucuaa

SEQ ID NO: 24950 - RNA, 774 nt, Artificial Sequence
  TPGS2__Homo_sapiens__NP_001258879
auggaggaggaggccagcagccccggccugggcugcagcaagccccaccuggagaagcugacccugggcaucaccagaauccuggagagcagccccggcgugaccgaggugaccaucaucgagaagccccccgccgagagacacaugaucagcagcugggagcagaagaacaacugcgugaugcccgaggacgugaagaacuucuaccugaugaccaacggcuuccacaugaccuggagcgugaagcuggacgccagcgacgaccagcccgagaagccccacuucgacagcagaagcgugaucuucgagcuggacagcugcaacggcagcggcaaggugugccugguguacaagagcggcaagcccgcccuggccgaggacaccgagaucugguuccuggacagagcccuguacuggcacuuccugaccgacaccuucaccgccuacuacagacugcugaucacccaccugggccugccccaguggcaguacgccuucaccagcuacggcaucagcccccaggccaagcagugguucagcauguacaagcccaucaccuacaacaccaaccugcugaccgaggagaccgacagcuucgugaacaagcuggaccccagcaagguguucaagagcaagaacaagaucgugauccccaagaagaagggccccgugcagcccgccggcggccagaagggccccagcggccccagcggccccagcaccagcagcaccagcaagagcagcagcggcagcggcaaccccaccagaaaguaa

SEQ ID NO: 24951 - RNA, 1335 nt, Artificial Sequence
  TPH1__Homo_sapiens__NP_004170
augaucgaggacaacaaggagaacaaggaccacagccuggagagaggcagagccagccugaucuucagccugaagaacgaggugggcggccugaucaaggcccugaagaucuuccaggagaagcacgugaaccugcugcacaucgagagcagaaagagcaagagaagaaacagcgaguucgagaucuucguggacugcgacaucaacagagagcagcugaacgacaucuuccaccugcugaagagccacaccaacgugcugagcgugaaccugcccgacaacuucacccugaaggaggacggcauggagaccgugcccugguuccccaagaagaucagcgaccuggaccacugcgccaacagagugcugauguacggcagcgagcuggacgccgaccaccccggcuucaaggacaacguguacagaaagagaagaaaguacuucgccgaccuggccaugaacuacaagcacggcgaccccauccccaagguggaguucaccgaggaggagaucaagaccuggggcaccguguuccaggagcugaacaagcuguaccccacccacgccugcagagaguaccugaagaaccugccccugcugagcaaguacugcggcuacagagaggacaacaucccccagcuggaggacgugagcaacuuccugaaggagagaaccggcuucagcaucagacccguggccggcuaccugagccccagagacuuccugagcggccuggccuucagaguguuccacugcacccaguacgugagacacagcagcgaccccuucuacacccccgagcccgacaccugccacgagcugcugggccacgugccccugcuggccgagcccagcuucgcccaguucagccaggagaucggccuggccagccugggcgccagcgaggaggccgugcagaagcuggccaccugcuacuucuucaccguggaguucggccugugcaagcaggacggccagcugagaguguucggcgccggccugcugagcagcaucagcgagcugaagcacgcccugagcggccacgccaaggugaagcccuucgaccccaagaucaccugcaagcaggagugccugaucaccaccuuccaggacguguacuucgugagcgagagcuucgaggacgccaaggagaagaugagagaguucaccaagaccaucaagagacccuucggcgugaaguacaaccccuacaccagaagcauccagauccugaaggacaccaagagcaucaccagcgccaugaacgagcugcagcacgaccuggacguggugagcgacgcccuggccaaggugagcagaaagcccagcaucuaa

SEQ ID NO: 24952 - RNA, 1473 nt, Artificial Sequence
  TPH2__Homo_sapiens__NP_775489
augcagcccgccaugaugauguucagcagcaaguacugggccagaagaggcuucagccuggacagcgccgugcccgaggagcaccagcugcugggcagcagcacccugaacaagcccaacagcggcaagaacgacgacaagggcaacaagggcagcagcaagagagaggccgccaccgagagcggcaagaccgccgugguguucagccugaagaacgaggugggcggccuggugaaggcccugagacuguuccaggagaagagagugaacauggugcacaucgagagcagaaagagcagaagaagaagcagcgagguggagaucuucguggacugcgagugcggcaagaccgaguucaacgagcugauccagcugcugaaguuccagaccaccaucgugacccugaacccccccgagaacaucuggaccgaggaggaggagcuggaggacgugcccugguuccccagaaagaucagcgagcuggacaagugcagccacagagugcugauguacggcagcgagcuggacgccgaccaccccggcuucaaggacaacguguacagacagagaagaaaguacuucguggacguggccaugggcuacaaguacggccagcccauccccagaguggaguacaccgaggaggagaccaagaccuggggcgugguguucagagagcugagcaagcuguaccccacccacgccugcagagaguaccugaagaacuucccccugcugaccaaguacugcggcuacagagaggacaacgugccccagcuggaggacgugagcauguuccugaaggagagaagcggcuucaccgugagacccguggccggcuaccugagccccagagacuuccuggccggccuggccuacagaguguuccacugcacccaguacaucagacacggcagcgacccccuguacacccccgagcccgacaccugccacgagcugcugggccacgugccccugcuggccgaccccaaguucgcccaguucagccaggagaucggccuggccagccugggcgccagcgacgaggacgugcagaagcuggccaccugcuacuucuucaccaucgaguucggccugugcaagcaggagggccagcugagagccuacggcgccggccugcugagcagcaucggcgagcugaagcacgcccugagcgacaaggccugcgugaaggccuucgaccccaagaccaccugccugcaggagugccugaucaccaccuuccaggaggccuacuucgugagcgagagcuucgaggaggccaaggagaagaugagagacuucgccaagagcaucaccagacccuucagcguguacuucaaccccuacacccagagcaucgagauccugaaggacaccagaagcaucgagaacguggugcaggaccugagaagcgaccugaacaccgugugcgacgcccugaacaagaugaaccaguaccugggcaucuaa

SEQ ID NO: 24953 - RNA, 750 nt, Artificial Sequence
  TPI1__Homo_sapiens__NP_000356
auggcccccagcagaaaguucuucgugggcggcaacuggaagaugaacggcagaaagcagagccugggcgagcugaucggcacccugaacgccgccaaggugcccgccgacaccgagguggugugcgccccccccaccgccuacaucgacuucgccagacagaagcuggaccccaagaucgccguggccgcccagaacugcuacaaggugaccaacggcgccuucaccggcgagaucagccccggcaugaucaaggacugcggcgccaccuggguggugcugggccacagcgagagaagacacguguucggcgagagcgacgagcugaucggccagaagguggcccacgcccuggccgagggccugggcgugaucgccugcaucggcgagaagcuggacgagagagaggccggcaucaccgagaaggugguguucgagcagaccaaggugaucgccgacaacgugaaggacuggagcaagguggugcuggccuacgagcccgugugggccaucggcaccggcaagaccgccaccccccagcaggcccaggaggugcacgagaagcugagaggcuggcugaagagcaacgugagcgacgccguggcccagagcaccagaaucaucuacggcggcagcgugaccggcgccaccugcaaggagcuggccagccagcccgacguggacggcuuccuggugggcggcgccagccugaagcccgaguucguggacaucaucaacgccaagcaguaa

SEQ ID NO: 24954 - RNA, 585 nt, Artificial Sequence
  TPK1__Homo_sapiens__NP_001035947
auggagcacgccuucaccccccuggagccccugcugagcaccggcaaccugaaguacugccuggugauccugaaccagccccuggacaacuacuucagacaccuguggaacaaggcccugcugagagccugcgccgacggcggcgccaacagacuguacgacaucaccgagggcgagagagagagcuuccugcccgaguucaucaacggcgacuucgacagcaucagacccgaggugagagaguacuacgccaccaagggcugcgagcugaucagcacccccgaccaggaccacaccgacuucaccaagugccugaagaugcugcagaagaagaucgaggagaaggaccugaagggcaagcacagacugcacguggacaccggcauggagggcgacuggugcggccugauccccgugggccagcccugcaugcaggugaccaccaccggccugaaguggaaccugaccaacgacgugcuggccuucggcacccuggugagcaccagcaacaccuacgacggcagcggcguggugaccguggagaccgaccacccccugcuguggaccauggccaucaagagcuaa

SEQ ID NO: 24955 - RNA, 855 nt, Artificial Sequence
  TPM1__Homo_sapiens__NP_000357
auggacgccaucaagaagaagaugcagaugcugaagcuggacaaggagaacgcccuggacagagccgagcaggccgaggccgacaagaaggccgccgaggacagaagcaagcagcuggaggacgagcuggugagccugcagaagaagcugaagggcaccgaggacgagcuggacaaguacagcgaggcccugaaggacgcccaggagaagcuggagcuggccgagaagaaggccaccgacgccgaggccgacguggccagccugaacagaagaauccagcugguggaggaggagcuggacagagcccaggagagacuggccaccgcccugcagaagcuggaggaggccgagaaggccgccgacgagagcgagagaggcaugaaggugaucgagagcagagcccagaaggacgaggagaagauggagauccaggagauccagcugaaggaggccaagcacaucgccgaggacgccgacagaaaguacgaggagguggccagaaagcuggugaucaucgagagcgaccuggagagagccgaggagagagccgagcugagcgagggccaggugagacagcuggaggagcagcugagaaucauggaccagacccugaaggcccugauggccgccgaggacaaguacagccagaaggaggacagauacgaggaggagaucaaggugcugagcgacaagcugaaggaggccgagaccagagccgaguucgccgagagaagcgugaccaagcuggagaagagcaucgacgaccuggaggacgagcuguacgcccagaagcugaaguacaaggccaucagcgaggagcuggaccacgcccugaacgacaugaccagcauguaa

SEQ ID NO: 24956 - RNA, 855 nt, Artificial Sequence
  TPM2__Homo_sapiens__NP_001288155
auggacgccaucaagaagaagaugcagaugcugaagcuggacaaggagaacgccaucgacagagccgagcaggccgaggccgacaagaagcaggccgaggacagaugcaagcagcuggaggaggagcagcaggcccugcagaagaagcugaagggcaccgaggacgagguggagaaguacagcgagagcgugaaggaggcccaggagaagcuggagcaggccgagaagaaggccaccgacgccgaggccgacguggccagccugaacagaagaauccagcugguggaggaggagcuggacagagcccaggagagacuggccaccgcccugcagaagcuggaggaggccgagaaggccgccgacgagagcgagagaggcaugaaggugaucgagaacagagccaugaaggacgaggagaagauggagcugcaggagaugcagcugaaggaggccaagcacaucgccgaggacagcgacagaaaguacgaggagguggccagaaagcuggugauccuggagggcgagcuggagagaagcgaggagagagccgagguggccgagagcaagugcggcgaccuggaggaggagcugaagaucgugaccaacaaccugaagagccuggaggcccaggccgacaaguacagcaccaaggaggacaaguacgaggaggagaucaagcugcuggaggagaagcugaaggaggccgagaccagagccgaguucgccgagagaagcguggccaagcuggagaagaccaucgacgaccuggaggagacccuggccagcgccaaggaggagaacguggagauccaccagacccuggaccagacccugcuggagcugaacaaccuguaa

SEQ ID NO: 24957 - RNA, 747 nt, Artificial Sequence
  TPM3__Homo_sapiens__NP_001036816
auggccggcaucaccaccaucgaggccgugaagagaaagauccaggugcugcagcagcaggccgacgacgccgaggagagagccgagagacugcagagagagguggagggcgagagaagagccagagagcaggccgaggccgagguggccagccugaacagaagaauccagcugguggaggaggagcuggacagagcccaggagagacuggccaccgcccugcagaagcuggaggaggccgagaaggccgccgacgagagcgagagaggcaugaaggugaucgagaacagagcccugaaggacgaggagaagauggagcugcaggagauccagcugaaggaggccaagcacaucgccgaggaggccgacagaaaguacgaggagguggccagaaagcuggugaucaucgagggcgaccuggagagaaccgaggagagagccgagcuggccgagagcaagugcagcgagcuggaggaggagcugaagaacgugaccaacaaccugaagagccuggaggcccaggccgagaaguacagccagaaggaggacaaguacgaggaggagaucaagauccugaccgacaagcugaaggaggccgagaccagagccgaguucgccgagagaagcguggccaagcuggagaagaccaucgacgaccuggaggacaagcugaagugcaccaaggaggagcaccugugcacccagagaaugcuggaccagacccugcuggaccugaacgagauguaa

SEQ ID NO: 24958 - RNA, 855 nt, Artificial Sequence
  TPM4__Homo_sapiens__NP_001138632
auggaggccaucaagaagaagaugcagaugcugaagcuggacaaggagaacgccaucgacagagccgagcaggccgaggccgacaagaaggccgccgaggacaagugcaagcagguggaggaggagcugacccaccugcagaagaagcugaagggcaccgaggacgagcuggacaaguacagcgaggaccugaaggacgcccaggagaagcuggagcugaccgagaagaaggccagcgacgccgagggcgacguggccgcccugaacagaagaauccagcugguggaggaggagcuggacagagcccaggagagacuggccaccgcccugcagaagcuggaggaggccgagaaggccgccgacgagagcgagagaggcaugaaggugaucgagaacagagccaugaaggacgaggagaagauggagauccaggagaugcagcugaaggaggccaagcacaucgccgaggaggccgacagaaaguacgaggagguggccagaaagcuggugauccuggagggcgagcuggagagagccgaggagagagccgaggugagcgagcugaagugcggcgaccuggaggaggagcugaagaacgugaccaacaaccugaagagccuggaggccgccagcgagaaguacagcgagaaggaggacaaguacgaggaggagaucaagcugcugagcgacaagcugaaggaggccgagaccagagccgaguucgccgagagaaccguggccaagcuggagaagaccaucgacgaccuggaggagaagcuggcccaggccaaggaggagaacgugggccugcaccagacccuggaccagacccugaacgagcugaacugcaucuaa

SEQ ID NO: 24959 - RNA, 738 nt, Artificial Sequence
  TPMT__Homo_sapiens__NP_000358
auggacggcaccagaaccagccuggacaucgaggaguacagcgacaccgaggugcagaagaaccaggugcugacccuggaggaguggcaggacaagugggugaacggcaagaccgccuuccaccaggagcagggccaccagcugcugaagaagcaccuggacaccuuccugaagggcaagagcggccugagaguguucuucccccugugcggcaaggccguggagaugaagugguucgccgacagaggccacagcguggugggcguggagaucagcgagcugggcauccaggaguucuucaccgagcagaaccugagcuacagcgaggagcccaucaccgagauccccggcaccaagguguucaagagcagcagcggcaacaucagccuguacugcugcagcaucuucgaccugcccagaaccaacaucggcaaguucgacaugaucugggacagaggcgcccugguggccaucaaccccggcgacagaaagugcuacgccgacaccauguucagccugcugggcaagaaguuccaguaccugcugugcgugcugagcuacgaccccaccaagcaccccggcccccccuucuacgugccccacgccgagaucgagagacuguucggcaagaucugcaacaucagaugccuggagaagguggacgccuucgaggagagacacaagagcuggggcaucgacugccuguucgagaagcuguaccugcugaccgagaaguaa

SEQ ID NO: 24960 - RNA, 2802 nt, Artificial Sequence
  TPO__Homo_sapiens__NP_001193673
augagagcccuggccgugcugagcgugacccuggugauggccugcaccgaggccuucuuccccuucaucagcagaggcaaggagcugcuguggggcaagcccgaggagagcagagugagcagcgugcuggaggagagcaagagacugguggacaccgccauguacgccaccaugcagagaaaccugaagaagagaggcauccugagccccgcccagcugcugagcuucagcaagcugcccgagcccaccagcggcgugaucgccagagccgccgagaucauggagaccagcauccaggccaugaagagaaaggugaaccugaagacccagcagagccagcaccccaccgacgcccugagcgaggaccugcugagcaucaucgccaacaugagcggcugccugcccuacaugcugccccccaagugccccaacaccugccuggccaacaaguacagacccaucaccggcgccugcaacaacagagaccaccccagauggggcgccagcaacaccgcccuggccagauggcugccccccguguacgaggacggcuucagccagcccagaggcuggaaccccggcuuccuguacaacggcuucccccugccccccgugagagaggugaccagacacgugauccaggugagcaacgagguggugaccgacgacgacagauacagcgaccugcugauggccuggggccaguacaucgaccacgacaucgccuucaccccccagagcaccagcaaggccgccuucggcggcggcgccgacugccagaugaccugcgagaaccagaaccccugcuuccccauccagcugcccgaggaggccagacccgccgccggcaccgccugccugcccuucuacagaagcagcgccgccugcggcaccggcgaccagggcgcccuguucggcaaccugagcaccgccaaccccagacagcagaugaacggccugaccagcuuccuggacgccagcaccguguacggcagcagccccgcccuggagagacagcugagaaacuggaccagcgccgagggccugcugagagugcacgccagacugagagacagcggcagagccuaccugcccuucgugccccccagagcccccgccgccugcgcccccgagcccggcauccccggcgagaccagaggccccugcuuccuggccggcgacggcagagccagcgaggugcccagccugaccgcccugcacacccuguggcugagagagcacaacagacuggccgccgcccugaaggcccugaacgcccacuggagcgccgacgccguguaccaggaggccagaaagguggugggcgcccugcaccagaucaucacccugagagacuacauccccagaauccugggccccgaggccuuccagcaguacgugggccccuacgagggcuacgacagcaccgccaaccccaccgugagcaacguguucagcaccgccgccuucagauucggccacgccaccauccacccccuggugagaagacuggacgccagcuuccaggagcaccccgaccugcccggccuguggcugcaccaggccuucuucagccccuggacccugcugagaggcggcggccuggacccccugaucagaggccugcuggccagacccgccaagcugcaggugcaggaccagcugaugaacgaggagcugaccgagagacuguucgugcugagcaacagcagcacccuggaccuggccagcaucaaccugcagagaggcagagaccacggccugcccggcuacaacgaguggagagaguucugcggccugcccagacuggagacccccgccgaccugagcaccgccaucgccagcagaagcguggccgacaagauccuggaccuguacaagcaccccgacaacaucgacguguggcugggcggccuggccgagaacuuccugcccagagccagaaccggcccccuguucgccugccugaucggcaagcagaugaaggcccugagagacggcgacugguucuggugggagaacagccacguguucaccgacgcccagagaagagagcuggagaagcacagccugagcagagugaucugcgacaacaccggccugaccagagugcccauggacgccuuccaggugggcaaguuccccgaggacuucgagagcugcgacagcaucaccggcaugaaccuggaggccuggagagagaccuucccccaggacgacaagugcggcuuccccgagagcguggagaacggcgacuucgugcacugcgaggagagcggcagaagagugcugguguacagcugcagacacggcuacgagcugcagggcagagagcagcugaccugcacccaggagggcugggacuuccagcccccccugugcaaggacgugaacgagugcgccgacggcgcccacccccccugccacgccagcgccagaugcagaaacaccaagggcggcuuccagugccugugcgccgaccccuacgagcugggcgacgacggcagaaccugcguggacagcggcagacugcccagagugaccuggaucagcaugagccuggccgcccugcugaucggcggcuucgccggccugaccagcaccgugaucugcagauggaccagaaccggcaccaagagcacccugcccaucagcgagaccggcggcggcacccccgagcugagaugcggcaagcaccaggccgugggcaccagcccccagagagccgccgcccaggacagcgagcaggagagcgccggcauggagggcagagacacccacagacugcccagagcccuguaa

SEQ ID NO: 24961 - RNA, 1692 nt, Artificial Sequence
  TPP1__Homo_sapiens__NP_000382
augggccugcaggccugccugcugggccuguucgcccugauccugagcggcaagugcagcuacagccccgagcccgaccagagaagaacccugccccccggcugggugagccugggcagagccgaccccgaggaggagcugagccugaccuucgcccugagacagcagaacguggagagacugagcgagcuggugcaggccgugagcgaccccagcagcccccaguacggcaaguaccugacccuggagaacguggccgaccuggugagacccagcccccugacccugcacaccgugcagaaguggcugcuggccgccggcgcccagaagugccacagcgugaucacccaggacuuccugaccugcuggcugagcaucagacaggccgagcugcugcugcccggcgccgaguuccaccacuacgugggcggccccaccgagacccacguggugagaagcccccaccccuaccagcugccccaggcccuggccccccacguggacuucgugggcggccugcacagauucccccccaccagcagccugagacagagacccgagccccaggugaccggcaccgugggccugcaccugggcgugacccccagcgugaucagaaagagauacaaccugaccagccaggacgugggcagcggcaccagcaacaacagccaggccugcgcccaguuccuggagcaguacuuccacgacagcgaccuggcccaguucaugagacuguucggcggcaacuucgcccaccaggccagcguggccagaguggugggccagcagggcagaggcagagccggcaucgaggccagccuggacgugcaguaccugaugagcgccggcgccaacaucagcaccuggguguacagcagccccggcagacacgagggccaggagcccuuccugcaguggcugaugcugcugagcaacgagagcgcccugccccacgugcacaccgugagcuacggcgacgacgaggacagccugagcagcgccuacauccagagagugaacaccgagcugaugaaggccgccgccagaggccugacccugcuguucgccagcggcgacagcggcgccggcugcuggagcgugagcggcagacaccaguucagacccaccuuccccgccagcagccccuacgugaccaccgugggcggcaccagcuuccaggagcccuuccugaucaccaacgagaucguggacuacaucagcggcggcggcuucagcaacguguuccccagacccagcuaccaggaggaggccgugaccaaguuccugagcagcagcccccaccugccccccagcagcuacuucaacgccagcggcagagccuaccccgacguggccgcccugagcgacggcuacuggguggugagcaacagagugcccauccccugggugagcggcaccagcgccagcacccccguguucggcggcauccugagccugaucaacgagcacagaauccugagcggcagacccccccugggcuuccugaaccccagacuguaccagcagcacggcgccggccuguucgacgugaccagaggcugccacgagagcugccuggacgaggagguggagggccagggcuucugcagcggccccggcugggaccccgugaccggcuggggcacccccaacuuccccgcccugcugaagacccugcugaaccccuaa

SEQ ID NO: 24962 - RNA, 3750 nt, Artificial Sequence
  TPP2__Homo_sapiens__NP_003282
auggccaccgccgccaccgaggagcccuuccccuuccacggccugcugcccaagaaggagaccggcgccgccagcuuccugugcagauaccccgaguacgacggcagaggcgugcugaucgccgugcuggacaccggcguggaccccggcgcccccggcaugcaggugaccaccgacggcaagcccaagaucguggacaucaucgacaccaccggcagcggcgacgugaacaccgccaccgagguggagcccaaggacggcgagaucgugggccugagcggcagagugcugaagauccccgccagcuggaccaaccccagcggcaaguaccacaucggcaucaagaacggcuacgacuucuaccccaaggcccugaaggagagaauccagaaggagagaaaggagaagaucugggaccccgugcacagaguggcccuggccgaggccugcagaaagcaggaggaguucgacguggccaacaacggcagcagccaggccaacaagcugaucaaggaggagcugcagagccagguggagcugcugaacagcuucgagaagaaguacagcgaccccggccccguguacgacugccugguguggcacgacggcgagguguggagagccugcaucgacagcaacgaggacggcgaccugagcaagagcaccgugcugagaaacuacaaggaggcccaggaguacggcagcuucggcaccgccgagaugcugaacuacagcgugaacaucuacgacgacggcaaccugcugagcaucgugaccagcggcggcgcccacggcacccacguggccagcaucgccgccggccacuuccccgaggagcccgagagaaacggcguggcccccggcgcccagauccugagcaucaagaucggcgacaccagacugagcaccauggagaccggcaccggccugaucagagccaugaucgaggugaucaaccacaagugcgaccuggugaacuacagcuacggcgaggccacccacuggcccaacagcggcagaaucugcgaggugaucaacgaggccguguggaagcacaacaucaucuacgugagcagcgccggcaacaacggccccugccugagcaccgugggcugccccggcggcaccaccagcagcgugaucggcgugggcgccuacgugagccccgacaugaugguggccgaguacagccugagagagaagcugcccgccaaccaguacaccuggagcagcagaggccccagcgccgacggcgcccugggcgugagcaucagcgcccccggcggcgccaucgccagcgugcccaacuggacccugagaggcacccagcugaugaacggcaccagcaugagcagccccaacgccugcggcggcaucgcccugauccugagcggccugaaggccaacaacaucgacuacaccgugcacagcgugagaagagcccuggagaacaccgccgugaaggccgacaacaucgagguguucgcccagggccacggcaucauccagguggacaaggccuacgacuaccuggugcagaacaccagcuucgccaacaagcugggcuucaccgugaccgugggcaacaacagaggcaucuaccugagagaccccgugcagguggccgcccccagcgaccacggcgugggcaucgagcccguguuccccgagaacaccgagaacagcgagaagaucagccugcagcugcaccuggcccugaccagcaacagcagcugggugcagugccccagccaccuggagcugaugaaccagugcagacacaucaacaucagaguggaccccagaggccugagagagggccugcacuacaccgaggugugcggcuacgacaucgccagccccaacgccggcccccuguucagagugcccaucaccgccgugaucgccgccaaggugaacgagagcagccacuacgaccuggccuucaccgacgugcacuucaagcccggccagaucagaagacacuucaucgaggugcccgagggcgccaccugggccgaggugaccgugugcagcugcagcagcgaggugagcgccaaguucgugcugcacgccgugcagcuggugaagcagagagccuacagaagccacgaguucuacaaguucugcagccugcccgagaagggcacccugaccgaggccuuccccgugcugggcggcaaggccaucgaguucugcaucgccagauggugggccagccugagcgacgugaacaucgacuacaccaucagcuuccacggcaucgugugcaccgccccccagcugaacauccacgccagcgagggcaucaacagauucgacgugcagagcagccugaaguacgaggaccuggcccccugcaucacccugaagaacugggugcagacccugagacccgugagcgccaagaccaagccccugggcagcagagacgugcugcccaacaacagacagcuguacgagauggugcugaccuacaacuuccaccagcccaagagcggcgaggugacccccagcugcccccugcugugcgagcugcuguacgagagcgaguucgacagccagcuguggaucaucuucgaccagaacaagagacagaugggcagcggcgacgccuacccccaccaguacagccugaagcuggagaagggcgacuacaccaucagacugcagaucagacacgagcagaucagcgaccuggagagacugaaggaccugcccuucaucgugagccacagacugagcaacacccugagccuggacauccacgagaaccacagcuucgcccugcugggcaagaagaagagcagcaaccugacccugccccccaaguacaaccagcccuucuucgugaccagccugcccgacgacaagauccccaagggcgccggccccggcugcuaccuggccggcagccugacccugagcaagaccgagcugggcaagaaggccgacgugauccccgugcacuacuaccugauccccccccccaccaagaccaagaacggcagcaaggacaaggagaaggacagcgagaaggagaaggaccugaaggaggaguucaccgaggcccugagagaccugaagauccaguggaugaccaagcuggacagcagcgacaucuacaacgagcugaaggagaccuaccccaacuaccugccccuguacguggccagacugcaccagcuggacgccgagaaggagagaaugaagagacugaacgagaucguggacgccgccaacgccgugaucagccacaucgaccagaccgcccuggccguguacaucgccaugaagaccgaccccagacccgacgccgccaccaucaagaacgacauggacaagcagaagagcacccugguggacgcccugugcagaaagggcugcgcccuggccgaccaccugcugcacacccaggcccaggacggcgccaucagcaccgacgccgagggcaaggaggaggagggcgagagcccccuggacagccuggccgagaccuucugggagaccaccaaguggaccgaccuguucgacaacaaggugcugaccuucgccuacaagcacgcccuggugaacaagauguacggcagaggccugaaguucgccaccaagcugguggaggagaagcccaccaaggagaacuggaagaacugcauccagcugaugaagcugcugggcuggacccacugcgccagcuucaccgagaacuggcugcccaucauguacccccccgacuacugcguguucuaa

SEQ ID NO: 24963 - RNA, 513 nt, Artificial Sequence
  TPPP2__Homo_sapiens__XP_005267381
auggccagcgaggccgagaagaccuuccacagauucgccgccuucggcgagagcagcagcagcggcaccgagaugaacaacaagaacuucagcaagcugugcaaggacugcggcaucauggacggcaagaccgugaccagcaccgacguggacaucguguucagcaaggugaaggccaagaacgccagaaccaucaccuuccagcaguucaaggaggccgugaaggagcugggccagaagagauucaagggcaagagccccgacgaggugcuggagaacaucuacggccugauggagggcaaggaccccgccaccaccggcgccaccaaggccaccaccgugggcgccguggacagacugaccgacaccagcaaguacaccggcacccacaaggagagauucgacgagagcggcaagggcaagggcaucgccggcagagaggagaugaccgacaacaccggcuacgugagcggcuacaagggcagcggcaccuacgacaagaagaccaaguaa

SEQ ID NO: 24964 - RNA, 531 nt, Artificial Sequence
  TPPP3__Homo_sapiens__NP_057224
auggccgccagcaccgacauggccggccuggaggagagcuucagaaaguucgccauccacggcgaccccaaggccagcggccaggagaugaacggcaagaacugggccaagcugugcaaggacugcaagguggccgacggcaagagcgugaccggcaccgacguggacaucguguucagcaaggugaagggcaagagcgccagagugaucaacuacgaggaguucaagaaggcccuggaggagcuggccaccaagagauucaagggcaagagcaaggaggaggccuucgacgccaucugccagcugguggccggcaaggagcccgccaacgugggcgugaccaaggccaagaccggcggcgccguggacagacugaccgacaccagcagauacaccggcagccacaaggagagauucgacgagagcggcaagggcaagggcaucgccggcagacaggacauccuggacgacagcggcuacgugagcgccuacaagaacgccggcaccuacgacgccaaggugaagaaguaa

SEQ ID NO: 24965 - RNA, 660 nt, Artificial Sequence
  TPPP__Homo_sapiens__NP_008961
auggccgacaaggccaagcccgccaaggccgccaacagaaccccccccaagagccccggcgaccccagcaaggacagagccgccaagagacugagccuggagagcgagggcgccggcgagggcgccgccgccagccccgagcugagcgcccuggaggaggccuucagaagauucgccgugcacggcgacgccagagccaccggcagagagaugcacggcaagaacuggagcaagcugugcaaggacugccaggugaucgacggcagaaacgugaccgugaccgacguggacaucguguucagcaagaucaagggcaagagcugcagaaccaucaccuucgagcaguuccaggaggcccuggaggagcuggccaagaagagauucaaggacaagagcagcgaggaggccgugagagaggugcacagacugaucgagggcaaggcccccaucaucagcggcgugaccaaggccaucagcagccccaccgugagcagacugaccgacaccaccaaguucaccggcagccacaaggagagauucgaccccagcggcaagggcaagggcaaggccggcagaguggaccugguggacgagagcggcuacgugagcggcuacaagcacgccggcaccuacgaccagaaggugcagggcggcaaguaa

SEQ ID NO: 24966 - RNA, 828 nt, Artificial Sequence
  TPRG1__Homo_sapiens__NP_940887
augagcaccaucggcagcuucgagggcuuccaggccgugagccugaagcaggagggcgacgaccagcccagcgagaccgaccaccugagcauggaggaggaggaccccaugcccagacagaucagcagacagagcagcgugaccgagagcacccuguaccccaaccccuaccaccagcccuacaucagcagaaaguacuucgccaccagacccggcgccaucgagaccgccauggaggaccugaagggccacguggccgagaccagcggcgagaccauccagggcuucuggcugcugaccaagaucgaccacuggaacaacgagaaggagagaauccugcuggugaccgacaagacccugcugaucugcaaguacgacuucaucaugcugagcugcgugcagcugcagagaaucccccugagcgccguguacagaaucugccugggcaaguucaccuuccccggcaugagccuggacaagagacagggcgagggccugagaaucuacuggggcagccccgaggagcagagccugcugagcagauggaaccccuggagcaccgaggugcccuacgccaccuucaccgagcaccccaugaaguacaccagcgagaaguuccuggagaucugcaagcugagcggcuucaugagcaagcuggugcccgccauccagaacgcccacaagaacagcaccggcagcggcagaggcaagaagcugauggugcugaccgagcccauccugaucgagaccuacaccggccugaugagcuucaucggcaacagaaacaagcugggcuacagccuggccagaggcagcaucggcuucuaa

SEQ ID NO: 24967 - RNA, 7092 nt, Artificial Sequence
  TPR__Homo_sapiens__NP_003283
auggccgccgugcugcagcaggugcuggagagaaccgagcugaacaagcugcccaagagcgugcagaacaagcuggagaaguuccuggccgaccagcagagcgagaucgacggccugaagggcagacacgagaaguucaagguggagagcgagcagcaguacuucgagaucgagaagagacugagccacagccaggagagacuggugaacgagaccagagagugccagagccugagacuggagcuggagaagcugaacaaccagcugaaggcccugaccgagaagaacaaggagcuggagaucgcccaggacagaaacaucgccauccagagccaguucaccagaaccaaggaggagcuggaggccgagaagagagaccugaucagaaccaacgagagacugagccaggagcuggaguaccugaccgaggacgugaagagacugaacgagaagcugaaggagagcaacaccaccaagggcgagcugcagcugaagcuggacgagcugcaggccagcgacgugagcgugaaguacagagagaagagacuggagcaggagaaggagcugcugcacagccagaacaccuggcugaacaccgagcugaagaccaagaccgacgagcugcuggcccugggcagagagaagggcaacgagauccuggagcugaagugcaaccuggagaacaagaaggaggaggugagcagacuggaggagcagaugaacggccugaagaccagcaacgagcaccugcagaagcacguggaggaccugcugaccaagcugaaggaggccaaggagcagcaggccagcauggaggagaaguuccacaacgagcugaacgcccacaucaagcugagcaaccuguacaagagcgccgccgacgacagcgaggccaagagcaacgagcugaccagagccguggaggagcugcacaagcugcugaaggaggccggcgaggccaacaaggccauccaggaccaccugcuggagguggagcagagcaaggaccagauggagaaggagaugcuggagaagaucggcagacuggagaaggagcuggagaacgccaacgaccugcugagcgccaccaagagaaagggcgccauccugagcgaggaggagcuggccgccaugagccccaccgccgccgccguggccaagaucgugaagcccggcaugaagcugaccgagcuguacaacgccuacguggagacccaggaccagcugcugcuggagaagcuggagaacaagagaaucaacaaguaccuggacgagaucgugaaggagguggaggccaaggcccccauccugaagagacagagagaggaguacgagagagcccagaaggccguggccagccugagcgugaagcuggagcaggccaugaaggagauccagagacugcaggaggacaccgacaaggccaacaagcagagcagcgugcuggagagagacaacagaagaauggagauccaggugaaggaccugagccagcagaucagagugcugcugauggagcuggaggaggccagaggcaaccacgugaucagagacgaggaggugagcagcgccgacaucagcagcagcagcgaggugaucagccagcaccuggugagcuacagaaacaucgaggagcugcagcagcagaaccagagacugcugguggcccugagagagcugggcgagaccagagagagagaggagcaggagaccaccagcagcaagaucaccgagcugcagcugaagcuggagagcgcccugaccgagcuggagcagcugagaaagagcagacagcaccagaugcagcugguggacagcaucgugagacagagagacauguacagaauccugcugagccagaccaccggcguggccaucccccugcacgccagcagccuggacgacgugagccuggccagcacccccaagagacccagcaccagccagaccgugagcacccccgcccccgugcccgugaucgagagcaccgaggccaucgaggccaaggccgcccugaagcagcugcaggagaucuucgagaacuacaagaaggagaaggccgagaacgagaagauccagaacgagcagcuggagaagcugcaggagcaggugaccgaccugagaagccagaacaccaagaucagcacccagcuggacuucgccagcaagagauacgagaugcugcaggacaacguggagggcuacagaagagagaucaccagccugcacgagagaaaccagaagcugaccgccaccacccagaagcaggagcagaucaucaacaccaugacccaggaccugagaggcgccaacgagaagcuggccguggccgaggugagagccgagaaccugaagaaggagaaggagaugcugaagcugagcgaggugagacugagccagcagagagagagccugcuggccgagcagagaggccagaaccugcugcugaccaaccugcagaccauccagggcauccuggagagaagcgagaccgagaccaagcagagacugagcagccagaucgagaagcuggagcacgagaucagccaccugaagaagaagcuggagaacgagguggagcagagacacacccugaccagaaaccuggacgugcagcugcuggacaccaagagacagcuggacaccgagaccaaccugcaccugaacaccaaggagcugcugaagaacgcccagaaggagaucgccacccugaagcagcaccugagcaacauggaggugcagguggccagccagagcagccagagaaccggcaagggccagcccagcaacaaggaggacguggacgaccuggugagccagcugagacagaccgaggagcaggugaacgaccugaaggagagacugaagaccagcaccagcaacguggagcaguaccaggccauggugaccagccuggaggagagccugaacaaggagaagcaggugaccgaggaggugagaaagaacaucgaggugagacugaaggagagcgccgaguuccagacccagcuggagaagaagcugauggagguggagaaggagaagcaggagcugcaggacgacaagagaagagccaucgagagcauggagcagcagcugagcgagcugaagaagacccugagcagcgugcagaacgaggugcaggaggcccugcagagagccagcaccgcccugagcaacgagcagcaggccagaagagacugccaggagcaggccaagaucgccguggaggcccagaacaaguacgagagagagcugaugcugcacgccgccgacguggaggcccugcaggccgccaaggagcaggugagcaagauggccagcgugagacagcaccuggaggagaccacccagaaggccgagagccagcugcuggagugcaaggccagcugggaggagagagagagaaugcugaaggacgaggugagcaagugcgugugcagaugcgaggaccuggagaagcagaacagacugcugcacgaccagaucgagaagcugagcgacaaggugguggccagcgugaaggagggcgugcagggcccccugaacgugagccugagcgaggagggcaagagccaggagcagauccuggagauccugagauucaucagaagagagaaggagaucgccgagaccagauucgagguggcccagguggagagccugagauacagacagagaguggagcugcuggagagagagcugcaggagcugcaggacagccugaacgccgagagagagaaggugcaggugaccgccaagaccauggcccagcacgaggagcugaugaagaagaccgagaccaugaacguggugauggagaccaacaagaugcugagagaggagaaggagagacuggagcaggaccugcagcagaugcaggccaaggugagaaagcuggagcuggacauccugccccugcaggaggccaacgccgagcugagcgagaagagcggcaugcugcaggccgagaagaagcugcuggaggaggacgugaagagauggaaggccagaaaccagcaccuggugagccagcagaaggaccccgacaccgaggaguacagaaagcugcugagcgagaaggaggugcacaccaagagaauccagcagcugaccgaggagaucggcagacugaaggccgagaucgccagaagcaacgccagccugaccaacaaccagaaccugauccagagccugaaggaggaccugaacaaggugagaaccgagaaggagaccauccagaaggaccuggacgccaagaucaucgacauccaggagaaggugaagaccaucacccaggugaagaagaucggcagaagauacaagacccaguacgaggagcugaaggcccagcaggacaaggugauggagaccagcgcccagagcagcggcgaccaccaggagcagcacgugagcgugcaggagaugcaggagcugaaggagacccugaaccaggccgagaccaagagcaagagccuggagagccagguggagaaccugcagaagacccugagcgagaaggagaccgaggccagaaaccugcaggagcagaccgugcagcugcagagcgagcugagcagacugagacaggaccugcaggacagaaccacccaggaggagcagcugagacagcagaucaccgagaaggaggagaagaccagaaaggccaucguggccgccaagagcaagaucgcccaccuggccggcgugaaggaccagcugaccaaggagaacgaggagcugaagcagagaaacggcgcccuggaccagcagaaggacgagcuggacgugagaaucaccgcccugaagagccaguacgagggcagaaucagcagacuggagagagagcugagagagcaccaggagagacaccuggagcagagagacgagccccaggagcccagcaacaaggugcccgagcagcagagacagaucacccugaagaccacccccgccagcggcgagagaggcaucgccagcaccagcgacccccccaccgccaacaucaagcccacccccguggugagcacccccagcaaggugaccgccgccgccauggccggcaacaagagcacccccagagccagcaucagacccauggugacccccgccaccgugaccaaccccaccaccacccccaccgccaccgugaugcccaccacccagguggagagccaggaggccaugcagagcgagggccccguggagcacgugcccguguucggcagcaccagcggcagcgugagaagcaccagccccaacgugcagcccagcaucagccagcccauccugaccgugcagcagcagacccaggccaccgccuucgugcagcccacccagcagagccacccccagaucgagcccgccaaccaggagcugagcagcaacaucguggagguggugcagagcagccccguggagagacccagcaccagcaccgccguguucggcaccgugagcgccacccccagcagcagccugcccaagagaaccagagaggaggaggaggacagcaccaucgaggccagcgaccaggugagcgacgacaccguggagaugccccugcccaagaagcugaagagcgugacccccgugggcaccgaggaggaggugauggccgaggagagcaccgacggcgagguggagacccagguguacaaccaggacagccaggacagcaucggcgagggcgugacccagggcgacuacacccccauggaggacagcgaggagaccagccagagccugcagaucgaccugggcccccugcagagcgaccagcagaccaccaccagcagccaggacggccagggcaagggcgacgacgugaucgugaucgacagcgacgacgaggaggaggacgacgacgagaacgacggcgagcacgaggacuacgaggaggacgaggaggacgacgacgacgacgaggacgacaccggcaugggcgacgagggcgaggacagcaacgagggcaccggcagcgccgacggcaacgacggcuacgaggccgacgacgccgagggcggcgacggcaccgaccccggcaccgagaccgaggagagcaugggcggcggcgagggcaaccacagagccgccgacagccagaacagcggcgagggcaacaccggcgccgccgagagcagcuucagccaggaggugagcagagagcagcagcccagcagcgccagcgagagacaggcccccagagccccccagagccccagaagacccccccacccccugccccccagacugaccauccacgcccccccccaggagcugggcccccccgugcagagaauccagaugaccagaagacagagcgugggcagaggccugcagcugacccccggcaucggcggcaugcagcagcacuucuucgacgacgaggacagaaccgugcccagcacccccacccugguggugccccacagaaccgacggcuucgccgaggccauccacagcccccagguggccggcgugcccagauucagauucggcccccccgaggacaugccccagaccagcagcagccacagcgaccugggccagcuggccagccagggcggccugggcauguacgagaccccccuguuccuggcccacgaggaggagagcggcggcagaagcgugcccaccaccccccugcagguggccgcccccgugaccguguucaccgagagcaccaccagcgacgccagcgagcacgccagccagagcgugcccauggugaccaccagcaccggcacccugagcaccaccaacgagaccgccaccggcgacgacggcgacgagguguucguggaggccgagagcgagggcaucagcagcgaggccggccuggagaucgacagccagcaggaggaggagcccgugcaggccagcgacgagagcgaccugcccagcaccagccaggacccccccagcagcagcagcguggacaccagcagcagccagcccaagcccuucagaagagugagacugcagaccacccugagacagggcgugagaggcagacaguucaacagacagagaggcgugagccacgccaugggcggcagaggcggcaucaacagaggcaacaucaacuaa

SEQ ID NO: 24968 - RNA, 2136 nt, Artificial Sequence
  TPRN__Homo_sapiens__NP_001121700
auggccgcccugggcagacccggcagcggccccagagccgccgugcccgccuggaagagagagauccuggagagaaagagagccaagcuggccgcccugggcggcggcgccggccccggcgccgccgagcccgagcagagagugcuggccgagagccugggcccccugagagagaaccccuucaugcugcuggaggccgagagaagaagaggcggcggcgccgccggcgccagacugcuggagagauacagaagagugcccggcgugagagcccugagagccgacagcgugcugaucaucgagaccgugcccggcuucccccccgccccccccgcccccggcgccgcccagaucagagccgccgaggugcugguguacggcgccccccccggcagagugagcagacugcuggagagauucgacccccccgccgcccccagaagaagaggcagccccgagagagccagaccccccccccccccccccccccccgccccccccagacccccccccgccgcccccagcccccccgccgcccccggccccagaggcggcggcgccagccccggcgccagaagaagcgacuuccugcagaagaccggcagcaacagcuucaccgugcaccccagaggccugcacagaggcgccggcgccagacugcugagcaacggccacagcgcccccgagcccagagccggccccgccaacagacuggccggcagcccccccggcagcggccaguggaagcccaagguggagagcggcgaccccagccugcaccccccccccagccccggcacccccagcgccacccccgccagcccccccgccagcgccacccccagccagagacagugcgugagcgccgccaccagcaccaacgacagcuucgagaucagacccgcccccaagcccgugauggagaccaucccccugggcgaccugcaggccagagcccuggccagccugagagccaacagcagaaacagcuucauggugauccccaagagcaaggccagcggcgcccccccccccgagggcagacagagcguggagcugcccaagggcgaccugggccccgccagccccagccaggagcugggcagccagcccgugcccggcggcgacggcgcccccgcccugggcaagagcccccuggagguggaggcccagugggccguggaggagggcgccugccccagaaccgccaccgcccuggccgacagagccaucagauggcagagacccagcagccccccccccuuccugcccgccgccagcgaggaggccgagcccgccgagggccugagagugcccggccuggccaagaacagcagagaguacgugagacccggccugcccgugaccuucaucgacgagguggacagcgaggaggccccccaggccgccaagcugcccuaccugccccaccccgccagaccccugcaccccgccagacccggcugcguggccgagcugcagcccagaggcagcaacaccuucaccguggugcccaagagaaagcccggcacccugcaggaccagcacuucagccaggccaacagagagcccagacccagagaggccgaggaggaggaggccagcugccugcugggccccacccugaagaagagauaccccaccgugcacgagaucgaggugaucggcggcuaccuggcccugcagaagagcugccugaccaaggccggcagcagcagaaagaagaugaagaucagcuucaacgacaagagccugcagaccaccuucgaguaccccagcgagagcagccuggagcaggaggaggagguggaccagcaggaggaggaggaggaggaggaggaggaggaggaggaggaggaggagggcagcggcagcgaggagaagcccuucgcccuguuccugcccagagccaccuucgugagcagcgugagacccgagagcagcagacugcccgagggcagcagcggccugagcagcuacacccccaagcacagcguggccuucagcaaguggcaggagcaggcccuggagcaggcccccagagaggccgagcccccccccguggaggccaugcugacccccgccagccagaacgaccugagcgacuucagaagcgagcccgcccuguacuucuaa

SEQ ID NO: 24969 - RNA, 828 nt, Artificial Sequence
  TPSAB1__Homo_sapiens__NP_003285
augcugaaccugcugcugcuggcccugcccgugcuggccagcagagccuacgccgcccccgcccccggccaggcccugcagagagugggcaucgugggcggccaggaggcccccagaagcaaguggcccuggcaggugagccugagagugcacggccccuacuggaugcacuucugcggcggcagccugauccacccccagugggugcugaccgccgcccacugcgugggccccgacgugaaggaccuggccgcccugagagugcagcugagagagcagcaccuguacuaccaggaccagcugcugcccgugagcagaaucaucgugcacccccaguucuacaccgcccagaucggcgccgacaucgcccugcuggagcuggaggagcccgugaacgugagcagccacgugcacaccgugacccugccccccgccagcgagaccuucccccccggcaugcccugcugggugaccggcuggggcgacguggacaacgacgagagacugcccccccccuucccccugaagcaggugaaggugcccaucauggagaaccacaucugcgacgccaaguaccaccugggcgccuacaccggcgacgacgugagaaucgugagagacgacaugcugugcgccggcaacaccagaagagacagcugccagggcgacagcggcggcccccuggugugcaaggugaacggcaccuggcugcaggccggcguggugagcuggggcgagggcugcgcccagcccaacagacccggcaucuacaccagagugaccuacuaccuggacuggauccaccacuacgugcccaagaagcccuaa

SEQ ID NO: 24970 - RNA, 828 nt, Artificial Sequence
  TPSB2__Homo_sapiens__NP_077078
augcugaaccugcugcugcuggcccugcccgugcuggccagcagagccuacgccgcccccgcccccggccaggcccugcagagagugggcaucgugggcggccaggaggcccccagaagcaaguggcccuggcaggugagccugagagugagagacagauacuggaugcacuucugcggcggcagccugauccacccccagugggugcugaccgccgcccacugcgugggccccgacgugaaggaccuggccgcccugagagugcagcugagagagcagcaccuguacuaccaggaccagcugcugcccgugagcagaaucaucgugcacccccaguucuacaccgcccagaucggcgccgacaucgcccugcuggagcuggaggagcccgugaacgugagcagccacgugcacaccgugacccugccccccgccagcgagaccuucccccccggcaugcccugcugggugaccggcuggggcgacguggacaacgacgagagacugcccccccccuucccccugaagcaggugaaggugcccaucauggagaaccacaucugcgacgccaaguaccaccugggcgccuacaccggcgacgacgugagaaucgugagagacgacaugcugugcgccggcaacaccagaagagacagcugccagggcgacagcggcggcccccuggugugcaaggugaacggcaccuggcugcaggccggcguggugagcuggggcgagggcugcgcccagcccaacagacccggcaucuacaccagagugaccuacuaccuggacuggauccaccacuacgugcccaagaagcccuaa

SEQ ID NO: 24971 - RNA, 729 nt, Artificial Sequence
  TPSD1__Homo_sapiens__NP_036349
augcugcugcuggccccccagaugcugagccugcugcugcuggcccugcccgugcuggccagccccgccuacguggcccccgcccccggccaggcccugcagcagaccggcaucgugggcggccaggaggcccccagaagcaaguggcccuggcaggugagccugagagugagaggccccuacuggaugcacuucugcggcggcagccugauccacccccagugggugcugaccgccgcccacugcguggagcccgacaucaaggaccuggccgcccugagagugcagcugagagagcagcaccuguacuaccaggaccagcugcugcccgugagcagaaucaucgugcacccccaguucuacaucauccagaccggcgccgacaucgcccugcuggagcuggaggagcccgugaacaucagcagccacauccacaccgugacccugccccccgccagcgagaccuucccccccggcaugcccugcugggugaccggcuggggcgacguggacaacaacgugcaccugcccccccccuacccccugaaggagguggaggugcccgugguggagaaccaccugugcaacgccgaguaccacaccggccugcacaccggccacagcuuccagaucgugagagacgacaugcugugcgccggcagcgagaaccacgacagcugccagggcgacagcggcggcccccuggugugcaaggugaacggcaccuaa

SEQ ID NO: 24972 - RNA, 966 nt, Artificial Sequence
  TPSG1__Homo_sapiens__NP_036599
auggcccugggcgccugcggccugcugcugcugcuggccgugcccggcgugagccugagaacccugcagcccggcugcggcagaccccaggugagcgacgccggcggcagaaucgugggcggccacgccgcccccgccggcgccuggcccuggcaggccagccugagacugagaagagugcacgugugcggcggcagccugcugagcccccagugggugcugaccgccgcccacugcuucagcggcagccugaacagcagcgacuaccaggugcaccugggcgagcuggagaucacccugagcccccacuucagcaccgugagacagaucauccugcacagcagccccagcggccagcccggcaccagcggcgacaucgcccugguggagcugagcgugcccgugacccugagcagcagaauccugcccgugugccugcccgaggccagcgacgacuucugccccggcaucagaugcugggugaccggcuggggcuacaccagagagggcgagccccugcccccccccuacagccugagagaggugaaggugagcgugguggacaccgagaccugcagaagagacuaccccggccccggcggcagcauccugcagcccgacaugcugugcgccagaggccccggcgacgccugccaggacgacagcggcggcccccuggugugccaggugaacggcgccugggugcaggccggcaucgugagcuggggcgagggcugcggcagacccaacagacccggcguguacaccagagugcccgccuacgugaacuggaucagaagacacaucaccgccagcggcggcagcgagagcggcuaccccagacugccccugcuggccggcuucuuccugcccggccuguuccugcugcuggugagcugcgugcugcuggccaagugccugcugcaccccagcgccgacggcacccccuuccccgcccccgacuaa

SEQ ID NO: 24973 - RNA, 417 nt, Artificial Sequence
  TPT1__Homo_sapiens__NP_001273202
auggugagcagaaccgagggcaacaucgacgacagccugaucggcggcaacgccagcgccgagggccccgagggcgagggcaccgagagcaccgugaucaccggcguggacaucgugaugaaccaccaccugcaggagaccagcuucaccaaggaggccuacaagaaguacaucaaggacuacaugaagagcaucaagggcaagcuggaggagcagagacccgagagagugaagcccuucaugaccggcgccgccgagcagaucaagcacauccuggccaacuucaagaacuaccaguucuucaucggcgagaacaugaaccccgacggcaugguggcccugcuggacuacagagaggacggcgugacccccuacaugaucuucuucaaggacggccuggagauggagaagugcuaa

SEQ ID NO: 24974 - RNA, 1236 nt, Artificial Sequence
  TPTE2__Homo_sapiens__NP_001135440
augaacgagagcccccagaccaacgaguucaagggcaccaccgaggaggcccccgccaaggagagcccccacaccagcgaguucaagggcgccgcccuggugagccccaucagcaagagcaugcuggagagacugagcaaguucgagguggaggacgccgagaacguggccagcuacgaguggacccaccuggugagacugcugagacugaucauccugaucagaaucuuccaccugcugcaccagaagagacagcuggagaagcugaugagaagacuggugagcgagaacaagagaagauacaccagagacggcuucgaccuggaccugaccuacgugaccgagagaaucaucgccaugagcuuccccagcagcggcagacagagcuucuacagaaaccccaucgaggagguggugagauuccuggacaagaagcacagaaaccacuacagaguguacaaccugugcagcgagagagccuacgaccccaagcacuuccacaacagagugagcagaaucaugaucgacgaccacaacgugcccacccugcacgagauggugguguucaccaaggaggugaacgaguggauggcccaggaccuggagaacaucguggccauccacugcaagggcggcaagggcagaaccggcaccauggugugcgcccugcugaucgccagcgagaucuuccugaccgccgaggagagccuguacuacuucggcgagagaagaaccaacaagacccacagcaacaaguuccagggcguggagacccccagccagaacagauacgugggcuacuucgcccaggugaagcaccuguacaacuggaaccugccccccagaagaauccuguucaucaagagauucaucaucuacagcaucagaggcgacgugugcgaccugaaggugcagguggugauggagaagaaggugguguucagcagcaccagccugggcaacugcagcauccugcacgacaucgagaccgacaagauccugaucaacguguacgacggccccccccuguacgacgacgugaaggugcaguucuucagcagcaaccugcccaaguacuacgacaacugccccuucuucuucugguucaacaccagcuucauccagaacaacagacugugccugcccagaaacgagcuggacaacccccacaagcagaaggccuggaagaucuacccccccgaguucgccguggagauccuguucggcgagaaguaa

SEQ ID NO: 24975 - RNA, 1602 nt, Artificial Sequence
  TPTE__Homo_sapiens__NP_954868
augaacgagagccccgaccccaccgaccuggccggcgugaucaucgagcugggccccaacgacagcccccagaccagcgaguucaagggcgccaccgaggaggcccccgccaaggagagcgugcuggccagacugagcaaguucgagguggaggacgccgagaacguggccagcuacgacagcaagaucaagaagaucgugcacagcaucgugagcagcuucgccuucggccuguucggcguguuccuggugcugcuggacgugacccugauccuggccgaccugaucuucaccgacagcaagcuguacaucccccuggaguacagaagcaucagccuggccaucgcccuguucuuccugauggacgugcugcugagaguguucguggagagaagacagcaguacuucagcgaccuguucaacauccuggacaccgccaucaucgugauccugcugcugguggacgugguguacaucuucuucgacaucaagcugcugagaaacauccccagauggacccaccugcugagacugcugagacugaucauccugcugagaaucuuccaccuguuccaccagaagagacagcuggagaagcugaucagaagaagagugagcgagaacaagagaagauacaccagagacggcuucgaccuggaccugaccuacgugaccgagagaaucaucgccaugagcuuccccagcagcggcagacagagcuucuacagaaaccccaucaaggagguggugagauuccuggacaagaagcacagaaaccacuacagaguguacaaccugugcagcgagagagccuacgaccccaagcacuuccacaacagaguggugagaaucaugaucgacgaccacaacgugcccacccugcaccagauggugguguucaccaaggaggugaacgaguggauggcccaggaccuggagaacaucguggccauccacugcaagggcggcaccgacagaaccggcaccauggugugcgccuuccugaucgccagcgagaucugcagcaccgccaaggagagccuguacuacuucggcgagagaagaaccgacaagacccacagcgagaaguuccagggcguggagacccccagccagaagagauacguggccuacuucgcccaggugaagcaccuguacaacuggaaccugccccccagaagaauccuguucaucaagcacuucaucaucuacagcauccccagauacgugagagaccugaagauccagaucgagauggagaagaaggugguguucagcaccaucagccugggcaagugcagcgugcuggacaacaucaccaccgacaagauccugaucgacguguucgacggccugccccuguacgacgacgugaaggugcaguucuucuacagcaaccugcccaccuacuacgacaacugcagcuucuacuucuggcugcacaccagcuucaucgagaacaacagacuguaccugcccaagaacgagcuggacaaccugcacaagcagaaggccagaagaaucuaccccagcgacuucgccguggagauccuguucggcgagaagaugaccagcagcgacgugguggccggcagcgacuaa

SEQ ID NO: 24976 - RNA, 2244 nt, Artificial Sequence
  TPX2__Homo_sapiens__XP_011527001
augagccaggugaagagcagcuacagcuacgacgcccccagcgacuucaucaacuucagcagccuggacgacgagggcgacacccagaacaucgacagcugguucgaggagaaggccaaccuggagaacaagcugcugggcaagaacggcaccggcggccuguuccagggcaagaccccccugagaaaggccaaccugcagcaggccaucgugaccccccugaagcccguggacaacaccuacuacaaggaggccgagaaggagaaccugguggagcagagcauccccagcaacgccugcagcagccuggagguggaggccgccaucagcagaaagacccccgcccagccccagagaagaagccugagacugagcgcccagaaggaccuggagcagaaggagaagcaccacgugaagaugaaggccaagagaugcgccacccccgugaucaucgacgagauccugcccagcaagaagaugaaggugagcaacaacaagaagaagcccgaggaggagggcagcgcccaccaggacaccgccgagaagaacgccagcagccccgagaaggccaagggcagacacaccgugcccugcaugccccccgccaagcagaaguuccugaagagcaccgaggagcaggagcuggagaagagcaugaagaugcagcaggaggugguggagaugagaaagaagaacgaggaguucaagaagcuggcccuggccggcaucggccagcccgugaagaagagcgugagccaggugaccaagagcguggacuuccacuucagaaccgacgagagaaucaagcagcaccccaagaaccaggaggaguacaaggaggugaacuucaccagcgagcugagaaagcaccccagcagccccgccagagugaccaagggcugcaccaucgugaagcccuucaaccugagccagggcaagaagagaaccuucgacgagaccgugagcaccuacgugccccuggcccagcagguggaggacuuccacaagagaacccccaacagauaccaccugagaagcaagaaggacgacaucaaccugcugcccagcaagagcagcgugaccaagaucugcagagacccccagacccccgugcugcagaccaagcacagagccagagccgugaccugcaagagcaccgccgagcuggaggccgaggagcuggagaagcugcagcaguacaaguucaaggccagagagcuggaccccagaauccuggagggcggccccauccugcccaagaagccccccgugaagccccccaccgagcccaucggcuucgaccuggagaucgagaagagaauccaggagagagagagcaagaagaagaccgaggacgagcacuucgaguuccacagcagacccugccccaccaagauccuggaggacguggugggcgugcccgagaagaaggugcugcccaucaccgugcccaagagccccgccuucgcccugaagaacagaaucagaaugcccaccaaggaggacgaggaggaggacgagcccguggugaucaaggcccagcccgugccccacuacggcgugcccuucaagccccagauccccgaggccagaaccguggagaucugccccuucagcuucgacagcagagacaaggagagacagcugcagaaggagaagaagaucaaggagcugcagaagggcgaggugcccaaguucaaggcccugccccugccccacuucgacaccaucaaccugcccgagaagaaggugaagaacgugacccagaucgagcccuucugccuggagaccgacagaagaggcgcccugaaggcccagaccuggaagcaccagcuggaggaggagcugagacagcagaaggaggccgccugcuucaaggccagacccaacaccgugaucagccaggagcccuucgugcccaagaaggagaagaagagcguggccgagggccugagcggcagccuggugcaggagcccuuccagcuggccaccgagaagagagccaaggagagacaggagcuggagaagagaauggccgagguggaggcccagaaggcccagcagcuggaggaggccagacugcaggaggaggagcagaagaaggaggagcuggccagacugagaagagagcuggugcacaaggccaaccccaucagaaaguaccagggccuggagaucaagagcagcgaccagccccugaccgugcccgugagccccaaguucagcaccagauuccacugcuaa

SEQ ID NO: 24977 - RNA, 543 nt, Artificial Sequence
  TRA2A__Homo_sapiens__NP_001269688
augagcaacagaagaagacacaccggcagcagagccaaccccgaccccaacaccugccugggcguguucggccugagccuguacaccaccgagagagaccugagagagguguucagcagauacggcccccugagcggcgugaacgugguguacgaccagagaaccggcagaagcagaggcuucgccuucguguacuucgagagaaucgacgacagcaaggaggccauggagagagccaacggcauggagcuggacggcagaagaaucagaguggacuacagcaucaccaagagagcccacacccccacccccggcaucuacaugggcagacccacccacagcggcggcggcggcggcggcggcggcggcggcggcggcggcggcggcggcagaagaagagacagcuacuacgacagaggcuacgacagaggcuacgacagauacgaggacuacgacuacagauacagaagaagccccagccccuacuacagcagauacagaagcagaagcagaagcagaagcuacagccccagaagauacuaa

SEQ ID NO: 24978 - RNA, 567 nt, Artificial Sequence
  TRA2B__Homo_sapiens__NP_001230808
augagcaccagaagaagacacgugggcaacagagccaaccccgaccccaacugcugccugggcguguucggccugagccuguacaccaccgagagagaccugagagagguguucagcaaguacggccccaucgccgacgugagcaucguguacgaccagcagagcagaagaagcagaggcuucgccuucguguacuucgagaacguggacgacgccaaggaggccaaggagagagccaacggcauggagcuggacggcagaagaaucagaguggacuucagcaucaccaagagaccccacacccccacccccggcaucuacaugggcagacccaccuacggcagcagcagaagaagagacuacuacgacagaggcuacgacagaggcuacgacgacagagacuacuacagcagaagcuacagaggcggcggcggcggcggcggcggcuggagagccgcccaggacagagaccagaucuacagaagaagaagccccagccccuacuacagcagaggcggcuacagaagcagaagcagaagcagaagcuacagccccagaagauacuaa

SEQ ID NO: 24979 - RNA, 1371 nt, Artificial Sequence
  TRABD2A__Homo_sapiens__NP_001074293
augagccccuggagcugguuccugcugcagacccugugccugcugcccaccggcgccgccagcagaagaggcgcccccggcaccgccaacugcgagcugaagccccagcagagcgagcugaacagcuuccuguggaccaucaagagagacccccccagcuacuucuucggcaccauccacgugcccuacaccagagugugggacuucauccccgacaacagcaaggaggccuuccugcagagcagcaucguguacuucgagcuggaccugaccgaccccuacaccaucagcgcccugaccagcugccagaugcugccccagggcgagaaccugcaggacgugcugcccagagacaucuacugcagacugaagagacaccuggaguacgugaagcugaugaugccccuguggaugacccccgaccagagaggcaagggccuguacgccgacuaccuguucaacgccaucgccggcaacugggagagaaagagacccgugugggugaugcugauggugaacagccugaccgagguggacaucaagagcagaggcgugcccgugcuggaccuguuccuggcccaggaggccgagagacugagaaagcagaccggcgccguggagaagguggaggagcagugccacccccugaacggccugaacuucagccaggugcccaacuucaucaacgccacccugcccccccaggagagaaucaccgcccaggagaucgacagcuaccugagaagagagcugaucuacaagagaaacgagagaaucggcaagagagugaaggcccugcuggaggaguuccccgacaagggcuucuucuucgccuucggcgccggccacuucaugggcaacaacaccgugcuggacgugcugagaagagagggcuacgagguggagcacgcccccgccggcagacccauccacaagggcaagagcaagaagaccagcaccagacccacccugagcaccaucuucgcccccaaggugcccacccuggaggugcccgcccccgaggccgugagcagcggccacagcacccugcccccccuggugagcagacccggcagcgccgacacccccagcgaggccgagcagagauucagaaagaagagaagaagaagccagagaagacccagacugagacaguucagcgaccugugggugagacuggaggagagcgacaucgugccccagcugcaggugcccgugcuggacagacacaucagcaccgagcugagacugcccagaagaggccacagccaccacagccagaugguggccagcagcgccugccugagccuguggacccccguguucugggugcuggugcuggccuuccagaccgagaccccccugcuguaa

SEQ ID NO: 24980 - RNA, 1131 nt, Artificial Sequence
  TRABD__Homo_sapiens__NP_079480
auggacggcgaggagcagcagcccccccacgaggccaacguggagcccguggugcccagcgaggccagcgagcccgugcccagagugcugagcggcgacccccagaaccugagcgacguggacgccuucaaccugcugcuggagaugaagcugaagagaagaagacagagacccaaccugcccagaaccgugacccagcugguggccgaggacggcagcagaguguacguggugggcaccgcccacuucagcgacgacagcaagagagacguggugaagaccaucagagaggugcagcccgacgugguggugguggagcugugccaguacagagugagcaugcugaagauggacgagagcacccugcugagagaggcccaggagcugagccuggagaagcugcagcaggccgugagacagaacggccugaugagcggccugaugcagaugcugcugcugaaggugagcgcccacaucaccgagcagcugggcauggcccccggcggcgaguucagagaggccuucaaggaggccagcaaggugcccuucugcaaguuccaccugggcgacagacccauccccgugaccuucaagagagccaucgccgcccugagcuucuggcagaaggugagacuggccuggggccugugcuuccugagcgaccccaucagcaaggacgacguggagagaugcaagcagaaggaccugcuggagcagaugauggccgagaugaucggcgaguuccccgaccugcacagaaccaucgugagcgagagagacguguaccugaccuacaugcugagacaggccgccagaagacuggagcugcccagagccagcgacgccgagcccagaaagugcgugcccagcgugguggugggcguggugggcaugggccacgugcccggcaucgagaagaacuggagcaccgaccugaacauccaggagaucaugaccgugcccccccccagcgugagcggcagagugagcagacuggccgugaaggccgccuucuucggccugcugggcuacagccuguacuggaugggcagaagaaccgccagccuggugcugagccugcccgccgcccaguacugccugcagagagugaccgaggccagacacaaguaa

SEQ ID NO: 24981 - RNA, 939 nt, Artificial Sequence
  TRADD__Homo_sapiens__XP_011521722
auggccgccggccagaacggccacgaggagugggugggcagcgccuaccuguucguggagagcagccuggacaagguggugcugagcgacgccuacgcccacccccagcagaagguggccguguacagagcccugcaggccgcccuggccgagagcggcggcagccccgacgugcugcagaugcugaagauccacagaagcgacccccagcugaucgugcagcugagauucugcggcagacagcccugcggcagauuccugagagccuacagagagggcgcccugagagccgcccugcagagaagccuggccgccgcccuggcccagcacagcgugccccugcagcuggagcugagagccggcgccgagagacuggacgcccugcuggccgacgaggagagaugccugagcugcauccuggcccagcagcccgacagacugagagacgaggagcuggccgagcuggaggacgcccugagaaaccugaagugcggcagcggcgccagaggcggcgacggcgagguggccagcgccccccugcagccccccgugcccagccugagcgaggugaagcccccccccccccccccccccgcccagaccuuccuguuccagggccagcccguggugaacagaccccugagccugaaggaccagcagaccuucgccagaagcgugggccugaaguggagaaaggugggcagaagccugcagagaggcugcagagcccugagagaccccgcccuggacagccuggccuacgaguacgagagagagggccuguacgagcaggccuuccagcugcugagaagauucgugcaggccgagggcagaagagccacccugcagagacugguggaggcccuggaggagaacgagcugaccagccuggccgaggaccugcugggccugaccgaccccaacggcggccuggccuaa

SEQ ID NO: 24982 - RNA, 885 nt, Artificial Sequence
  TRAF1__Homo_sapiens__NP_001177876
augaagcaguggaaggccagacugggcugcggccuggagagcggccccauggcccuggagcagaaccugagcgaccugcagcugcaggccgccguggagguggccggcgaccuggagguggacugcuacagagcccccugcagcgagagccaggaggagcuggcccugcagcacuucaugaaggagaagcugcuggccgagcuggagggcaagcugagaguguucgagaacaucguggccgugcugaacaaggagguggaggccagccaccuggcccuggccaccagcauccaccagagccagcuggacagagagagaauccugagccuggagcagagagugguggagcugcagcagacccuggcccagaaggaccaggcccugggcaagcuggagcagagccugagacugauggaggaggccagcuucgacggcaccuuccuguggaagaucaccaacgugaccagaagaugccacgagagcgccugcggcagaaccgugagccuguucagccccgccuucuacaccgccaaguacggcuacaagcugugccugagacuguaccugaacggcgacggcaccggcaagagaacccaccugagccuguucaucgugaucaugagaggcgaguacgacgcccugcugcccuggcccuucagaaacaaggugaccuucaugcugcuggaccagaacaacagagagcacgccaucgacgccuucagacccgaccugagcagcgccagcuuccagagaccccagagcgagaccaacguggccagcggcugcccccuguucuucccccugagcaagcugcagagccccaagcacgccuacgugaaggacgacaccauguuccugaagugcaucguggagaccagcaccuaa

SEQ ID NO: 24983 - RNA, 1506 nt, Artificial Sequence
  TRAF2__Homo_sapiens__NP_066961
auggccgccgccagcgugaccccccccggcagccuggagcugcugcagcccggcuucagcaagacccugcugggcaccaagcuggaggccaaguaccugugcagcgccugcagaaacgugcugagaagacccuuccaggcccagugcggccacagauacugcagcuucugccuggccagcauccugagcagcggcccccagaacugcgccgccugcgugcacgagggcaucuacgaggagggcaucagcauccuggagagcagcagcgccuuccccgacaacgccgccagaagagagguggagagccugcccgccgugugccccagcgacggcugcaccuggaagggcacccugaaggaguacgagagcugccacgagggcagaugcccccugaugcugaccgagugccccgccugcaagggccuggugagacugggcgagaaggagagacaccuggagcacgagugccccgagagaagccugagcugcagacacugcagagcccccugcugcggcgccgacgugaaggcccaccacgaggugugccccaaguucccccugaccugcgacggcugcggcaagaagaagauccccagagagaaguuccaggaccacgugaagaccugcggcaagugcagagugcccugcagauuccacgccaucggcugccuggagaccguggagggcgagaagcagcaggagcacgaggugcaguggcugagagagcaccuggccaugcugcugagcagcgugcuggaggccaagccccugcugggcgaccagagccacgccggcagcgagcugcugcagagaugcgagagccuggagaagaagaccgccaccuucgagaacaucgugugcgugcugaacagagagguggagagaguggccaugaccgccgaggccugcagcagacagcacagacuggaccaggacaagaucgaggcccugagcagcaaggugcagcagcuggagagaagcaucggccugaaggaccuggccauggccgaccuggagcagaaggugcuggagauggaggccagcaccuacgacggcguguucaucuggaagaucagcgacuucgccagaaagagacaggaggccguggccggcagaauccccgccaucuucagccccgccuucuacaccagcagauacggcuacaagaugugccugagaaucuaccugaacggcgacggcaccggcagaggcacccaccugagccuguucuucguggugaugaagggccccaacgacgcccugcugagauggcccuucaaccagaaggugacccugaugcugcuggaccagaacaacagagagcacgugaucgacgccuucagacccgacgugaccagcagcagcuuccagagacccgugaacgacaugaacaucgccagcggcugcccccuguucugccccgugagcaagauggaggccaagaacagcuacgugagagacgacgccaucuucaucaaggccaucguggaccugaccggccuguaa

SEQ ID NO: 24984 - RNA, 1458 nt, Artificial Sequence
  TRAF3__Homo_sapiens__NP_001186356
auggagagcagcaagaagauggacagccccggcgcccugcagaccaaccccccccugaagcugcacaccgacagaagcgccggcacccccguguucgugcccgagcagggcggcuacaaggagaaguucgugaagaccguggaggacaaguacaagugcgagaagugccaccuggugcugugcagccccaagcagaccgagugcggccacagauucugcgagagcugcauggccgcccugcugagcagcagcagccccaagugcaccgccugccaggagagcaucgugaaggacaagguguucaaggacaacugcugcaagagagagauccuggcccugcagaucuacugcagaaacgagagcagaggcugcgccgagcagcugaugcugggccaccugcuggugcaccugaagaacgacugccacuucgaggagcugcccugcgugagacccgacugcaaggagaaggugcugagaaaggaccugagagaccacguggagaaggccugcaaguacagagaggccaccugcagccacugcaagagccaggugcccaugaucgcccugcaggugagccugcugcagaacgagagcguggagaagaacaagagcauccagagccugcacaaccagaucugcagcuucgagaucgagaucgagagacagaaggagaugcugagaaacaacgagagcaagauccugcaccugcagagagugaucgacagccaggccgagaagcugaaggagcuggacaaggagaucagacccuucagacagaacugggaggaggccgacagcaugaagagcagcguggagagccugcagaacagagugaccgagcuggagagcguggacaagagcgccggccagguggccagaaacaccggccugcuggagagccagcugagcagacacgaccagaugcugagcgugcacgacaucagacuggccgacauggaccugagauuccaggugcuggagaccgccagcuacaacggcgugcugaucuggaagaucagagacuacaagagaagaaagcaggaggccgugaugggcaagacccugagccuguacagccagcccuucuacaccggcuacuucggcuacaagaugugcgccagaguguaccugaacggcgacggcaugggcaagggcacccaccugagccuguucuucgugaucaugagaggcgaguacgacgcccugcugcccuggcccuucaagcagaaggugacccugaugcugauggaccagggcagcagcagaagacaccugggcgacgccuucaagcccgaccccaacagcagcagcuucaagaagcccaccggcgagaugaacaucgccagcggcugccccguguucguggcccagaccgugcuggagaacggcaccuacaucaaggacgacaccaucuucaucaaggugaucguggacaccagcgaccugcccgaccccuaa

SEQ ID NO: 24985 - RNA, 1878 nt, Artificial Sequence
  TRAF3IP1__Homo_sapiens__NP_001132962
augaacgccgccguggugagaagaacccaggaggcccugggcaaggugaucagaagacccccccugaccgagaagcugcugagcaagccccccuucagauaccugcacgacaucaucaccgaggugaucagaaugaccggcuucaugaagggccuguacaccgacgccgagaugaagagcgacaacgugaaggacaaggacgccaagaucagcuuccugcagaaggccaucgacgugguggugauggugagcggcgagccccugcuggccaagcccgccagaaucguggccggccacgagcccgagagaaccaacgagcugcugcagaucaucggcaagugcugccugaacaagcugagcagcgacgacgccgugagaagagugcuggccggcgagaagggcgaggugaagggcagagccagccugaccagcagaagccaggagcuggacaacaagaacgugagagaggaggagagcagagugcacaagaacaccgaggacagaggcgacgccgagaucaaggagagaagcaccagcagagacagaaagcagaaggaggagcugaaggaggacagaaagcccagagagaaggacaaggacaaggagaaggccaaggagaacggcggcaacagacacagagagggcgagagagagagagccaaggccagagccagacccgacaacgagagacagaaggacagaggcaacagagagagagacagagacagcgagagaaagaaggagaccgagagaaagagcgagggcggcaaggagaaggagagacugagagacagagacagagagagagacagagacaagggcaaggacagagacagaagaagagugaagaacggcgagcacagcugggaccuggacagagagaagaacagagagcacgacaagcccgagaagaagagcgccagcagcggcgagaugagcaagaagcugagcgacggcaccuucaaggacagcaaggccgagaccgagaccgagaucagcaccagagccagcaagagccugaccaccaagaccagcaagagaagaagcaagaacagcguggagggcgacagcaccagcgacgccgagggcgacgccggccccgccggccaggacaagagcgaggugcccgagacccccgagauccccaacgagcugagcagcaacaucagaagaauccccagacccggcagcgccagacccgccccccccagagugaagagacaggacagcauggaggcccugcagauggacagaagcggcagcggcaagaccgugagcaacgugaucaccgagagccacaacagcgacaacgaggaggacgaccaguucgugguggaggccgccccccagcugagcgagaugagcgagaucgagauggugaccgccguggagcuggaggaggaggagaagcacggcggccuggugaagaagauccuggagaccaagaaggacuacgagaagcugcagcagagccccaagcccggcgagaaggagagaagccuguucgagagcgccuggaagaaggagaaggacaucgugagcaaggagaucgagaagcugagaaccagcauccagacccugugcaagagcgcccugccccugggcaagaucauggacuacauccaggaggacguggacgccaugcagaacgagcugcagauguggcacagcgagaacagacagcacgccgaggcccugcagcaggagcagagaaucaccgacugcgccguggagccccugaaggccgagcuggccgagcuggagcagcugaucaaggaccagcaggacaagaucugcgccgugaaggccaacauccugaagaacgaggagaagauccagaagaugguguacagcaucaaccugaccagcagaagauaa

SEQ ID NO: 24986 - RNA, 1695 nt, Artificial Sequence
  TRAF3IP2__Homo_sapiens__NP_001157753
augaacagaagcauccccguggagguggacgagagcgagcccuaccccagccagcugcugaagcccauccccgaguacagccccgaggaggagagcgagccccccgcccccaacaucagaaacauggcccccaacagccugagcgcccccaccaugcugcacaacagcagcggcgacuucagccaggcccacagcacccugaagcuggccaaccaccagagacccgugagcagacaggugaccugccugagaacccaggugcuggaggacagcgaggacagcuucugcagaagacaccccggccugggcaaggccuuccccagcggcugcagcgccgugagcgagcccgccagcgagagcguggugggcgcccugcccgccgagcaccaguucagcuucauggagaagagaaaccaguggcuggugagccagcugagcgccgccagccccgacaccggccacgacagcgacaagagcgaccagagccugcccaacgccagcgccgacagccugggcggcagccaggagauggugcagagaccccagccccacagaaacagagccggccuggaccugcccaccaucgacaccggcuacgacagccagccccaggacgugcugggcaucagacagcuggagagaccccugccccugaccagcgugugcuacccccaggaccugcccagaccccugagaagcagagaguucccccaguucgagccccagagauaccccgccugcgcccagaugcugccccccaaccugagcccccacgcccccuggaacuaccacuaccacugccccggcagccccgaccaccaggugcccuacggccacgacuaccccagagccgccuaccagcaggugauccagcccgcccugcccggccagccccugcccggcgccagcgugagaggccugcaccccgugcagaaggugauccugaacuaccccagccccugggaccacgaggagagacccgcccagagagacugcagcuuccccggccugcccagacaccaggaccagccccaccaccagccccccaacagagccggcgcccccggcgagagccuggagugccccgccgagcugagaccccaggugccccagccccccagccccgccgccgugcccagaccccccagcaacccccccgccagaggcacccugaagaccagcaaccugcccgaggagcugagaaagguguucaucaccuacagcauggacaccgccauggagguggugaaguucgugaacuuccugcuggugaacggcuuccagaccgccaucgacaucuucgaggacagaaucagaggcaucgacaucaucaaguggauggagagauaccugagagacaccgugaugaucaucguggccaucagccccaaguacaagcaggacguggagggcgccgagagccagcuggacgaggacgagcacggccugcacaccaaguacauccacagaaugaugcagaucgaguucaucaagcagggcagcaugaacuucagauucauccccgugcuguuccccaacgccaagaaggagcacgugcccaccuggcugcagaacacccacguguacagcuggcccaagaacaagaagaacauccugcugagacugcugagagaggaggaguacguggccccccccagaggcccccugcccacccugcagguggugccccuguaa

SEQ ID NO: 24987 - RNA, 1413 nt, Artificial Sequence
  TRAF4__Homo_sapiens__NP_004286
augcccggcuucgacuacaaguuccuggagaagcccaagagaagacugcugugcccccugugcggcaagcccaugagagagcccgugcaggugagcaccugcggccacagauucugcgacaccugccugcaggaguuccugagcgagggcguguucaagugccccgaggaccagcugccccuggacuacgccaagaucuaccccgaccccgagcuggaggugcaggugcugggccugcccaucagaugcauccacagcgaggagggcugcagauggagcggcccccugagacaccugcagggccaccugaacaccugcagcuucaacgugauccccugccccaacagaugccccaugaagcugagcagaagagaccugcccgcccaccugcagcacgacugccccaagagaagacugaagugcgaguucugcggcugcgacuucagcggcgaggccuacgagagccacgagggcaugugcccccaggagagcguguacugcgagaacaagugcggcgccagaaugaugagaagacugcuggcccagcacgccaccagcgagugccccaagagaacccagcccugcaccuacugcaccaaggaguucguguucgacaccauccagagccaccaguaccagugccccagacugcccguggccugccccaaccagugcggcgugggcaccguggccagagaggaccugcccggccaccugaaggacagcugcaacaccgcccuggugcugugccccuucaaggacagcggcugcaagcacagaugccccaagcuggccauggccagacacguggaggagagcgugaagccccaccuggccaugaugugcgcccuggugagcagacagagacaggagcugcaggagcugagaagagagcuggaggagcugagcgugggcagcgacggcgugcugaucuggaagaucggcagcuacggcagaagacugcaggaggccaaggccaagcccaaccuggagugcuucagccccgccuucuacacccacaaguacggcuacaagcugcaggugagcgccuuccugaacggcaacggcagcggcgagggcacccaccugagccuguacaucagagugcugcccggcgccuucgacaaccugcuggaguggcccuucgccagaagagugaccuucagccugcuggaccagagcgaccccggccuggccaagccccagcacgugaccgagaccuuccaccccgaccccaacuggaagaacuuccagaagcccggcaccuggagaggcagccuggacgagagcagccugggcuucggcuaccccaaguucaucagccaccaggacaucagaaagagaaacuacgugagagacgacgccguguucaucagagccgccguggagcugcccagaaagauccugagcuaa

SEQ ID NO: 24988 - RNA, 1674 nt, Artificial Sequence
  TRAF5__Homo_sapiens__NP_665702
auggccuacagcgaggagcacaagggcaugcccugcggcuucaucagacagaacagcggcaacagcaucagccuggacuucgagcccagcaucgaguaccaguucguggagagacuggaggagagauacaagugcgccuucugccacagcgugcugcacaacccccaccagaccggcugcggccacagauucugccagcacugcauccugagccugagagagcugaacaccgugcccaucugccccguggacaaggaggugaucaagagccaggagguguucaaggacaacugcugcaagagagaggugcugaaccuguacguguacugcagcaacgcccccggcugcaacgccaaggugauccugggcagauaccaggaccaccugcagcagugccuguuccagcccgugcagugcagcaacgagaagugcagagagcccgugcugagaaaggaccugaaggagcaccugagcgccagcugccaguucagaaaggagaagugccuguacugcaagaaggacgugguggugaucaaccugcagaaccacgaggagaaccugugccccgaguaccccguguucugccccaacaacugcgccaagaucauccugaagaccgagguggacgagcaccuggccgugugccccgaggccgagcaggacugccccuucaagcacuacggcugcgccgugaccgacaagagaagaaaccugcagcagcacgagcacagcgcccugagagagcacaugagacuggugcuggagaagaacgugcagcuggaggagcagaucagcgaccugcacaagagccuggagcagaaggagagcaagauccagcagcuggccgagaccaucaagaagcuggagaaggaguucaagcaguucgcccagcuguucggcaagaacggcagcuuccugcccaacauccagguguucgccagccacaucgacaagagcgccuggcuggaggcccaggugcaccagcugcugcagauggugaaccagcagcagaacaaguucgaccugagaccccugauggaggccguggacaccgugaagcagaagaucacccugcuggagaacaacgaccagagacuggccgugcuggaggaggagaccaacaagcacgacacccacaucaacauccacaaggcccagcugagcaagaacgaggagagauucaagcugcuggagggcaccugcuacaacggcaagcugaucuggaaggugaccgacuacaagaugaagaagagagaggccguggacggccacaccgugagcaucuucagccagagcuucuacaccagcagaugcggcuacagacugugcgccagagccuaccugaacggcgacggcagcggcagaggcagccaccugagccuguacuucguggugaugagaggcgaguucgacagccugcugcaguggcccuucagacagagagugacccugaugcugcuggaccagagcggcaagaagaacaucauggagaccuucaagcccgaccccaacagcagcagcuucaagagacccgacggcgagaugaacaucgccagcggcugccccagauucguggcccacagcgugcuggagaacgccaagaacgccuacaucaaggacgacacccuguuccugaagguggccguggaccugaccgaccuggaggaccuguaa

SEQ ID NO: 24989 - RNA, 1569 nt, Artificial Sequence
  TRAF6__Homo_sapiens__NP_665802
augagccugcugaacugcgagaacagcugcggcagcagccagagcgagagcgacugcugcguggccauggccagcagcugcagcgccgugaccaaggacgacagcgugggcggcaccgccagcaccggcaaccugagcagcagcuucauggaggagauccagggcuacgacguggaguucgaccccccccuggagagcaaguacgagugccccaucugccugauggcccugagagaggccgugcagacccccugcggccacagauucugcaaggccugcaucaucaagagcaucagagacgccggccacaagugccccguggacaacgagauccugcuggagaaccagcuguuccccgacaacuucgccaagagagagauccugagccugauggugaagugccccaacgagggcugccugcacaagauggagcugagacaccuggaggaccaccaggcccacugcgaguucgcccugauggacugcccccagugccagagacccuuccagaaguuccacaucaacauccacauccugaaggacugccccagaagacaggugagcugcgacaacugcgccgccagcauggccuucgaggacaaggagauccacgaccagaacugcccccuggccaacgugaucugcgaguacugcaacaccauccugaucagagagcagaugcccaaccacuacgaccuggacugccccaccgcccccauccccugcaccuucagcaccuucggcugccacgagaagaugcagagaaaccaccuggccagacaccugcaggagaacacccagagccacaugagaaugcuggcccaggccgugcacagccugagcgugauccccgacagcggcuacaucagcgaggugagaaacuuccaggagaccauccaccagcuggagggcagacuggugagacaggaccaccagaucagagagcugaccgccaagauggagacccagagcauguacgugagcgagcugaagagaaccaucagaacccuggaggacaagguggccgagaucgaggcccagcagugcaacggcaucuacaucuggaagaucggcaacuucggcaugcaccugaagugccaggaggaggagaagcccguggugauccacagccccggcuucuacaccggcaagcccggcuacaagcugugcaugagacugcaccugcagcugcccaccgcccagagaugcgccaacuacaucagccuguucgugcacaccaugcagggcgaguacgacagccaccugcccuggcccuuccagggcaccaucagacugaccauccuggaccagagcgaggcccccgugagacagaaccacgaggagaucauggacgccaagcccgagcugcuggccuuccagagacccaccauccccagaaaccccaagggcuucggcuacgugaccuucaugcaccuggaggcccugagacagagaaccuucaucaaggacgacacccugcuggugagaugcgaggugagcaccagauucgacaugggcagccugagaagagagggcuuccagcccagaagcaccgacgccggcguguaa

SEQ ID NO: 24990 - RNA, 2013 nt, Artificial Sequence
  TRAF7__Homo_sapiens__NP_115647
augagcagcggcaagagcgccagauacaacagauucagcggcggccccagcaaccugcccacccccgacgugaccaccggcaccagaauggagaccaccuucggccccgccuucagcgccgugaccaccaucaccaaggccgacggcaccagcaccuacaagcagcacugcagaacccccagcagcagcagcacccuggccuacagccccagagacgaggaggacagcaugccccccaucagcacccccagaagaagcgacagcgccaucagcgugagaagccugcacagcgagagcagcaugagccugagaagcaccuucagccugcccgaggaggaggaggagcccgagccccugguguucgccgagcagcccagcgugaagcugugcugccagcugugcugcagcguguucaaggaccccgugaucaccaccugcggccacaccuucugcagaagaugcgcccugaagagcgagaagugccccguggacaacgugaagcugaccgugguggugaacaacaucgccguggccgagcagaucggcgagcuguucauccacugcagacacggcugcagaguggccggcagcggcaagccccccaucuucgagguggaccccagaggcugccccuucaccaucaagcugagcgccagaaaggaccacgagggcagcugcgacuacagacccgugagaugccccaacaaccccagcugccccccccugcugagaaugaaccuggaggcccaccugaaggagugcgagcacaucaagugcccccacagcaaguacggcugcaccuucaucggcaaccaggacaccuacgagacccaccuggagaccugcagauucgagggccugaaggaguuccugcagcagaccgacgacagauuccacgagaugcacguggcccuggcccagaaggaccaggagaucgccuuccugagaagcaugcugggcaagcugagcgagaagaucgaccagcuggagaagagccuggagcugaaguucgacgugcuggacgagaaccagagcaagcugagcgaggaccugauggaguucagaagagacgccagcaugcugaacgacgagcugagccacaucaacgccagacugaacaugggcauccugggcagcuacgacccccagcagaucuucaagugcaagggcaccuucgugggccaccagggccccguguggugccugugcguguacagcaugggcgaccugcuguucagcggcagcagcgacaagaccaucaaggugugggacaccugcaccaccuacaagugccagaagacccuggagggccacgacggcaucgugcuggcccugugcauccagggcugcaagcuguacagcggcagcgccgacugcaccaucaucgugugggacauccagaaccugcagaaggugaacaccaucagagcccacgacaaccccgugugcacccuggugagcagccacaacgugcuguucagcggcagccugaaggccaucaaggugugggacaucgugggcaccgagcugaagcugaagaaggagcugaccggccugaaccacugggugagagcccugguggccgcccagagcuaccuguacagcggcagcuaccagaccaucaagaucugggacaucagaacccuggacugcauccacgugcugcagaccagcggcggcagcguguacagcaucgccgugaccaaccaccacaucgugugcggcaccuacgagaaccugauccacgugugggacaucgagagcaaggagcaggugagaacccugaccggccacgugggcaccguguacgcccuggccgugaucagcacccccgaccagaccaagguguucagcgccagcuacgacagaagccugagaguguggagcauggacaacaugaucugcacccagacccugcugagacaccagggcagcgugaccgcccuggccgugagcagaggcagacuguucagcggcgccguggacagcaccgugaagguguggaccugcuaa

SEQ ID NO: 24991 - RNA, 1749 nt, Artificial Sequence
  TRAFD1__Homo_sapiens__NP_006691
auggccgaguuccuggacgaccaggagaccagacugugcgacaacugcaagaaggagauccccguguucaacuucaccauccacgagauccacugccagagaaacaucggcaugugccccaccugcaaggagcccuuccccaagagcgacauggagacccacauggccgccgagcacugccaggugaccugcaagugcaacaagaagcuggagaagagacugcugaagaagcacgaggagaccgagugcccccugagacuggccgugugccagcacugcgaccuggagcugagcauccugaagcugaaggagcacgaggacuacugcggcgccagaaccgagcugugcggcaacugcggcagaaacgugcuggugaaggaccugaagacccaccccgaggugugcggcagagagggcgaggagaagagaaacgagguggccaucccccccaacgccuacgacgagagcuggggccaggacggcaucuggaucgccagccagcugcugagacagaucgaggcccuggacccccccaugagacugcccagaagaccccugagagccuucgagagcgacguguuccacaacagaaccaccaaccagagaaacaucaccgcccaggugagcauccagaacaaccuguucgaggagcaggagagacaggagagaaacagaggccagcagccccccaaggagggcggcgaggagagcgccaaccuggacuucaugcuggcccugagccugcagaacgagggccaggccagcagcguggccgagcaggacuucuggagagccgugugcgaggccgaccagagccacggcggccccagaagccugagcgacaucaagggcgccgccgacgagaucaugcugcccugcgaguucugcgaggagcuguaccccgaggagcugcugaucgaccaccagaccagcugcaaccccagcagagcccugcccagccugaacaccggcagcagcagccccagaggcguggaggagcccgacgugaucuuccagaacuuccugcagcaggccgccagcaaccagcuggacagccugaugggccugagcaacagccaccccguggaggagagcaucaucauccccugcgaguucugcggcgugcagcuggaggaggaggugcuguuccaccaccaggaccagugcgaccagagacccgccaccgccaccaaccacgugaccgagggcauccccagacuggacagccagccccaggagaccagccccgagcugcccagaagaagagugagacaccagggcgaccugagcagcggcuaccuggacgacaccaagcaggagaccgccaacggccccaccagcugccugccccccagcagacccaucaacaacaugaccgccaccuacaaccagcugagcagaagcaccagcggccccagacccggcugccagcccagcagccccugcgugcccaagcugagcaacagcgacagccaggacauccagggcagaaacagagacagccagaacggcgccaucgcccccggccacgugagcgugaucagacccccccagaaccuguaccccgagaacaucgugcccagcuucagccccggccccagcggcagauacggcgccagcggcagaagcgagggcggcagaaacagcagagugacccccgccgccgccaacuacagaagcagaaccgccaaggccaagcccagcaagcagcagggcgccggcgacgccgaggaggaggaggaggaguaa

SEQ ID NO: 24992 - RNA, 2862 nt, Artificial Sequence
  TRAK1__Homo_sapiens__NP_001036111
auggcccugguguuccaguucggccagcccgugagagcccagccccugcccggccugugccacggcaagcugaucagaaccaacgccugcgacgugugcaacagcaccgaccugcccgagguggagaucaucagccugcuggaggagcagcugccccacuacaagcugagagccgacaccaucuacggcuacgaccacgacgacuggcugcacaccccccugaucagccccgacgccaacaucgaccugaccaccgagcagaucgaggagacccugaaguacuuccugcugugcgccgagagagugggccagaugaccaagaccuacaacgacaucgacgccgugaccagacugcuggaggagaaggagagagaccuggagcuggccgccagaaucggccagagccugcugaagaagaacaagacccugaccgagagaaacgagcugcuggaggagcagguggagcacaucagagaggaggugagccagcugagacacgagcugagcaugaaggacgagcugcugcaguucuacaccagcgccgccgaggagagcgagcccgagagcgugugcagcaccccccugaagagaaacgagagcagcagcagcgugcagaacuacuuccaccuggacagccugcagaagaagcugaaggaccuggaggaggagaacguggugcugagaagcgaggccagccagcugaagaccgagaccaucaccuacgaggagaaggagcagcagcuggugaacgacugcgugaaggagcugagagacgccaacgugcagaucgccagcaucagcgaggagcuggccaagaagaccgaggacgccgccagacagcaggaggagaucacccaccugcugagccagaucguggaccugcagaagaaggccaaggccugcgccguggagaacgaggagcuggugcagcaccugggcgccgccaaggacgcccagagacagcugaccgccgagcugagagagcuggaggacaaguacgccgagugcauggagaugcugcacgaggcccaggaggagcugaagaaccugagaaacaagaccaugcccaacaccaccagcagaagauaccacagccugggccuguuccccauggacagccuggccgccgagaucgagggcaccaugagaaaggagcugcagcuggaggaggccgagagccccgacaucacccaccagaagagaguguucgagaccgugagaaacaucaaccagguggugaagcagagaagccugacccccagccccaugaacauccccggcagcaaccagagcagcgccaugaacagccugcugagcagcugcgugagcacccccagaagcagcuucuacggcagcgacaucggcaacguggugcuggacaacaagaccaacagcaucauccuggagaccgaggccgccgaccugggcaacgacgagagaagcaagaagcccggcacccccggcacccccggcagccacgaccuggagaccgcccugagaagacugagccugagaagagagaacuaccugagcgagagaagauucuucgaggaggagcaggagagaaagcugcaggagcuggccgagaagggcgagcugagaagcggcagccugacccccaccgagagcaucaugagccugggcacccacagcagauucagcgaguucaccggcuucagcggcaugagcuucagcagcagaagcuaccugcccgagaagcugcagaucgugaagccccuggagggcagcgccacccugcaccacuggcagcagcuggcccagccccaccugggcggcauccuggaccccagacccggcguggugaccaagggcuucagaacccuggacguggaccuggacgagguguacugccugaacgacuucgaggaggacgacaccggcgaccacaucagccugcccagacuggccaccagcacccccgugcagcaccccgagaccagcgcccaccaccccggcaagugcaugagccagaccaacagcaccuucaccuucaccaccugcagaauccugcaccccagcgacgagcugaccagagugacccccagccugaacagcgcccccacccccgccugcggcagcaccagccaccugaagagcacccccguggccacccccugcacccccagaagacugagccuggccgagagcuucaccaacaccagagagagcaccaccaccaugagcaccagccugggccugguguggcugcugaaggagagaggcaucagcgccgccguguacgacccccagagcugggacagagccggcagaggcagccugcugcacagcuacacccccaagauggccgugauccccagcaccccccccaacagccccaugcagacccccaccagcagcccccccagcuucgaguucaagugcaccagcccccccuacgacaacuuccuggccagcaagcccgccagcagcauccugagagaggugagagagaagaacgugagaagcagcgagagccagaccgacgugagcgugagcaaccugaaccugguggacaaggugagaagauucggcguggccaagguggugaacagcggcagagcccacgugcccacccugaccgaggagcagggcccccugcugugcggcccccccggccccgcccccgcccuggugcccagaggccuggugcccgagggccugccccugagaugccccaccgugaccagcgccaucggcggccugcagcugaacagcggcaucagaagaaacagaagcuuccccaccauggugggcagcagcaugcagaugaaggcccccgugacccugaccagcggcauccugaugggcgccaagcugagcaagcagaccagccugagauaa

SEQ ID NO: 24993 - RNA, 2745 nt, Artificial Sequence
  TRAK2__Homo_sapiens__NP_055864
augagccagagccagaacgccaucuucaccagccccaccggcgaggagaaccugaugaacagcaaccacagagacagcgagagcaucaccgacgugugcagcaacgaggaccugcccgagguggagcuggugagccugcuggaggagcagcugccccaguacagacugaagguggacacccuguuccuguacgagaaccaggacuggacccagagcccccaccagagacagcacgccagcgacgcccugagccccgugcuggccgaggagaccuucagauacaugauccugggcaccgacagaguggagcagaugaccaagaccuacaacgacaucgacauggugacccaccugcuggccgagagagacagagaccuggagcuggccgccagaaucggccaggcccugcugaagagaaaccacgugcugagcgagcagaacgagagccuggaggagcagcugggccaggccuucgaccaggugaaccagcugcagcacgagcugugcaagaaggacgagcugcugagaaucgugagcaucgccagcgaggagagcgagaccgacagcagcugcagcaccccccugagauucaacgagagcuucagccugagccagggccugcugcagcuggagaugcugcaggagaagcugaaggagcuggaggaggagaacauggcccugagaagcaaggccugccacaucaagaccgagaccgugaccuacgaggagaaggagcagcagcuggugagcgacugcgugaaggagcugagagagaccaacgcccagaugagcagaaugaccgaggagcugagcggcaagagcgacgagcugaucagauaccaggaggagcugagcagccugcugagccagaucguggaccugcagcacaagcugaaggagcacgugaucgagaaggaggagcugaagcugcaccugcaggccagcaaggacgcccagagacagcugaccauggagcugcacgagcugcaggacagaaacauggagugccugggcaugcugcacgagagccaggaggagaucaaggagcugagaagcagaagcggccccaccgcccaccuguacuucagccagagcuacggcgccuucaccggcgagagccuggccgccgagaucgagggcaccaugagaaagaagcugagccuggacgaggagagcagccuguucaagcagaaggcccagcagaagagaguguucgacaccgugagaaucgccaacgacaccagaggcagaagcaucagcuuccccgcccugcugcccauccccggcagcaacagaagcagcgugaucaugaccgccaagcccuucgagagcggccugcagcagaccgaggacaagagccugcugaaccagggcagcagcagcgaggagguggccggcagcagccagaagaugggccagcccggccccagcggcgacagcgaccuggccaccgcccugcacagacugagccugagaagacagaacuaccugagcgagaagcaguucuucgccgaggaguggcagagaaagauccaggugcuggccgaccagaaggagggcgugagcggcugcgugacccccaccgagagccuggccagccugugcaccacccagagcgagaucaccgaccugagcagcgccagcugccugagaggcuucaugcccgagaagcugcagaucgugaagccccuggagggcagccagacccuguaccacuggcagcagcuggcccagcccaaccugggcaccauccuggaccccagacccggcgugaucaccaagggcuucacccagcugcccggcgacgccaucuaccacaucagcgaccuggaggaggacgaggaggagggcaucaccuuccaggugcagcagccccuggagguggaggagaagcugagcaccagcaagcccgugaccggcaucuuccugccccccaucaccagcgccggcggccccgugaccguggccaccgccaaccccggcaagugccugagcugcaccaacagcaccuucaccuucaccaccugcagaauccugcaccccagcgacaucacccaggugacccccagcagcggcuuccccagccugagcugcggcagcagcggcagcagcagcagcaacaccgccgugaacagccccgcccugagcuacagacugagcaucggcgagagcaucaccaacagaagagacagcaccaccaccuucagcagcaccaugagccuggccaagcugcugcaggagagaggcaucagcgccaagguguaccacagccccaucagcgagaacccccugcagccccugcccaagagccuggccauccccagcaccccccccaacagccccagccacagccccugccccagcccccugcccuucgagcccagagugcaccugagcgagaacuuccuggccagcagacccgccgagaccuuccugcaggagauguacggccugagacccagcagaaacccccccgacgugggccagcugaagaugaaccugguggacagacugaagagacugggcaucgccagaguggugaagaaccccggcgcccaggagaacggcagaugccaggaggccgagaucggcccccagaagcccgacagcgccguguaccugaacagcggcagcagccugcugggcggccugagaagaaaccagagccugcccgugaucaugggcagcuucgccgcccccgugugcaccagcagccccaagaugggcgugcugaaggaggacuaa

SEQ ID NO: 24994 - RNA, 1125 nt, Artificial Sequence
  TRAM1__Homo_sapiens__NP_055109
auggccaucagaaagaagagcaccaagagcccccccgugcugagccacgaguucgugcugcagaaccacgccgacaucgugagcugcguggccaugguguuccugcugggccugauguucgagaucaccgccaaggccagcaucaucuucgugacccugcaguacaacgugacccugcccgccaccgaggagcaggccaccgagagcgugagccuguacuacuacggcaucaaggaccuggccaccguguucuucuacaugcugguggccaucaucauccacgccgugauccaggaguacaugcuggacaagaucaacagaagaaugcacuucagcaagaccaagcacagcaaguucaacgagagcggccagcugagcgccuucuaccuguucgccugcguguggggcaccuucauccugaucagcgagaacuacaucagcgaccccaccauccuguggagagccuacccccacaaccugaugaccuuccagaugaaguucuucuacaucagccagcuggccuacuggcugcacgccuuccccgagcuguacuuccagaagaccaagaaggaggacauccccagacagcugguguacaucggccuguaccuguuccacaucgccggcgccuaccugcugaaccugaaccaccugggccuggugcugcuggugcugcacuacuucguggaguuccuguuccacaucagcagacuguucuacuucagcaacgagaaguaccagaagggcuucagccugugggccgugcuguucgugcugggcagacugcugacccugauccugagcgugcugaccgugggcuucggccuggccagagccgagaaccagaagcuggacuucagcaccggcaacuucaacgugcuggccgugagaaucgccgugcuggccagcaucugcgugacccaggccuucaugauguggaaguucaucaacuuccagcugagaagauggagagagcacagcgccuuccaggcccccgccgugaagaagaagcccaccgugaccaagggcagaagcagcaagaagggcaccgagaacggcgugaacggcacccugaccagcaacguggccgacagccccagaaacaagaaggagaagagcagcuaa

SEQ ID NO: 24995 - RNA, 1110 nt, Artificial Sequence
  TRAM1L1__Homo_sapiens__NP_689615
augggccugagaaagaagagcaccaagaacccccccgugcugagccaggaguucauccugcagaaccacgccgacaucgugagcugcgugggcauguucuuccugcugggccugguguucgagggcaccgccgaggccagcaucguguuccugacccugcagcacagcguggccgugcccgccgccgaggagcaggccaccggcagcaagagccuguacuacuacggcgugaaggaccuggccaccguguucuucuacaugcugguggccaucaucauccacgccaccauccaggaguacgugcuggacaagaucaacaagagaaugcaguucaccaaggccaagcagaacaaguucaacgagagcggccaguucagcguguucuacuucuucagcugcaucuggggcaccuucauccugaucagcgagaacugccugagcgaccccacccugaucuggaaggccagaccccacagcaugaugaccuuccagaugaaguucuucuacaucagccagcuggccuacugguuccacgccuuccccgagcuguacuuccagaagaccaagaagcaggacauccccagacagcugguguacaucggccugcaccuguuccacaucaccggcgccuaccugcuguaccugaaccaccugggccugcugcugcuggugcugcacuacuucguggagcugcugagccacaugugcggccuguucuacuucagcgacgagaaguaccagaagggcaucagccugugggccaucguguucauccugggcagacuggugacccugaucgugagcgugcugaccgugggcuuccaccuggccggcagccagaacagaaaccccgacgcccugaccggcaacgugaacgugcuggccgccaagaucgccgugcugagcagcagcugcaccauccaggccuacgugaccuggaaccugaucacccuguggcugcagagauggguggaggacagcaacauccaggccagcugcaugaagaagaagagaagcagaagcagcaagaagagaaccgagaacggcgugggcguggagaccagcaacagaguggacugcccccccaagagaaaggagaagagcagcuaa

SEQ ID NO: 24996 - RNA, 1113 nt, Artificial Sequence
  TRAM2__Homo_sapiens__NP_036420
auggccuucagaagaagaaccaagagcuacccccuguucagccaggaguucgugauccacaaccacgccgacaucggcuucugccuggugcugugcgugcugaucggccugauguucgaggugaccgccaagaccgccuuccuguucauccugccccaguacaacaucagcgugcccaccgccgacagcgagaccgugcacuaccacuacggccccaaggaccuggugaccauccuguucuacaucuucaucaccaucauccugcacgccguggugcaggaguacauccuggacaagaucagcaagagacugcaccugagcaaggugaagcacagcaaguucaacgagagcggccagcuggugguguuccacuucaccagcgugaucuggugcuucuacgugguggugaccgagggcuaccugaccaaccccagaagccugugggaggacuacccccacgugcaccugcccuuccaggugaaguucuucuaccugugccagcuggccuacuggcugcacgcccugcccgagcuguacuuccagaaggugagaaaggaggagauccccagacagcugcaguacaucugccuguaccuggugcacaucgccggcgccuaccugcugaaccugagcagacugggccugauccugcugcugcugcaguacagcaccgaguuccuguuccacaccgccagacuguucuacuucgccgacgagaacaacgagaagcuguucagcgccugggccgccguguucggcgugaccagacuguucauccugacccuggccgugcuggccaucggcuucggccuggccagaauggagaaccaggccuucgaccccgagaagggcaacuucaacacccuguucugcagacugugcgugcugcugcuggugugcgccgcccaggccuggcugauguggagauucauccacagccagcugagacacuggagagaguacuggaacgagcagagcgccaagagaagagugcccgccacccccagacugcccgccagacugaucaagagagagagcggcuaccacgagaacggcguggugaaggccgagaacggcaccagccccagaaccaagaagcugaagagccccuaa

SEQ ID NO: 24997 - RNA, 1956 nt, Artificial Sequence
  TRAP1__Homo_sapiens__NP_001258978
auggccagagagcugagagcccugcugcuguggggcagaagacugagaccccugcugagagcccccgcccuggccgccgugcccggcggcagcaccagcaagcacgaguuccaggccgagaccaagaagcugcuggacaucguggccagaagccuguacagcgagaaggagguguucaucagagagcugaucagcaacgccagcgacgcccuggagaagcugagacacaagcuggugagcgacggccaggcccugcccgagauggagauccaccugcagaccaacgccgagaagggcaccaucaccauccaggacaccggcaucggcaugacccaggaggagcuggugagcaaccugggcaccaucgccagaagcggcagcaaggccuuccuggacgcccugcagaaccaggccgaggccagcagcaagaucaucggccaguucggcgugggcuucuacagcgccuucaugguggccgacagaguggagguguacagcagaagcgccgcccccggcagccugggcuaccaguggcugagcgacggcagcggcguguucgagaucgccgaggccagcggcgugagaaccggcaccaagaucaucauccaccugaagagcgacugcaaggaguucagcagcgaggccagagugagagacguggugaccaaguacagcaacuucgugagcuucccccuguaccugaacggcagaagaaugaacacccugcaggccaucuggaugauggaccccaaggacgugagagaguggcagcacgaggaguucuacagauacguggcccaggcccacgacaagcccagauacacccugcacuacaagaccgacgccccccugaacaucagaagcaucuucuacgugcccgacaugaagcccagcauguucgacgugagcagagagcugggcagcagcguggcccuguacagcagaaaggugcugauccagaccaaggccaccgacauccugcccaaguggcugagauucaucagaggcgugguggacagcgaggacaucccccugaaccugagcagagagcugcugcaggagagcgcccugaucagaaagcugagagacgugcugcagcagagacugaucaaguucuucaucgaccagagcaagaaggacgccgagaaguacgccaaguucuucgaggacuacggccuguucaugagagagggcaucgugaccgccaccgagcaggaggugaaggaggacaucgccaagcugcugagauacgagagcagcgcccugcccagcggccagcugaccagccugagcgaguacgccagcagaaugagagccggcaccagaaacaucuacuaccugugcgcccccaacagacaccuggccgagcacagccccuacuacgaggccaugaagaagaaggacaccgaggugcuguucugcuucgagcaguucgacgagcugacccugcugcaccugagagaguucgacaagaagaagcugaucagcguggagaccgacaucgugguggaccacuacaaggaggagaaguucgaggacagaagccccgccgccgagugccugagcgagaaggagaccgaggagcugauggccuggaugagaaacgugcugggcagcagagugaccaacgugaaggugacccugagacuggacacccaccccgccauggugaccgugcuggagaugggcgccgccagacacuuccugagaaugcagcagcuggccaagacccaggaggagagagcccagcugcugcagcccacccuggagaucaaccccagacacgcccugaucaagaagcugaaccagcugagagccagcgagcccggccuggcccagcugcugguggaccagaucuacgagaacgccaugaucgccgccggccugguggacgaccccagagccauggugggcagacugaacgagcugcuggugaaggcccuggagagacacuaa

SEQ ID NO: 24998 - RNA, 3780 nt, Artificial Sequence
  TRAPPC10__Homo_sapiens__NP_003265
auggacgccagcgaggagccccugccccccgugaucuacaccauggagaacaagcccaucgugaccugcgccggcgaccagaaccuguucaccagcguguaccccacccugagccagcagcugcccagagagcccauggaguggagaagaagcuacggcagagcccccaagaugauccaccuggagagcaacuucgugcaguucaaggaggagcugcugcccaaggagggcaacaaggcccugcugaccuuccccuuccugcacaucuacuggaccgagugcugcgacaccgagguguacaaggccaccgugaaggacgaccugaccaaguggcagaacgugcugaaggcccacagcagcguggacuggcugaucgugaucguggagaacgacgccaagaagaagaacaagaccaacauccugcccagaaccagcaucguggacaagaucagaaacgacuucugcaacaagcagagcgacagaugcguggugcugagcgacccccugaaggacagcagcagaacccaggagagcuggaacgccuuccugaccaagcugagaacccugcugcugaugagcuucaccaagaaccugggcaaguucgaggacgacaugagaacccugagagagaagagaaccgagcccggcuggagcuucugcgaguacuucauggugcaggaggagcuggccuucguguucgagaugcugcagcaguucgaggacgcccuggugcaguacgacgagcuggacgcccuguucagccaguacguggugaacuucggcgccggcgacggcgccaacuggcugaccuucuucugccagcccgugaagagcuggaacggccugauccugagaaagcccaucgacauggagaagagagagagcauccagagaagagaggccacccugcuggaccugagaagcuaccuguucagcagacagugcacccugcugcuguuccugcagagacccugggagguggcccagagagcccuggagcugcugcacaacugcgugcaggagcugaagcugcuggaggugagcgugccccccggcgcccuggacugcuggguguuccugagcugccuggaggugcugcagagaaucgagggcugcugcgacagagcccagaucgacagcaacaucgcccacaccgugggccuguggagcuacgccaccgagaagcugaagagccugggcuaccugugcggccuggugagcgagaagggccccaacagcgaggaccugaacagaaccguggaccugcuggccggccugggcgccgagagacccgagaccgccaacaccgcccagagccccuacaagaagcugaaggaggcccugagcagcguggaggccuucgagaagcacuaccuggaccugagccacgccaccaucgagauguacaccagcaucggcagaaucagaagcgccaaguucgugggcaaggaccuggccgaguucuacaugagaaagaaggccccccagaaggccgagaucuaccugcagggcgcccugaagaacuaccuggccgagggcugggcccugcccaucacccacaccagaaagcagcuggccgagugccagaagcaccugggccagaucgagaacuaccugcagaccagcagccugcuggccagcgaccaccaccugaccgaggaggagagaaagcacuucugccaggagauccuggacuucgccagccagcccagcgacagccccggccacaagaucgugcugcccaugcacagcuucgcccagcugagagaccugcacuucgaccccagcaacgccguggugcacgugggcggcgugcugugcguggagaucaccauguacagccagaugcccgugcccgugcacguggagcagaucguggugaacgugcacuucagcaucgagaagaacagcuacagaaagaccgccgaguggcugaccaagcacaagaccagcaacggcaucaucaacuucccccccgagaccgcccccuuccccgugagccagaacagccugcccgcccuggagcuguacgagauguucgagagaagccccagcgacaacagccugaacaccaccggcaucaucugcagaaacgugcacaugcugcugagaagacaggagagcagcagcagccuggagaugcccagcggcguggcccuggaggagggcgcccacgugcugagaugcagccacgugacccuggagcccggcgccaaccagaucaccuucagaacccaggccaaggagcccggcaccuacacccugagacagcugugcgccagcgugggcagcgugugguucgugcugccccacaucuaccccaucgugcaguacgacguguacagccaggagccccagcugcacguggagccccuggccgacagccugcuggccggcaucccccagagagugaaguucaccgugaccaccggccacuacaccaucaagaacggcgacagccugcagcugagcaacgccgaggccaugcugauccugugccaggccgagagcagagccgugguguacagcaacaccagagagcagagcagcgaggccgcccugagaauccagagcagcgacaaggugaccagcaucagccugcccguggcccccgccuaccacgugaucgaguucgagcuggaggugcugagccugcccagcgcccccgcccugggcggcgagagcgacaugcugggcauggccgagccccacagaaagcacaaggacaagcagagaaccggcagaugcauggugaccaccgaccacaaggugagcaucgacugccccuggagcaucuacagcaccgugaucgcccugaccuucagcgugcccuucagaaccacccacagccugcugagcagcggcaccagaaaguacgugcaggugugcgugcagaaccugagcgagcuggacuuccagcugagcgacagcuaccugguggacaccggcgacagcaccgaccugcagcuggugccccugaacacccagagccagcagcccaucuacagcaagcagagcguguucuucgugugggagcugaaguggaccgaggagcccccccccagccugcacugcagauucagcgugggcuucagccccgccagcgaggagcagcugagcaucagccugaagcccuacaccuacgaguucaagguggagaacuucuucacccuguacaacgugaaggccgagaucuucccccccagcggcauggaguacugcagaaccggcagccugugcagccuggaggugcugaucaccagacugagcgaccugcuggagguggacaaggacgaggcccugaccgagagcgacgagcacuucagcaccaagcugauguacgaggugguggacaacagcagcaacugggccgugugcggcaagagcugcggcgugaucagcaugcccguggccgccagagccacccacagagugcacauggaggugaugccccuguucgccggcuaccugccccugcccgacgugagacuguucaaguaccugccccaccacagcgcccacagcagccagcuggacgccgacagcuggaucgagaacgacagccugagcguggacaagcacggcgacgaccagcccgacagcagcagccugaagagcagaggcagcgugcacagcgccugcagcagcgagcacaagggccugcccaugcccagacugcaggcccugcccgccggccagguguucaacagcagcagcggcacccaggugcuggugauccccagccaggacgaccacgugcuggaggugagcgugaccuaa

SEQ ID NO: 24999 - RNA, 3402 nt, Artificial Sequence
  TRAPPC11__Homo_sapiens__NP_068761
augagccccacccagugggacuuccccguggagcugugcugcagacccauggccuucgugacccugaccggccuggacgugguguacaacgccgugcacagagccgugugggacgccuucugcgccaacagaagagccgacagagugcccaucagcuucaaggugcugcccggcgaccacgaguaccccaagugcagacccaagagaaccagcuacgagugguacauccccaagggcauccugaagaccggcuggaugaacaagcaccugaaccuggugcccgcccugguggugguguucuacgagcuggacugggacgagccccaguggaaggagaagcagagcgagugcgccaccagaguggagaucgugagacagagccugcagggcagaaacaccaagguggccguggugcugauccagaagaagaccccccugccccccggcgaggacgugaucgccagcgagagagccgccgcccugugcaacgccugcgagcugagcggcaagagccuguucgugcugccccacaccgaccaccuggugggcuacaucaucagacuggagaacgccuucuacgagcacgcccagaccuacuacuacaccgagaucagaagagugaagagccacaaggaguuccugaacaagaccacccaccagcugcuguucgugagacaccaguucaagaucgccuucuucagcgagcugaagcaggacacccagaacgcccugaagaacuacagaaccgccuacaaccuggugcacgagcugagagcccacgagaccaacauccuggagaucaagaccauggccggcuucaucaacuacaagaucugcagacugugcuuccagcacaacaccccccuggacgccaucgcccaguucagaaagcacaucgaccugugcaagaagaagaucggcagcgccgagcugagcuucgagcacgacgccuggaugagcaagcaguuccaggccuucggcgaccuguucgacgaggccaucaagcugggccugaccgccauccagacccagaaccccggcuucuacuaccagcaggccgccuacuacgcccaggagagaaagcagcuggccaagacccugugcaaccacgaggccagcgugauguaccccaaccccgacccccuggagacccagaccggcgugcuggacuucuacggccagagaagcuggagacagggcauccugagcuucgaccugagcgaccccgagaaggagaaggugggcauccuggccauccagcugaaggagagaaacguggugcacagcgagaucaucaucacccugcugagcaacgccguggcccaguucaagaaguacaagugccccagaaugaagagccaccugauggugcagaugggcgaggaguacuacuacgccaaggacuacaccaaggcccugaagcugcuggacuacgugaugugcgacuacagaagcgagggcugguggacccugcugaccagcgugcugaccaccgcccugaagugcagcuaccugauggcccagcugaaggacuacaucaccuacagccuggagcugcugggcagagccagcacccugaaggacgaccagaagagcagaaucgagaagaaccugaucaacgugcugaugaacgagagccccgaccccgagcccgacugcgacauccuggccgugaagaccgcccagaagcugugggccgacagaaucagccuggccggcagcaacaucuucaccaucggcgugcaggacuucgugcccuucgugcagugcaaggccaaguuccacgcccccagcuuccacguggacgugcccgugcaguucgacaucuaccugaaggccgacugcccccaccccaucagauucagcaagcugugcgugagcuucaacaaccaggaguacaaccaguucugcgugaucgaggaggccagcaaggccaacgaggugcuggagaaccugacccagggcaagaugugccuggugcccggcaagaccagaaagcugcuguucaaguucguggccaagaccgaggacgugggcaagaagaucgagaucaccagcguggaccuggcccugggcaacgagaccggcagaugcguggugcugaacuggcagggcggcggcggcgacgccgccagcagccaggaggcccugcaggccgccagaagcuucaagagaagacccaagcugcccgacaacgaggugcacugggacagcaucaucauccaggccagcaccaugaucaucagcagagugcccaacaucagcgugcaccugcugcacgagccccccgcccugaccaacgagauguacugccugguggugaccgugcagagccacgagaagacccagaucagagacgugaagcugaccgccggccugaagcccggccaggacgccaaccugacccagaagacccacgugacccugcacggcaccgagcugugcgacgagagcuaccccgcccugcugaccgacauccccgugggcgaccugcaccccggcgagcagcuggagaagaugcuguacgugagaugcggcaccgugggcagcagaauguuccugguguacgugagcuaccugaucaacaccaccguggaggagaaggagaucgugugcaagugccacaaggacgagaccgugaccaucgagaccguguuccccuucgacguggccgugaaguucgugagcaccaaguucgagcaccuggagagaguguacgccgacauccccuuccugcugaugaccgaccugcugagcgccagccccugggcccugaccaucgugagcagcgagcugcagcuggcccccagcaugaccaccguggaccagcuggagagccagguggacaacgugauccugcagaccggcgagagcgccagcgagugcuucugccugcagugccccagccugggcaacaucgagggcggcguggccaccggccacuacaucaucagcuggaagagaaccagcgccauggagaacauccccaucaucaccaccgugaucacccugccccacgugaucguggagaacaucccccugcacgugaacgccgaccugcccagcuucggcagagugagagagagccugcccgugaaguaccaccugcagaacaagaccgaccuggugcaggacguggagaucagcguggagcccagcgacgccuucauguucagcggccugaagcagaucagacugagaauccugcccggcaccgagcaggagaugcuguacaacuucuacccccugauggccggcuaccagcagcugcccagccugaacaucaaccugcugagauuccccaacuucaccaaccagcugcugagaagauucauccccaccagcaucuucgugaagccccagggcagacugauggacgacaccagcaucgccgccgccuaa

SEQ ID NO: 25000 - RNA, 438 nt, Artificial Sequence
  TRAPPC1__Homo_sapiens__NP_067033
augaccgugcacaaccuguaccuguucgacagaaacggcgugugccugcacuacagcgaguggcacagaaagaagcaggccggcauccccaaggaggaggaguacaagcugauguacggcaugcuguucagcaucagaagcuucgugagcaagaugagcccccuggacaugaaggacggcuuccuggccuuccagaccagcagauacaagcugcacuacuacgagacccccaccggcaucaagguggugaugaacaccgaccugggcgugggccccaucagagacgugcugcaccacaucuacagcgcccuguacguggagcugguggugaagaacccccugugcccccugggccagaccgugcagagcgagcuguucagaagcagacuggacagcuacgugagaagccugcccuucuucagcgccagagccggcuaa

SEQ ID NO: 25001 - RNA, 525 nt, Artificial Sequence
  TRAPPC2__Homo_sapiens__NP_001122307
augagcagcuggaagcaggacagaagcggccugagaagcaccgagcugaacgugcuggaguaccagccccugugcgccgugagaagccacauccugaagaccaugagcggcagcuucuacuucgugaucgugggccaccacgacaaccccguguucgagauggaguuccugcccgccggcaaggccgagagcaaggacgaccacagacaccugaaccaguucaucgcccacgccgcccuggaccugguggacgagaacauguggcugagcaacaacauguaccugaagaccguggacaaguucaacgagugguucgugagcgccuucgugaccgccggccacaugagauucaucaugcugcacgacaucagacaggaggacggcaucaagaacuucuucaccgacguguacgaccuguacaucaaguucagcaugaaccccuucuacgagcccaacagccccaucagaagcagcgccuucgacagaaaggugcaguuccugggcaagaagcaccugcugagcuaa

SEQ ID NO: 25002 - RNA, 660 nt, Artificial Sequence
  TRAPPC4__Homo_sapiens__NP_057230
auggccaucuucagcguguacguggugaacaaggccggcggccugaucuaccagcuggacagcuacgcccccagagccgaggccgagaagaccuucagcuacccccuggaccugcugcugaagcugcacgacgagagagugcugguggccuucggccagagagacggcaucagagugggccacgccgugcuggccaucaacggcauggacgugaacggcagauacaccgccgacggcaaggaggugcuggaguaccugggcaaccccgccaacuaccccgugagcaucagauucggcagacccagacugaccagcaacgagaagcugaugcuggccagcauguuccacagccuguucgccaucggcagccagcugagccccgagcagggcagcagcggcaucgagaugcuggagaccgacaccuucaagcugcacugcuaccagacccugaccggcaucaaguucguggugcuggccgaccccagacaggccggcaucgacagccugcugagaaagaucuacgagaucuacagcgacuucgcccugaagaaccccuucuacagccuggagaugcccaucagaugcgagcuguucgaccagaaccugaagcuggcccuggagguggccgagaaggccggcaccuucggccccggcagcuaa

SEQ ID NO: 25003 - RNA, 3447 nt, Artificial Sequence
  TRAPPC9__Homo_sapiens__NP_001153844
augagcgugcccgacuacaugcagugcgccgaggaccaccagacccugcuggugguggugcagcccgugggcaucgugagcgaggagaacuucuucagaaucuacaagagaaucugcagcgugagccagaucagcgugagagacagccagagagugcuguacaucagauacagacaccacuacccccccgagaacaacgaguggggcgacuuccagacccacagaaagguggugggccugaucaccaucaccgacugcuucagcgccaaggacuggccccagaccuucgagaaguuccacgugcagaaggagaucuacggcagcacccuguacgacagcagacuguucguguucggccugcagggcgagaucguggagcagcccagaaccgacguggccuucuaccccaacuacgaggacugccagaccguggagaagagaaucgaggacuucaucgagagccuguucaucgugcuggagagcaagagacuggacagagccaccgacaagagcggcgacaagaucccccugcugugcgugcccuucgagaagaaggacuucgugggccuggacaccgacagcagacacuacaagaagagaugccagggcagaaugagaaagcacgugggcgaccugugccugcaggccggcaugcugcaggacagccuggugcacuaccacaugagcguggagcugcugagaagcgugaacgacuuccuguggcugggcgccgcccuggagggccugugcagcgccagcgugaucuaccacuaccccggcggcaccggcggcaagagcggcgccagaagauuccagggcagcacccugcccgccgaggccgccaacagacacagacccggcgcccaggaggugcugaucgaccccggcgcccugaccaccaacggcaucaaccccgacaccagcaccgagaucggcagagccaagaacugccugagccccgaggacaucaucgacaaguacaaggaggccaucagcuacuacagcaaguacaagaacgccggcgugaucgagcuggaggccugcaucaaggccgugagagugcuggccauccagaagagaagcauggaggccagcgaguuccugcagaacgccguguacaucaaccugagacagcugagcgaggaggagaagauccagagauacagcauccugagcgagcuguacgagcugaucggcuuccacagaaagagcgccuucuucaagagaguggccgccaugcagugcguggcccccagcaucgccgagcccggcuggagagccugcuacaagcugcugcuggagacccugcccggcuacagccugagccuggaccccaaggacuucagcagaggcacccacagaggcugggccgccgugcagaugagacugcugcacgagcugguguacgccagcagaagaaugggcaaccccgcccugagcgugagacaccugagcuuccugcugcagaccaugcuggacuuccugagcgaccaggagaagaaggacguggcccagagccuggagaacuacaccagcaagugccccggcaccauggagcccaucgcccugcccggcggccugacccugccccccgugcccuucaccaagcugcccaucgugagacacgugaagcugcugaaccugcccgccagccugagaccccacaagaugaagagccugcugggccagaacgugagcaccaagagccccuucaucuacagccccaucaucgcccacaacagaggcgaggagagaaacaagaagaucgacuuccagugggugcagggcgacgugugcgaggugcagcugaugguguacaaccccaugcccuucgagcugagaguggagaacaugggccugcugaccagcggcguggaguucgagagccugcccgccgcccugagccugcccgccgagagcggccuguaccccgugacccuggugggcgugccccagaccaccggcaccaucaccgugaacggcuaccacaccaccguguucggcguguucagcgacugccugcuggacaaccugcccggcaucaagaccagcggcagcaccguggaggugauccccgcccugcccagacugcagaucagcaccagccugcccagaagcgcccacagccugcagcccagcagcggcgacgagaucagcaccaacgugagcgugcagcuguacaacggcgagagccagcagcugaucaucaagcuggagaacaucggcauggagccccuggagaagcuggaggugaccagcaaggugcugaccaccaaggagaagcuguacggcgacuuccugagcuggaagcuggaggagacccuggcccaguucccccugcagcccggcaagguggccaccuucaccaucaacaucaaggugaagcuggacuucagcugccaggagaaccugcugcaggaccugagcgacgacggcaucagcgugagcggcuucccccugagcagccccuucagacagguggugagacccagaguggagggcaagcccgugaacccccccgagagcaacaaggccggcgacuacagccacgugaagacccuggaggccgugcugaacuucaaguacagcggcggccccggccacaccgagggcuacuacagaaaccugagccugggccugcacguggagguggagcccagcguguucuucaccagagugagcacccugcccgccaccagcaccagacagugccaccugcugcuggacguguucaacagcaccgagcacgagcugaccgugagcaccagaagcagcgaggcccugauccugcacgccggcgagugccagagaauggccauccagguggacaaguucaacuucgagagcuuccccgagagccccggcgagaagggccaguucgccaaccccaagcagcuggaggaggagagaagagaggccagaggccuggagauccacagcaagcugggcaucugcuggagaauccccagccugaagagaagcggcgaggccagcguggagggccugcugaaccagcuggugcuggagcaccugcagcuggccccccugcagugggacgugcugguggacggccagcccugcgacagagaggccguggccgccugccaggugggcgaccccgugagacuggaggugagacugaccaacagaagccccagaagcgugggccccuucgcccugaccguggugcccuuccaggaccaccagaacggcgugcacaacuacgaccugcacgacaccgugagcuucgugggcagcagcaccuucuaccuggacgccgugcagcccagcggccagagcgccugccugggcgcccugcuguuccuguacaccggcgacuucuuccugcacaucagauuccacgaggacagcaccagcaaggagcugccccccagcugguucugccugcccagcgugcacgugugcgcccuggaggcccaggccuaa

SEQ ID NO: 25004 - RNA, 561 nt, Artificial Sequence
  TRAT1__Homo_sapiens__NP_057472
augagcggcaucagcggcugccccuucuuccuguggggccugcuggcccugcugggccuggcccuggugaucagccugaucuucaacaucagccacuacguggagaagcagagacaggacaagauguacagcuacagcagcgaccacaccagaguggacgaguacuacaucgaggacacccccaucuacggcaaccuggacgacaugaucagcgagcccauggacgagaacugcuacgagcagaugaaggccagacccgagaagagcgugaacaagaugcaggaggccacccccagcgcccaggccaccaacgagacccagaugugcuacgccagccuggaccacagcgugaagggcaagagaagaaagcccagaaagcagaacacccacuucagcgacaaggacggcgacgagcagcugcacgccaucgacgccagcgugagcaagaccacccugguggacagcuucagccccgagagccaggccguggaggagaacauccacgacgaccccaucagacuguucggccugaucagagccaagagagagcccaucaacuaa

SEQ ID NO: 25005 - RNA, 1176 nt, Artificial Sequence
  TRDMT1__Homo_sapiens__NP_004403
auggagccccugagagugcuggagcuguacagcggcgugggcggcaugcaccacgcccugagagagagcugcauccccgcccaggugguggccgccaucgacgugaacaccguggccaacgagguguacaaguacaacuucccccacacccagcugcuggccaagaccaucgagggcaucacccuggaggaguucgacagacugagcuucgacaugauccugaugagcccccccugccagcccuucaccagaaucggcagacagggcgacaugaccgacagcagaaccaacagcuuccugcacauccuggacauccugcccagacugcagaagcugcccaaguacauccugcuggagaacgugaagggcuucgaggugagcagcaccagagaccugcugauccagaccaucgagaacugcggcuuccaguaccaggaguuccugcugagccccaccagccugggcauccccaacagcagacugagauacuuccugaucgccaagcugcagagcgagccccugcccuuccaggcccccggccaggugcugauggaguuccccaagaucgagagcgugcacccccagaaguacgccauggacguggagaacaagauccaggagaagaacguggagcccaacaucagcuucgacggcagcauccagugcagcggcaaggacgccauccuguucaagcuggagaccgccgaggagauccacagaaagaaccagcaggacagcgaccugagcgugaagaugcugaaggacuuccuggaggacgacaccgacgugaaccaguaccugcugccccccaagagccugcugagauacgcccugcugcuggacaucgugcagcccaccugcagaagaagcgugugcuucaccaagggcuacggcagcuacaucgagggcaccggcagcgugcugcagaccgccgaggacgugcagguggagaacaucuacaagagccugaccaaccugagccaggaggagcagaucaccaagcugcugauccugaagcugagauacuucacccccaaggagaucgccaaccugcugggcuucccccccgaguucggcuuccccgagaagaucaccgugaagcagagauacagacugcugggcaacagccugaacgugcacgugguggccaagcugaucaagauccuguacgaguaa

SEQ ID NO: 25006 - RNA, 1386 nt, Artificial Sequence
  TRDN__Homo_sapiens__NP_001238916
augaccgagaucaccgccgagggcaacgccagcaccaccaccaccgugaucgacagcaagaacggcagcgugcccaagagccccggcaaggugcugaagagaaccgugaccgaggacaucgugaccaccuucagcagccccgccgccuggcugcuggugaucgcccugaucaucaccuggagcgccguggccaucgugauguucgaccugguggacuacaagaacuucagcgccagcagcaucgccaagaucggcagcgacccccugaagcuggugagagacgccauggaggagaccaccgacuggaucuacggcuucuucagccugcugagcgacaucaucagcagcgaggacgaggaggacgacgacggcgacgaggacaccgacaagggcgagaucgacgagcccccccugagaaagaaggagauccacaaggacaagaccgagaagcaggagaagcccgagagaaagauccagaccaaggugacccacaaggagaaggagaagggcaaggagaaggugagagagaaggagaagcccgagaagaaggccacccacaaggagaagaucgagaagaaggagaagcccgagaccaagacccuggccaaggagcagaagaaggccaagaccgccgagaagagcgaggagaagaccaagaaggaggugaagggcggcaagcaggagaaggugaagcagaccgccgccaaggugaaggaggugcagaagacccccagcaagcccaaggagaaggaggacaaggagaaggccgccgugagcaagcacgagcagaaggaccaguacgccuucugcagauacaugaucgacaucuucgugcacggcgaccugaagcccggccagagccccgccaucccccccccccugcccaccgagcaggccagcagacccacccccgccagccccgcccuggaggagaaggagggcgagaagaagaaggccgagaagaaggugaccagcgagaccaagaagaaggccgagaaggaggacaucaagaagaagagcgagaaggagaccgccaucgacguggagaagaaggagcccggcaaggccagcgagaccaagcagggcaccgugaagaucgccgcccaggccgccgccaagaaggacgagaagaaggaggacagcaagaagaccaagaagcccgccgagguggagcagcccaagggcaagaagcaggagaagaaggagaagcacguggagcccgccaagagccccaagaaggagcacagcgugcccagcgacaagcaggugaaggccaagaccgagagagccaaggaggagaucggcgccgugagcaucaagaaggccgugcccggcaagaaggaggagaagaccaccaagaccguggagcagggcaagaagaaguaa

SEQ ID NO: 25007 - RNA, 1659 nt, Artificial Sequence
  TREH__Homo_sapiens__NP_001287994
augcccggcagaaccugggagcugugccugcugcugcugcugggccugggccugggcagccaggaggcccugcccccccccugcgagagcgagaucuacugccacggcgagcugcugaaccaggugcagauggccaagcuguaccaggacgacaagcaguucguggacaugccccugagcaucgcccccgagcaggugcugcagaccuucaccgagcugagcagagaccacaaccacagcauccccagagagcagcugcaggccuucgugcacgagcacuuccaggccaagggccaggagcugcagcccuggacccccgccgacuggaaggacagcccccaguuccugcagaagaucagcgacgccaagcugagagccugggccggccagcugcaccagcuguggaagaagcugggcaagaagaugaagcccgaggugcugagccaccccgagagauucagccugaucuacagcgagcaccccuucaucgugcccggcggcagauucguggaguucuacuacugcuacggccacgugcccaacggcggcagaguguacuaccugcagagaagccagcccccccugcugacccugaugauggacugcuaccugacccacaccaacgacaccgccuuccugcaggagaacaucgagacccuggcccuggagcuggacuucuggaccaagaacagaaccgugagcgugagccuggagggcaagaacuaccugcugaacagauacuacgugcccuacggcggccccagacccgagagcuacagcaaggacguggagcuggccgacacccugcccgagggcgacagagaggcccugugggccgagcugaaggccggcgccgagagcggcugggacuucagcagcagauggcugaucggcggccccaaccccaacagccugagcggcaucagaaccagcaagcuggugcccguggaccugaacgccuuccugugccaggccgaggagcugaugagcaacuucuacagcagacugggcaacgacagccaggccaccaaguacagaauccugagaagccagagacuggccgcccugaacaccgugcugugggacgagcagaccggcgccugguucgacuacgaccuggagaagaagaagaagaacagagaguucuaccccagcaaccugaccccccugugggccggcugcuucagcgaccccggcguggccgacaaggcccugaaguaccuggaggacaacagaauccugaccuaccaguacggcauccccaccagccugcagaagaccggccagcagugggacuuccccaacgccugggccccccugcaggaccuggugaucagaggccuggccaaggccccccugagaagagcccaggagguggccuuccagcuggcccagaacuggaucagaaccaacuucgacguguacagccagaagagcgccauguacgagaaguacgacgugagcaacggcggccagcccggcggcggcggcgaguacgaggugcaggagggcuucggcuggaccaacggcguggugcugaugcugcuggacagauacggcgacagacugaccagcggcgccaagcuggccuuccuggagccccacugccuggccgccacccugcugcccagccugcugcugagccugcugcccugguaa

SEQ ID NO: 25008 - RNA, 678 nt, Artificial Sequence
  TREM1__Homo_sapiens__NP_001229518
augagaaagaccagacuguggggccugcuguggaugcuguucgugagcgagcugagagccgccaccaagcugaccgaggagaaguacgagcugaaggagggccagacccuggacgugaagugcgacuacacccuggagaaguucgccagcagccagaaggccuggcagaucaucagagacggcgagaugcccaagacccuggccugcaccgagagacccagcaagaacagccaccccgugcaggugggcagaaucauccuggaggacuaccacgaccacggccugcugagagugagaauggugaaccugcagguggaggacagcggccuguaccagugcgugaucuaccagccccccaaggagccccacaugcuguucgacagaaucagacugguggugaccaagggcuucagcggcacccccggcagcaacgagaacagcacccagaacguguacaagaucccccccaccaccaccaaggcccugugcccccuguacaccagccccagaaccgugacccaggccccccccaagagcaccgccgacgugagcacccccgacagcgagaucaaccugaccaacgugaccgacaucaucagauacagcuuccaggugcccggcccccugguguggacccugagcccccuguuccccagccugugcgccgagagaauguaa

SEQ ID NO: 25009 - RNA, 660 nt, Artificial Sequence
  TREM2__Homo_sapiens__NP_001258750
auggagccccugagacugcugauccugcuguucgugaccgagcugagcggcgcccacaacaccaccguguuccagggcguggccggccagagccugcaggugagcugccccuacgacagcaugaagcacuggggcagaagaaaggccuggugcagacagcugggcgagaagggccccugccagagaguggugagcacccacaaccuguggcugcugagcuuccugagaagauggaacggcagcaccgccaucaccgacgacacccugggcggcacccugaccaucacccugagaaaccugcagccccacgacgccggccuguaccagugccagagccugcacggcagcgaggccgacacccugagaaaggugcugguggaggugcuggccgacccccuggaccacagagacgccggcgaccugugguuccccggcgagagcgagagcuucgaggacgcccacguggagcacagcaucagcagagccgagagacacgugaaggaggacgacggcagaaagagccccggcgaggugccccccggcaccagccccgccugcauccuggccaccuggccccccggccugcuggugcugcuguggcaggagaccacccugcccgagcacugcuucagcuggacccuggaggccggcaccggcuaa

SEQ ID NO: 25010 - RNA, 600 nt, Artificial Sequence
  TREML1__Homo_sapiens__NP_001258736
augggccugacccugcugcugcugcugcugcugggccuggagggccagggcaucgugggcagccugcccgaggugcugcaggcccccgugggcagcagcauccuggugcagugccacuacagacugcaggacgugaaggcccagaagguguggugcagauuccugcccgagggcugccagccccuggugagcagcgccguggacagaagagcccccgccggcagaagaaccuuccugaccgaccugggcggcggccugcugcagguggagauggugacccugcaggaggaggacgccggcgaguacggcugcaugguggacggcgccagaggcccccagauccugcacagagugagccugaacauccugccccccgaggaggaggaggagacccacaagaucggcagccuggccgagaacgccuucagcgaccccgccggcagcgccaacccccuggagcccagccaggacgagaagagcaucccccugaucuggggcgccgugcugcuggugggccugcugguggccgccguggugcuguucgccgugauggccaagagaaagcaggagagccugcugagcggcccccccagacaguaa

SEQ ID NO: 25011 - RNA, 966 nt, Artificial Sequence
  TREML2__Homo_sapiens__NP_079083
auggcccccgccuuccugcugcugcugcugcuguggccccagggcugcgugagcggccccagcgccgacagcguguacaccaaggugagacugcuggagggcgagacccugagcgugcagugcagcuacaagggcuacaagaacagaguggagggcaagguguggugcaagaucagaaagaagaagugcgagcccggcuucgccagagugugggugaagggccccagauaccugcugcaggacgacgcccaggccaagguggugaacaucaccaugguggcccugaagcugcaggacagcggcagauacuggugcaugagaaacaccagcggcauccuguacccccugaugggcuuccagcuggacgugagccccgccccccagaccgagagaaacauccccuucacccaccuggacaacauccugaagagcggcaccgugaccaccggccaggcccccaccagcggccccgacgcccccuucaccaccggcgugaugguguucacccccggccugaucacccugcccagacugcuggccagcaccagacccgccagcaagaccggcuacagcuucaccgccaccagcaccaccagccagggccccagaagaaccaugggcagccagaccgugaccgccagccccagcaacgccagagacagcagcgccggccccgagagcaucagcaccaagagcggcgaccugagcaccagaagccccaccaccggccugugccugaccagcagaagccugcugaacagacugcccagcaugcccagcaucagacaccaggacguguacagcaccgugcugggcguggugcugacccugcuggugcugaugcugaucaugguguacggcuucuggaagaagagacacauggccagcuacagcaugugcagcgaccccagcaccagagacccccccggcagacccgagcccuacguggagguguaccugaucuaa

SEQ ID NO: 25012 - RNA, 3603 nt, Artificial Sequence
  TRERF1__Homo_sapiens__XP_006715208
augggcgaccagcagcuguacaagaccaaccacguggcccacggcagcgagaaccuguucuaccagcagcccccccugggcgugcacagcggccugaaccacaacuacggcaacgccgugaccggcggcggcauggacgccccccaggccagccccaucagcccccacuucccccaggacaccagagacggccugggccugcccgugggcagcaagaaccugggccagauggacaccagcagacagggcggcuggggcagccacgccggccccggcaaccacgugcagcugagaggcaaccuggccaacagcaacaugauguggggcgcccccgcccaggccgagcccaccgacggcuaccaguacaccuacagccaggccagcgagaucagaacccagaagcugaccagcggcgugcugcacaagcuggacagcuucacccagguguucgccaaccagaaccugagaauccaggugaacaacauggcccaggugcugcacacccagagcgccgugauggacggcgcccccgacagcgcccugagacagcugcugagccagaagcccauggagccccccgcccccgccauccccagcagauaccagcaggugccccagcagccccaccccggcuucaccggcggccugagcaagcccgcccugcaggugggccagcaccccacccagggccaccuguacuacgacuaccagcagccccuggcccaggugcccgugcagggcggccagccccugcaggccccccagaugcugagccagcacaugcagcagaugcagcagcaccaguacuaccccccccagcagcagcagcaggccggccagcagagaaucagcaugcaggagauccagacccagccccagcagaucagacccagccagccccagccccccccccagcagcagcagccccagcagcugcagcugcagcagagacagggcagcaugcagaucccccaguacuaccagccccagcccaugaugcagcaccugcaggagcagcagcagcagcagaugcaccugcagccccccagcuaccacagagacccccaccaguacacccccgagcaggcccacaccgugcagcugaucccccugggcagcaugagccaguacuacuaccaggagccccagcagcccuacagccacccccuguaccagcagagccaccugagccagcaccagcagagagaggacagccagcugaagaccuacagcagcgacagacaggcccaggccaugcugagcagccacggcgaccugggcccccccgacaccggcaugggcgaccccgccagcagcgaccugaccagagugagcagcacccugccccacagaccccugcugagccccagcggcauccaccugaacaacaugggcccccagcaccagcagcugagccccagcgccauguggccccagaugcaccugcccgacggcagagcccagcccggcagccccgagagcagcggccagcccaagggcgccuucggcgagcaguucgacgccaagaacaagcugaccugcagcaucugccugaaggaguucaagaaccugcccgcccugaacggccacaugagaagccacggcggcaugagagccagccccaaccugaagcaggaggagggcgagaaggugcugcccccccagccccagcccccccugcccccccccccccccccccccccccccccccagcugccccccgaggccgagagccugacccccauggugaugcccgugagcgugcccgugaagcugcugccccccaagcccagcagccagggcuucaccaacagcaccguggccgcccccagcgccagagacaagcccgccagcagcaugagcgacgacgagaugcccgugcuggagauccccagaaagcaccagcccagcgugcccaaggccgaggagccccugaagaccgugcaggagaagaagaaguucagacacagacccgagccccuguucaucccccccccccccagcuacaaccccaaccccgccgccagcuacagcggcgccacccuguaccagagccagcugagaagccccagagugcugggcgaccaccugcugcuggaccccacccacgagcugccccccuacacccccccccccaugcugagccccgugagacagggcagcggccuguucagcaacgugcugaucagcggccacggccccggcgcccacccccagcugccccugaccccccugacccccacccccagagugcugcugugcagaagcaacagcaucgacggcagcaacgugaccgugacccccggccccggcgagcagaccguggacguggagcccagaaucaacaucggccugagauuccaggccgagauccccgagcugcaggacaucagcgcccuggcccaggacacccacaaggccacccugguguggaagcccuggcccgagcuggagaaccacgaccugcagcagagaguggagaaccugcugaaccugugcugcagcagcgcccugcccggcggcggcaccaacagcgaguucgcccugcacagccuguucgaggccaagggcgacgugaugguggcccuggagaugcugcugcugagaaagcccgugagacugaagugccacccccuggccaacuaccacuacgccggcagcgacaaguggaccagccuggagagaaagcuguucaacaaggcccuggccaccuacagcaaggacuucaucuucgugcagaagauggugaagagcaagaccguggcccagugcguggaguacuacuacaccuggaagaagaucaugagacugggcagaaagcacagaaccagacuggccgagaucaucgacgacugcgugaccagcgaggaggaggaggagcuggaggaggaggaggaggaggaccccgaggaggacagaaagagcaccaaggaggaggagagcgaggugcccaagagccccgagcccccccccgugcccgugcuggcccccaccgagggccccccccugcaggcccugggccagcccagcggcagcuucaucugcgagaugcccaacugcggcgccguguucagcagcagacaggcccugaacggccacgccagaauccacggcggcaccaaccaggugaccaaggccagaggcgccauccccagcggcaagcagaagcccggcggcacccagagcggcuacugcagcgugaagagcagccccagccacagcaccaccagcggcgagaccgaccccaccaccaucuuccccugcaaggagugcggcaagguguucuucaagaucaagagcagaaacgcccacaugaagacccacagacagcaggaggagcagcagagacagaaggcccagaaggccgccuucgccgccgagauggccgccaccaucgagagaaccaccggccccgugggcgcccccggccugcugccccuggaccagcugagccugaucaagcccaucaaggacguggacauccuggacgacgacguggugcagcagcugggcggcgugauggaggaggccgaggugguggacaccgaccugcugcuggacgaccaggacagcgugcugcugcagggcgacgccgagcuguaa

SEQ ID NO: 25013 - RNA, 915 nt, Artificial Sequence
  TREX1__Homo_sapiens__NP_009179
augcagacccugaucuucuucgacauggaggccaccggccugcccuucagccagcccaaggugaccgagcugugccugcuggccgugcacagaugcgcccuggagagcccccccaccagccagggccccccccccaccgugccccccccccccagagugguggacaagcugagccugugcguggcccccggcaaggccugcagccccgccgccagcgagaucaccggccugagcaccgccgugcuggccgcccacggcagacagugcuucgacgacaaccuggccaaccugcugcuggccuuccugagaagacagccccagcccuggugccugguggcccacaacggcgacagauacgacuucccccugcugcaggccgagcuggccaugcugggccugaccagcgcccuggacggcgccuucugcguggacagcaucaccgcccugaaggcccuggagagagccagcagccccagcgagcacggccccagaaagagcuacagccugggcagcaucuacaccagacuguacggccagagcccccccgacagccacaccgccgagggcgacgugcuggcccugcugagcaucugccaguggagaccccaggcccugcugagauggguggacgcccacgccagacccuucggcaccaucagacccauguacggcgugaccgccagcgccagaaccaagcccagacccagcgccgugaccaccaccgcccaccuggccaccaccagaaacaccagccccagccugggcgagagcagaggcaccaaggaccugccccccgugaaggaccccggcgcccugagcagagagggccugcuggccccccugggccugcuggccauccugacccuggccguggccacccuguacggccugagccuggccacccccggcgaguaa

SEQ ID NO: 25014 - RNA, 711 nt, Artificial Sequence
  TREX2__Homo_sapiens__NP_542432
augagcgaggcccccagagccgagaccuucguguuccuggaccuggaggccaccggccugcccagcguggagcccgagaucgccgagcugagccuguucgccgugcacagaagcagccuggagaaccccgagcacgacgagagcggcgcccuggugcugcccagagugcuggacaagcugacccugugcaugugccccgagagacccuucaccgccaaggccagcgagaucaccggccugagcagcgagggccuggccagaugcagaaaggccggcuucgacggcgccguggugagaacccugcaggccuuccugagcagacaggccggccccaucugccugguggcccacaacggcuucgacuacgacuucccccugcugugcgccgagcugagaagacugggcgccagacugcccagagacaccgugugccuggacacccugcccgcccugagaggccuggacagagcccacagccacggcaccagagccagaggcagacagggcuacagccugggcagccuguuccacagauacuucagagccgagcccagcgccgcccacagcgccgagggcgacgugcacacccugcugcugaucuuccugcacagagccgccgagcugcuggccugggccgacgagcaggccagaggcugggcccacaucgagcccauguaccugccccccgacgaccccagccuggaggccuaa

SEQ ID NO: 25015 - RNA, 3075 nt, Artificial Sequence
  TRHDE__Homo_sapiens__NP_037513
augggcgaggacgacgccgcccugagagccggcagcagaggccugagcgaccccugggccgacagcgugggcgugagacccagaaccaccgagagacacaucgccgugcacaagagacuggugcuggccuucgccgugagccugguggcccugcuggccgugaccaugcuggccgugcugcugagccugagauucgacgagugcggcgccagcgccacccccggcgccgacggcggccccagcggcuuccccgagagaggcggcaacggcagccugcccggcagcgccagaagaaaccaccacgccggcggcgacagcuggcagcccgaggccggcggcguggccagccccggcaccaccagcgcccagccccccagcgaggaggagagagagcccugggagcccuggacccagcugagacugagcggccaccugaagccccugcacuacaaccugaugcugaccgccuucauggagaacuucaccuucagcggcgaggugaacguggagaucgccugcagaaacgccaccagauacguggugcugcacgccagcagaguggccguggagaaggugcagcuggccgaggacagagccuucggcgccgugcccguggccggcuucuuccuguacccccagacccaggugcuggugguggugcugaacagaacccuggacgcccagagaaacuacaaccugaagaucaucuacaacgcccugaucgagaacgagcugcugggcuucuucagaagcagcuacgugcugcacggcgagagaagauuccugggcgugacccaguucagccccacccacgccagaaaggccuuccccugcuucgacgagcccaucuacaaggccaccuucaagaucagcaucaagcaccaggccaccuaccugagccugagcaacaugcccguggagaccagcguguucgaggaggacggcugggugaccgaccacuucagccagaccccccugaugagcaccuacuaccuggccugggccaucugcaacuucaccuacagagagaccaccaccaagagcggcgugguggugagacuguacgccagacccgacgccaucagaagaggcagcggcgacuacgcccugcacaucaccaagagacugaucgaguucuacgaggacuacuucaaggugcccuacagccugcccaagcuggaccugcuggccgugcccaagcaccccuacgccgccauggagaacuggggccugagcaucuucguggagcagagaauccugcuggaccccagcgugagcagcaucagcuaccugcuggacgugaccauggugaucgugcacgagaucugccaccagugguucggcgaccuggugacccccguguggugggaggacguguggcugaaggagggcuucgcccacuacuucgaguucgugggcaccgacuaccuguaccccggcuggaacauggagaagcagagauuccugaccgacgugcugcacgaggugaugcugcuggacggccuggccagcagccaccccgugagccaggaggugcugcaggccaccgacaucgacagaguguucgacuggaucgccuacaagaagggcgccgcccugaucagaaugcuggccaacuucaugggccacagcguguuccagagaggccugcaggacuaccugaccauccacaaguacggcaacgccgccagaaacgaccuguggaacacccugagcgaggcccugaagagaaacggcaaguacgugaacauccaggaggugauggaccaguggacccugcagaugggcuaccccgugaucaccauccugggcaacaccaccgccgagaacagaaucaucaucacccagcagcacuucaucuacgacaucagcgccaagaccaaggcccugaagcugcagaacaacagcuaccuguggcagaucccccugaccaucguggugggcaacagaagccacgugagcagcgaggccaucaucugggugagcaacaagagcgagcaccacagaaucaccuaccuggacaagggcagcuggcugcugggcaacaucaaccagaccggcuacuucagagugaacuacgaccugagaaacuggagacugcugaucgaccagcugaucagaaaccacgaggugcugagcgugagcaacagagccggccugaucgacgacgccuucagccuggccagagccggcuaccugccccagaacaucccccuggagaucaucagauaccugagcgaggagaaggacuuccugcccuggcacgccgccagcagagcccuguacccccuggacaagcugcuggacagaauggagaacuacaacaucuucaacgaguacauccugaagcagguggccaccaccuacaucaagcugggcuggcccaagaacaacuucaacggcagccuggugcaggccagcuaccagcacgaggagcugagaagagaggugaucaugcuggccugcagcuucggcaacaagcacugccaccagcaggccagcacccugaucagcgacuggaucagcagcaacagaaacagaaucccccugaacgugagagacaucguguacugcaccggcgugagccugcuggacgaggacgugugggaguucaucuggaugaaguuccacagcaccaccgccgugagcgagaagaagauccugcuggaggcccugaccugcagcgacgacagaaaccugcugaacagacugcugaaccugagccugaacagcgagguggugcuggaccaggacgccaucgacgugaucauccacguggccagaaacccccacggcagagaccuggccuggaaguucuucagagacaaguggaagauccugaacaccagauacggcgaggcccuguucaugaacagcaagcugaucagcggcgugaccgaguuccugaacaccgagggcgagcugaaggagcugaagaacuucaugaagaacuacgacggcguggccgccgccagcuucagcagagccguggagaccguggaggccaacgugagauggaagaugcuguaccaggacgagcuguuccaguggcugggcaaggcccugagacacuaa

SEQ ID NO: 25016 - RNA, 729 nt, Artificial Sequence
  TRH__Homo_sapiens__NP_009048
augcccggccccuggcugcugcuggcccuggcccugacccugaaccugaccggcgugcccggcggcagagcccagcccgaggccgcccagcaggaggccgugaccgccgccgagcaccccggccuggacgacuuccugagacagguggagagacugcuguuccugagagagaacauccagagacugcagggcgaccagggcgagcacagcgccagccagaucuuccagagcgacuggcugagcaagagacagcaccccggcaagagagaggaggaggaggaggagggcguggaggaggaggaggaggaggagggcggcgccgugggcccccacaagagacagcaccccggcagaagagaggacgaggccagcuggagcguggacgugacccagcacaagagacagcaccccggcagaagaagccccuggcuggccuacgccgugcccaagagacagcaccccggcagaagacuggccgaccccaaggcccagagaagcugggaggaggaggaggaggaggaggagagagaggaggaccugaugcccgagaagagacagcaccccggcaagagagcccugggcggccccugcggcccccagggcgccuacggccaggccggccugcugcugggccugcuggacgaccugagcagaagccagggcgccgaggagaagagacagcaccccggcagaagagccgccugggugagagagccccuggaggaguaa

SEQ ID NO: 25017 - RNA, 1197 nt, Artificial Sequence
  TRHR__Homo_sapiens__XP_011515565
auggagaacgagaccgugagcgagcugaaccagacccagcugcagcccagagccgugguggcccuggaguaccagguggugaccauccugcuggugcugaucaucugcggccugggcaucgugggcaacaucaugguggugcugguggugaugagaaccaagcacaugagaacccccaccaacugcuaccuggugagccuggccguggccgaccugauggugcugguggccgccggccugcccaacaucaccgacagcaucuacggcagcuggguguacggcuacgugggcugccugugcaucaccuaccugcaguaccugggcaucaacgccagcagcugcagcaucaccgccuucaccaucgagagauacaucgccaucugccaccccaucaaggcccaguuccugugcaccuucagcagagccaagaagaucaucaucuucgugugggccuucaccagccuguacugcaugcugugguucuuccugcuggaccugaacaucagcaccuacaaggacgccaucgugaucagcugcggcuacaagaucagcagaaacuacuacagccccaucuaccugauggacuucggcguguucuacguggugcccaugauccuggccaccgugcuguacggcuucaucgccagaauccuguuccugaaccccauccccagcgaccccaaggagaacagcaagaccuggaagaacgacagcacccaccagaacaccaaccugaacgugaacaccagcaacagaugcuucaacagcaccgugagcagcagaaagcaggugaccaagaugcuggccgugguggugauccuguucgcccugcuguggaugcccuacagaacccuggugguggugaacagcuuccugagcagccccuuccaggagaacugguuccugcuguucugcagaaucugcaucuaccugaacagcgccaucaaccccgugaucuacaaccugaugagccagaaguucagagccgccuucagaaagcugugcaacugcaagcagaagcccaccgagaagcccgccaacuacagcguggcccugaacuacagcgugaucaaggagagcgaccacuucagcaccgagcuggacgacaucaccgugaccgacaccuaccugagcgccaccaaggugagcuucgacgacaccugccuggccagcgaggugagcuucagccagagcuaa

SEQ ID NO: 25018 - RNA, 231 nt, Artificial Sequence
  TRIAP1__Homo_sapiens__NP_057483
augaacagcgugggcgaggccugcaccgacaugaagagagaguacgaccagugcuucaacagaugguucgccgagaaguuccugaagggcgacagcagcggcgaccccugcaccgaccuguucaagagauaccagcagugcgugcagaaggccaucaaggagaaggagauccccaucgagggccuggaguucaugggccacggcaaggagaagcccgagaacagcagcuaa

SEQ ID NO: 25019 - RNA, 1119 nt, Artificial Sequence
  TRIB1__Homo_sapiens__NP_079471
augagagugggccccgugagaagcgccaugagcggcgccagccagcccagaggccccgcccugcuguuccccgccaccagaggcgugcccgccaagagacugcuggacgccgacgacgccgccgccguggccgccaagugccccagacugagcgagugcagcagcccccccgacuaccugagcccccccggcagccccugcagcccccagcccccccccgccgcccccggcgccggcggcggcagcggcagcgcccccggccccagcagaaucgccgacuaccugcugcugccccuggccgagagagagcacgugagcagagcccugugcauccacaccggcagagagcugagaugcaagguguuccccaucaagcacuaccaggacaagaucagacccuacauccagcugcccagccacagcaacaucaccggcaucguggaggugauccugggcgagaccaaggccuacguguucuucgagaaggacuucggcgacaugcacagcuacgugagaagcagaaagagacugagagaggaggaggccgccagacuguucaagcagaucgugagcgccguggcccacugccaccagagcgccaucgugcugggcgaccugaagcugagaaaguucguguucagcaccgaggagagaacccagcugagacuggagagccuggaggacacccacaucaugaagggcgaggacgacgcccugagcgacaagcacggcugccccgccuacgugagccccgagauccugaacaccaccggcaccuacagcggcaaggccgccgacguguggagccugggcgugaugcuguacacccugcuggugggcagauaccccuuccacgacagcgaccccagcgcccuguucagcaagaucagaagaggccaguucugcauccccgagcacaucagccccaaggccagaugccugaucagaagccugcugagaagagagcccagcgagagacugaccgcccccgagauccugcugcaccccugguucgagagcgugcuggagcccggcuacaucgacagcgagaucggcaccagcgaccagaucgugcccgaguaccaggaggacagcgacaucagcagcuucuucugcuaa

SEQ ID NO: 25020 - RNA, 1032 nt, Artificial Sequence
  TRIB2__Homo_sapiens__NP_067675
augaacauccacagaagcacccccaucaccaucgccagauacggcagaagcagaaacaagacccaggacuucgaggagcugagcagcaucagaagcgccgagcccagccagagcuucagccccaaccugggcagccccagcccccccgagacccccaaccugagccacugcgugagcugcaucggcaaguaccugcugcuggagccccuggagggcgaccacguguucagagccgugcaccugcacagcggcgaggagcuggugugcaagguguucgacaucagcugcuaccaggagagccuggcccccugcuucugccugagcgcccacagcaacaucaaccagaucaccgagaucauccugggcgagaccaaggccuacguguucuucgagagaagcuacggcgacaugcacagcuucgugagaaccugcaagaagcugagagaggaggaggccgccagacuguucuaccagaucgccagcgccguggcccacugccacgacggcggccuggugcugagagaccugaagcugagaaaguucaucuucaaggacgaggagagaaccagagugaagcuggagagccuggaggacgccuacauccugagaggcgacgacgacagccugagcgacaagcacggcugccccgccuacgugagccccgagauccugaacaccagcggcagcuacagcggcaaggccgccgacguguggagccugggcgugaugcuguacaccaugcuggugggcagauaccccuuccacgacaucgagcccagcagccuguucagcaagaucagaagaggccaguucaacauccccgagacccugagccccaaggccaagugccugaucagaagcauccugagaagagagcccagcgagagacugaccagccaggagauccuggaccaccccugguucagcaccgacuucagcgugagcaacagcgccuacggcgccaaggaggugagcgaccagcuggugcccgacgugaacauggaggagaaccuggaccccuucuucaacuaa

SEQ ID NO: 25021 - RNA, 1077 nt, Artificial Sequence
  TRIB3__Homo_sapiens__NP_001288117
augagagccaccccccuggccgcccccgccggcagccugagcagaaagaagagacuggagcuggacgacaaccuggacaccgagagacccgugcagaagagagccagaagcggcccccagcccagacugccccccugccugcugccccugagcccccccaccgcccccgacagagccaccgccguggccaccgccagcagacugggccccuacgugcugcuggagcccgaggagggcggcagagccuaccaggcccugcacugccccaccggcaccgaguacaccugcaagguguaccccgugcaggaggcccuggccgugcuggagcccuacgccagacugcccccccacaagcacguggccagacccaccgaggugcuggccggcacccagcugcuguacgccuucuucaccagaacccacggcgacaugcacagccuggugagaagcagacacagaauccccgagcccgaggccgccgugcuguucagacagauggccaccgcccuggcccacugccaccagcacggccuggugcugagagaccugaagcugugcagauucguguucgccgacagagagagaaagaagcuggugcuggagaaccuggaggacagcugcgugcugaccggccccgacgacagccugugggacaagcacgccugccccgccuacgugggccccgagauccugagcagcagagccagcuacagcggcaaggccgccgacguguggagccugggcguggcccuguucaccaugcuggccggccacuaccccuuccaggacagcgagcccgugcugcuguucggcaagaucagaagaggcgccuacgcccugcccgccggccugagcgcccccgccagaugccuggugagaugccugcugagaagagagcccgccgagagacugaccgccaccggcauccugcugcaccccuggcugagacaggaccccaugccccuggcccccaccagaagccaccugugggaggccgcccagguggugcccgacggccugggccuggacgaggccagagaggaggagggcgacagagagguggugcuguacggcuaa

SEQ ID NO: 25022 - RNA, 1446 nt, Artificial Sequence
  TRIM10__Homo_sapiens__NP_006769
auggccagcgccgccagcgugaccagccuggccgacgaggugaacugccccaucugccagggcacccugagagagcccgugaccaucgacugcggccacaacuucugcagagccugccugaccagauacugcgagauccccggccccgaccuggaggagagccccaccugcccccugugcaaggagcccuucagacccggcagcuucagacccaacuggcagcuggccaacgugguggagaacaucgagagacugcagcuggugagcacccugggccugggcgaggaggacgugugccaggagcacggcgagaagaucuacuucuucugcgaggacgacgagaugcagcugugcguggugugcagagaggccggcgagcacgccacccacaccaugagauuccuggaggacgccgccgcccccuacagagagcagauccacaagugccugaagugccugagaaaggagagagaggagauccaggagauccagagcagagagaacaagagaaugcaggugcugcugacccaggugagcaccaagagacagcaggugaucagcgaguucgcccaccugagaaaguuccuggaggagcagcagagcauccugcuggcccagcuggagagccaggacggcgacauccugagacagagagacgaguucgaccugcugguggccggcgagaucugcagauucagcgcccugaucgaggagcuggaggagaagaacgagagacccgccagagagcugcugaccgacaucagaagcacccugaucagaugcgagaccagaaagugcagaaagcccguggccgugagccccgagcugggccagagaaucagagacuucccccagcaggcccugccccugcagagagagaugaagauguuccuggagaagcugugcuucgagcuggacuacgagcccgcccacaucagccuggacccccagaccagccaccccaagcugcugcugagcgaggaccaccagagagcccaguucagcuacaaguggcagaacagccccgacaacccccagagauucgacagagccaccugcgugcuggcccacaccggcaucaccggcggcagacacaccuggguggugagcaucgaccuggcccacggcggcagcugcaccgugggcguggugagcgaggacgugcagagaaagggcgagcugagacugagacccgaggagggcgugugggccgugagacuggccuggggcuucgugagcgcccugggcagcuuccccaccagacugacccugaaggagcagcccagacaggugagagugagccuggacuacgaggugggcugggugaccuucaccaacgccgugaccagagagcccaucuacaccuucaccgccagcuucaccagaaaggugauccccuucuucggccuguggggcagaggcagcagcuucagccugagcagcuaa

SEQ ID NO: 25023 - RNA, 1407 nt, Artificial Sequence
  TRIM11__Homo_sapiens__NP_660215
auggccgcccccgaccugagcaccaaccugcaggaggaggccaccugcgccaucugccuggacuacuucaccgaccccgugaugaccgacugcggccacaacuucugcagagagugcaucagaagaugcuggggccagcccgagggccccuacgccugccccgagugcagagagcugagcccccagagaaaccugagacccaacagaccccuggccaagauggccgagauggccagaagacugcacccccccagccccgugccccagggcgugugccccgcccacagagagccccuggccgccuucugcggcgacgagcugagacugcugugcgccgccugcgagagaagcggcgagcacugggcccacagagugagaccccugcaggacgccgccgaggaccugaaggccaagcuggagaagagccuggagcaccugagaaagcagaugcaggacgcccugcuguuccaggcccaggccgacgagaccugcgugcuguggcagaagaugguggagagccagagacagaacgugcugggcgaguucgagagacugagaagacugcuggccgaggaggagcagcagcugcugcagagacuggaggaggaggagcuggaggugcugcccagacugagagagggcgccgcccaccugggccagcagagcgcccaccuggccgagcugaucgccgagcuggagggcagaugccagcugcccgcccugggccugcugcaggacaucaaggacgcccugagaagagugcaggacgugaagcugcagccccccgagguggugcccauggagcugagaaccgugugcagagugcccggccugguggagacccugagaagauucagaggcgacgugacccuggaccccgacaccgccaaccccgagcugauccugagcgaggacagaagaagcgugcagagaggcgaccugagacaggcccugcccgacagccccgagagauucgaccccggccccugcgugcugggccaggagagauucaccagcggcagacacuacugggagguggaggugggcgacagaaccagcugggcccugggcgugugcagagagaacgugaacagaaaggagaagggcgagcugagcgccggcaacggcuucuggauccugguguuccugggcagcuacuacaacagcagcgagagagcccuggccccccugagagacccccccagaagagugggcaucuuccuggacuacgaggccggccaccugagcuucuacagcgccaccgacggcagccugcuguucaucuuccccgagauccccuucagcggcacccugagaccccuguucagcccccugagcagcagccccacccccaugaccaucugcagacccaagggcggcagcggcgacacccuggccccccaguaa

SEQ ID NO: 25024 - RNA, 1233 nt, Artificial Sequence
  TRIM13__Homo_sapiens__NP_001007279
auggacgugauggagcugcuggaggaggaccugaccugccccaucugcugcagccuguucgacgaccccagagugcugcccugcagccacaacuucugcaagaagugccuggagggcauccuggagggcagcgugagaaacagccuguggagacccgcccccuucaagugccccaccugcagaaaggagaccagcgccaccggcaucaacagccugcaggugaacuacagccugaagggcaucguggagaaguacaacaagaucaagaucagccccaagaugcccgugugcaagggccaccugggccagccccugaacaucuucugccugaccgacaugcagcugaucugcggcaucugcgccaccagaggcgagcacaccaagcacguguucugcagcaucgaggacgccuacgcccaggagagagacgccuucgagagccuguuccagagcuucgagaccuggagaagaggcgacgcccugagcagacuggacacccuggagaccagcaagagaaagagccugcagcugcugaccaaggacagcgacaaggugaaggaguucuucgagaagcugcagcacacccuggaccagaagaagaacgagauccugagcgacuucgagaccaugaagcuggccgugaugcaggccuacgaccccgagaucaacaagcugaacaccauccugcaggagcagagaauggccuucaacaucgccgaggccuucaaggacgugagcgagcccaucguguuccugcagcagaugcaggaguucagagagaagaucaaggugaucaaggagaccccccugccccccagcaaccugcccgccagcccccugaugaagaacuucgacaccagccagugggaggacaucaagcugguggacguggacaagcugagccugccccaggacaccggcaccuucaucagcaagauccccuggagcuucuacaagcuguuccugcugauccugcugcugggccuggugaucguguucggccccaccauguuccuggaguggagccuguucgacgaccuggccaccuggaagggcugccugagcaacuucagcagcuaccugaccaagaccgccgacuucaucgagcagagcguguucuacugggagcaggugaccgacggcuucuucaucuucaacgagagauucaagaacuucacccugguggugcugaacaacguggccgaguucgugugcaaguacaagcugcuguaa

SEQ ID NO: 25025 - RNA, 1398 nt, Artificial Sequence
  TRIM15__Homo_sapiens__NP_150232
augcccgccacccccagccugaagguggugcacgagcugcccgccugcacccugugcgccggcccccuggaggacgccgugaccauccccugcggccacaccuucugcagacugugccugcccgcccugagccagaugggcgcccagagcagcggcaagauccugcugugcccccugugccaggaggaggagcaggccgagacccccauggcccccgugccccugggcccccugggcgagaccuacugcgaggagcacggcgagaagaucuacuucuucugcgagaacgacgccgaguuccugugcguguucugcagagagggccccacccaccaggcccacaccgugggcuuccuggacgaggccauccagcccuacagagacagacugagaagcagacuggaggcccugagcaccgagagagacgagaucgaggacgugaagugccaggaggaccagaagcugcaggugcugcugacccagaucgagagcaagaagcaccagguggagaccgccuucgagagacugcagcaggagcuggagcagcagagaugccugcugcuggccagacugagagagcuggagcagcagaucuggaaggagagagacgaguacaucaccaaggugagcgaggaggugaccagacugggcgcccaggugaaggagcuggaggagaagugccagcagcccgccagcgagcugcugcaggacgugagagugaaccagagcagaugcgagaugaagaccuucgugagccccgaggccaucagccccgaccuggugaagaagaucagagacuuccacagaaagauccugacccugcccgagaugaugagaauguucagcgagaaccuggcccaccaccuggagaucgacagcggcgugaucacccuggacccccagaccgccagcagaagccuggugcugagcgaggacagaaagagcgugagauacaccagacagaagaagagccugcccgacagcccccugagauucgacggccugcccgccgugcugggcuuccccggcuucagcagcggcagacacagauggcagguggaccugcagcugggcgacggcggcggcugcaccgugggcguggccggcgagggcgugagaagaaagggcgagaugggccugagcgccgaggacggcgugugggccgugaucaucagccaccagcagugcugggccagcaccagccccggcaccgaccugccccugagcgagauccccagaggcgugagaguggcccuggacuacgaggccggccaggugacccugcacaacgcccagacccaggagcccaucuucaccuucaccgccagcuucagcggcaagguguuccccuucuucgccguguggaagaagggcagcugccugacccugaagggcuaa

SEQ ID NO: 25026 - RNA, 1695 nt, Artificial Sequence
  TRIM16__Homo_sapiens__NP_006461
auggccgagcuggaccugauggcccccggcccccugcccagagccaccgcccagccccccgccccccugagccccgacagcggcagccccagccccgacagcggcagcgccagccccguggaggaggaggacgugggcagcagcgagaagcugggcagagagaccgaggagcaggacagcgacagcgccgagcagggcgaccccgccggcgagggcaaggaggugcugugcgacuucugccuggacgacaccagaagagugaaggccgugaagagcugccugaccugcauggugaacuacugcgaggagcaccugcagccccaccaggugaacaucaagcugcagagccaccugcugaccgagcccgugaaggaccacaacuggagauacugccccgcccaccacagcccccugagcgccuucugcugccccgaccagcagugcaucugccaggacugcugccaggagcacagcggccacaccaucgugagccuggacgccgccagaagagacaaggaggccgagcugcagugcacccagcuggaccuggagagaaagcugaagcugaacgagaacgccaucagcagacugcaggccaaccagaagagcgugcuggugagcgugagcgaggugaaggccguggccgagaugcaguucggcgagcugcuggccgccgugagaaaggcccaggccaacgugaugcuguuccuggaggagaaggagcaggccgcccugagccaggccaacggcaucaaggcccaccuggaguacagaagcgccgagauggagaagagcaagcaggagcuggagagaauggccgccaucagcaacaccgugcaguuccuggaggaguacugcaaguucaagaacaccgaggacaucaccuuccccagcguguacgugggccugaaggacaagcugagcggcaucagaaaggugaucaccgagagcaccgugcaccugauccagcugcuggagaacuacaagaagaagcugcaggaguucagcaaggaggaggaguacgacaucagaacccaggugagcgccguggugcagagaaaguacuggaccagcaagcccgagcccagcaccagagagcaguuccugcaguacgccuacgacaucaccuucgaccccgacaccgcccacaaguaccugagacugcaggaggagaacagaaaggugaccaacaccacccccugggagcaccccuaccccgaccugcccagcagauuccugcacuggagacaggugcugagccagcagagccuguaccugcacagauacuacuucgagguggagaucuucggcgccggcaccuacgugggccugaccugcaagggcaucgacagaaagggcgaggagagaaacagcugcaucagcggcaacaacuucagcuggagccugcaguggaacggcaaggaguucaccgccugguacagcgacauggagaccccccugaaggccggccccuucagaagacugggcguguacaucgacuuccccggcggcauccugagcuucuacggcguggaguacgacaccaugacccuggugcacaaguucgccugcaaguucagcgagcccguguacgccgccuucuggcugagcaagaaggagaacgccaucagaaucguggaccugggcgaggagcccgagaagcccgcccccagccuggugggcaccgcccccuaa

SEQ ID NO: 25027 - RNA, 1434 nt, Artificial Sequence
  TRIM17__Homo_sapiens__NP_001020111
auggaggccguggagcuggccagaaagcugcaggaggaggccaccugcagcaucugccuggacuacuucaccgaccccgugaugaccaccugcggccacaacuucugcagagccugcauccagcugagcugggagaaggccagaggcaagaagggcagaagaaagagaaagggcagcuuccccugccccgagugcagagagaugagcccccagagaaaccugcugcccaacagacugcugaccaagguggccgagauggcccagcagcaccccggccugcagaagcaggaccugugccaggagcaccacgagccccugaagcuguucugccagaaggaccagagccccaucugcguggugugcagagagagcagagagcacagacugcacagagugcugcccgccgaggaggccgugcagggcuacaagcugaagcuggaggaggacauggaguaccugagagagcagaucaccagaaccggcaaccugcaggccagagaggagcagagccuggccgaguggcagggcaaggugaaggagagaagagagagaaucgugcuggaguucgagaagaugaaccuguaccugguggaggaggagcagagacugcugcaggcccuggagaccgaggaggaggagaccgccagcagacugagagagagcguggccugccuggacagacagggccacagccuggagcugcugcugcugcagcuggaggagagaagcacccagggcccccugcagaugcugcaggacaugaaggagccccugagcagaaagaacaacgugagcgugcagugccccgagguggccccccccaccagacccagaaccgugugcagagugcccggccagaucgaggugcugagaggcuuccuggaggacguggugcccgacgccaccagcgccuaccccuaccugcugcuguacgagagcagacagagaagauaccugggcagcagccccgagggcagcggcuucugcagcaaggacagauucguggccuaccccugcgccgugggccagaccgccuucagcagcggcagacacuacugggaggugggcaugaacaucaccggcgacgcccugugggcccugggcgugugcagagacaacgugagcagaaaggacagagugcccaagugccccgagaacggcuucuggguggugcagcugagcaagggcaccaaguaccugagcaccuucagcgcccugacccccgugaugcugauggagccccccagccacaugggcaucuuccuggacuucgaggccggcgaggugagcuucuacagcgugagcgacggcagccaccugcacaccuacagccaggccaccuuccccggcccccugcagcccuucuucugccugggcgcccccaagagcggccagauggugaucagcaccgugaccaugugggugaagggcuaa

SEQ ID NO: 25028 - RNA, 1428 nt, Artificial Sequence
  TRIM21__Homo_sapiens__NP_003132
auggccagcgccgccagacugaccaugaugugggaggaggugaccugccccaucugccuggaccccuucguggagcccgugagcaucgagugcggccacagcuucugccaggagugcaucagccaggugggcaagggcggcggcagcgugugccccgugugcagacagagauuccugcugaagaaccugagacccaacagacagcuggccaacauggugaacaaccugaaggagaucagccaggaggccagagagggcacccagggcgagagaugcgccgugcacggcgagagacugcaccuguucugcgagaaggacggcaaggcccugugcugggugugcgcccagagcagaaagcacagagaccacgccauggugccccuggaggaggccgcccaggaguaccaggagaagcugcagguggcccugggcgagcugagaagaaagcaggagcuggccgagaagcuggagguggagaucgccaucaagagagccgacuggaagaagaccguggagacccagaagagcagaauccacgccgaguucgugcagcagaagaacuuccugguggaggaggagcagagacagcugcaggagcuggagaaggacgagagagagcagcugagaauccugggcgagaaggaggccaagcuggcccagcagagccaggcccugcaggagcugaucagcgagcuggacagaagaugccacagcagcgcccuggagcugcugcaggaggugaucaucgugcuggagagaagcgagagcuggaaccugaaggaccuggacaucaccagccccgagcugagaagcgugugccacgugcccggccugaagaagaugcugagaaccugcgccgugcacaucacccuggaccccgacaccgccaaccccuggcugauccugagcgaggacagaagacaggugagacugggcgacacccagcagagcauccccggcaacgaggagagauucgacagcuaccccauggugcugggcgcccagcacuuccacagcggcaagcacuacugggagguggacgugaccggcaaggaggccugggaccugggcgugugcagagacagcgugagaagaaagggccacuuccugcugagcagcaagagcggcuucuggaccaucuggcuguggaacaagcagaaguacgaggccggcaccuacccccagaccccccugcaccugcaggugccccccugccaggugggcaucuuccuggacuacgaggccggcauggugagcuucuacaacaucaccgaccacggcagccugaucuacagcuucagcgagugcgccuucaccggcccccugagacccuucuucagccccggcuucaacgacggcggcaagaacaccgccccccugacccugugcccccugaacaucggcagccagggcagcaccgacuacuaa

SEQ ID NO: 25029 - RNA, 1485 nt, Artificial Sequence
  TRIM22__Homo_sapiens__NP_001186502
auggacuucagcgugaagguggacaucgagaaggaggugaccugccccaucugccuggagcugcugaccgagccccugagccuggacugcggccacagcuucugccaggccugcaucaccgccaagaucaaggagagcgugaucaucagcagaggcgagagcagcugccccgugugccagaccagauuccagcccggcaaccugagacccaacagacaccuggccaacaucguggagagagugaaggaggugaagaugagcccccaggagggccagaagagagacgugugcgagcaccacggcaagaagcugcagaucuucugcaaggaggacggcaaggugaucugcugggugugcgagcugagccaggagcaccagggccaccagaccuucagaaucaacgagguggugaaggagugccaggagaagcugcagguggcccugcagagacugaucaaggaggaccaggaggccgagaagcuggaggacgacaucagacaggagagaaccgccuggaagaucgagagacagaagauccugaagggcuucaacgagaugagagugauccuggacaacgaggagcagagagagcugcagaagcuggaggagggcgaggugaacgugcuggacaaccuggccgccgccaccgaccagcuggugcagcagagacaggacgccagcacccugaucagcgaccugcagagaagacugagaggcagcagcguggagaugcugcaggacgugaucgacgugaugaagagaagcgagagcuggacccugaagaagcccaagagcgugagcaagaagcugaagagcguguucagagugcccgaccugagcggcaugcugcaggugcugaaggagcugaccgacgugcaguacuacuggguggacgugaugcugaaccccggcagcgccaccagcaacguggccaucagcguggaccagagacaggugaagaccgugagaaccugcaccuucaagaacagcaaccccugcgacuucagcgccuucggcguguucggcugccaguacuucagcagcggcaaguacuacugggagguggacgugagcggcaagaucgccuggauccugggcgugcacagcaagaucagcagccugaacaagagaaagagcagcggcuucgccuucgaccccagcgugaacuacagcaagguguacagcagauacagaccccaguacggcuacugggugaucggccugcagaacaccugcgaguacaacgccuucgaggacagcagcagcagcgaccccaaggugcugacccuguucauggccgugccccccugcagaaucggcguguuccuggacuacgaggccggcaucgugagcuucuucaacgugaccaaccacggcgcccugaucuacaaguucagcggcugcagauucagcagacccgccuaccccuacuucaaccccuggaacugccuggugcccaugaccgugugcccccccagcagcuaa

SEQ ID NO: 25030 - RNA, 1725 nt, Artificial Sequence
  TRIM23__Homo_sapiens__NP_001647
auggccacccugguggugaacaagcugggcgccggcguggacagcggcagacagggcagcagaggcaccgccguggugaaggugcuggagugcggcgugugcgaggacguguucagccugcagggcgacaaggugcccagacugcugcugugcggccacaccgugugccacgacugccugaccagacugccccugcacggcagagccaucagaugccccuucgacagacaggugaccgaccugggcgacagcggcguguggggccugaagaagaacuucgcccugcuggagcugcuggagagacugcagaacggccccaucggccaguacggcgccgccgaggagagcaucggcaucagcggcgagagcaucaucagaugcgacgaggacgaggcccaccuggccagcguguacugcaccgugugcgccacccaccugugcagcgagugcagccaggugacccacagcaccaagacccuggccaagcacagaagagugccccuggccgacaagccccacgagaagaccaugugcagccagcaccaggugcacgccaucgaguucgugugccuggaggagggcugccagaccagcccccugaugugcugcgugugcaaggaguacggcaagcaccagggccacaagcacagcgugcuggagcccgaggccaaccagaucagagccagcauccuggacauggcccacugcaucagaaccuucaccgaggagaucagcgacuacagcagaaagcuggugggcaucgugcagcacaucgagggcggcgagcagaucguggaggacggcaucggcauggcccacaccgagcacgugcccggcaccgccgagaacgccagaagcugcaucagagccuacuucuacgaccugcacgagacccugugcagacaggaggagauggcccugagcgugguggacgcccacgugagagagaagcugaucuggcugagacagcagcaggaggacaugaccauccugcugagcgaggugagcgccgccugccugcacugcgagaagacccugcagcaggacgacugcagaguggugcuggccaagcaggagaucaccagacugcuggagacccugcagaagcagcagcagcaguucaccgagguggccgaccacauccagcuggacgccagcauccccgugaccuucaccaaggacaacagagugcacaucggccccaagauggagaucagaguggugacccugggccuggacggcgccggcaagaccaccauccuguucaagcugaagcaggacgaguucaugcagcccauccccaccaucggcuucaacguggagaccguggaguacaagaaccugaaguucaccaucugggacgugggcggcaagcacaagcugagaccccuguggaagcacuacuaccugaacacccaggccgugguguucgugguggacagcagccacagagacagaaucagcgaggcccacagcgagcuggccaagcugcugaccgagaaggagcugagagacgcccugcugcugaucuucgccaacaagcaggacguggccggcgcccugagcguggaggagaucaccgagcugcugagccugcacaagcugugcugcggcagaagcugguacauccagggcugcgacgccagaagcggcaugggccuguacgagggccuggacuggcugagcagacagcugguggccgccggcgugcuggacguggccuaa

SEQ ID NO: 25031 - RNA, 3051 nt, Artificial Sequence
  TRIM24__Homo_sapiens__NP_003843
auggagguggccguggagaaggccguggccgccgccgccgccgccagcgccgccgccagcggcggccccagcgccgcccccagcggcgagaacgaggccgagagcagacagggccccgacagcgagagaggcggcgaggccgccagacugaaccugcuggacaccugcgccgugugccaccagaacauccagagcagagcccccaagcugcugcccugccugcacagcuucugccagagaugccugcccgccccccagagauaccugaugcugcccgcccccaugcugggcagcgccgagacccccccccccgugcccgcccccggcagccccgugagcggcagcagccccuucgccacccaggugggcgugaucagaugccccgugugcagccaggagugcgccgagagacacaucaucgacaacuucuucgugaaggacaccaccgaggugcccagcagcaccguggagaagagcaaccaggugugcaccagcugcgaggacaacgccgaggccaacggcuucugcguggagugcguggaguggcugugcaagaccugcaucagagcccaccagagagugaaguucaccaaggaccacaccgugagacagaaggaggaggugagccccgaggccgugggcgugaccagccagagacccguguucugccccuuccacaagaaggagcagcugaagcuguacugcgagaccugcgacaagcugaccugcagagacugccagcugcuggagcacaaggagcacagauaccaguucaucgaggaggccuuccagaaccagaaggugaucaucgacacccugaucaccaagcugauggagaagaccaaguacaucaaguucaccggcaaccagauccagaacagaaucaucgaggugaaccagaaccagaagcagguggagcaggacaucaagguggccaucuucacccugaugguggagaucaacaagaagggcaaggcccugcugcaccagcuggagagccuggccaaggaccacagaaugaagcugaugcagcagcagcaggagguggccggccugagcaagcagcuggagcacgugaugcacuucagcaagugggccgugagcagcggcagcagcaccgcccugcuguacagcaagagacugaucaccuacagacugagacaccugcugagagccagaugcgacgccagccccgugaccaacaacaccauccaguuccacugcgaccccagcuucugggcccagaacaucaucaaccugggcagccuggugaucgaggacaaggagagccagccccagaugcccaagcagaaccccgugguggagcagaacagccagccccccagcggccugagcagcaaccagcugagcaaguuccccacccagaucagccuggcccagcugagacugcagcacaugcagcagcagcagcccccccccagacugaucaacuuccagaaccacagccccaagcccaacggccccgugcugcccccccacccccagcagcugagauacccccccaaccagaacauccccagacaggccaucaagcccaacccccugcagauggccuuccuggcccagcaggccaucaagcaguggcagaucagcagcggccagggcacccccagcaccaccaacagcaccagcagcacccccagcagccccaccaucaccagcgccgccggcuacgacggcaaggccuucggcagccccaugaucgaccugagcagccccgugggcggcagcuacaaccugcccagccugcccgacaucgacugcagcagcaccaucaugcuggacaacaucgugagaaaggacaccaacaucgaccacggccagcccagaccccccagcaacagaaccgugcagagccccaacagcagcgugcccagccccggccuggccggccccgugaccaugaccagcgugcacccccccaucagaagccccagcgccagcagcgugggcagcagaggcagcagcggcagcagcagcaagcccgccggcgccgacagcacccacaaggugcccguggugaugcuggagcccaucagaaucaagcaggagaacagcggcccccccgagaacuacgacuuccccguggugaucgugaagcaggagagcgacgaggagagcagaccccagaacgccaacuaccccagaagcauccugaccagccugcugcugaacagcagccagagcagcaccagcgaggagaccgugcugagaagcgacgcccccgacagcaccggcgaccagcccggccugcaccaggacaacagcagcaacggcaagagcgaguggcuggaccccagccagaagagcccccugcacgugggcgagaccagaaaggaggacgaccccaacgaggacuggugcgccgugugccagaacggcggcgagcugcugugcugcgagaagugccccaagguguuccaccugagcugccacgugcccacccugaccaacuuccccagcggcgaguggaucugcaccuucugcagagaccugagcaagcccgagguggaguacgacugcgacgcccccagccacaacagcgagaagaagaagaccgagggccuggugaagcugacccccaucgacaagagaaagugcgagagacugcugcuguuccuguacugccacgagaugagccuggccuuccaggaccccgugccccugaccgugcccgacuacuacaagaucaucaagaaccccauggaccugagcaccaucaagaagagacugcaggaggacuacagcauguacagcaagcccgaggacuucguggccgacuucagacugaucuuccagaacugcgccgaguucaacgagcccgacagcgagguggccaacgccggcaucaagcuggagaacuacuucgaggagcugcugaagaaccuguaccccgagaagagauuccccaagcccgaguucagaaacgagagcgaggacaacaaguucagcgacgacagcgacgacgacuucgugcagcccagaaagaagagacugaagagcaucgaggagagacagcugcugaaguaa

SEQ ID NO: 25032 - RNA, 1893 nt, Artificial Sequence
  TRIM25__Homo_sapiens__NP_005073
auggccgagcugugcccccuggccgaggagcugagcugcagcaucugccuggagcccuucaaggagcccgugaccacccccugcggccacaacuucugcggcagcugccugaacgagaccugggccgugcagggcagccccuaccugugcccccagugcagagccguguaccaggccagaccccagcugcacaagaacaccgugcugugcaacgugguggagcaguuccugcaggccgaccuggccagagagccccccgccgacguguggaccccccccgccagagccagcgcccccagccccaacgcccagguggccugcgaccacugccugaaggaggccgccgugaagaccugccuggugugcauggccagcuucugccaggagcaccugcagccccacuucgacagccccgccuuccaggaccacccccugcagccccccgugagagaccugcugagaagaaagugcagccagcacaacagacugagagaguucuucugccccgagcacagcgagugcaucugccacaucugccugguggagcacaagaccugcagccccgccagccugagccaggccagcgccgaccuggaggccacccugagacacaagcugaccgugauguacagccagaucaacggcgccagcagagcccuggacgacgugagaaacagacagcaggacgugagaaugaccgccaacagaaagguggagcagcugcagcaggaguacaccgagaugaaggcccugcuggacgccagcgagaccaccagcaccagaaagaucaaggaggaggagaagagagugaacagcaaguucgacaccaucuaccagauccugcugaagaagaagagcgagauccagacccugaaggaggagaucgagcagagccugaccaagagagacgaguucgaguuccuggagaaggccagcaagcugagaggcaucagcaccaagcccguguacauccccgagguggagcugaaccacaagcugaucaagggcauccaccagagcaccaucgaccugaagaacgagcugaagcagugcaucggcagacugcaggagcccacccccagcagcggcgaccccggcgagcacgaccccgccagcacccacaagagcaccagacccgugaagaaggugagcaaggaggagaagaagagcaagaagcccccccccgugcccgcccugcccagcaagcugcccaccuucggcgcccccgagcagcugguggaccugaagcaggccggccuggaggccgccgccaaggccaccagcagccaccccaacagcaccagccugaaggccaaggugcuggagaccuuccuggccaagagcagacccgagcugcuggaguacuacaucaaggugauccuggacuacaacaccgcccacaacaagguggcccugagcgagugcuacaccguggccagcguggccgagaugccccagaacuacagaccccacccccagagauucaccuacugcagccaggugcugggccugcacugcuacaagaagggcauccacuacugggagguggagcugcagaagaacaacuucugcggcgugggcaucugcuacggcagcaugaacagacagggccccgagagcagacugggcagaaacagcgccagcuggugcguggagugguucaacaccaagaucagcgccuggcacaacaacguggagaagacccugcccagcaccaaggccaccagagugggcgugcugcugaacugcgaccacggcuucgugaucuucuucgccguggccgacaaggugcaccugauguacaaguucagaguggacuucaccgaggcccuguaccccgccuucuggguguucagcgccggcgccacccugagcaucugcagccccaaguaa

SEQ ID NO: 25033 - RNA, 1620 nt, Artificial Sequence
  TRIM26__Homo_sapiens__XP_005249435
auggccaccagcgccccccugagaagccuggaggaggaggugaccugcagcaucugccuggacuaccugagagaccccgugaccaucgacugcggccacguguucugcagaagcugcaccaccgacgugagacccaucagcggcagcagacccgugugcccccugugcaagaagcccuucaagaaggagaacaucagacccguguggcagcuggccagccugguggagaacaucgagagacugaagguggacaagggcagacagcccggcgaggugaccagagagcagcaggacgccaagcugugcgagagacacagagagaagcugcacuacuacugcgaggacgacggcaagcugcugugcgugaugugcagagagagcagagagcacagaccccacaccgccgugcugauggagaaggccgcccagccccacagagagaagauccugaaccaccugagcacccugagaagagacagagacaagauccagggcuuccaggccaagggcgaggccgacauccuggccgcccugaagaagcugcaggaccagagacaguacaucguggccgaguucgagcagggccaccaguuccugagagagagagaggagcaccugcuggagcagcuggccaagcuggagcaggagcugaccgagggcagagagaaguucaagagcagaggcgugggcgagcuggccagacuggcccuggugaucagcgagcuggagggcaaggcccagcagcccgccgccgagcugaugcaggacaccagagacuuccugaacagauaccccagaaagaaguucugggugggcaagcccaucgccagaguggugaagaagaagaccggcgaguucagcgacaagcugcugagccugcagagaggccugagagaguuccagggcaagcugcugagagaccuggaguacaagaccgugagcgugacccuggacccccagagcgccagcggcuaccugcagcugagcgaggacuggaagugcgugaccuacaccagccuguacaagagcgccuaccugcacccccagcaguucgacugcgagcccggcgugcugggcagcaagggcuucaccuggggcaagguguacugggagguggagguggagagagagggcuggagcgaggacgaggaggagggcgacgaggaggaggagggcgaggaggaggaggaggaggaggaggccggcuacggcgacggcuacgacgacugggagaccgacgaggacgaggagagccugggcgacgaggaggaggaggaggaggaggaggaggaggaggugcuggagagcugcauggugggcguggccagagacagcgugaagagaaagggcgaccugagccugagacccgaggacggcgugugggcccugagacugagcagcagcggcaucugggccaacaccagccccgaggccgagcuguuccccgcccugagacccagaagagugggcaucgcccuggacuacgagggcggcaccgugaccuucaccaacgccgagagccaggagcugaucuacaccuucaccgccaccuucaccagaagacuggugcccuuccuguggcugaaguggcccggcaccagacugcugcugagacccuaa

SEQ ID NO: 25034 - RNA, 1542 nt, Artificial Sequence
  TRIM27__Homo_sapiens__NP_006501
auggccagcggcagcguggccgagugccugcagcaggagaccaccugccccgugugccugcaguacuucgccgagcccaugaugcuggacugcggccacaacaucugcugcgccugccuggccagaugcuggggcaccgccgagaccaacgugagcugcccccagugcagagagaccuucccccagagacacaugagacccaacagacaccuggccaacgugacccagcuggugaagcagcugagaaccgagagacccagcggccccggcggcgagaugggcgugugcgagaagcacagagagccccugaagcuguacugcgaggaggaccagaugcccaucugcguggugugcgacagaagcagagagcacagaggccacagcgugcugccccuggaggaggccguggagggcuucaaggagcagauccagaaccagcuggaccaccugaagagagugaaggaccugaagaagagaagaagagcccagggcgagcaggccagagccgagcugcugagccugacccagauggagagagagaagaucgugugggaguucgagcagcuguaccacagccugaaggagcacgaguacagacugcuggccagacuggaggagcuggaccuggccaucuacaacagcaucaacggcgccaucacccaguucagcugcaacaucagccaccugagcagccugaucgcccagcuggaggagaagcagcagcagcccaccagagagcugcugcaggacaucggcgacacccugagcagagccgagagaaucagaauccccgagcccuggaucaccccccccgaccugcaggagaagauccacaucuucgcccagaagugccuguuccugaccgagagccugaagcaguucaccgagaagaugcagagcgacauggagaagauccaggagcugagagaggcccagcuguacagcguggacgugacccuggaccccgacaccgccuaccccagccugauccugagcgacaaccugagacaggugagauacagcuaccugcagcaggaccugcccgacaaccccgagagauucaaccuguuccccugcgugcugggcagccccugcuucaucgccggcagacacuacugggagguggaggugggcgacaaggccaaguggaccaucggcgugugcgaggacagcgugugcagaaagggcggcgugaccagcgccccccagaacggcuucugggccgugagccugugguacggcaaggaguacugggcccugaccagccccaugaccgcccugccccugagaaccccccugcagagagugggcaucuuccuggacuacgacgccggcgaggugagcuucuacaacgugaccgagagaugccacaccuucaccuucagccacgccaccuucugcggccccgugagacccuacuucagccugagcuacagcggcggcaagagcgccgccccccugaucaucugccccaugagcggcaucgacggcuucagcggccacgugggcaaccacggccacagcauggagaccagccccuaa

SEQ ID NO: 25035 - RNA, 2508 nt, Artificial Sequence
  TRIM28__Homo_sapiens__NP_005753
auggccgccagcgccgccgccgccagcgccgccgccgccagcgccgccagcggcagccccggccccggcgagggcagcgccggcggcgagaagagaagcaccgcccccagcgccgccgccagcgccagcgccagcgccgccgccagcagccccgccggcggcggcgccgaggcccuggagcugcuggagcacugcggcgugugcagagagagacugagacccgagagagagcccagacugcugcccugccugcacagcgccugcagcgccugccugggccccgccgcccccgccgccgccaacagcagcggcgacggcggcgccgccggcgacggcaccgugguggacugccccgugugcaagcagcagugcuucagcaaggacaucguggagaacuacuucaugagagacagcggcagcaaggccgccaccgacgcccaggacgccaaccagugcugcaccagcugcgaggacaacgcccccgccaccagcuacugcguggagugcagcgagccccugugcgagaccugcguggaggcccaccagagagugaaguacaccaaggaccacaccgugagaagcaccggccccgccaagagcagagacggcgagagaaccguguacugcaacgugcacaagcacgagccccuggugcuguucugcgagagcugcgacacccugaccugcagagacugccagcugaacgcccacaaggaccaccaguaccaguuccuggaggacgccgugagaaaccagagaaagcugcuggccagccuggugaagagacugggcgacaagcacgccacccugcagaagagcaccaaggaggugagaagcagcaucagacaggugagcgacgugcagaagagagugcagguggacgugaagauggccauccugcagaucaugaaggagcugaacaagagaggcagagugcuggugaacgacgcccagaaggugaccgagggccagcaggagagacuggagagacagcacuggaccaugaccaagauccagaagcaccaggagcacauccugagauucgccagcugggcccuggagagcgacaacaacaccgcccugcugcugagcaagaagcugaucuacuuccagcugcacagagcccugaagaugaucguggaccccguggagccccacggcgagaugaaguuccagugggaccugaacgccuggaccaagagcgccgaggccuucggcaagaucguggccgagagacccggcaccaacagcaccggccccgcccccauggccccccccagagcccccggcccccugagcaagcagggcagcggcagcagccagcccauggaggugcaggagggcuacggcuucggcagcggcgacgaccccuacagcagcgccgagccccacgugagcggcgugaagagaagcagaagcggcgagggcgaggugagcggccugaugagaaaggugcccagagugagccuggagagacuggaccuggaccugaccgccgacagccagccccccguguucaagguguuccccggcagcaccaccgaggacuacaaccugaucgugaucgagagaggcgccgccgccgccgccaccggccagcccggcaccgcccccgccggcacccccggcgcccccccccuggccggcauggccaucgugaaggaggaggagaccgaggccgccaucggcgccccccccaccgccaccgagggccccgagaccaagcccgugcugauggcccuggccgagggccccggcgccgagggccccagacuggccagccccagcggcagcaccagcagcggccuggaggugguggcccccgagggcaccagcgcccccggcggcggccccggcacccuggacgacagcgccaccaucugcagagugugccagaagcccggcgaccuggugaugugcaaccagugcgaguucugcuuccaccuggacugccaccugcccgcccugcaggacgugcccggcgaggaguggagcugcagccugugccacgugcugcccgaccugaaggaggaggacggcagccugagccuggacggcgccgacagcaccggcgugguggccaagcugagccccgccaaccagagaaagugcgagagagugcugcuggcccuguucugccacgagcccugcagaccccugcaccagcuggccaccgacagcaccuucagccuggaccagcccggcggcacccuggaccugacccugaucagagccagacugcaggagaagcugagcccccccuacagcagcccccaggaguucgcccaggacgugggcagaauguucaagcaguucaacaagcugaccgaggacaaggccgacgugcagagcaucaucggccugcagagauucuucgagaccagaaugaacgaggccuucggcgacaccaaguucagcgccgugcugguggagcccccccccaugagccugcccggcgccggccugagcagccaggagcugagcggcggccccggcgacggccccuaa

SEQ ID NO: 25036 - RNA, 1767 nt, Artificial Sequence
  TRIM29__Homo_sapiens__NP_036233
auggaggccgccgacgccagcagaagcaacggcagcagccccgaggccagagacgccagaagccccagcggccccagcggcagccuggagaacggcaccaaggccgacggcaaggacgccaagaccaccaacggccacggcggcgaggccgccgagggcaagagccugggcagcgcccugaagcccggcgagggcagaagcgcccuguucgccggcaacgaguggagaagacccaucauccaguucguggagagcggcgacgacaagaacagcaacuacuucagcauggacagcauggagggcaagagaagccccuacgccggccugcagcugggcgccgccaagaagccccccgugaccuucgccgagaagggcgagcugagaaagagcaucuucagcgagagcagaaagcccaccgugagcaucauggagcccggcgagaccagaagaaacagcuaccccagagccgacaccggccuguucagcagaagcaagagcggcagcgaggaggugcugugcgacagcugcaucggcaacaagcagaaggccgugaagagcugccuggugugccaggccagcuucugcgagcugcaccugaagccccaccuggagggcgccgccuucagagaccaccagcugcuggagcccaucagagacuucgaggccagaaagugccccgugcacggcaagaccauggagcuguucugccagaccgaccagaccugcaucugcuaccugugcauguuccaggagcacaagaaccacagcaccgugaccguggaggaggccaaggccgagaaggagaccgagcugagccugcagaaggagcagcugcagcugaagaucaucgagaucgaggacgaggccgagaaguggcagaaggagaaggacagaaucaagagcuucaccaccaacgagaaggccauccuggagcagaacuucagagaccuggugagagaccuggagaagcagaaggaggaggugagagccgcccuggagcagagagagcaggacgccguggaccaggugaaggugaucauggacgcccuggacgagagagccaaggugcugcacgaggacaagcagaccagagagcagcugcacagcaucagcgacagcgugcuguuccugcaggaguucggcgcccugaugagcaacuacagccugccccccccccugcccaccuaccacgugcugcuggagggcgagggccugggccagagccugggcaacuucaaggacgaccugcugaacgugugcaugagacacguggagaagaugugcaaggccgaccugagcagaaacuucaucgagagaaaccacauggagaacggcggcgaccacagauacgugaacaacuacaccaacagcuucggcggcgaguggagcgcccccgacaccaugaagagauacagcauguaccugacccccaagggcggcgugagaaccagcuaccagcccagcagccccggcagauucaccaaggagaccacccagaagaacuucaacaaccuguacggcaccaagggcaacuacaccagcagagugugggaguacagcagcagcauccagaacagcgacaacgaccugcccguggugcagggcagcagcagcuucagccugaagggcuaccccagccugaugagaagccagagccccaaggcccagccccagaccuggaagagcggcaagcagaccaugcugagccacuacagacccuucuacgugaacaagggcaacggcaucggcagcaacgaggcccccuaa

SEQ ID NO: 25037 - RNA, 2235 nt, Artificial Sequence
  TRIM2__Homo_sapiens__NP_001123539
auggccagcgagggcaccaacauccccagccccguggugagacagaucgacaagcaguuccugaucugcagcaucugccuggagagauacaagaaccccaaggugcugcccugccugcacaccuucugcgagagaugccugcagaacuacauccccgcccacagccugacccugagcugccccgugugcagacagaccagcauccugcccgagaagggcguggccgcccugcagaacaacuucuucaucaccaaccugauggacgugcugcagagaacccccggcagcaacgccgaggagagcagcauccuggagaccgugaccgccguggccgccggcaagccccugagcugccccaaccacgacggcaacgugauggaguucuacugccagagcugcgagaccgccaugugcagagagugcaccgagggcgagcacgccgagcaccccaccgugccccugaaggacgugguggagcagcacaaggccagccugcaggugcagcuggacgccgugaacaagagacugcccgagaucgacagcgcccugcaguucaucagcgagaucauccaccagcugaccaaccagaaggccagcaucguggacgacauccacagcaccuucgacgagcugcagaagacccugaacgugagaaagagcgugcugcugauggagcuggaggugaacuacggccugaagcacaaggugcugcagagccagcuggacacccugcugcagggccaggagagcaucaagagcugcagcaacuucaccgcccaggcccugaaccacggcaccgagaccgaggugcugcuggugaagaagcagaugagcgagaagcugaacgagcuggccgaccaggacuucccccugcaccccagagagaacgaccagcuggacuucaucguggagaccgagggccugaagaagagcauccacaaccugggcaccauccugaccaccaacgccguggccagcgagaccguggccaccggcgagggccugagacagaccaucaucggccagcccaugagcgugaccaucaccaccaaggacaaggacggcgagcugugcaagaccggcaacgccuaccugaccgccgagcugagcacccccgacggcagcguggccgacggcgagauccuggacaacaagaacggcaccuacgaguuccuguacaccgugcagaaggagggcgacuucacccugagccugagacuguacgaccagcacaucagaggcagccccuucaagcugaaggugaucagaagcgccgacgugagccccaccaccgagggcgugaagagaagagugaagagccccggcagcggccacgugaagcagaaggccgugaagagacccgccagcauguacagcaccggcaagagaaaggagaaccccaucgaggacgaccugaucuucagagugggcaccaagggcagaaacaagggcgaguucaccaaccugcagggcguggccgccagcaccaacggcaagauccugaucgccgacagcaacaaccagugcgugcagaucuucagcaacgacggccaguucaagagcagauucggcaucagaggcagaagccccggccagcugcagagacccaccggcguggccgugcaccccagcggcgacaucaucaucgccgacuacgacaacaagugggugagcaucuucagcagcgacggcaaguucaagaccaagaucggcagcggcaagcugaugggccccaagggcgugagcguggacagaaacggccacaucaucgugguggacaacaaggccugcugcguguucaucuuccagcccaacggcaagaucgugaccagauucggcagcagaggcaacggcgacagacaguucgccggcccccacuucgccgccgugaacagcaacaacgagaucaucaucaccgacuuccacaaccacagcgugaagguguucaaccaggagggcgaguucaugcugaaguucggcagcaacggcgagggcaacggccaguucaacgcccccaccggcguggccguggacagcaacggcaacaucaucguggccgacuggggcaacagcagaauccagguguucgacggcagcggcagcuuccugagcuacaucaacaccagcgccgacccccuguacggcccccagggccuggcccugaccagcgacggccacguggugguggccgacagcggcaaccacugcuucaagguguacagauaccugcaguaa

SEQ ID NO: 25038 - RNA, 1278 nt, Artificial Sequence
  TRIM31__Homo_sapiens__NP_008959
auggccagcggccaguucgugaacaagcugcaggaggaggugaucugccccaucugccuggacauccugcagaagcccgugaccaucgacugcggccacaacuucugccugaagugcaucacccagaucggcgagaccagcugcggcuucuucaagugcccccugugcaagaccagcgugagaaagaacgccaucagauucaacagccugcugagaaaccugguggagaagauccaggcccugcaggccagcgaggugcagagcaagagaaaggaggccaccugccccagacaccaggagauguuccacuacuucugcgaggacgacggcaaguuccugugcuucgugugcagagagagcaaggaccacaagagccacaacgugagccugaucgaggaggccgcccagaacuaccagggccagauccaggagcagauccaggugcugcagcagaaggagaaggagaccgugcaggugaaggcccagggcgugcacagaguggacguguucaccgaccagguggagcacgagaagcagagaauccugaccgaguucgagcugcugcaccaggugcuggaggaggagaagaacuuccugcugagcagaaucuacuggcugggccacgagggcaccgaggccggcaagcacuacguggccagcaccgagccccagcugaacgaccugaagaagcugguggacagccugaagaccaagcagaacaugccccccagacagcugcuggaggacaucaagguggugcugugcagaagcgaggaguuccaguuccugaaccccacccccgugccccuggagcuggagaagaagcugagcgaggccaagagcagacacgacagcaucaccggcagccugaagaaguucaaggaccagcugcaggccgacagaaagaaggacgagaacagauucuucaagagcaugaacaagaacgacaugaagagcuggggccugcugcagaagaacaaccacaagaugaacaagaccagcgagcccggcagcagcagcgccggcggcagaaccaccagcggcccccccaaccaccacagcagcgcccccagccacagccuguucagagccagcagcgccggcaaggugaccuuccccgugugccugcuggccagcuacgacgagaucagcggccagggcgccagcagccaggacaccaagaccuucgacguggcccugagcgaggagcugcacgccgcccugagcgaguggcugaccgccaucagagccugguucugcgaggugcccagcagcuaa

SEQ ID NO: 25039 - RNA, 1962 nt, Artificial Sequence
  TRIM32__Homo_sapiens__XP_011516700
auggccgccgccgccgccagccaccugaaccuggacgcccugagagaggugcuggagugccccaucugcauggagagcuucaccgaggagcagcugagacccaagcugcugcacugcggccacaccaucugcagacagugccuggagaagcugcuggccagcagcaucaacggcgugagaugccccuucugcagcaagaucaccagaaucaccagccugacccagcugaccgacaaccugaccgugcugaagaucaucgacaccgccggccugagcgaggccgugggccugcugaugugcagaagcugcggcagaagacugcccagacaguucugcagaagcugcggccuggugcugugcgagcccugcagagaggccgaccaccagccccccggccacugcacccugcccgugaaggaggccgccgaggagagaagaagagacuucggcgagaagcugaccagacugagagagcugaugggcgagcugcagagaagaaaggccgcccuggagggcgugagcaaggaccugcaggccagauacaaggccgugcugcaggaguacggccacgaggagagaagagugcaggacgagcuggccagaagcagaaaguucuucaccggcagccuggccgagguggagaagagcaacagccaggugguggaggagcagagcuaccugcugaacaucgccgaggugcaggccgugagcagaugcgacuacuuccuggccaagaucaagcaggccgacguggcccugcuggaggagaccgccgacgaggaggagcccgagcugaccgccagccugcccagagagcugacccugcaggacguggagcugcugaaggugggccacgugggcccccugcagaucggccaggccgugaagaagcccagaaccgugaacguggaggacagcugggccauggaggccaccgccagcgccgccagcaccagcgugaccuucagagagauggacaugagccccgaggaggugguggccagccccagagccagccccgccaagcagagaggccccgaggccgccagcaacauccagcagugccuguuccugaagaagaugggcgccaagggcagcacccccggcauguucaaccugcccgugagccuguacgugaccagccagggcgaggugcugguggccgacagaggcaacuacagaauccagguguucaccagaaagggcuuccugaaggagaucagaagaagccccagcggcaucgacagcuucgugcugagcuuccugggcgccgaccugcccaaccugaccccccugagcguggccaugaacugccagggccugaucggcgugaccgacagcuacgacaacagccugaagguguacacccuggacggccacugcguggccugccacagaagccagcugagcaagcccuggggcaucaccgcccugcccagcggccaguucguggugaccgacguggagggcggcaagcuguggugcuucaccguggacagaggcagcggcguggugaaguacagcugccugugcagcgccgugagacccaaguucgugaccugcgacgccgagggcaccguguacuucacccagggccugggccugaaccuggagaacagacagaacgagcaccaccuggagggcggcuucagcaucggcagcgugggccccgacggccagcugggcagacagaucagccacuucuucagcgagaacgaggacuucagaugcaucgccggcaugugcguggacgccagaggcgaccugaucguggccgacagcagcagaaaggagauccugcacuuccccaagggcggcggcuacagcgugcugaucagagagggccugaccugccccgugggcaucgcccugacccccaagggccagcugcuggugcuggacugcugggaccacugcaucaagaucuacagcuaccaccugagaagauacagcacccccuaa

SEQ ID NO: 25040 - RNA, 1467 nt, Artificial Sequence
  TRIM34__Homo_sapiens__NP_067629
auggccagcaagauccugcugaacgugcaggaggaggugaccugccccaucugccuggagcugcugaccgagccccugagccuggacugcggccacagccugugcagagccugcaucaccgugagcaacaaggaggccgugaccagcaugggcggcaagagcagcugccccgugugcggcaucagcuacagcuucgagcaccugcaggccaaccagcaccuggccaacaucguggagagacugaaggaggugaagcugagccccgacaacggcaagaagagagaccugugcgaccaccacggcgagaagcugcugcuguucugcaaggaggacagaaaggugaucugcuggcugugcgagagaagccaggagcacagaggccaccacaccgugcugaccgaggagguguucaaggagugccaggagaagcugcaggccgugcugaagagacugaagaaggaggaggaggaggccgagaagcuggaggccgacaucagagaggagaagaccagcuggaaguaccaggugcagaccgagagacagagaauccagaccgaguucgaccagcugagaagcauccugaacaacgaggagcagagagagcugcagagacuggaggaggaggagaagaagacccuggacaaguucgccgaggccgaggacgagcuggugcagcagaagcagcuggugagagagcugaucagcgacguggagugcagaagccaguggagcaccauggagcugcugcaggacaugagcggcaucaugaaguggagcgagaucuggagacugaagaagcccaagauggugagcaagaagcugaagaccguguuccacgcccccgaccugagcagaaugcugcagauguucagagagcugaccgccgugagaugcuacuggguggacgugacccugaacagcgugaaccugaaccugaaccuggugcugagcgaggaccagagacaggugaucagcgugcccaucuggcccuuccagugcuacaacuacggcgugcugggcagccaguacuucagcagcggcaagcacuacugggagguggacgugagcaagaagaccgccuggauccugggcguguacugcagaaccuacagcagacacaugaaguacguggugagaagaugcgccaacagacagaaccuguacaccaaguacagaccccuguucggcuacugggugaucggccugcagaacaagugcaaguacggcguguucgaggagagccugagcagcgaccccgaggugcugacccugagcauggccgugccccccugcagagugggcguguuccuggacuacgaggccggcaucgugagcuucuucaacgugaccagccacggcagccugaucuacaaguucagcaagugcugcuucagccagcccguguaccccuacuucaaccccuggaacugccccgcccccaugacccugugcccccccagcagcuaa

SEQ ID NO: 25041 - RNA, 1482 nt, Artificial Sequence
  TRIM35__Homo_sapiens__NP_741983
auggagagaagccccgacgugagccccggccccagcagaagcuucaaggaggagcugcugugcgccgugugcuacgaccccuucagagacgccgugacccugagaugcggccacaacuucugcagaggcugcgugagcagaugcugggaggugcaggugagccccaccugccccgugugcaaggacagagccagccccgccgaccugagaaccaaccacacccugaacaaccugguggagaagcugcugagagaggaggccgagggcgccagauggaccagcuacagauucagcagagugugcagacugcacagaggccagcugagccuguucugccuggaggacaaggagcugcugugcugcagcugccaggccgaccccagacaccagggccacagagugcagcccgugaaggacaccgcccacgacuucagagccaagugcagaaacauggagcacgcccugagagagaaggccaaggccuucugggccaugagaagaagcuacgaggccaucgccaagcacaaccagguggaggccgccuggcuggagggcagaaucagacaggaguucgacaagcugagagaguuccugagaguggaggagcaggccauccuggacgccauggccgaggagaccagacagaagcagcugcuggccgacgagaagaugaagcagcugaccgaggagaccgaggugcuggcccacgagaucgagagacugcagauggagaugaaggaggacgacgugagcuuccugaugaagcacaagagcagaaagagaagacuguucugcaccauggagcccgagcccgugcagcccggcaugcugaucgacgugugcaaguaccugggcagccugcaguacagaguguggaagaagaugcuggccagcguggagagcgugcccuucagcuucgaccccaacaccgccgccggcuggcugagcgugagcgacgaccugaccagcgugaccaaccacggcuacagagugcagguggagaaccccgagagauucagcagcgcccccugccugcugggcagcagaguguucagccagggcagccacgccugggagguggcccugggcggccugcagagcuggagagugggcguggugagagugagacaggacagcggcgccgagggccacagccacagcugcuaccacgacaccagaagcggcuucugguacgugugcagaacccagggcguggagggcgaccacugcgugaccagcgaccccgccaccagcccccuggugcuggccauccccagaagacugagaguggagcuggagugcgaggagggcgagcugagcuucuacgacgccgagagacacugccaccuguacaccuuccacgccagauucggcgaggugagacccuacuucuaccugggcggcgccagaggcgccggcccccccgagccccugagaaucugcccccugcacaucagcgugaaggaggagcuggacggcuaa

SEQ ID NO: 25042 - RNA, 183 nt, Artificial Sequence
  TRIM36__Homo_sapiens__NP_001017397
augagcgagagcggcgagaugagcgaguucggcuacaucauggagcugaucgccaagggcaagaugcccgacuggagaagaggcuacagaugcagacagggcugcggcaagaccaccgagcuggccaccgccaccgacuucagccagaccggcaacaagagcggcaagcacuucaagaccuaa

SEQ ID NO: 25043 - RNA, 2895 nt, Artificial Sequence
  TRIM37__Homo_sapiens__NP_056109
auggacgagcagagcguggagagcaucgccgagguguucagaugcuucaucugcauggagaagcugagagacgccagacugugcccccacugcagcaagcugugcugcuucagcugcaucagaagauggcugaccgagcagagagcccagugcccccacugcagagccccccugcagcugagagagcuggugaacugcagaugggccgaggaggugacccagcagcuggacacccugcagcugugcagccugaccaagcacgaggagaacgagaaggacaagugcgagaaccaccacgagaagcugagcguguucugcuggaccugcaagaagugcaucugccaccagugcgcccuguggggcggcaugcacggcggccacaccuucaagccccuggccgagaucuacgagcagcacgugaccaaggugaacgaggagguggccaagcugagaagaagacugauggagcugaucagccuggugcaggagguggagagaaacguggaggccgugagaaacgccaaggacgagagagugagagagaucagaaacgccguggagaugaugaucgccagacuggacacccagcugaagaacaagcugaucacccugaugggccagaagaccagccugacccaggagaccgagcugcuggagagccugcugcaggagguggagcaccagcugagaagcugcagcaagagcgagcugaucagcaagagcagcgagauccugaugauguuccagcaggugcacagaaagcccauggccagcuucgugaccacccccgugccccccgacuucaccagcgagcuggugcccagcuacgacagcgccaccuucgugcuggagaacuucagcacccugagacagagagccgaccccguguacagccccccccugcaggugagcggccugugcuggagacugaagguguaccccgacggcaacggcguggugagaggcuacuaccugagcguguuccuggagcugagcgccggccugcccgagaccagcaaguacgaguacagaguggagauggugcaccagagcugcaacgaccccaccaagaacaucaucagagaguucgccagcgacuucgaggugggcgagugcuggggcuacaacagauucuucagacuggaccugcuggccaacgagggcuaccugaacccccagaacgacaccgugauccugagauuccaggugagaagccccaccuucuuccagaagagcagagaccagcacugguacaucacccagcuggaggccgcccagaccagcuacauccagcagaucaacaaccugaaggagagacugaccaucgagcugagcagaacccagaagagcagagaccugagcccccccgacaaccaccugagcccccagaacgacgacgcccuggagaccagagccaagaagagcgccugcagcgacaugcugcuggagggcggccccaccaccgccagcgugagagaggccaaggaggacgaggaggacgaggagaagauccagaacgaggacuaccaccacgagcugagcgacggcgaccuggaccuggaccugguguacgaggacgaggugaaccagcuggacggcagcagcagcagcgccagcagcaccgccaccagcaacaccgaggagaacgacaucgacgaggagaccaugagcggcgagaacgacguggaguacaacaacauggagcuggaggagggcgagcugauggaggacgccgccgccgccggccccgccggcagcagccacggcuacgugggcagcagcagcagaaucagcagaagaacccaccugugcagcgccgccaccagcagccugcuggacaucgacccccugauccugauccaccugcuggaccugaaggacagaagcagcaucgagaaccuguggggccugcagcccagaccccccgccagccugcugcagcccaccgccagcuacagcagaaaggacaaggaccagagaaagcagcaggccauguggagagugcccagcgaccugaagaugcugaagagacugaagacccagauggccgaggugagaugcaugaagaccgacgugaagaacacccugagcgagaucaagagcagcagcgccgccagcggcgacaugcagaccagccuguucagcgccgaccaggccgcccuggccgccugcggcaccgagaacagcggcagacugcaggaccugggcauggagcugcuggccaagagcagcguggccaacugcuacaucagaaacagcaccaacaagaagagcaacagccccaagcccgccagaagcagcguggccggcagccugagccugagaagagccguggaccccggcgagaacagcagaagcaagggcgacugccagacccugagcgagggcagccccggcagcagccagagcggcagcagacacagcagccccagagcccugauccacggcagcaucggcgacauccugcccaagaccgaggacagacagugcaaggcccuggacagcgacgccguggugguggccguguucagcggccugcccgccguggagaagagaagaaagauggugacccugggcgccaacgccaagggcggccaccuggagggccugcagaugaccgaccuggagaacaacagcgagaccggcgagcugcagcccgugcugcccgagggcgccagcgccgcccccgaggagggcaugagcagcgacagcgacaucgagugcgacaccgagaacgaggagcaggaggagcacaccagcgugggcggcuuccacgacagcuucauggugaugacccagccccccgacgaggacacccacagcagcuuccccgacggcgagcagaucggccccgaggaccugagcuucaacaccgacgagaacagcggcagauaa

SEQ ID NO: 25044 - RNA, 1398 nt, Artificial Sequence
  TRIM38__Homo_sapiens__XP_005248857
auggccagcaccaccagcaccaagaagaugauggaggaggccaccugcagcaucugccugagccugaugaccaaccccgugagcaucaacugcggccacagcuacugccaccugugcaucaccgacuucuucaagaaccccagccagaagcagcugagacaggagaccuucugcugcccccagugcagagcccccuuccacauggacagccugagacccaacaagcagcugggcagccugaucgaggcccugaaggagaccgaccaggagaugagcugcgaggagcacggcgagcaguuccaccuguucugcgaggacgagggccagcugaucugcuggagaugcgagagagccccccagcacaagggccacaccaccgcccugguggaggacgugugccagggcuacaaggagaagcugcagaaggccgugaccaagcugaagcagcuggaggacagaugcaccgagcagaagcugagcaccgccaugagaaucaccaaguggaaggagaaggugcagauccagagacagaagaucagaagcgacuucaagaaccugcagugcuuccugcacgaggaggagaagagcuaccuguggagacuggagaaggaggagcagcagacccugagcagacugagagacuacgaggccggccugggccugaagagcaacgagcugaagagccacauccuggagcuggaggagaagugccagggcagcgcccagaagcugcugcagaacgugaacgacacccugagcagaagcugggccgugaagcuggagaccagcgaggccgugagccuggagcugcacaccaugugcaacgugagcaagcuguacuucgacgugaagaagaugcugagaagccaccaggugagcgugacccuggaccccgacaccgcccaccacgagcugauccugagcgaggacagaagacaggugaccagaggcuacacccaggagaaccaggacaccagcagcagaagauucaccgccuuccccugcgugcugggcugcgagggcuucaccagcggcagaagauacuucgagguggacgugggcgagggcaccggcugggaccugggcgugugcauggagaacgugcagagaggcaccggcaugaagcaggagccccagagcggcuucuggacccugagacugugcaagaagaagggcuacguggcccugaccagcccccccaccagccugcaccugcacgagcagccccugcuggugggcaucuuccuggacuacgaggccggcguggugagcuucuacaacggcaacaccggcugccacaucuucaccuuccccaaggccagcuucagcgacacccugagacccuacuuccagguguaccaguacagcccccuguuccugcccccccccggcgacuaa

SEQ ID NO: 25045 - RNA, 1557 nt, Artificial Sequence
  TRIM39__Homo_sapiens__NP_067076
auggccgagaccagccugcuggaggccggcgccagcgccgccagcaccgccgccgcccuggagaaccugcagguggaggccagcugcagcgugugccuggaguaccugaaggagcccgugaucaucgagugcggccacaacuucugcaaggccugcaucaccagauggugggaggaccuggagagagacuuccccugccccgugugcagaaagaccagcagauacagaagccugagacccaacagacagcugggcagcaugguggagaucgccaagcagcugcaggccgugaagagaaagaucagagacgagagccugugcccccagcaccacgaggcccugagccuguucugcuacgaggaccaggaggccgugugccugaucugcgccaucagccacacccacagagcccacaccguggugccccuggacgacgccacccaggaguacaaggagaagcugcagaagugccuggagccccuggagcagaagcugcaggagaucaccagaugcaagagcagcgaggagaagaagcccggcgagcugaagagacugguggagagcagaagacagcagauccugagagaguucgaggagcugcacagaagacuggacgaggagcagcaggugcugcugagcagacuggaggaggaggagcaggacauccugcagagacugagagagaacgccgcccaccugggcgacaagagaagagaccuggcccaccuggccgccgagguggagggcaagugccugcagagcggcuucgagaugcugaaggacgugaagagcacccuggagaagaacauccccagaaaguucggcggcagccugagcaccaucugccccagagaccacaaggcccugcugggccuggugaaggagaucaacagaugcgagaaggugaagaccauggaggugaccagcgugagcaucgagcuggagaagaacuucagcaacuuccccagacaguacuucgcccugagaaagauccugaagcagcugaucgccgacgugacccuggaccccgagaccgcccaccccaaccuggugcugagcgaggacagaaagagcgugaaguucguggagaccagacugagagaccugcccgacacccccagaagauucaccuucuaccccugcgugcuggccaccgagggcuucaccagcggcagacacuacugggagguggaggugggcgacaagacccacugggccgugggcgugugcagagacagcgugagcagaaagggcgagcugaccccccugcccgagaccggcuacuggagagugagacuguggaacggcgacaaguacgccgccaccaccacccccuucaccccccugcacaucaaggugaagcccaagagagugggcaucuuccuggacuacgaggccggcacccugagcuucuacaacgugaccgacagaagccacaucuacaccuucaccgacaccuucaccgagaagcuguggccccuguucuaccccggcaucagagccggcagaaagaacgccgccccccugaccaucagaccccccaccgacugggaguaa

SEQ ID NO: 25046 - RNA, 2235 nt, Artificial Sequence
  TRIM3__Homo_sapiens__XP_011518146
auggccaagagagaggacagccccggccccgaggugcagcccauggacaagcaguuccuggugugcagcaucugccuggacagauaccagugccccaaggugcugcccugccugcacaccuucugcgagagaugccugcagaacuacauccccgcccagagccugacccugagcugccccgugugcagacagaccagcauccugcccgagcagggcgugagcgcccugcagaacaacuucuucaucagcagccugauggaggccaugcagcaggcccccgacggcgcccacgaccccgaggacccccacccccugagcgugguggccggcagaccccugagcugccccaaccacgagggcaagaccauggaguucuacugcgaggccugcgagaccgccaugugcggcgagugcagagccggcgagcacagagagcacggcaccgugcugcugagagacgugguggagcagcacaaggccgcccugcagagacagcuggaggccgugagaggcagacugccccagcugagcgccgccaucgcccuggugggcggcaucagccagcagcugcaggagagaaaggccgaggcccuggcccagaucagcgccgccuucgaggaccuggagcaggcccugcagcagagaaagcaggcccuggugagcgaccuggagaccaucugcggcgccaagcagaaggugcugcagagccagcuggacacccugagacagggccaggagcacaucggcagcagcugcagcuucgccgagcaggcccugagacugggcagcgcccccgaggugcugcuggugagaaagcacaugagagagagacuggccgcccuggccgcccaggccuuccccgagagaccccacgagaacgcccagcuggagcuggugcuggagguggacggccugagaagaagcgugcugaaccugggcgcccugcugaccaccagcgccaccgcccacgagaccguggccaccggcgagggccugagacaggcccuggugggccagcccgccagccugaccgugaccaccaaggacaaggacggcagacuggugagaaccggcagcgccgagcugagagccgagaucaccggccccgacggcaccagacugcccgugcccgugguggaccacaagaacggcaccuacgagcugguguacaccgccagaaccgagggcgagcugcugcugagcgugcugcuguacggccagcccgugagaggcagccccuucagagugagagcccugagacccggcgaccugccccccagccccgacgacgugaagagaagagugaagagccccggcggccccggcagccacgugagacagaaggccgugagaagacccagcagcauguacagcaccggcggcaagagaaaggacaaccccaucgaggacgagcugguguucagagugggcagcagaggcagagagaagggcgaguucaccaaccugcagggcgugagcgccgccagcagcggcagaaucgugguggccgacagcaacaaccagugcauccagguguucagcaacgagggccaguucaaguucagauucggcgugagaggcagaagccccggccagcugcagagacccaccggcguggccguggacaccaacggcgacaucaucguggccgacuacgacaacagaugggugagcaucuucagccccgagggcaaguucaagaccaagaucggcgccggcagacugaugggccccaagggcguggccguggacagaaacggccacaucaucgugguggacaacaagagcugcugcguguucaccuuccagcccaacggcaagcuggugggcagauucggcggcagaggcgccaccgacagacacuucgccggcccccacuucguggccgugaacaacaagaacgagaucguggugaccgacuuccacaaccacagcgugaagguguacagcgccgacggcgaguuccuguucaaguucggcagccacggcgagggcaacggccaguucaacgcccccaccggcguggccguggacagcaacggcaacaucaucguggccgacuggggcaacagcagaauccagguguucgacagcagcggcagcuuccugagcuacaucaacaccagcgccgagccccuguacggcccccagggccuggcccugaccagcgacggccacguggugguggccgacgccggcaaccacugcuucaaggccuacagauaccugcaguaa

SEQ ID NO: 25047 - RNA, 777 nt, Artificial Sequence
  TRIM40__Homo_sapiens__NP_001273562
augaucccccugcagaaggacaaccaggaggagggcgugugccccaucugccaggagagccugaaggaggccgugagcaccaacugcggccaccuguucugcagagugugccugacccagcacguggagaaggccagcgccagcggcguguucugcugcccccugugcagaaagcccugcagcgaggaggugcugggcaccggcuacaucugccccaaccaccagaagagagugugcagauucugcgaggagagcagacugcugcugugcguggagugccuggugagccccgagcacaugagccaccacgagcugaccaucgagaacgcccugagccacuacaaggagagacugaacagaagaagcagaaagcugagaaaggacaucgccgagcugcagagacugaaggcccagcaggagaagaagcugcaggcccugcaguuccagguggaccacggcaaccacagacuggaggccggccccgagagccagcaccagaccagagagcagcugggcgcccugccccagcaguggcugggccagcuggagcacaugcccgccgaggccgccagaauccuggacaucagcagagccgugacccagcugagaagccuggugaucgaccuggagagaaccgccaaggagcuggacaccaacacccugaagaacgccggcgaccugcugaacagaagcgccccccagaagcuggaggugaucuacccccagcuggagaagggcgugagcgagcugcugcugcagcccccccagaagcuguaa

SEQ ID NO: 25048 - RNA, 2172 nt, Artificial Sequence
  TRIM42__Homo_sapiens__NP_689829
auggagaccgccaugugcgugugcugccccugcugcaccuggcagagaugcugcccccagcugugcagcugccugugcugcaaguucaucuucaccagcgagagaaacugcaccugcuuccccugccccuacaaggacgagagaaacugccaguucugccacugcaccugcagcgagagccccaacugccacuggugcugcugcagcugggccaacgaccccaacugcaagugcugcugcaccgccagcagcaaccugaacugcuacuacuacgagagcagaugcugcagaaacaccaucaucaccuuccacaagggcagacugagaagcauccacaccagcagcaagaccgcccugagaaccggcagcagcgacacccagguggacgaggugaagagcauccccgccaacagccaccuggugaaccaccugaacugccccaugugcagcagacugagacugcacagcuucaugcugcccugcaaccacagccugugcgagaagugccugagacagcugcagaagcacgccgaggugaccgagaacuucuucauccugaucugccccgugugcgacagaagccacugcaugcccuacagcaacaagaugcagcugcccgagaacuaccugcacggcagacugaccaagagauacaugcaggagcacggcuaccugaaguggagauucgacagaagcagcggccccauccugugccaggugugcagaaacaagagaaucgccuacaagagaugcaucaccugcagacugaaccugugcaacgacugccugaaggccuuccacagcgacguggccaugcaggaccacguguucguggacaccagcgccgaggagcaggacgagaagaucugcauccaccaccccagcagcagaaucaucgaguacugcagaaacgacaacaagcugcugugcaccuucugcaaguucagcuuccacaacggccacgacaccaucagccugaucgacgccugcagcgagagagccgccagccuguucagcgccaucgccaaguucaaggccgugagauacgagaucgacaacgaccugauggaguucaacauccugaagaacagcuucaaggccgacaaggaggccaagagaaaggagaucagaaacggcuuccugaagcugagaagcauccugcaggagaaggagaagaucaucauggagcagaucgagaaccuggaggugagcagacagaaggagaucgagaaguacguguacgugaccaccaugaaggugaacgagauggacggccugaucgccuacagcaaggaggcccugaaggagaccggccagguggccuuccugcagagcgccaagauccugguggaccagaucgaggacggcauccagaccaccuacagacccgacccccagcugagacugcacagcaucaacuacgugccccuggacuucguggagcugagcagcgccauccacgagcuguuccccaccggccccaagaaggugagaagcagcggcgacagccugcccagccccuaccccgugcacagcgagaccaugaucgccagaaaggugaccuucagcacccacagccugggcaaccagcacaucuaccagagaagcagcagcaugcugagcuucagcaacaccgacaagaaggccaaggugggccuggaggccugcggcagagcccagagcgccacccccgccaagcccaccgacggccuguacaccuacuggagcgccggcgccgacagccagagcgugcagaacagcagcagcuuccacaacugguacagcuucaacgacggcagcgugaagacccccggccccaucgugaucuaccagacccugguguaccccagagccgccaagguguacuggaccugccccgccgaggacguggacagcuucgagauggaguucuacgaggugaucaccagcccccccaacaacgugcagauggagcugugcggccagaucagagacaucaugcagcagaaccuggagcugcacaaccugacccccaacaccgaguacguguucaaggugagagccaucaacgacaacggccccggccaguggagcgacaucugcaagguggugacccccgacggccacggcaagaacagagccaaguggggccugcugaagaacauccagagcgcccugcagaagcacuucuaa

SEQ ID NO: 25049 - RNA, 1035 nt, Artificial Sequence
  TRIM44__Homo_sapiens__NP_060053
auggccagcggcgugggcgccgccuucgaggagcugccccacgacggcaccugcgacgagugcgagcccgacgaggcccccggcgccgaggaggugugcagagagugcggcuucugcuacugcagaagacacgccgaggcccacagacagaaguuccugagccaccaccuggccgaguacgugcacggcagccaggccuggaccccccccgccgacggcgagggcgccggcaaggaggaggccgaggugaagguggagcaggagagagagaucgagagcgaggccggcgaggagagcgagagcgaggaggagagcgagagcgaggaggagagcgagaccgaggaggagagcgaggacgagagcgacgaggagagcgaggaggacagcgaggaggagauggaggacgagcaggagagcgaggccgaggaggacaaccaggaggagggcgagagcgaggccgagggcgagaccgaggccgagagcgaguucgaccccgagaucgagauggaggccgagagaguggccaagagaaagugccccgaccacggccuggaccugagcaccuacugccaggaggacagacagcugaucugcgugcugugccccgugaucggcgcccaccagggccaccagcugagcacccuggacgaggccuucgaggagcugagaagcaaggacagcggcggccugaaggccgccaugaucgagcugguggagagacugaaguucaagagcagcgaccccaaggugaccagagaccagaugaagauguucauccagcaggaguucaagaaggugcagaaggugaucgccgacgaggagcagaaggcccugcaccugguggacauccaggaggccauggccaccgcccacgugaccgagauccuggccgacauccagagccacauggacagacugaugacccagauggcccaggccaaggagcagcuggacaccagcaacgagagcgccgagcccaaggccgagggcgacgaggagggccccagcggcgccagcgaggaggaggacaccuaa

SEQ ID NO: 25050 - RNA, 1464 nt, Artificial Sequence
  TRIM50__Homo_sapiens__NP_835226
auggccuggcaggugagccugcccgagcuggaggacagacugcagugccccaucugccuggagguguucaaggagccccugaugcugcagugcggccacagcuacugcaagggcugccuggugagccugagcugccaccuggacgccgagcugagaugccccgugugcagacaggccguggacggcagcagcagccugcccaacgugagccuggccagagugaucgaggcccugagacugcccggcgaccccgagcccaaggugugcgugcaccacagaaacccccugagccuguucugcgagaaggaccaggagcugaucugcggccugugcggccugcugggcagccaccagcaccaccccgugacccccgugagcaccguguacagcagaaugaaggaggagcuggccgcccugaucagcgagcugaagcaggagcagaagaagguggacgagcugaucgccaagcuggugaacaacagaaccagaaucgugaacgagagcgacguguucagcugggugaucagaagagaguuccaggagcugcaccaccugguggacgaggagaaggccagaugccuggagggcaucggcggccacaccagaggccugguggccagccuggacaugcagcuggagcaggcccagggcaccagagagagacuggcccaggccgagugcgugcuggagcaguucggcaacgaggaccaccacaaguucaucagaaaguuccacagcauggccagcagagccgagaugccccaggccagaccccuggagggcgccuucagccccaucagcuucaagcccggccugcaccaggccgacaucaagcugaccguguggaagagacuguucagaaaggugcugcccgcccccgagccccugaagcuggaccccgccaccgcccacccccugcuggagcugagcaagggcaacaccguggugcagugcggccugcuggcccagagaagagccagccagcccgagagauucgacuacagcaccugcgugcuggccagcagaggcuucagcugcggcagacacuacugggaggugguggugggcagcaagagcgacuggagacugggcgugaucaagggcaccgccagcagaaagggcaagcugaacagaagccccgagcacggcguguggcugaucggccugaaggagggcagaguguacgaggccuucgccugccccagagugccccugcccguggccggccacccccacagaaucggccuguaccugcacuacgagcagggcgagcugaccuucuucgacgccgacagacccgacgaccugagaccccuguacaccuuccaggccgacuuccagggcaagcuguaccccauccuggacaccugcuggcacgagagaggcagcaacagccugcccauggugcugcccccccccagcggccccggcccccugagccccgagcagcccaccaagcuguaa

SEQ ID NO: 25051 - RNA, 2268 nt, Artificial Sequence
  TRIM56__Homo_sapiens__NP_112223
auggugagccacggcagcagccccagccugcuggaggcccugagcagcgacuuccuggccugcaagaucugccuggagcagcugagagcccccaagacccugcccugccugcacaccuacugccaggacugccuggcccagcuggccgacggcggcagagugagaugccccgagugcagagagaccgugcccgugccccccgagggcguggccagcuucaagaccaacuucuucgugaacggccugcuggaccuggugaaggccagagccugcggcgaccugagagccggcaagcccgccugcgcccugugcccccuggugggcggcaccagcaccggcggccccgccaccgccagaugccuggacugcgccgacgaccugugccaggccugcgccgacggccacagaugcaccagacagacccacacccacagagugguggaccuggugggcuacagagccggcugguacgacgaggaggccagagagagacaggccgcccagugcccccagcaccccggcgaggcccugagauuccugugccagcccugcagccagcugcugugcagagagugcagacuggacccccaccuggaccaccccugccugccccuggccgaggccgugagagccagaagacccggccuggagggccugcuggccggcguggacaacaaccugguggagcuggaggccgccagaagaguggagaaggaggcccuggccagacugagagagcaggccgccagagugggcacccagguggaggaggccgccgagggcgugcugagagcccugcuggcccagaagcaggaggugcugggccagcugagagcccacguggaggccgccgaggaggccgccagagagagacuggccgagcuggagggcagagagcagguggccagagccgccgccgccuucgccagaagagugcugagccugggcagagaggccgagauccugagccuggagggcgccaucgcccagagacugagacagcugcagggcugccccugggcccccggccccgcccccugccugcugccccagcuggagcugcaccccggccugcuggacaagaacugccaccugcugagacugagcuucgaggagcagcagccccagaaggacggcggcaaggacggcgccggcacccagggcggcgaggagagccagagcagaagagaggacgagcccaagaccgagagacagggcggcgugcagccccaggccggcgacggcgcccagacccccaaggaggagaaggcccagaccaccagagaggagggcgcccagacccuggaggaggacagagcccagaccccccacgaggacggcggcccccagccccacagaggcggcagacccaacaagaagaagaaguucaagggcagacugaagagcaucagcagagagcccagccccgcccugggccccaaccuggacggcagcggccugcugcccagacccaucuucuacugcagcuuccccaccagaaugcccggcgacaagagaagccccagaaucaccggccugugccccuucggccccagagagauccugguggccgacgagcagaacagagcccugaagagauucagccugaacggcgacuacaagggcaccgugcccgugcccgagggcugcagccccugcagcguggccgcccugcagagcgccguggccuucagcgccagcgccagacuguaccugaucaaccccaacggcgaggugcaguggagaagagcccugagccugagccaggccagccacgccguggccgcccugcccagcggcgacagaguggccgugagcguggccggccacguggagguguacaacauggagggcagccuggccaccagauucauccccggcggcaaggccagcagaggccugagagcccugguguuccugaccaccagcccccagggccacuucgugggcagcgacuggcagcagaacagcguggugaucugcgacggccugggccagguggugggcgaguacaagggccccggccugcacggcugccagcccggcagcgugagcguggacaagaagggcuacaucuuccugacccugagagaggugaacaagguggugauccuggaccccaagggcagccugcugggcgacuuccugaccgccuaccacggccuggagaagcccagagugaccaccaugguggacggcagauaccugguggugagccugagcaacggcaccauccacaucuucagagugagaagccccgacagcuaa

SEQ ID NO: 25052 - RNA, 1461 nt, Artificial Sequence
  TRIM58__Homo_sapiens__NP_056246
auggccugggccccccccggcgagagacugagagaggacgccagaugccccgugugccuggacuuccugcaggagcccgugagcguggacugcggccacagcuucugccugagaugcaucagcgaguucugcgagaagagcgacggcgcccagggcggcguguacgccugcccccagugcagaggccccuucagacccagcggcuucagacccaacagacagcuggccggccugguggagagcgugagaagacugggccugggcgccggccccggcgccagaagaugcgccagacacggcgaggaccugagcagauucugcgaggaggacgaggccgcccugugcugggugugcgacgccggccccgagcacagaacccacagaaccgccccccugcaggaggccgccggcagcuaccaggugaagcugcagauggcccuggagcugaugagaaaggagcuggaggacgcccugacccaggaggccaacgugggcaagaagaccgugaucuggaaggagaagguggagaugcagagacagagauucagacuggaguucgagaagcacagaggcuuccuggcccaggaggagcagagacagcugagaagacuggaggccgaggagagagccacccugcagagacugagagagagcaagagcagacuggugcagcagagcaaggcccugaaggagcuggccgacgagcugcaggagagaugccagagacccgcccugggccugcuggagggcgugagaggcgugcugagcagaagcaaggccgugaccagacuggaggccgagaacauccccauggagcugaagaccgccugcugcauccccggcagaagagagcugcugagaaaguuccagguggacgugaagcuggaccccgccaccgcccaccccagccugcugcugaccgccgaccugagaagcgugcaggacggcgagcccuggagagacgugcccaacaaccccgagagauucgacaccuggcccugcauccugggccugcagagcuucagcagcggcagacacuacugggaggugcuggugggcgagggcgccgaguggggccugggcgugugccaggacacccugcccagaaagggcgagaccacccccagccccgagaacggcgugugggcccuguggcugcugaagggcaacgaguacauggugcuggccagccccagcgugccccugcugcagcuggagagccccagaugcaucggcaucuuccuggacuacgaggccggcgagaucagcuucuacaacgugaccgacggcagcuacaucuacaccuucaaccagcuguucagcggccugcugagacccuacuucuucaucugcgacgccaccccccugauccugccccccaccaccaucgccggcagcggcaacugggccagcagagaccaccuggaccccgccagcgacgugagagacgaccaccuguaa

SEQ ID NO: 25053 - RNA, 1212 nt, Artificial Sequence
  TRIM59__Homo_sapiens__NP_775107
augcacaacuucgaggaggagcugaccugccccaucugcuacagcaucuucgaggaccccagagugcugcccugcagccacaccuucugcagaaacugccuggagaacauccugcaggccagcggcaacuucuacaucuggagaccccugagaaucccccugaagugccccaacugcagaagcaucaccgagaucgcccccaccggcaucgagagccugcccgugaacuucgcccugagagccaucaucgagaaguaccagcaggaggaccaccccgacaucgugaccugccccgagcacuacagacagccccugaacguguacugccugcuggacaagaagcuggugugcggccacugccugaccaucggccagcaccacggccaccccaucgacgaccugcagagcgccuaccugaaggagaaggacaccccccagaagcugcuggagcagcugaccgacacccacuggaccgaccugacccaccugaucgagaagcugaaggagcagaagagccacagcgagaagaugauccagggcgacaaggaggccgugcugcaguacuucaaggagcugaacgacacccuggagcagaagaagaagagcuuccugaccgcccugugcgacgugggcaaccugaucaaccaggaguacaccccccagaucgagagaaugaaggagaucagagagcagcagcuggagcugauggcccugaccaucagccugcaggaggagagcccccugaaguuccuggagaagguggacgacgugagacagcacgugcagauccugaagcagagaccccugcccgaggugcagcccguggagaucuaccccagagugagcaagauccugaaggaggaguggagcagaaccgagaucggccagaucaagaacgugcugauccccaagaugaagaucagccccaagagaaugagcugcagcuggcccggcaaggacgagaaggagguggaguuccugaagauccugaacaucgugguggugacccugaucagcgugauccugaugagcauccuguucuucaaccagcacaucaucaccuuccugagcgagaucacccugaucugguucagcgaggccagccugagcguguaccagagccugagcaacagccugcacaaggugaagaacauccugugccacaucuucuaccugcugaaggaguucguguggaagaucgugagccacuaa

SEQ ID NO: 25054 - RNA, 1482 nt, Artificial Sequence
  TRIM5__Homo_sapiens__NP_149023
auggccagcggcauccuggugaacgugaaggaggaggugaccugccccaucugccuggagcugcugacccagccccugagccuggacugcggccacagcuucugccaggccugccugaccgccaaccacaagaagagcaugcuggacaagggcgagagcagcugccccgugugcagaaucagcuaccagcccgagaacaucagacccaacagacacguggccaacaucguggagaagcugagagaggugaagcugagccccgagggccagaagguggaccacugcgccagacacggcgagaagcugcugcuguucugccaggaggacggcaaggugaucugcuggcugugcgagagaagccaggagcacagaggccaccacaccuuccugaccgaggagguggccagagaguaccaggugaagcugcaggccgcccuggagaugcugagacagaagcagcaggaggccgaggagcuggaggccgacaucagagaggagaaggccagcuggaagacccagauccaguacgacaagaccaacgugcuggccgacuucgagcagcugagagacauccuggacugggaggagagcaacgagcugcagaaccuggagaaggaggaggaggacauccugaagagccugaccaacagcgagaccgagauggugcagcagacccagagccugagagagcugaucagcgaccuggagcacagacugcagggcagcgugauggagcugcugcagggcguggacggcgugaucaagagaaccgagaacgugacccugaagaagcccgagaccuuccccaagaaccagagaagaguguucagagcccccgaccugaagggcaugcuggagguguucagagagcugaccgacgugagaagauacuggguggacgugaccguggcccccaacaacaucagcugcgccgugaucagcgaggacaagagacaggugagcagccccaagccccagaucaucuacggcgccagaggcaccagauaccagaccuucgugaacuucaacuacugcaccggcauccugggcagccagagcaucaccagcggcaagcacuacugggagguggacgugagcaagaagaccgccuggauccugggcgugugcgccggcuuccagcccgacgccaugugcaacaucgagaagaacgagaacuaccagcccaaguacggcuacugggugaucggccuggaggagggcgugaagugcagcgccuuccaggacagcagcuuccacacccccagcgugcccuucaucgugccccugagcgugaucaucugccccgacagagugggcguguuccuggacuacgaggccugcaccgugagcuucuucaacaucaccaaccacggcuuccugaucuacaaguucagccacugcagcuucagccagcccguguuccccuaccugaaccccagaaagugcggcgugcccaugacccugugcagccccagcagcuaa

SEQ ID NO: 25055 - RNA, 1065 nt, Artificial Sequence
  TRIM62__Homo_sapiens__XP_011540007
augcccgagaagaccgccguggaccagcccuggacccaggcccugagagagcugaaggaccagcugcaggcccugcaggacagcgagagagagcacaccgaggcccugcagcugcugaagagacagcuggccgagaccaagagcagcaccaagagccugagaaccaccaucggcgaggccuucgagagacugcacagacugcugagagagagacagaaggccaugcuggaggagcuggaggccgacaccgccagaacccugaccgacaucgagcagaaggugcagagauacagccagcagcugagaaaggugcaggagggcgcccagauccugcaggagagacuggccgagaccgacagacacaccuuccuggccggcguggccagccugagcgagagacugaagggcaagauccacgagaccaaccugaccuacgaggacuuccccaccagcaaguacaccggcccccugcaguacaccaucuggaagagccuguuccaggacauccaccccgugcccgccgcccugacccuggaccccggcaccgcccaccagagacugauccugagcgacgacugcaccaucguggccuacggcaaccugcacccccagccccugcaggacagccccaagagauucgacguggaggugagcgugcugggcagcgaggccuucagcagcggcgugcacuacugggagguggugguggccgagaagacccagugggugaucggccuggcccacgaggccgccagcagaaagggcagcauccagauccagcccagcagaggcuucuacugcaucgugaugcacgacggcaaccaguacagcgccugcaccgagcccuggaccagacugaacgugagagacaagcuggacaaggugggcguguuccuggacuacgaccagggccugcugaucuucuacaacgccgacgacaugagcuggcuguacaccuucagagagaaguuccccggcaagcugugcagcuacuucagccccggccagagccacgccaacggcaagaacgugcagccccugagaaucaacaccgugagaaucuaa

SEQ ID NO: 25056 - RNA, 3651 nt, Artificial Sequence
  TRIM66__Homo_sapiens__NP_055633
auggccagaaacugcagcgagugcaaggagaagagagccgcccacauccugugcaccuacugcaacagauggcugugcagcagcugcaccgaggagcacagacacagccccgugcccggcggccccuucuuccccagagcccagaagggcagccccggcgugaacggcggccccggcgacuucacccuguacugcccccugcacacccaggaggugcugaagcuguucugcgagaccugcgacaugcugaccugccacagcugccuggugguggagcacaaggagcacagaugcagacacguggaggaggugcugcagaaccagagaaugcugcuggagggcgugaccacccagguggcccacaagaagagcagccugcagaccagcgccaagcagaucgaggacagaaucuucgaggugaagcaccagcacagaaagguggagaaccagaucaagauggccaagauggugcugaugaacgagcugaacaagcaggccaacggccugaucgaggagcuggagggcaucaccaacgagagaaagagaaagcuggagcagcagcugcagagcaucauggugcugaacagacaguucgagcacgugcagaacuucaucaacugggccgugugcagcaagaccagcgugcccuuccuguucagcaaggagcugaucguguuccagaugcagagacugcuggagaccagcugcaacaccgaccccggcagccccuggagcaucagauucaccugggagcccaacuucuggaccaagcagcuggccagccugggcugcaucaccaccgagggcggccagaugagcagagccgacgcccccgccuacggcggccugcagggcagcagccccuucuaccagagccaccagagccccguggcccagcaggaggcccugagccaccccagccacaaguuccagagccccgccgugugcagcagcagcgugugcugcagccacugcagccccgugagccccagccugaagggccaggugcccccccccagcauccaccccgcccacagcuucagacagccccccgagauggugccccagcagcugggcagccugcagugcagcgcccugcugcccagagagaaggagcuggccugcagcccccacccccccaagcugcugcagcccuggcuggagacccagccccccguggagcaggagagcaccagccagagacugggccagcagcugaccagccagcccgugugcaucgugcccccccaggacgugcagcagggcgcccacgcccagcccacccugcagacccccagcauccaggugcaguucggccaccaccagaagcugaagcugagccacuuccagcagcagccccagcagcagcugcccccccccccccccccccugccccaccccccccccccccugcccccccccccccagcagccccaccccccccugccccccagccagcaccuggccagcagccagcacgagagcccccccggccccgccugcagccagaacauggacaucaugcaccacaaguucgagcuggaggagaugcagaaggaccuggagcugcugcugcaggcccagcagcccagccugcagcugagccagaccaagagcccccagcaccugcagcagaccaucgugggccagaucaacuacaucgugagacagcccgcccccgugcagagccagagccaggaggagacccugcaggccaccgacgagccccccgccagccagggcagcaagcccgcccugccccuggacaagaacaccgccgccgcccugccccaggccagcggcgaggagaccccccugagcgugccccccguggacagcaccauccagcacagcagccccaacguggugagaaagcacagcaccagccugagcaucaugggcuucagcaacacccuggagauggagcugagcagcaccagacuggagagaccccuggagccccagauccagagcgugagcaaccugaccgccggcgccccccaggccgugcccagccugcugagcgccccccccaagauggugagcagccugaccagcgugcagaaccaggccaugcccagccugaccaccagccaccugcagaccgugcccagccuggugcacagcaccuuccagagcaugcccaaccugaucagcgacagcccccaggccauggccagccuggccagcgaccacccccaggccggccccagccugaugagcggccacacccaggccgugcccagccuggccaccugcccccugcagagcaucccccccgugagcgacaugcagcccgagaccggcagcagcagcagcagcggcagaaccagcggcagccugugccccagagacggcgccgaccccagccuggagaacgcccugugcaaggugaagcuggaggagcccaucaaccugagcgugaagaagcccccccuggcccccguggugagcaccagcaccgcccugcagcaguaccagaaccccaaggagugcgagaacuucgagcagggcgcccuggagcuggacgccaaggagaaccagagcaucagagccuucaacagcgagcacaagauccccuacgugagacuggagagacugaagaucugcgccgccagcagcggcgagaugcccguguucaagcugaagccccagaagaacgaccaggacggcagcuuccugcugaucaucgagugcggcaccgagagcagcagcaugagcaucaaggugagccaggacagacugagcgaggccacccaggcccccggccuggagggcagaaaggugaccgugaccagccuggccggccagagaccccccgagguggagggcaccagccccgaggagcacagacugauccccagaacccccggcgccaagaagggcccccccgcccccaucgagaacgaggacuucugcgccgugugccugaacggcggcgagcugcugugcugcgacagaugccccaagguguuccaccugagcugccacgugcccgcccugcugagcuuccccggcggcgagugggugugcacccugugcagaagccugacccagcccgagauggaguacgacugcgagaacgccugcuacaaccagcccggcaugagagccagccccggccugagcauguacgaccagaagaagugcgagaagcuggugcugagccugugcugcaacaaccugagccugcccuuccacgagcccgugagcccccuggccagacacuacuaccagaucaucaagagacccauggaccugagcaucaucagaagaaagcugcagaagaaggaccccgcccacuacaccacccccgaggagguggugagcgacgugagacugauguucuggaacugcgccaaguucaacuaccccgacagcgagguggccgaggccggcagaugccuggagguguucuucgagggcuggcugaaggagaucuaccccgagaagagauucgcccagcccagacaggaggacagcgacagcgaggaggugagcagcgagagcggcugcagcaccccccagggcuuccccuggccccccuacaugcaggagggcauccagcccaagagaagaagaagacacauggagaacgagagagccaagagaaugagcuucagacuggccaacagcaucagccagguguaa

SEQ ID NO: 25057 - RNA, 789 nt, Artificial Sequence
  TRIM68__Homo_sapiens__NP_001291425
augcagaagcuggagcugaaccacagcgagcugauccagcagagccaggugcuguggagaaugaucgccgagcugaaggagagaagccagagacccgugagauggaugcugcaggacauccaggaggugcugaacagaagcaagagcuggagccugcagcagcccgagcccaucagccuggagcugaagaccgacugcagagugcugggccugagagagauccugaagaccuacgccgccgacgugagacuggaccccgacaccgccuacagcagacugaucgugagcgaggacagaaagagagugcacuacggcgacaccaaccagaagcugcccgacaaccccgagagauucuacagauacaacaucgugcugggcagccagugcaucagcagcggcagacacuacugggagguggaggugggcgacagaagcgaguggggccugggcgugugcaagcagaacguggacagaaaggaggugguguaccugagcccccacuacggcuucugggugaucagacugagaaagggcaacgaguacagagccggcaccgacgaguaccccauccugagccugcccgugccccccagaagagugggcaucuucguggacuacgaggcccacgacaucagcuucuacaacgugaccgacugcggcagccacaucuucaccuuccccagauaccccuuccccggcagacugcugcccuacuucagccccugcuacagcaucggcaccaacaacaccgccccccuggccaucugcagccuggacggcgaggacuaa

SEQ ID NO: 25058 - RNA, 891 nt, Artificial Sequence
  TRIM69__Homo_sapiens__NP_001288073
auggaguuccugaagcugcaccaguuccugcacagcaaggagaaggacauccugaccgagcugagagaggagggcaaggcccugaacgaggagauggagcugaaccugagccagcugcaggagcagugccugcuggccaaggacaugcuggugagcauccaggccaagaccgagcagcagaacagcuucgacuuccugaaggacaucaccacccugcugcacagccuggagcagggcaugaaggugcuggccaccagagagcugaucagcagaaagcugaaccugggccaguacaagggccccauccaguacaugguguggagagagaugcaggacacccugugccccggccugagcccccugacccuggaccccaagaccgcccaccccaaccuggugcugagcaagagccagaccagcguguggcacggcgacaucaagaagaucaugcccgacgaccccgagagauucgacagcagcguggccgugcugggcagcagaggcuucaccagcggcaagugguacugggagguggagguggccaagaagaccaaguggaccgugggcguggugagagagagcaucaucagaaagggcagcugcccccugacccccgagcagggcuucuggcugcugagacugagaaaccagaccgaccugaaggcccuggaccugcccagcuucagccugacccugaccaacaaccuggacaaggugggcaucuaccuggacuacgagggcggccagcugagcuucuacaacgccaagaccaugacccacaucuacaccuucagcaacaccuucauggagaagcuguaccccuacuucugccccugccugaacgacggcggcgagaacaaggagccccugcacauccugcacccccaguaa

SEQ ID NO: 25059 - RNA, 2529 nt, Artificial Sequence
  TRIM6-TRIM34__Homo_sapiens__NP_001003819
augugcggcagcgagagaauccugcaggccggcaacauccuggagaucagagugggccaggccggcgccagaagaguggccaccaugaccagccccgugcugguggacaucagagaggaggugaccugccccaucugccuggagcugcugaccgagccccugagcaucgacugcggccacagcuucugccaggccugcaucacccccaacggcagagagagcgugaucggccaggagggcgagagaagcugccccgugugccagaccagcuaccagcccggcaaccugagacccaacagacaccuggccaacaucgugagaagacugagagagguggugcugggccccggcaagcagcugaaggccgugcugugcgccgaccacggcgagaagcugcagcuguucugccaggaggacggcaaggugaucugcuggcugugcgagagaagccaggagcacagaggccaccacaccuuccugguggaggagguggcccaggaguaccaggagaaguuccaggagagccugaagaagcugaagaacgaggagcaggaggccgagaagcugaccgccuucaucagagagaagaagaccagcuggaagaaccagauggagcccgagagaugcagaauccagaccgaguucaaccagcugagaaacauccuggacagaguggagcagagagagcugaagaagcuggagcaggaggagaagaagggccugagaaucaucgaggaggccgagaacgaccuggugcaccagacccagagccugagagagcugaucagcgaccuggagagaagaugccagggcagcaccauggagcugcugcaggacgugagcgacgugaccgagagaagcgaguucuggacccugagaaagcccgaggcccugcccaccaagcugagaagcauguucagagcccccgaccugaagagaaugcugagagugugcagagagcugaccgacgugcagagcuacugggccauccagggcagccugaccagaagagagagaagagccagcggcgugagaaccagaagaagccagggcagcagcgccauggccagcaagauccugcugaacgugcaggaggaggugaccugccccaucugccuggagcugcugaccgagccccugagccuggacugcggccacagccugugcagagccugcaucaccgugagcaacaaggaggccgugaccagcaugggcggcaagagcagcugccccgugugcggcaucagcuacagcuucgagcaccugcaggccaaccagcaccuggccaacaucguggagagacugaaggaggugaagcugagccccgacaacggcaagaagagagaccugugcgaccaccacggcgagaagcugcugcuguucugcaaggaggacagaaaggugaucugcuggcugugcgagagaagccaggagcacagaggccaccacaccgugcugaccgaggagguguucaaggagugccaggagaagcugcaggccgugcugaagagacugaagaaggaggaggaggaggccgagaagcuggaggccgacaucagagaggagaagaccagcuggaaguaccaggugcagaccgagagacagagaauccagaccgaguucgaccagcugagaagcauccugaacaacgaggagcagagagagcugcagagacuggaggaggaggagaagaagacccuggacaaguucgccgaggccgaggacgagcuggugcagcagaagcagcuggugagagagcugaucagcgacguggagugcagaagccaguggagcaccauggagcugcugcaggacaugagcggcaucaugaaguggagcgagaucuggagacugaagaagcccaagauggugagcaagaagcugaagaccguguuccacgcccccgaccugagcagaaugcugcagauguucagagagcugaccgccgugagaugcuacuggguggacgugacccugaacagcgugaaccugaaccugaaccuggugcugagcgaggaccagagacaggugaucagcgugcccaucuggcccuuccagugcuacaacuacggcgugcugggcagccaguacuucagcagcggcaagcacuacugggagguggacgugagcaagaagaccgccuggauccugggcguguacugcagaaccuacagcagacacaugaaguacguggugagaagaugcgccaacagacagaaccuguacaccaaguacagaccccuguucggcuacugggugaucggccugcagaacaagugcaaguacggcguguucgaggagagccugagcagcgaccccgaggugcugacccugagcauggccgugccccccugcagagugggcguguuccuggacuacgaggccggcaucgugagcuucuucaacgugaccagccacggcagccugaucuacaaguucagcaagugcugcuucagccagcccguguaccccuacuucaaccccuggaacugccccgcccccaugacccugugcccccccagcagcuaa

SEQ ID NO: 25060 - RNA, 2607 nt, Artificial Sequence
  TRIM71__Homo_sapiens__NP_001034200
auggccagcuuccccgagaccgacuuccagaucugccugcugugcaaggagaugugcggcagccccgccccccugagcagcaacagcagcgccagcagcagcagcagccagaccagcaccagcagcggcggcggcggcggcggccccggcgccgccgccagaagacugcacgugcugcccugccugcacgccuucugcagacccugccuggaggcccacagacugcccgccgccggcggcggcgccgccggcgagccccugaagcugagaugccccgugugcgaccagaagguggugcuggccgaggccgccggcauggacgcccugcccagcagcgccuuccugcugagcaaccugcuggacgccgugguggccaccgccgacgagcccccccccaagaacggcagagccggcgcccccgccggcgccggcggccacagcaaccacagacaccacgcccaccacgcccaccccagagccagcgccagcgcccccccccugccccaggccccccagccccccgcccccagcagaagcgcccccggcggccccgccgccagccccagcgcccugcugcugagaagaccccacggcugcagcagcugcgacgagggcaacgccgccagcagcagaugccuggacugccaggagcaccugugcgacaacugcgugagagcccaccagagagugagacugaccaaggaccacuacaucgagagaggcccccccggccccggcgccgccgccgccgcccagcagcugggccugggcccccccuuccccggcccccccuucagcauccugagcguguuccccgagagacugggcuucugccagcaccacgacgacgaggugcugcaccuguacugcgacaccugcagcgugcccaucugcagagagugcaccaugggcagacacggcggccacagcuucaucuaccugcaggaggcccugcaggacagcagagcccugaccauccagcugcuggccgacgcccagcagggcagacaggccauccagcugagcaucgagcaggcccagaccguggccgagcagguggagaugaaggccaagguggugcagagcgaggugaaggccgugaccgccagacacaagaaggcccuggaggagagagagugcgagcugcuguggaagguggagaagaucagacaggugaaggccaagagccuguaccugcagguggagaagcugagacagaaccugaacaagcuggagagcaccaucagcgccgugcagcaggugcuggaggagggcagagcccuggacauccugcuggccagagacagaaugcuggcccaggugcaggagcugaagaccgugagaagccugcugcagccccaggaggacgacagagugauguucaccccccccgaccaggcccuguaccuggccaucaagagcuucggcuucgugagcagcggcgccuucgccccccugaccaaggccaccggcgacggccugaagagagcccugcagggcaagguggccagcuucaccgugaucggcuacgaccacgacggcgagcccagacugagcggcggcgaccugaugagcgccguggugcugggccccgacggcaaccuguucggcgccgaggugagcgaccagcagaacggcaccuacguggugagcuacagaccccagcuggagggcgagcaccuggugagcgugacccugugcaaccagcacaucgagaacagccccuucaaggugguggugaagagcggcagaagcuacgugggcaucggccugcccggccugagcuucggcagcgagggcgacagcgacggcaagcugugcagacccuggggcgugagcguggacaaggagggcuacaucaucguggccgacagaagcaacaacagaauccagguguucaagcccugcggcgccuuccaccacaaguucggcacccugggcagcagacccggccaguucgacagacccgccggcguggccugcgacgccagcagaagaaucgugguggccgacaaggacaaccacagaauccagaucuucaccuucgagggccaguuccugcugaaguucggcgagaagggcaccaagaacggccaguucaacuaccccugggacguggccgugaacagcgagggcaagauccuggugagcgacaccagaaaccacagaauccagcuguucggccccgacggcguguuccugaacaaguacggcuucgagggcgcccuguggaagcacuucgacagccccagaggcguggccuucaaccacgagggccaccugguggugaccgacuucaacaaccacagacugcuggugauccaccccgacugccagagcgccagauuccugggcagcgagggcaccggcaacggccaguuccugagaccccagggcguggccguggaccaggagggcagaaucaucguggccgacagcagaaaccacagagugcagauguucgagagcaacggcagcuuccugugcaaguucggcgcccagggcagcggcuucggccagauggacagacccagcggcaucgccaucacccccgacggcaugaucguggugguggacuucggcaacaacagaauccugguguucuaa

SEQ ID NO: 25061 - RNA, 1434 nt, Artificial Sequence
  TRIM72__Homo_sapiens__NP_001008275
augagcgccgcccccggccugcugcaccaggagcugagcugcccccugugccugcagcuguucgacgcccccgugaccgccgagugcggccacagcuucugcagagccugccugggcagaguggccggcgagcccgccgccgacggcaccgugcugugccccugcugccaggcccccaccagaccccaggcccugagcaccaaccugcagcuggccagacugguggagggccuggcccaggugccccagggccacugcgaggagcaccuggacccccugagcaucuacugcgagcaggacagagcccuggugugcggcgugugcgccagccugggcagccacagaggccacagacugcugcccgccgccgaggcccacgccagacugaagacccagcugccccagcagaagcugcagcugcaggaggccugcaugagaaaggagaagagcguggccgugcuggagcaccagcugguggagguggaggagaccgugagacaguucagaggcgccgugggcgagcagcugggcaagaugagaguguuccuggccgcccuggagggcagccuggacagagaggccgagagagugagaggcgaggccggcguggcccugagaagagagcugggcagccugaacagcuaccuggagcagcugagacagauggagaaggugcuggaggagguggccgacaagccccagaccgaguuccugaugaaguacugccuggugaccagcagacugcagaagauccuggccgagagccccccccccgccagacuggacauccagcugcccaucaucagcgacgacuucaaguuccagguguggagaaagauguucagagcccugaugcccgcccuggaggagcugaccuucgaccccagcagcgcccaccccagccugguggugagcagcagcggcagaagaguggagugcagcgagcagaaggccccccccgccggcgaggaccccagacaguucgacaaggccguggccgugguggcccaccagcagcugagcgagggcgagcacuacugggagguggacgugggcgacaagcccagaugggcccugggcgugaucgccgccgaggcccccagaagaggcagacugcacgccgugcccagccagggccuguggcugcugggccugagagagggcaagauccuggaggcccacguggaggccaaggagcccagagcccugagaagccccgagagaagacccaccagaaucggccuguaccugagcuucggcgacggcgugcugagcuucuacgacgccagcgacgccgacgcccuggugccccuguucgccuuccacgagagacugcccagacccguguaccccuucuucgacgugugcuggcacgacaagggcaagaacgcccagccccugcugcuggugggccccgagggcgccgaggccuaa

SEQ ID NO: 25062 - RNA, 753 nt, Artificial Sequence
  TRIM73__Homo_sapiens__NP_944606
auggccuggcaggugagccugcuggagcuggaggacagacugcagugccccaucugccuggagguguucaaggagagccugaugcugcagugcggccacagcuacugcaagggcugccuggugagccugagcuaccaccuggacaccaaggugagaugccccaugugcuggcaggugguggacggcagcagcagccugcccaacgugagccuggccugggugaucgaggcccugagacugcccggcgaccccgagcccaaggugugcgugcaccacagaaacccccugagccuguucugcgagaaggaccaggagcugaucugcggccugugcggccugcugggcagccaccagcaccaccccgugacccccgugagcaccgugugcagcagaaugaaggaggagcuggccgcccuguucagcgagcugaagcaggagcagaagaagguggacgagcugaucgccaagcuggugaagaacagaaccagaaucgugaacgagagcgacguguucagcugggugaucagaagagaguuccaggagcugagacaccccguggacgaggagaaggccagaugccuggagggcaucggcggccacaccagaggccugguggccagccuggacaugcagcuggagcaggcccagggcaccagagagagacuggcccaggccgagugcgugcuggagcaguucggcaacgaggaccaccacgaguucaucuggaaguuccacagcauggccagcagauaa

SEQ ID NO: 25063 - RNA, 750 nt, Artificial Sequence
  TRIM74__Homo_sapiens__XP_011514491
auggccuggcaggugagccugcuggagcuggaggacuggcugcagugccccaucugccuggagguguucaaggagagccugaugcugcagugcggccacagcuacugcaagggcugccuggugagccugagcuaccaccuggacaccaaggugagaugccccaugugcuggcaggugguggacggcagcagcagccugcccaacgugagccuggccugggugaucgaggcccugagacugcccggcgaccccgagcccaaggugugcgugcaccacagaaacccccugagccuguucugcgagaaggaccaggagcugaucugcggccugugcggccugcugggcagccaccagcaccaccccgugacccccgugagcaccgugugcagcagaaugaaggaggagcuggccgcccuguucagcgagcugaagcaggagcagaagaagguggacgagcugaucgccaagcuggugaagaacagaaccagaaucgugaacgagagcgacguguucagcugggugaucagaagagaguuccaggagcugagacaccccguggacgaggagaaggccagaugccuggagggcaucggcggccacaccagaggccugguggccagccuggacaugcagcuggagcaggcccagggcaccagagagagacuggcccaggccgagugcgugcuggagcaguucggcaacgaggaccaccacgaguucaucugguuccacagcauggccagcagauaa

SEQ ID NO: 25064 - RNA, 1656 nt, Artificial Sequence
  TRIM8__Homo_sapiens__NP_112174
auggccgagaacuggaagaacugcuucgaggaggagcugaucugccccaucugccugcacguguucguggagcccgugcagcugcccugcaagcacaacuucugcagaggcugcaucggcgaggccugggccaaggacagcggccuggugagaugccccgagugcaaccaggccuacaaccagaagcccggccuggagaagaaccugaagcugaccaacaucguggagaaguucaacgcccugcacguggagaagccccccgccgcccugcacugcguguucugcagaagaggccccccccugcccgcccagaaggugugccugagaugcgaggcccccugcugccagagccacgugcagacccaccugcagcagcccagcaccgccagaggccaccugcugguggaggccgacgacgugagagccuggagcugcccccagcacaacgccuacagacuguaccacugcgaggccgagcagguggccgugugccaguacugcugcuacuacagcggcgcccaccagggccacagcgugugcgacguggagaucagaagaaacgagaucagaaagaugcugaugaagcagcaggacagacuggaggagagagagcaggacaucgaggaccagcuguacaagcuggagagcgacaagagacugguggaggagaaggugaaccagcugaaggaggaggugagacugcaguacgagaagcugcaccagcugcuggacgaggaccugagacagaccguggaggugcuggacaaggcccaggccaaguucugcagcgagaacgccgcccaggcccugcaccugggcgagagaaugcaggaggccaagaagcugcugggcagccugcagcugcuguucgacaagaccgaggacgugagcuucaugaagaacaccaagagcgugaagauccugauggacagaacccagaccugcaccagcagcagccugagccccaccaagaucggccaccugaacagcaagcuguuccugaacgagguggccaagaaggagaagcagcugagaaagaugcuggagggccccuucagcacccccgugcccuuccugcagagcgugccccuguaccccugcggcgugagcagcagcggcgccgagaagagaaagcacagcaccgccuuccccgaggccagcuuccuggagaccagcagcggccccgugggcggccaguacggcgccgccggcaccgccagcggcgagggccagagcggccagccccugggccccugcagcagcacccagcaccugguggcccugcccggcggcgcccagcccgugcacagcagccccguguucccccccagccaguaccccaacggcagcgccgcccagcagcccaugcugccccaguacggcggcagaaagauccuggugugcagcguggacaacugcuacugcagcagcguggccaaccacggcggccaccagcccuaccccagaagcggccacuuccccuggaccgugcccagccaggaguacagccacccccugccccccacccccagcgugccccagagccugcccagccuggccgugagagacuggcuggacgccagccagcagcccggccaccaggacuucuacagaguguacggccagcccagcaccaagcacuacgugaccagcuaa

SEQ ID NO: 25065 - RNA, 2133 nt, Artificial Sequence
  TRIM9__Homo_sapiens__NP_055978
auggaggagauggaggaggagcugaagugccccgugugcggcagcuucuacagagagcccaucauccugcccugcagccacaaccugugccaggccugcgccagaaacauccuggugcagacccccgagagcgagagcccccagagccacagagccgccggcagcggcgugagcgacuacgacuaccuggaccuggacaagaugagccuguacagcgaggccgacagcggcuacggcagcuacggcggcuucgccagcgcccccaccacccccugccagaagagccccaacggcgugagaguguucccccccgccaugcccccccccgccacccaccugagccccgcccuggcccccgugcccagaaacagcugcaucaccugcccccagugccacagaagccugauccuggacgacagaggccugagaggcuuccccaagaacagagugcuggagggcgugaucgacagauaccagcagagcaaggccgccgcccugaagugccagcugugcgagaaggcccccaaggaggccaccgugaugugcgagcagugcgacguguucuacugcgaccccugcagacugagaugccacccccccagaggcccccuggccaagcacagacuggugccccccgcccagggcagagugagcagaagacugagccccagaaaggugagcaccugcaccgaccacgagcuggagaaccacagcauguacugcgugcagugcaagaugcccgugugcuaccagugccuggaggagggcaagcacagcagccacgaggugaaggcccugggcgccauguggaagcugcacaagagccagcugagccaggcccugaacggccugagcgacagagccaaggaggccaaggaguuccuggugcagcugagaaacauggugcagcagauccaggagaacagcguggaguucgaggccugccugguggcccagugcgacgcccugaucgacgcccugaacagaagaaaggcccagcugcuggccagagugaacaaggagcacgagcacaagcugaagguggugagagaccagaucagccacugcaccgugaagcugagacagaccaccggccugauggaguacugccuggaggugaucaaggagaacgaccccagcggcuuccugcagaucagcgacgcccugaucagaagagugcaccugaccgaggaccaguggggcaagggcacccugacccccagaaugaccaccgacuucgaccugagccuggacaacagcccccugcugcagagcauccaccagcuggacuucgugcaggugaaggccagcagccccgugcccgccacccccauccugcagcuggaggagugcugcacccacaacaacagcgccacccugagcuggaagcagcccccccugagcaccgugcccgccgacggcuacauccuggagcuggacgacggcaacggcggccaguucagagagguguacgugggcaaggagaccaugugcaccguggacggccugcacuucaacagcaccuacaacgccagagugaaggccuucaacaagaccggcgugagccccuacagcaagacccuggugcugcagaccagcgagguggccugguucgccuucgaccccggcagcgcccacagcgacaucauccugagcaacgacaaccugaccgugaccugcagcagcuacgacgacagaguggugcugggcaagaccggcuucagcaagggcauccacuacugggagcugaccguggacagauacgacaaccaccccgaccccgccuucggcguggccagaauggacgugaugaaggacgugaugcugggcaaggacgacaaggccugggccauguacguggacaacaacagaagcugguucaugcacaacaacagccacaccaacagaaccgagggcggcaucaccaagggcgccaccaucggcgugcugcuggaccugaacagaaagaaccugaccuucuucaucaacgacgagcagcagggccccaucgccuucgacaacguggagggccuguucuuccccgccgugagccugaacagaaacgugcaggugacccugcacaccggccugcccgugcccgacuucuacagcagcagagccagcaucgccuaa

SEQ ID NO: 25066 - RNA, 7098 nt, Artificial Sequence
  TRIOBP__Homo_sapiens__NP_001034230
auggaggaggugcccggcgacgcccugugcgagcacuucgaggccaacauccugacccagaacagaugccagaacugcuuccaccccgaggaggcccacggcgccagauaccaggagcugagaagccccagcggcgccgaggugcccuacugcgaccugcccagaugcccccccgcccccgaggacccccugagcgccagcaccagcggcugccagagcgugguggaccccggccugagacccggccccaagagaggccccagccccagcgccggccugcccgaggagggccccaccgccgcccccagaagcagaagcagagagcuggaggccgugcccuaccuggagggccugaccaccagccugugcggcagcugcaacgaggaccccggcagcgaccccaccagcagccccgacagcgccacccccgacgacaccagcaacagcagcagcguggacugggacaccguggagagacaggaggaggaggcccccagcugggacgagcuggccgugaugauccccagaagacccagagagggccccagagccgacagcagccagagagcccccagccugcugaccagaagccccgugggcggcgacgccgccggccagaagaaggaggacaccggcggcggcggcagaagcgccggccagcacugggccagacugagaggcgagagcggccugagccuggagagacacagaagcacccugacccaggccagcagcaugaccccccacagcggccccagaagcaccaccagccaggccagccccgcccagagagacaccgcccaggccgccagcaccagagagauccccagagccagcagcccccacagaaucacccagagagacaccagcagagccagcagcacccagcaggagaucagcagagccagcagcacccagcaggagaccagcagagccagcagcacccaggaggacacccccagagccagcagcacccaggaggacacccccagagccagcagcacccaguggaacacccccagagccagcagccccagcagaagcacccagcuggacaaccccagaaccagcagcacccagcaggacaacccccagaccagcuuccccaccugcaccccccagagagagaaccccagaacccccugcgugcagcaggacgaccccagagccagcagccccaacagaaccacccagagagagaacagcagaaccagcugcgcccagagagacaaccccaaggccagcagaaccagcagccccaacagagccaccagagacaaccccagaaccagcugcgcccagagagacaaccccagagccagcagccccagcagagccaccagagacaaccccaccaccagcugcgcccagagagacaaccccagagccagcagaaccagcagccccaacagagccaccagagacaaccccagaaccagcugcgcccagagagacaaccccagagccagcagccccagcagagccaccagagacaaccccaccaccagcugcgcccagagagacaaccccagagccagcagaaccagcagccccaacagagccaccagagacaaccccagaaccagcugcgcccagagagacaaccccagagccagcagccccaacagagccgccagagacaaccccaccaccagcugcgcccagagagacaaccccagagccagcagaaccagcagccccaacagagccaccagagacaaccccagaaccagcugcgcccagagagacaaccccagagccagcagccccaacagagccaccagagacaaccccaccaccagcugcgcccagagagacaaccccagagccagcagaaccagcagccccaacagagccaccagagacaaccccagaaccagcugcgcccagagagacaaccccagagccagcagccccaacagaaccacccagcaggacagccccagaaccagcugcgccagaagagacgaccccagagccagcagccccaacagaaccauccagcaggagaaccccagaaccagcugcgcccugagagacaaccccagagccagcagccccagcagaaccauccagcaggagaaccccagaaccagcugcgcccagagagacgaccccagagccagcagccccaacagaaccacccagcaggagaaccccagaaccagcugcgccagaagagacaaccccagagccagcagcagaaacagaaccauccagagagacaaccccagaaccagcugcgcccagagagacaaccccagagccagcagccccaacagaaccauccagcaggagaaccugagaaccagcugcaccagacaggacaaccccagaaccagcagccccaacagagccaccagagacaaccccagaaccagcugcgcccagagagacaaccugagagccagcagccccaucagagccacccagcaggacaaccccagaaccugcauccagcagaacauccccagaagcagcagcacccagcaggacaaccccaagaccagcugcaccaagagagacaaccugagacccaccugcacccagagagacagaacccagagcuucagcuuccagagagacaaccccggcaccagcagcagccagugcugcacccagaaggagaaccugagacccagcagcccccacagaagcacccaguggaacaaccccagaaacagcagcccccacagaaccaacaaggacauccccugggccagcuucccccugagacccacccagagcgacggccccagaaccagcagccccagcagaagcaagcagagcgaggugcccugggccagcaucgcccugagacccacccagggcgacagaccccagaccagcagccccagcagacccgcccagcacgaccccccccagagcagcuucggccccacccaguacaaccugcccagcagagccaccagcagcagccacaaccccggccaccagagcaccagcagaaccagcagccccguguaccccgccgccuacggcgccccccugaccagccccgagcccagccagccccccugcgccgugugcaucggccacagagacgcccccagagccagcagcccccccagauaccugcagcacgaccccuuccccuucuuccccgagcccagagcccccgagagcgagcccccccaccacgagccccccuacaucccccccgccgugugcaucggccacagagacgcccccagagccagcagcccccccagacacacccaguucgaccccuuccccuuccugcccgacaccagcgacgccgagcaccagugccagagcccccagcacgagccccugcagcugcccgcccccgugugcaucggcuacagagacgcccccagagccagcagcccccccagacaggcccccgagcccagccugcuguuccaggaccugcccagagccagcaccgagagccuggugcccagcauggacagccugcacgagugcccccacauccccacccccgugugcaucggccacagagacgcccccagcuucagcagcccccccagacaggcccccgagcccagccuguucuuccaggacccccccggcaccagcauggagagccuggcccccagcaccgacagccugcacggcagccccgugcugaucccccaggugugcaucggccacagagacgcccccagagccagcagcccccccagacacccccccagcgaccuggccuuccuggcccccagccccagccccggcagcagcggcggcagcagaggcagcgccccccccggcgagaccagacacaaccuggagagagaggaguacaccgugcuggccgaccugcccccccccagaagacuggcccagagacagcccggcccccaggcccagugcagcagcggcggcagaacccacagccccggcagagccgagguggagagacuguucggccaggagagaagaaagagcgaggccgccggcgccuuccaggcccaggacgagggcagaagccagcagcccagccagggccagagccagcugcugagaagacagagcagccccgcccccagcagacaggugaccaugcugcccgccaagcaggccgagcugaccagaagaagccaggccgagcccccccaccccuggagccccgagaagagacccgagggcgacagacagcugcagggcagcccccugccccccagaaccagcgccagaacccccgagagagagcugagaacccagagaccccuggagagcggccaggccggccccagacagccccugggcguguggcagagccaggaggagccccccggcagccagggcccccacagacaccuggagagaagcuggagcagccaggagggcggccugggccccggcggcugguggggcugcggcgagcccagccugggcgccgccaaggcccccgagggcgccuggggcggcaccagcagagaguacaaggagagcuggggccagcccgaggccugggaggagaagcccacccacgagcugcccagagagcugggcaagagaagcccccugaccagcccccccgagaacuggggcggccccgccgagagcagccagagcuggcacagcggcacccccaccgccgugggcuggggcgccgagggcgccugccccuaccccagaggcagcgagagaagacccgagcuggacuggagagaccugcugggccugcugagagcccccggcgagggcgugugggccagagugcccagccuggacugggagggccugcuggagcugcugcaggccagacugcccagaaaggaccccgccggccacagagacgaccuggccagagcccugggccccgagcugggcccccccggcaccaacgacgugcccgagcaggagagccacagccagcccgagggcugggccgaggccacccccgugaacggccacagccccgcccugcagagccagagccccgugcagcugcccagccccgccugcaccagcacccaguggcccaagaucaaggugaccagaggccccgccaccgccacccuggccggccuggagcagaccggcccccugggcagcagaagcaccgccaagggccccagccugcccgagcugcaguuccagcccgaggagcccgaggagagcgagcccagcagaggccaggacccccugaccgaccagaagcaggccgacagcgccgacaagagacccgccgagggcaaggccggcagcccccugaagggcagacuggugaccagcuggagaaugcccggcgacagacccacccuguucaaccccuuccugcugagccugggcgugcugagauggagaagacccgaccugcugaacuucaagaagggcuggaugagcauccuggacgagcccggcgagccccccagccccagccugaccaccaccagcaccagccaguggaagaagcacugguucgugcugaccgacagcagccugaaguacuacagagacagcaccgccgaggaggccgacgagcuggacggcgagaucgaccugagaagcugcaccgacgugaccgaguacgccgugcagagaaacuacggcuuccagauccacaccaaggacgccguguacacccugagcgccaugaccagcggcaucagaagaaacuggaucgaggcccugagaaagaccgugagacccaccagcgcccccgacgugaccaagcugagcgacagcaacaaggagaacgcccugcacagcuacagcacccagaagggcccccugaaggccggcgagcagagagccggcagcgaggugaucagcagaggcggccccagaaaggccgacggccagagacaggcccuggacuacguggagcugagcccccugacccaggccagcccccagagagccagaacccccgccagaacccccgacagacuggccaagcaggaggagcuggagagagaccuggcccagagaagcgaggagagaagaaagugguucgaggccaccgacagcagaacccccgaggugcccgccggcgagggccccagaagaggccugggcgccccccugaccgaggaccagcagaacagacugagcgaggagaucgagaagaaguggcaggagcuggagaagcugccccugagagagaacaagagagugccccugaccgcccugcugaaccagagcagaggcgagagaagaggcccccccagcgacggccacgaggcccuggagaaggaggugcaggcccugagagcccagcuggaggccuggagacugcagggcgaggccccccagagcgcccugagaagccaggaggacggccacaucccccccggcuacaucagccaggaggccugcgagagaagccuggccgagauggagagcagccaccagcaggugauggaggagcugcagagacaccacgagagagagcugcagagacugcagcaggagaaggaguggcugcuggccgaggagaccgccgccaccgccagcgccaucgaggccaugaagaaggccuaccaggaggagcugagcagagagcugagcaagaccagaagccugcagcagggccccgacggccugagaaagcagcaccagagcgacguggaggcccugaagagagagcugcaggugcugagcgagcaguacagccagaagugccuggagaucggcgcccugaugagacaggccgaggagagagagcacacccugagaagaugccagcaggagggccaggagcugcugagacacaaccaggagcugcacggcagacugagcgaggagaucgaccagcugagaggcuucaucgccagccagggcaugggcaacggcugcggcagaagcaacgagagaagcagcugcgagcuggaggugcugcugagagugaaggagaacgagcugcaguaccugaagaaggaggugcagugccugagagacgagcugcagaugaugcagaaggacaagagauucaccagcggcaaguaccaggacguguacguggagcugagccacaucaagaccagaagcgagagagagaucgagcagcugaaggagcaccugagacuggccauggccgcccugcaggagaaggagagcaugagaaacagccuggccgaguaa

SEQ ID NO: 25067 - RNA, 9294 nt, Artificial Sequence
  TRIO__Homo_sapiens__NP_009049
augagcggcagcagcggcggcgccgccgcccccgccgccagcagcggccccgccgccgccgccagcgccgccggcagcggcugcggcggcggcgccggcgagggcgccgaggaggccgccaaggaccuggccgacaucgccgccuucuucagaagcggcuucagaaagaacgacgagaugaaggccauggacgugcugcccauccugaaggagaagguggccuaccugagcggcggcagagacaagagaggcggccccauccugaccuuccccgccagaagcaaccacgacagaaucagacaggaggaccugagaagacugaucagcuaccuggccugcauccccagcgaggaggugugcaagagaggcuucaccgugaucguggacaugagaggcagcaagugggacagcaucaagccccugcugaagauccugcaggagagcuuccccugcugcauccacguggcccugaucaucaagcccgacaacuucuggcagaagcagagaaccaacuucggcagcagcaaguucgaguucgagaccaacauggugagccuggagggccugaccaaggugguggaccccagccagcugacccccgaguucgacggcugccuggaguacaaccacgaggaguggaucgagaucagaguggccuucgaggacuacaucagcaacgccacccacaugcugagcagacuggaggagcugcaggacauccuggccaagaaggagcugccccaggaccuggagggcgccagaaacaugaucgaggagcacagccagcugaagaagaaggugaucaaggcccccaucgaggaccuggaccuggagggccagaagcugcugcagagaauccagagcagcgagagcuuccccaagaagaacagcggcagcggcaacgccgaccugcagaaccugcugcccaaggugagcaccaugcuggacagacugcacagcaccagacagcaccugcaccagauguggcacgugagaaagcugaagcuggaccagugcuuccagcugagacuguucgagcaggacgccgagaagauguucgacuggaucacccacaacaagggccuguuccugaacagcuacaccgagaucggcaccagccacccccacgccauggagcugcagacccagcacaaccacuucgccaugaacugcaugaacguguacgugaacaucaacagaaucaugagcguggccaacagacugguggagagcggccacuacgccagccagcagaucagacagaucgccagccagcuggagcaggaguggaaggccuucgccgccgcccuggacgagagaagcacccugcuggacaugagcagcaucuuccaccagaaggccgagaaguacaugagcaacguggacagcuggugcaaggccugcggcgagguggaccugcccagcgagcugcaggaccuggaggacgccauccaccaccaccagggcaucuacgagcacaucacccuggccuacagcgaggugagccaggacggcaagagccugcuggacaagcugcagagaccccugacccccggcagcagcgacagccugaccgccagcgccaacuacagcaaggccgugcaccacgugcuggacgugauccacgaggugcugcaccaccagagacagcuggagaacaucuggcagcacagaaaggugagacugcaccagagacugcagcugugcguguuccagcaggacgugcagcaggugcuggacuggaucgagaaccacggcgaggccuuccugagcaagcacaccggcgugggcaagagccugcacagagccagagcccugcagaagagacacgaggacuucgaggagguggcccagaacaccuacaccaacgccgacaagcugcuggaggccgccgagcagcuggcccagaccggcgagugcgaccccgaggagaucuaccaggccgcccaccagcuggaggacagaauccaggacuucgugagaagaguggagcagagaaagauccugcuggacaugagcgugagcuuccacacccacgugaaggagcuguggaccuggcuggaggagcugcagaaggagcugcuggacgacguguacgccgagagcguggaggccgugcaggaccugaucaagagauucggccagcagcagcagaccacccugcaggugaccgugaacgugaucaaggagggcgaggaccugauccagcagcugagagacagcgccaucagcagcaacaagaccccccacaacagcagcaucaaccacaucgagaccgugcugcagcagcuggacgaggcccagagccagauggaggagcuguuccaggagagaaagaucaagcuggagcuguuccugcagcugagaaucuucgagagagacgccaucgacaucaucagcgaccuggagagcuggaacgacgagcugagccagcagaugaacgacuucgacaccgaggaccugaccaucgccgagcagagacugcagcaccacgccgacaaggcccugaccaugaacaaccugaccuucgacgugauccaccagggccaggaccugcugcaguacgugaacgaggugcaggccagcggcguggagcugcugugcgacagagacguggacauggccaccagagugcaggaccugcuggaguuccugcacgagaagcagcaggagcuggaccuggccgccgagcagcacagaaagcaccuggagcagugcgugcagcugagacaccugcaggccgaggugaagcaggugcugggcuggaucagaaacggcgagagcaugcugaacgccggccugaucaccgccagcagccugcaggaggccgagcagcugcagagagagcacgagcaguuccagcacgccaucgagaagacccaccagagcgcccugcaggugcagcagaaggccgaggccaugcugcaggccaaccacuacgacauggacaugaucagagacugcgccgagaagguggccagccacuggcagcagcugaugcugaagauggaggacagacugaagcuggugaacgccagcguggccuucuacaagaccagcgagcaggugugcagcgugcuggagagccuggagcaggaguacaagagagaggaggacuggugcggcggcgccgacaagcugggccccaacagcgagaccgaccacgugacccccaugaucagcaagcaccuggagcagaaggaggccuuccugaaggccugcacccuggccagaagaaacgccgacguguuccugaaguaccugcacagaaacagcgugaacaugcccggcauggugacccacaucaaggcccccgagcagcaggugaagaacauccugaacgagcuguuccagagagagaacagagugcugcacuacuggaccaugagaaagagaagacuggaccagugccagcaguacgugguguucgagagaagcgccaagcaggcccuggaguggauccacgacaacggcgaguucuaccugagcacccacaccagcaccggcagcagcauccagcacacccaggagcugcugaaggagcacgaggaguuccagaucaccgccaagcagaccaaggagagagugaagcugcugauccagcuggccgacggcuucugcgagaagggccacgcccacgccgccgagaucaagaagugcgugaccgccguggacaagagauacagagacuucagccugagaauggagaaguacagaaccagccuggagaaggcccugggcaucagcagcgacagcaacaagagcagcaagagccugcagcuggacaucauccccgccagcauccccggcagcgaggugaagcugagagacgccgcccacgagcugaacgaggagaagagaaagagcgccagaagaaaggaguucaucauggccgagcugauccagaccgagaaggccuacgugagagaccugagagagugcauggacaccuaccugugggagaugaccagcggcguggaggagaucccccccggcaucgugaacaaggagcugaucaucuucggcaacaugcaggagaucuacgaguuccacaacaacaucuuccugaaggagcuggagaaguacgagcagcugcccgaggacgugggccacugcuucgugaccugggccgacaaguuccagauguacgugaccuacugcaagaacaagcccgacagcacccagcugauccuggagcacgccggcagcuacuucgacgagauccagcagagacacggccuggccaacagcaucagcagcuaccugaucaagcccgugcagagaaucaccaaguaccagcugcugcugaaggagcugcugaccugcugcgaggagggcaagggcgagaucaaggacggccuggaggugaugcugagcgugcccaagagagccaacgacgccaugcaccugagcaugcuggagggcuucgacgagaacaucgagagccagggcgagcugauccugcaggagagcuuccaggugugggaccccaagacccugaucagaaagggcagagagagacaccuguuccuguucgagaugagccugguguucagcaaggaggugaaggacagcagcggcagaagcaaguaccuguacaagagcaagcuguucaccagcgagcugggcgugaccgagcacguggagggcgaccccugcaaguucgcccugugggugggcagaacccccaccagcgacaacaagaucgugcugaaggccagcagcaucgagaacaagcaggacuggaucaagcacaucagagaggugauccaggagagaaccauccaccugaagggcgcccugaaggagcccauccacauccccaagaccgcccccgccaccagacagaagggcagaagagacggcgaggaccuggacagccagggcgacggcagcagccagcccgacaccaucagcaucgccagcagaaccagccagaacacccuggacagcgacaagcugagcggcggcugcgagcugaccguggugauccacgacuucaccgccugcaacagcaacgagcugaccaucagaagaggccagaccguggaggugcuggagagaccccacgacaagcccgacuggugccuggugagaaccaccgacagaagccccgccgccgagggccuggugcccugcggcagccugugcaucgcccacagcagaagcagcauggagauggagggcaucuucaaccacaaggacagccugagcgugagcagcaacgacgccagcccccccgccagcguggccagccugcagccccacaugaucggcgcccagagcagccccggccccaagagacccggcaacacccugagaaaguggcugaccagccccgugagaagacugagcagcggcaaggccgacggccacgugaagaagcuggcccacaagcacaagaagagcagagaggugagaaagagcgccgacgccggcagccagaaggacagcgacgacagcgccgccaccccccaggacgagaccguggaggagagaggcagaaacgagggccugagcagcggcacccugagcaagagcagcagcagcggcaugcagagcugcggcgaggaggagggcgaggagggcgccgacgccgugccccugcccccccccauggccauccagcagcacagccugcugcagcccgacagccaggacgacaaggccagcagcagacugcuggugagacccaccagcagcgagacccccagcgccgccgagcuggugagcgccaucgaggagcuggugaagagcaagauggcccuggaggacagacccagcagccugcugguggaccagggcgacagcagcagccccagcuucaaccccagcgacaacagccugcugagcagcagcagccccaucgacgagauggaggagagaaagagcagcagccugaagagaagacacuacgugcugcaggagcugguggagaccgagagagacuacgugagagaccugggcuacgugguggagggcuacauggcccugaugaaggaggacggcgugcccgacgacaugaagggcaaggacaagaucguguucggcaacauccaccagaucuacgacuggcacagagacuucuuccugggcgagcuggagaagugccuggaggaccccgagaagcugggcagccuguucgugaagcacgagagaagacugcacauguacaucgccuacugccagaacaagcccaagagcgagcacaucgugagcgaguacaucgacaccuucuucgaggaccugaagcagagacugggccacagacugcagcugaccgaccugcugaucaagcccgugcagagaaucaugaaguaccagcugcugcugaaggacuuccugaaguacagcaagaaggccagccuggacaccagcgagcuggagagagccguggaggugaugugcaucgugcccagaagaugcaacgacaugaugaacgugggcagacugcagggcuucgacggcaagaucguggcccagggcaagcugcugcugcaggacaccuuccuggugaccgaccaggacgccggccugcugcccagaugcagagagagaagaaucuuccuguucgagcagaucgugaucuucagcgagccccuggacaagaagaagggcuucagcaugcccggcuuccuguucaagaacagcaucaaggugagcugccugugccuggaggagaacguggagaacgaccccugcaaguucgcccugaccagcagaaccggcgacgugguggagaccuucauccugcacagcagcagccccagcgugagacagaccuggauccacgagaucaaccagauccuggagaaccagagaaacuuccugaacgcccugaccagccccaucgaguaccagagaaaccacagcggcggcggcggcggcggcggcagcggcggcagcggcggcggcggcggcagcggcggcggcggcgcccccagcggcggcagcggccacagcggcggccccagcagcugcggcggcgcccccagcaccagcagaagcagacccagcagaaucccccagcccgugagacaccacccccccgugcuggugagcagcgccgccagcagccaggccgaggccgacaagaugagcggcaccagcacccccggccccagccugcccccccccggcgccgcccccgaggccggccccagcgcccccagcagaagaccccccggcgccgacgccgagggcagcgagagagaggccgagcccauccccaagaugaaggugcuggagagccccagaaagggcgccgccaacgccagcggcagcagccccgacgcccccgccaaggacgccagagccagccugggcacccugccccugggcaagcccagagccggcgccgccagcccccugaacagcccccugagcagcgccgugcccagccugggcaaggagcccuucccccccagcagcccccugcagaagggcggcagcuucuggagcagcauccccgccagccccgccagcagacccggcagcuucaccuuccccggcgacagcgacagccugcagagacagacccccagacacgccgcccccggcaaggacaccgacagaaugagcaccugcagcagcgccagcgagcagagcgugcagagcacccagagcaacggcagcgagagcagcagcagcagcaacaucagcaccaugcuggugacccacgacuacaccgccgugaaggaggacgagaucaacguguaccagggcgagguggugcagauccuggccagcaaccagcagaacauguuccugguguucagagccgccaccgaccagugccccgccgccgagggcuggauccccggcuucgugcugggccacaccagcgccgugaucguggagaaccccgacggcacccugaagaagagcaccagcuggcacaccgcccugagacugagaaagaagagcgagaagaaggacaaggacggcaagagagagggcaagcuggagaacggcuacagaaagagcagagagggccugagcaacaaggugagcgugaagcugcugaaccccaacuacaucuacgacgugccccccgaguucgugaucccccugagcgaggugaccugcgagaccggcgagaccguggugcugagaugcagagugugcggcagacccaaggccagcaucaccuggaagggccccgagcacaacacccugaacaacgacggccacuacagcaucagcuacagcgaccugggcgaggccacccugaagaucgugggcgugaccaccgaggacgacggcaucuacaccugcaucgccgugaacgacaugggcagcgccagcagcagcgccagccugagagugcugggccccggcauggacggcaucauggugaccuggaaggacaacuucgacagcuucuacagcgagguggccgagcugggcagaggcagauucagcguggugaagaagugcgaccagaagggcaccaagagagccguggccaccaaguucgugaacaagaagcugaugaagagagaccaggugacccacgagcugggcauccugcagagccugcagcacccccugcuggugggccugcuggacaccuucgagacccccaccagcuacauccuggugcuggagauggccgaccagggcagacugcuggacugcguggugagauggggcagccugaccgagggcaagaucagagcccaccugggcgaggugcuggaggccgugagauaccugcacaacugcagaaucgcccaccuggaccugaagcccgagaacauccugguggacgagagccuggccaagcccaccaucaagcuggccgacuucggcgacgccgugcagcugaacaccaccuacuacauccaccagcugcugggcaaccccgaguucgccgcccccgagaucauccugggcaaccccgugagccugaccagcgacaccuggagcgugggcgugcugaccuacgugcugcugagcggcgugagccccuuccuggacgacagcguggaggagaccugccugaacaucugcagacuggacuucagcuuccccgacgacuacuucaagggcgugagccagaaggccaaggaguucgugugcuuccugcugcaggaggaccccgccaagagacccagcgccgcccuggcccugcaggagcaguggcugcaggccggcaacggcagaagcaccggcgugcuggacaccagcagacugaccagcuucaucgagagaagaaagcaccagaacgacgugagacccaucagaagcaucaagaacuuccugcagagcagacugcugcccagaguguaa

SEQ ID NO: 25068 - RNA, 1806 nt, Artificial Sequence
  TRIP10__Homo_sapiens__NP_001275891
auggacuggggcaccgagcugugggaccaguucgaggugcuggagagacacacccaguggggccuggaccugcuggacagauacgugaaguucgugaaggagagaaccgagguggagcaggccuacgccaagcagcugagaagccuggugaagaaguaccugcccaagagacccgccaaggacgaccccgagagcaaguucagccagcagcagagcuucgugcagauccugcaggaggugaacgacuucgccggccagagagagcugguggccgagaaccugagcgugagagugugccuggagcugaccaaguacagccaggagaugaagcaggagagaaagaugcacuuccaggagggcagaagagcccagcagcagcuggagaacggcuucaagcagcuggagaacagcaagagaaaguucgagagagacugcagagaggccgagaaggccgcccagaccgccgagagacuggaccaggacaucaacgccaccaaggccgacguggagaaggccaagcagcaggcccaccugagaagccacauggccgaggagagcaagaacgaguacgccgcccagcugcagagauucaacagagaccaggcccacuucuacuucagccagaugccccagaucuucgacaagcugcaggacauggacgagagaagagccaccagacugggcgccggcuacggccugcugagcgaggccgagcuggagguggugcccaucaucgccaagugccuggagggcaugaagguggccgccaacgccguggaccccaagaacgacagccacgugcugaucgagcugcacaagagcggcuucgccagacccggcgacguggaguucgaggacuucagccagcccaugaacagagcccccagcgacagcagccugggcacccccagcgacggcagacccgagcugagaggccccggcagaagcagaaccaagagauggcccuucggcaagaagaacaagcccagaccccccccccugagcccccugggcggccccgugcccagcgcccugcccaacggcccccccagccccagaagcggcagagacccccuggccauccugagcgagaucagcaagagcgugaagcccagacuggccagcuucagaagccugagaggcagcagaggcaccguggugaccgaggacuucagccaccugccccccgagcagcagagaaagagacugcagcagcagcuggaggagagaagcagagagcugcagaaggagguggaccagagagaggcccugaagaagaugaaggacguguacgagaagaccccccagaugggcgaccccgccagccuggagccccagaucgccgagacccugagcaacaucgagagacugaagcuggaggugcagaaguacgaggccuggcuggccgaggccgagagcagagugcugagcaacagaggcgacagccugagcagacacgccagaccccccgacccccccgccagcgccccccccgacagcagcagcaacagcgccagccaggacaccaaggagagcagcgaggagccccccagcgaggagagccaggacacccccaucuacaccgaguucgacgaggacuucgaggaggagcccaccagccccaucggccacugcguggccaucuaccacuucgagggcagcagcgagggcaccaucagcauggccgagggcgaggaccugagccugauggaggaggacaagggcgacggcuggaccagagugagaagaaaggagggcggcgagggcuacgugcccaccagcuaccugagagugacccugaacuaa

SEQ ID NO: 25069 - RNA, 5940 nt, Artificial Sequence
  TRIP11__Homo_sapiens__NP_004230
augagcagcuggcugggcggccugggcagcggccugggccagagccugggccaggugggcggcagccuggccagccugaccggccagaucagcaacuucaccaaggacaugcugauggagggcaccgaggagguggaggccgagcugcccgacagcagaaccaaggagaucgaggccauccacgccauccugagaagcgagaacgagagacugaagaagcugugcaccgaccuggaggagaagcacgaggccagcgagauccagaucaagcagcagagcaccagcuacagaaaccagcugcagcagaaggagguggagaucagccaccugaaggccagacagaucgcccugcaggaccagcugcugaagcugcagagcgccgcccagagcgugcccagcggcgccggcgugcccgccaccaccgccagcagcagcuucgccuacggcaucagccaccaccccagcgccuuccacgacgacgacauggacuucggcgacaucaucagcagccagcaggagaucaacagacugagcaacgaggugagcagacuggagagcgaggugggccacuggagacacaucgcccagaccagcaaggcccagggcaccgacaacagcgaccagagcgagaucugcaagcugcagaacaucaucaaggagcugaagcagaacagaagccaggagaucgacgaccaccagcacgagaugagcgugcugcagaacgcccaccagcagaagcugaccgagaucagcagaagacacagagaggagcugagcgacuacgaggagagaaucgaggagcuggagaaccugcugcagcagggcggcagcggcgugaucgagaccgaccugagcaagaucuacgagaugcagaagaccauccaggugcugcagaucgagaagguggagagcaccaagaagauggagcagcuggaggacaagaucaaggacaucaacaagaagcugagcagcgccgagaacgacagagacauccugagaagagagcaggagcagcugaacguggagaagagacagaucauggaggagugcgagaaccugaagcuggagugcagcaagcugcagcccagcgccgugaagcagagcgacaccaugaccgagaaggagagaauccuggcccagagcgccagcguggaggagguguucagacugcagcaggcccugagcgacgccgagaacgagaucaugagacugagcagccugaaccaggacaacagccuggccgaggacaaccugaagcugaagaugagaaucgaggugcuggagaaggagaagagccugcugagccaggagaaggaggagcugcagaugagccugcugaagcugaacaacgaguacgaggugaucaagagcaccgccaccagagacaucagccuggacagcgagcugcacgaccugagacugaaccuggaggccaaggagcaggagcugaaccagagcaucagcgagaaggagacccugaucgccgagaucgaggagcuggacagacagaaccaggaggccaccaagcacaugauccugaucaaggaccagcugagcaagcagcagaacgagggcgacagcaucaucagcaagcugaagcaggaccugaacgacgagaagaagagagugcaccagcuggaggacgacaagauggacaucaccaaggagcuggacgugcagaaggagaagcugauccagagcgagguggcccugaacgaccugcaccugaccaagcagaagcuggaggacaagguggagaaccugguggaccagcugaacaagagccaggagagcaacgugagcauccagaaggagaaccuggagcugaaggagcacaucagacagaacgaggaggagcugagcagaaucagaaacgagcugaugcagagccugaaccaggacagcaacagcaacuucaaggacacccugcugaaggagagagaggccgaggugagaaaccugaagcagaaccugagcgagcuggagcagcugaacgagaaccugaagaagguggccuucgacgugaagauggagaacgagaagcuggugcuggccugcgaggacgugagacaccagcuggaggagugccuggccggcaacaaccagcugagccuggagaagaacaccaucguggagacccugaagauggagaagggcgagaucgaggccgagcugugcugggccaagaagagacugcuggaggaggccaacaaguacgagaagaccaucgaggagcugagcaacgccagaaaccugaacaccagcgcccugcagcuggagcacgagcaccugaucaagcugaaccagaagaaggacauggagaucgccgagcugaagaagaacaucgagcagauggacaccgaccacaaggagaccaaggacgugcugagcagcagccuggaggagcagaagcagcugacccagcugaucaacaagaaggagaucuucaucgagaagcugaaggagagaagcagcaagcugcaggaggagcuggacaaguacagccaggcccugagaaagaacgagauccugagacagaccaucgaggagaaggacagaagccugggcagcaugaaggaggagaacaaccaccugcaggaggagcuggagagacugagagaggagcagagcagaaccgcccccguggccgaccccaagacccuggacagcgugaccgagcuggccagcgaggugagccagcugaacaccaucaaggagcaccuggaggaggagaucaagcaccaccagaagaucaucgaggaccagaaccagagcaagaugcagcugcugcagagccugcaggagcagaagaaggagauggacgaguucagauaccagcacgagcagaugaacgccacccacacccagcuguuccuggagaaggacgaggagaucaagagccugcagaagaccaucgagcagaucaagacccagcugcacgaggagagacaggacauccagaccgacaacagcgacaucuuccaggagaccaaggugcagagccugaacaucgagaacggcagcgagaagcacgaccugagcaaggccgagaccgagagacuggugaagggcaucaaggagagagagcuggagaucaagcugcugaacgagaagaacaucagccugaccaagcagaucgaccagcugagcaaggacgaggugggcaagcugacccagaucauccagcagaaggaccuggagauccaggcccugcacgccagaaucagcagcaccagccacacccaggacgugguguaccugcagcagcagcugcaggccuacgccauggagagagagaagguguucgccgugcugaacgagaagaccagagagaacagccaccugaagaccgaguaccacaagaugauggacaucguggccgccaaggaggccgcccugaucaagcugcaggacgagaacaagaagcugagcaccagauucgagagcagcggccaggacauguucagagagaccauccagaaccugagcagaaucaucagagagaaggacaucgagaucgacgcccugagccagaagugccagacccugcuggccgugcugcagaccagcagcaccggcaacgaggccggcggcgugaacagcaaccaguucgaggagcugcugcaggagagagacaagcugaagcagcaggugaagaagauggaggaguggaagcagcaggugaugaccaccgugcagaacaugcagcacgagagcgcccagcugcaggaggagcugcaccagcugcaggcccaggugcugguggacagcgacaacaacagcaagcugcagguggacuacaccggccugauccagagcuacgagcagaacgagaccaagcugaagaacuucggccaggagcuggcccaggugcagcacagcaucggccagcugugcaacaccaaggaccugcugcugggcaagcuggacaucaucagcccccagcugagcagcgccagccugcugaccccccagagcgccgagugccugagagccagcaagagcgaggugcugagcgagagcagcgagcugcugcagcaggagcuggaggagcugagaaagagccugcaggagaaggacgccaccaucagaacccugcaggagaacaaccacagacugagcgacagcaucgccgccaccagcgagcuggagagaaaggagcacgagcagaccgacagcgagaucaagcagcugaaggagaagcaggacgugcugcagaagcugcugaaggagaaggaccugcugaucaaggccaagagcgaccagcugcugagcagcaacgagaacuucaccaacaaggugaacgagaacgagcugcugagacaggccgugaccaaccugaaggagagaauccugauccuggagauggacaucggcaagcugaagggcgagaacgagaagaucguggagaccuacagaggcaaggagaccgaguaccaggcccugcaggagaccaacaugaaguucagcaugaugcugagagagaaggaguucgagugccacagcaugaaggagaaggcccuggccuucgagcagcugcugaaggagaaggagcagggcaagaccggcgagcugaaccagcugcugaacgccgugaagagcaugcaggagaagaccgugguguuccagcaggagagagaccaggugaugcuggcccugaagcagaagcagauggagaacaccgcccugcagaacgaggugcagagacugagagacaaggaguucagaagcaaccaggagcuggagagacugagaaaccaccugcuggagagcgaggacagcuacaccagagaggcccuggccgccgaggacagagaggccaagcugagaaagaaggugaccgugcuggaggagaagcuggugagcagcagcaacgccauggagaacgccagccaccaggccagcgugcagguggagagccugcaggagcagcugaacguggugagcaagcagagagacgagaccgcccugcagcugagcgugagccaggagcaggugaagcaguacgcccugagccuggccaaccugcagauggugcuggagcacuuccagcaggaggagaaggccauguacagcgccgagcuggagaagcagaagcagcugaucgccgaguggaagaagaacgccgagaaccuggagggcaaggugaucagccugcaggagugccuggacgaggccaacgccgcccuggacagcgccagcagacugaccgagcagcuggacgugaaggaggagcagaucgaggagcugaagagacagaacgagcugagacaggagaugcuggacgacgugcagaagaagcugaugagccuggccaacagcagcgagggcaagguggacaaggugcugaugagaaaccuguucaucggccacuuccacacccccaagaaccagagacacgaggugcugagacugaugggcagcauccugggcgugagaagagaggagauggagcagcuguuccacgacgaccagggcggcgugaccagauggaugaccggcuggcugggcggcggcagcaagagcgugcccaacaccccccugagacccaaccagcagagcguggugaacagcagcuucagcgagcuguucgugaaguuccuggagaccgagagccaccccagcauccccccccccaagcugagcgugcacgacaugaagccccuggacagccccggcagaagaaagagagacaccaacgcccccgagagcuucaaggacaccgccgagagcagaagcggcagaagaaccgacgugaaccccuuccuggcccccagaagcgccgccgugccccugaucaaccccgccggccugggccccggcggccccggccaccugcugcugaagcccaucagcgacgugcugcccaccuucaccccccugcccgcccugcccgacaacagcgccggcguggugcugaaggaccugcugaagcaguaa

SEQ ID NO: 25070 - RNA, 870 nt, Artificial Sequence
  TRIP13__Homo_sapiens__NP_001159732
auggacgaggccgugggcgaccugaagcaggcccugcccugcguggccgagagccccaccgugcacguggaggugcaccagagaggcagcagcaccgccaagaaggaggacaucaaccugagcgugagaaagcugcugaacagacacaacaucguguucggcgacuacaccuggaccgaguucgacgagcccuuccugaccagaaacgugcagagcgugagcaucaucgacaccgagcugaaggugaaggacagccagcccaucgaccugagcgccugcaccguggcccugcacaucuuccagcugaacgaggacggccccagcagcgagaaccuggaggaggagaccgagaacaucaucgccgccaaccacugggugcugcccgccgccgaguuccacggccugugggacagccugguguacgacguggaggugaagagccaccugcuggacuacgugaugaccacccugcuguucagcgacaagaacgugaacagcaaccugaucaccuggaacagaguggugcugcugcacggcccccccggcaccggcaagaccagccugugcaaggcccuggcccagaagcugaccaucagacugagcagcagauacagauacggccagcugaucgagaucaacagccacagccuguucagcaagugguucagcgagagcggcaagcuggugaccaagauguuccagaagauccaggaccugaucgacgacaaggacgcccugguguucgugcugaucgacgagguggagagccugaccgccgccagaaacgccugcagagccggcaccgagcccagcgacgccaucagaguggugaacgccgugcugacccagaucgaccagaucaagagauaa

SEQ ID NO: 25071 - RNA, 1746 nt, Artificial Sequence
  TRIP4__Homo_sapiens__NP_057297
auggccguggccggcgccgugagcggcgagccccuggugcacuggugcacccagcagcugagaaagaccuucggccuggacgugagcgaggagaucauccaguacgugcugagcaucgagagcgccgaggagaucagagaguacgugaccgaccugcugcagggcaacgagggcaagaagggccaguucaucgaggagcugaucaccaaguggcagaagaacgaccaggagcugaucagcgacccccugcagcagugcuucaagaaggacgagauccuggacggccagaagagcggcgaccaccugaagagaggcagaaagaagggcagaaacagacaggaggugcccgccuucaccgagcccgacaccaccgccgaggugaagacccccuucgaccuggccaaggcccaggagaacagcaacagcgugaagaagaagaccaaguucgugaaccuguacaccagagagggccaggacagacuggccgugcugcugcccggcagacaccccugcgacugccugggccagaagcacaagcugaucaacaacugccugaucugcggcagaaucgugugcgagcaggagggcagcggccccugccuguucugcggcacccuggugugcacccacgaggagcaggacauccugcagagagacagcaacaagagccagaagcugcugaagaagcugaugagcggcguggagaacagcggcaagguggacaucagcaccaaggaccugcugccccaccaggagcugagaaucaagagcggccuggagaaggccaucaagcacaaggacaagcugcuggaguucgacagaaccagcaucagaagaacccaggugaucgacgacgagagcgacuacuucgccagcgacagcaaccaguggcugagcaagcuggagagagagacccugcagaagagagaggaggagcugagagagcugagacacgccagcagacugagcaagaaggugaccaucgacuucgccggcagaaagauccuggaggaggagaacagccuggccgaguaccacagcagacuggacgagaccauccaggccaucgccaacggcacccugaaccagccccugaccaagcuggacagaagcagcgaggagccccugggcgugcuggugaaccccaacauguaccagagccccccccaguggguggaccacaccggcgccgccagccagaagaaggccuucagaagcagcggcuucggccuggaguucaacagcuuccagcaccagcugagaauccaggaccaggaguuccaggagggcuucgacggcggcuggugccugagcgugcaccagcccugggccagccugcuggugagaggcaucaagagaguggagggcagaagcugguacaccccccacagaggcagacuguggaucgccgccaccgccaagaagcccagcccccaggaggugagcgagcugcaggccaccuacagacugcugagaggcaaggacguggaguuccccaacgacuaccccagcggcugccugcugggcugcguggaccugaucgacugccugagccagaagcaguucaaggagcaguuccccgacaucagccaggagagcgacagccccuucguguucaucugcaagaacccccaggagaugguggugaaguuccccaucaagggcaaccccaagaucuggaagcuggacagcaagauccaccagggcgccaagaagggccugaugaagcagaacaaggccguguaa

SEQ ID NO: 25072 - RNA, 1431 nt, Artificial Sequence
  TRIP6__Homo_sapiens__XP_011514847
augagcggccccaccuggcugccccccaagcagcccgagcccgccagagccccccagggcagagccauccccagaggcacccccggccccccccccgcccacggcgccgcccugcagccccaccccagagugaacuucugcccccugcccagcgagcagugcuaccaggcccccggcggccccgaggacagaggccccgccugggugggcagccacggcgugcugcagcacacccagggccugcccgccgacagaggcggccugagacccggcagccuggacgccgagaucgaccugcugagcagcacccuggccgagcugaacggcggcagaggccacgccagcagaagacccgacagacaggccuacgagcccccccccccccccgccuacagaaccggcagccugaagcccaaccccgccagcccccugcccgccagccccuacggcggccccacccccgccagcuacaccaccgccagcacccccgccggccccgccuuccccgugcaggugaagguggcccagcccgugagaggcugcggcccccccagaagaggcgccagccaggccagcggcccccugcccggcccccacuucccccugcccggcagaggcgagguguggggccccggcuacagaagccagagagagcccggccccggcgccaaggaggaggccgccggcgugagcggccccgccggcagaggcagaggcggcgagcacggcccccaggugccccugagccagccccccgaggacgagcuggacagacugaccaagaagcuggugcacgacaugaaccacccccccagcggcgaguacuucggccagugcggcggcugcggcgaggacguggugggcgacggcgccggcgugguggcccuggacagaguguuccacgugggcugcuucgugugcagcaccugcagagcccagcugagaggccagcacuucuacgccguggagagaagagccuacugcgagggcugcuacguggccacccuggagaagugcgccaccugcagccagcccauccuggacagaauccugagagccaugggcaaggccuaccaccccggcugcuucaccugcguggugugccacagaggccuggacggcauccccuucaccguggacgccaccagccagauccacugcaucgaggacuuccacagaaaguucgcccccagaugcagcgugugcggcggcgccaucaugcccgagcccggccaggaggagaccgugagaaucguggcccuggacagaagcuuccacaucggcugcuacaagugcgaggagugcggccugcugcugagcagcgagggcgagugccagggcugcuacccccuggacggccacauccugugcaaggccugcagcgccuggagaauccaggagcugagcgccaccgugaccaccgacugcuaa

SEQ ID NO: 25073 - RNA, 261 nt, Artificial Sequence
  TRIQK__Homo_sapiens__XP_011515284
augggcagaaaggacgccgccaccaucaagcugcccguggaccaguacagaaagcagaucggcaagcaggacuacaagaagaccaagcccauccugagagccaccaagcugaaggccgaggccaagaagaccgccaucggcaucaaggaggugggccuggugcuggccgccauccuggcccugcugcuggccuucuacgccuucuucuaccugagacugaccaccgacguggaccccgaccuggaccaggacgaggacuaa

SEQ ID NO: 25074 - RNA, 1020 nt, Artificial Sequence
  TRMT10A__Homo_sapiens__NP_001128137
augagcagcgagaugcugcccgccuucaucgagaccagcaacguggacaagaagcagggcaucaacgaggaccaggaggagagccagaagcccagacugggcgagggcugcgagcccaucagcaagagacagaugaagaagcugaucaagcagaagcagugggaggagcagagagagcugagaaagcagaagagaaaggagaagagaaagagaaagaagcuggagagacagugccagauggagcccaacagcgacggccacgacagaaagagagugagaagagacguggugcacagcacccugagacugaucaucgacugcagcuucgaccaccugauggugcugaaggacaucaagaagcugcacaagcagauccagagaugcuacgccgagaacagaagagcccugcaccccgugcaguucuaccugaccagccacggcggccagcugaagaagaacauggacgagaacgacaagggcugggugaacuggaaggacauccacaucaagcccgagcacuacagcgagcugaucaagaaggaggaccugaucuaccugaccagcgacagccccaacauccugaaggagcuggacgagagcaaggccuacgugaucggcggccugguggaccacaaccaccacaagggccugaccuacaagcaggccagcgacuacggcaucaaccacgcccagcugccccugggcaacuucgugaagaugaacagcagaaaggugcuggccgugaaccacguguucgagaucauccuggaguaccuggagaccagagacuggcaggaggccuucuucaccauccugccccagagaaagggcgccgugcccaccgacaaggccugcgagagcgccagccacgacaaccagagcgugagaauggaggagggcggcagcgacagcgacagcagcgaggaggaguacagcagaaacgagcuggacagcccccacgaggagaagcaggacaaggagaaccacaccgagagcaccgugaacagccugccccacuaa

SEQ ID NO: 25075 - RNA, 1347 nt, Artificial Sequence
  TRMT12__Homo_sapiens__NP_060426
augagagagaacgugguggugagcaacauggagagagagagcggcaagcccguggccgugguggccguggugaccgagcccugguucacccagagauacagagaguaccugcagagacagaagcuguucgacacccagcacagaguggagaagaugcccgacggcagcguggcccugcccgugcugggcgagacccugcccgagcagcaccugcaggagcugagaaacagaguggcccccggcagccccugcaugcugacccagcugcccgaccccgugcccagcaagagagcccagggcugcagccccgcccagaagcugugccuggaggugagcagauggguggagggcagaggcgugaaguggagcgccgagcuggaggccgaccugcccagaagcuggcagagacacggcaaccugcugcugcugagcgaggacugcuuccaggccaagcaguggaagaaccugggccccgagcugugggagaccguggcccuggcccugggcgugcagagacuggccaagagaggcagagugagccccgacggcaccagaacccccgccgugacccugcugcugggcgaccacggcuggguggagcacguggacaacggcaucagauacaaguucgacgugacccagugcauguucagcuucggcaacaucaccgagaagcugagaguggccagccugagcugcgccggcgaggugcugguggaccuguacgccggcaucggcuacuucacccugcccuuccuggugcacgccggcgccgccuucgugcacgccugcgaguggaacccccacgccgugguggcccugagaaacaaccuggagaucaacggcguggccgacagaugccagauccacuucggcgacaacagaaagcugaagcugagcaacaucgccgacagagugauccugggccugauccccagcagcgaggagggcuggcccaucgccugccaggugcugagacaggacgccggcggcauccugcacauccaccagaacguggagagcuuccccggcaagaaccugcaggcccugggcgugagcaagguggagaaggagcacuggcuguacccccagcagaucaccaccaaccaguggaagaacggcgccaccagagacagcagaggcaagaugcugagccccgccaccaagcccgaguggcagagaugggccgagagcgccgagaccagaaucgccacccugcugcagcaggugcacggcaagcccuggaagacccagauccugcacauccagcccgugaagagcuacgccccccacguggaccacaucgugcuggaccuggagugcugccccugccccagcgugggcuaa

SEQ ID NO: 25076 - RNA, 1893 nt, Artificial Sequence
  TRMT1__Homo_sapiens__NP_001136026
augcagggcagcagccuguggcugagccugaccuucagaagcgccagagugcugagcagagccagauucuucgaguggcagagccccggccugcccaacaccgccgccauggagaacggcaccggccccuacggcgaggagagacccagagaggugcaggagaccaccgugaccgagggcgccgccaagaucgccuuccccagcgccaacgagguguucuacaaccccgugcaggaguucaacagagaccugaccugcgccgugaucaccgaguucgccagaauccagcugggcgccaagggcauccagaucaaggugcccggcgagaaggacacccagaagguggugguggaccugagcgagcaggaggaggagaagguggagcugaaggagagcgagaaccuggccagcggcgaccagcccagaaccgccgccgugggcgagaucugcgaggagggccugcacgugcuggagggccuggccgccagcggccugagaagcaucagauucgcccuggaggugcccggccugagaagcgugguggccaacgacgccagcaccagagccguggaccugaucagaagaaacgugcagcugaacgacguggcccaccuggugcagcccagccaggccgacgccagaaugcugauguaccagcaccagagagugagcgagagauucgacgugaucgaccuggaccccuacggcagccccgccaccuuccuggacgccgccgugcaggccgugagcgagggcggccugcugugcgugaccugcaccgacauggccgugcuggccggcaacagcggcgagaccugcuacagcaaguacggcgccauggcccugaagagcagagccugccacgagauggcccugagaaucgugcugcacagccuggaccugagagccaacugcuaccagagauucguggugccccugcugagcaucagcgccgacuucuacgugagaguguucgugagaguguucaccggccaggccaaggugaaggccagcgccagagccaaguucagcgccgccugcggcccccccgugacccccgagugcgagcacugcggccagagacaccagcugggcggccccaugugggccgagcccauccacgaccuggacuucgugggcagagugcuggaggccgugagcgccaaccccggcagauuccacaccagcgagagaaucagaggcgugcugagcgugaucaccgaggagcugcccgacgugccccuguacuacacccuggaccagcugagcagcaccauccacugcaacacccccagccugcugcagcugagaagcgcccugcugcacgccgacuucagagugagccugagccacgccugcaagaacgccgugaagaccgacgcccccgccagcgcccugugggacaucaugagaugcugggagaaggagugccccgugaagagagagagacugagcgagaccagccccgccuucagaauccugagcguggagcccagacugcaggccaacuucaccaucagagaggacgccaaccccagcagcagacagagaggccugaagagauuccaggccaaccccgaggccaacuggggccccagacccagagccagacccggcggcaaggccgccgacgaggccauggaggagagaagaagacugcugcagaacaagagaaaggagccccccgaggacguggcccagagagccgccagacugaagaccuuccccugcaagagauucaaggagggcaccugccagagaggcgaccagugcugcuacagccacagcccccccacccccagagugagcgccgacgccgcccccgacugccccgagaccagcaaccagaccccccccggccccggcgccgccgccggccccggcaucgacuaa

SEQ ID NO: 25077 - RNA, 2274 nt, Artificial Sequence
  TRMT44__Homo_sapiens__NP_689757
auggccgaggugggcagaaccggcaucagcuaccccggcgcccugcugccccagggcuucugggccgccguggagguguggcuggagagaccccagguggccaacaagagacugugcggcgccagacuggaggccagauggagcgccgcccugcccugcgccgaggccagaggccccggcaccagcgccggcagcgagcagaaggagagaggccccggccccggccagggcagccccggcggcggccccggccccagaagccugagcggccccgagcagggcaccgccugcugcgagcuggaggaggcccagggccagugccagcaggaggaggcccagagagaggccgccagcgugccccugagagacagcggccaccccggccacgccgagggcagagagggcgacuuccccgccgccgaccuggacagccugugggaggacuucagccagagccuggccagaggcaacagcgagcugcuggccuuccugaccagcagcggcgccggcagccagcccgaggcccagagagagcuggacguggugcugagaaccgugauccccaagaccagcccccacugcccccugaccacccccagaagagagaucguggugcaggacgugcugaacggcaccaucaccuuccugccccuggaggaggacgacgagggcaaccugaaggugaagaugagcaacguguaccagauccagcugagccacagcaaggaggagugguucaucagcgugcugaucuucugccccgagagauggcacagcgacggcaucguguaccccaagcccaccuggcugggcgaggagcugcuggccaagcuggccaaguggagcguggagaacaagaagagcgacuucaagagcacccugagccugaucagcaucaugaaguacagcaaggccuaccaggagcugaaggagaaguacaaggagauggugaagguguggcccgaggugaccgaccccgagaaguucguguacgaggacguggccaucgccgccuaccugcugauccugugggaggaggagagagccgagagaagacugaccgccagacagagcuucguggaccugggcugcggcaacggccugcuggugcacauccugagcagcgagggccaccccggcagaggcaucgacgugagaagaagaaagaucugggacauguacggcccccagacccagcuggaggaggacgccaucacccccaacgacaagacccuguuccccgacguggacuggcugaucggcaaccacagcgacgagcugacccccuggauccccgugaucgccgccagaagcagcuacaacugcagauucuucgugcugcccugcugcuucuucgacuucaucggcagauacagcagaagacagagcaagaagacccaguacagagaguaccuggacuucaucaaggaggugggcuucaccugcggcuuccacguggacgaggacugccugagaauccccagcaccaagagagugugccuggugggcaagagcagaaccuaccccagcagcagagaggccagcguggacgagaagagaacccaguacaucaagagcagaagaggcugccccgugagcccccccggcugggagcugagccccagccccagauggguggccgccggcagcgccggccacugcgacggccagcaggcccuggacgccagagugggcugcgugaccagagccugggccgccgagcacggcgccggcccccaggccgagggccccuggcugcccggcuuccaccccagagagaaggccgagagagugagaaacugcgccgcccugcccagagacuucaucgaccagguggugcugcagguggccaaccugcugcugggcggcaagcagcugaacaccagaagcagcagaaacggcagccugaagaccuggaacggcggcgagagccugagccuggccgagguggccaacgagcuggacaccgagacccugagaagacugaagagagagugcggcggccugcagacccugcugagaaacagccaccagguguuccagguggugaacggcagagugcacaucagagacuggagagaggagacccuguggaagaccaagcagcccgaggccaagcagagacugcugagcgaggccugcaagaccagacugugcugguucuucaugcaccaccccgacggcugcgcccugagcaccgacugcugccccuucgcccacggccccgccgagcugagaccccccagaaccacccccagaaagaagaucagcuaa

SEQ ID NO: 25078 - RNA, 1530 nt, Artificial Sequence
  TRMT5__Homo_sapiens__NP_065861
auggugcuguggauccuguggagacccuucggcuucagcggcagauuccugaagcuggagagccacagcaucaccgagagcaagagccugauccccguggccuggaccagccugacccagaugcugcuggaggcccccggcaucuuccugcugggccagagaaagagauucagcaccaugcccgagaccgagacccacgagagagagaccgagcuguucagcccccccagcgacgugagaggcaugaccaagcuggacagaaccgccuucaagaagaccgugaacauccccgugcugaaggugagaaaggagaucgugagcaagcugaugagaagccugaagagagccgcccugcagagacccggcaucagaagagugaucgaggaccccgaggacaaggagagcagacugaucaugcuggaccccuacaagaucuucacccacgacagcuucgagaaggccgagcugagcgugcuggagcagcugaacgugagcccccagaucagcaaguacaaccuggagcugaccuacgagcacuucaagagcgaggagauccugagagccgugcugcccgagggccaggacgugaccagcggcuucagcagaaucggccacaucgcccaccugaaccugagagaccaccagcugcccuucaagcaccugaucggccaggugaugaucgacaagaaccccggcaucaccagcgccgugaacaagaucaacaacaucgacaacauguacagaaacuuccagauggaggugcugagcggcgagcagaacaugaugaccaaggugagagagaacaacuacaccuacgaguucgacuucagcaagguguacuggaaccccagacugagcaccgagcacagcagaaucaccgagcugcugaagcccggcgacgugcuguucgacguguucgccggcgugggccccuucgccauccccguggccaagaagaacugcaccguguucgccaacgaccugaaccccgagagccacaaguggcugcuguacaacugcaagcugaacaagguggaccagaaggugaagguguucaaccuggacggcaaggacuuccugcagggccccgugaaggaggagcugaugcagcugcugggccugagcaaggagagaaagcccagcgugcacguggugaugaaccugcccgccaaggccaucgaguuccugagcgccuucaaguggcugcuggacggccagcccugcagcagcgaguuccugcccaucgugcacugcuacagcuucagcaaggacgccaaccccgccgaggacgugagacagagagccggcgccgugcugggcaucagccuggaggccugcagcagcgugcaccuggugagaaacguggcccccaacaaggagaugcugugcaucaccuuccagauccccgccagcgugcuguacaagaaccagaccagaaaccccgagaaccacgaggaccccccccugaagagacagagaaccgccgaggccuucagcgacgagaagacccagaucgugagcaacaccuaa

SEQ ID NO: 25079 - RNA, 924 nt, Artificial Sequence
  TRMU__Homo_sapiens__NP_001269711
augaugugcagcggcgccgacgccaucgccaccggccacuacgccagaaccagccuggaggacgaggagguguucgagcagaagcacgugaagaagcccgagggccuguucagaaacagauucgaggugagaaacgccgugaagcugcugcaggccgccgacagcuucaaggaccagaccuucuuccugagccaggugagccaggacgcccugagaagaaccaucuucccccugggcggccugaccaaggaguucgugaagaagaucgccgccgagaacagacugcaccacgugcugcagaagaaggagagcaugggcaugugcuucaucggcaagagaaacuucgagcacuuccugcugcaguaccugcagcccagacccggccacuucaucagcaucgaggacaacaaggugcugggcacccacaagggcugguuccuguacacccugggccagagagccaacaucggcggccugagagagcccugguacgugguggagaaggacagcgugaagggcgacguguucguggcccccagaaccgaccaccccgcccuguacagagaccugcugagaaccagcagagugcacuggaucgccgaggagccccccgccgcccuggugagagacaagaugauggagugccacuucagauucagacaccagauggcccuggugcccugcgugcugacccugaaccaggacggcaccgugugggugaccgccgugcaggccgugagagcccuggccaccggccaguucgccguguucuacaagggcgacgagugccugggcagcggcaagauccugagacugggccccagcgccuacacccugcagaagggccagagaagagccggcauggccaccgagagccccagcgacagccccgaggacggccccggccugagcccccugcuguaa

SEQ ID NO: 25080 - RNA, 4296 nt, Artificial Sequence
  TRO__Homo_sapiens__NP_001034794
auggacagaagaaacgacuacggcuacagagugccccuguuccagggcccccugcccccccccggcagccugggccugcccuucccccccgacauccagaccgagaccaccgaggaggacagcgugcugcugaugcacacccugcuggccgccaccaaggacagccuggccauggacccccccguggugaacagacccaagaagagcaagaccaagaaggcccccaucaagaccaucaccaaggccgcccccgccgccccccccgugcccgccgccaacgagaucgccaccaacaagcccaagaucaccuggcaggcccugaaccugcccgugaucacccagaucagccaggcccugcccaccaccgaggugaccaacacccaggccagcagcgugaccgcccagcccaagaaggccaacaagaugaagagagugaccgccaaggccgcccagggcagccagagccccaccggccacgagggcggcaccauccagcugaagagcccccugcaggugcugaagcugcccgugaucagccagaacauccacgcccccaucgccaacgagagcgccagcagccaggcccugaucaccagcaucaagcccaagaaggccagcaaggccaagaaggccgccaacaaggccaucgccagcgccaccgaggugagccuggccgccaccgccacccacaccgccaccacccagggccagaucaccaacgagaccgccagcauccacaccaccgccgccagcaucagaaccaagaaggccagcaaggccagaaagaccaucgccaaggugaucaacaccgacaccgagcacaucgaggcccugaacgugaccgacgccgccaccagacagaucgaggccagcgugguggccaucagacccaagaagagcaagggcaagaaggccgccagcagaggccccaacagcgugagcgagaucagcgaggccccccuggccacccagaucgugaccaaccaggcccuggccgccacccugagagugaagagaggcagcagagccagaaaggccgccaccaaggccagagccaccgagagccagacccccaacgccgaccagggcgcccaggccaagaucgccagcgcccagaccaacgugagcgcccuggagacccagguggccgccgccgugcaggcccuggccgacgacuaccuggcccagcugagccuggagcccaccaccagaaccagaggcaagagaaacagaaagagcaagcaccugaacggcgacgagagaagcggcagcaacuacagaagaauccccuggggcagaagacccgccccccccagagacguggccauccugcaggagagagccaacaagcuggugaaguaccugcuggugaaggaccagaccaagauccccaucaagagaagcgacaugcugagagacgugauccaggaguacgacgaguacuuccccgagaucaucgagagagccagcuacacccuggagaagauguucagagugaaccugaaggagaucgacaagcagagcagccuguacauccugaucagcacccaggagagcagcgccggcauccugggcaccaccaaggacacccccaagcugggccugcugauggugauccugagcgugaucuucaugaacggcaacaaggccagcgaggccgugaucugggaggugcugagaaagcugggccugagacccggcgugagacacagccuguucggcgaggugagaaagcugaucaccgacgaguucgugaagcagaaguaccuggaguacaagagagugcccaacagcagaccccccgaguacgaguucuucuggggccugagaagcuaccacgagaccagcaagaugaaggugcugaaguucgccugcagagugcagaagaaggaccccaaggacugggccgugcaguacagagaggccguggagauggaggugcaggccgccgccguggccguggccgaggccgaggccagagccgaggccagagcccagaugggcaucggcgaggaggccguggccggccccuggaacugggacgacauggacaucgacugccugaccagagaggagcugggcgacgacgcccaggccuggagcagauucagcuucgagaucgaggccagagcccaggagaacgccgacgccagcaccaacgugaacuucagcagaggcgccagcaccagagccggcuucagcgacggcgccagcaucagcuucaacggcgcccccagcagcagcggcggcuucagcggcggccccggcaucaccuucggcguggcccccagcaccagcgccagcuucagcaacaccgccagcaucagcuucggcggcacccugagcaccagcagcagcuucagcagcgccgccagcaucagcuucggcugcgcccacagcaccagcaccagcuucagcagcgaggccagcaucagcuucggcggcaugcccugcaccagcgccagcuucagcggcggcgugagcagcagcuucagcggcccccugagcaccagcgccaccuucagcggcggcgccagcagcggcuucggcggcacccugagcaccaccgccggcuucagcggcgugcugagcaccagcaccagcuucggcagcgcccccaccaccagcaccguguucagcagcgcccugagcaccagcaccggcuucggcggcauccugagcaccagcgugugcuucggcggcagccccagcagcagcggcagcuucggcggcacccugagcaccagcaucugcuucggcggcagccccugcaccagcaccggcuucggcggcacccugagcaccagcgugagcuucggcggcagcagcagcaccagcgccaacuucggcggcacccugagcaccagcaucugcuucgacggcagccccagcaccggcgccggcuucggcggcgcccugaacaccagcgccagcuucggcagcgugcugaacaccagcaccggcuucggcggcgccaugagcaccagcgccgacuucggcggcacccugagcaccagcgugugcuucggcggcagccccggcaccagcgugagcuucggcagcgcccugaacaccaacgccggcuacggcggcgccgugagcaccaacaccgacuucggcggcacccugagcaccagcgugugcuucggcggcagccccagcaccagcgccggcuucggcggcgcccugaacaccaacgccagcuucggcugcgccgugagcaccagcgccagcuucagcggcgccgugagcaccagcgccugcuucagcggcgcccccaucaccaaccccggcuucggcggcgccuucagcaccagcgccggcuucggcggcgcccugagcaccgccgccgacuucggcggcacccccagcaacagcaucggcuucggcgccgcccccagcaccagcgugagcuucggcggcgcccacggcaccagccugugcuucggcggcgcccccagcaccagccugugcuucggcagcgccagcaacaccaaccugugcuucggcggcccccccagcaccagcgccugcuucagcggcgccaccagccccagcuucugcgacggccccagcaccagcaccggcuucagcuucggcaacggccugagcaccaacgccggcuucggcggcggccugaacaccagcgccggcuucggcggcggccugggcaccagcgccggcuucagcggcggccugagcaccagcagcggcuucgacggcggccugggcaccagcgccggcuucggcggcggccccggcaccagcaccggcuucggcggcggccugggcaccagcgccggcuucagcggcggccugggcaccagcgccggcuucggcggcggccuggugaccagcgacggcuucggcggcggccugggcaccaacgccagcuucggcagcacccugggcaccagcgccggcuucagcggcggccugagcaccagcgacggcuucggcagcagacccaacgccagcuucgacagaggccugagcaccaucaucggcuucggcagcggcagcaacaccagcaccggcuucaccggcgagcccagcaccagcaccggcuucagcagcggccccagcagcaucgugggcuucagcggcggccccagcaccggcgugggcuucugcagcggccccagcaccagcggcuucagcggcggccccagcaccggcgccggcuucggcggcggccccaacaccggcgccggcuucggcggcggccccagcaccagcgccggcuucggcagcggcgccgccagccugggcgccugcggcuucagcuacggcuaa

SEQ ID NO: 25081 - RNA, 1578 nt, Artificial Sequence
  TROVE2__Homo_sapiens__NP_001035828
auggaggagagcgugaaccagaugcagccccugaacgagaagcagaucgccaacagccaggacggcuacguguggcaggugaccgacaugaacagacugcacagauuccugugcuucggcagcgagggcggcaccuacuacaucaaggagcagaagcugggccuggagaacgccgaggcccugaucagacugaucgaggacggcagaggcugcgaggugauccaggagaucaagagcuucagccaggagggcagaaccaccaagcaggagcccaugcuguucgcccuggccaucugcagccagugcagcgacaucagcaccaagcaggccgccuucaaggccgugagcgaggugugcagaauccccacccaccuguucaccuucauccaguucaagaaggaccugaaggagagcaugaagugcggcauguggggcagagcccugagaaaggccaucgccgacugguacaacgagaagggcggcauggcccuggcccuggccgugaccaaguacaagcagagaaacggcuggagccacaaggaccugcugagacugagccaccugaagcccagcagcgagggccuggccaucgugaccaaguacaucaccaagggcuggaaggaggugcacgagcuguacaaggagaaggcccugagcguggagaccgagaagcugcugaaguaccuggaggccguggagaaggugaagagaaccagagacgagcuggaggugauccaccugaucgaggagcacagacuggugagagagcaccugcugaccaaccaccugaagagcaaggagguguggaaggcccugcugcaggagaugccccugaccgcccugcugagaaaccugggcaagaugaccgccaacagcgugcuggagcccggcaacagcgaggugagccuggugugcgagaagcugugcaacgagaagcugcugaagaaggccagaauccaccccuuccacauccugaucgcccuggagaccuacaagaccggccacggccugagaggcaagcugaaguggagacccgacgaggagauccugaaggcccuggacgccgccuucuacaagaccuucaagaccguggagcccaccggcaagagauuccugcuggccguggacgugagcgccagcaugaaccagagagugcugggcagcauccugaacgccagcaccguggccgccgccaugugcaugguggugaccagaaccgagaaggacagcuacgugguggccuucagcgacgagauggugcccugccccgugaccaccgacaugacccugcagcaggugcugauggccaugagccagauccccgccggcggcaccgacugcagccugcccaugaucugggcccagaagaccaacacccccgccgacguguucaucguguucaccgacaacgagaccuucgccggcggcgugcaccccgccaucgcccugagagaguacagaaagaagauggacauccccgccaagcugaucgugugcggcaugaccagcaacggcuucaccaucgccgaccccgacgacagagcccugcagaacacccugcugaacaagagcuucuaa

SEQ ID NO: 25082 - RNA, 3435 nt, Artificial Sequence
  TRPA1__Homo_sapiens__XP_011515926
augagcaucagcaugaagaagggcgccagagccagaggcgagcagcugcaccagguggccagcggcgugggcagcaugaagagaagccugagaaagauguggagacccggcgagaagaaggagccccagggcgugguguacgaggacgugcccgacgacaccgaggacuucaaggagagccugaaggugguguucgagggcagcgccuacggccugcagaacuucaacaagcagaagaagcugaagagaugcgacgacauggacaccuucuuccugcacuacgccgccgccgagggccagaucgagcugauggagaagaucaccagagacagcagccuggaggugcugcacgagauggacgacuacggcaacaccccccugcacugcgccguggagaagaaccagaucgagagcgugaaguuccugcugagcagaggcgccaaccccaaccugagaaacuucaacaugauggccccccugcacaucgccgugcagggcaugaacaacgaggugaugaaggugcugcuggagcacagaaccaucgacgugaaccuggagggcgagaacggcaacaccgccgugaucaucgccugcaccaccaacaacagcgaggcccugcagauccugcugaagaagggcgccaagcccugcaagagcaacaaguggggcugcuuccccauccaccaggccgccuucagcggcagcaaggagugcauggagaucauccugagauucggcgaggagcacggcuacagcagacagcugcacaucaacuucaugaacaacggcaaggccaccccccugcaccuggccgugcagaacggcgaccuggagaugaucaagaugugccuggacaacggcgcccagaucgaccccguggagaagggcagaugcaccgccauccacuucgccgccacccagggcgccaccgagaucgugaagcugaugaucagcagcuacagcggcagcguggacaucgugaacaccaccgacggcugccacgagaccaugcugcacagagccagccuguucgaccaccacgagcuggccgacuaccugaucagcgugggcgccgacaucaacaagaucgacagcgagggcagaagcccccugauccuggccaccgccagcgccagcuggaacaucgugaaccugcugcugagcaagggcgcccagguggacaucaaggacaacuucggcagaaacuuccugcaccugaccgugcagcagcccuacggccugaagaaccugagacccgaguucaugcagaugcagcagaucaaggagcuggugauggacgaggacaacgacggcugcaccccccugcacuacgccugcagacagggcggccccggcagcgugaacaaccugcugggcuucaacgugagcauccacagcaagagcaaggacaagaagagcccccugcacuucgccgccagcuacggcagaaucaacaccugccagagacugcugcaggacaucagcgacaccagacugcugaacgagggcgaccugcacggcaugaccccccugcaccuggccgccaagaacggccacgacaagguggugcagcugcugcugaagaagggcgcccuguuccugagcgaccacaacggcuggaccgcccugcaccacgccagcaugggcggcuacacccagaccaugaaggugauccuggacaccaaccugaagugcaccgacagacuggacgaggacggcaacaccgcccugcacuucgccgccagagagggccacgccaaggccguggcccugcugcugagccacaacgccgacaucgugcugaacaagcagcaggccagcuuccugcaccuggcccugcacaacaagagaaaggagguggugcugaccaucaucagaagcaagagaugggacgagugccugaagaucuucagccacaacagccccggcaacaagugccccaucaccgagaugaucgaguaccugcccgagugcaugaaggugcugcuggacuucugcaugcugcacagcaccgaggacaagagcugcagagacuacuacaucgaguacaacuucaaguaccugcagugcccccuggaguucaccaagaagacccccacccaggacgugaucuacgagccccugaccgcccugaacgccauggugcagaacaacagaaucgagcugcugaaccaccccgugugcaaggaguaccugcugaugaaguggcuggccuacggcuucagagcccacaugaugaaccugggcagcuacugccugggccugauccccaugaccauccugguggugaacaucaagcccggcauggccuucaacagcaccggcaucaucaacgagaccagcgaccacagcgagauccuggacaccaccaacagcuaccugaucaagaccugcaugauccugguguuccugagcagcaucuucggcuacugcaaggaggccggccagaucuuccagcagaagagaaacuacuucauggacaucagcaacgugcuggaguggaucaucuacaccaccggcaucaucuucgugcugccccuguucguggagauccccgcccaccugcaguggcagugcggcgccaucgccguguacuucuacuggaugaacuuccugcuguaccugcagagauucgagaacugcggcaucuucaucgugaugcuggaggugauccugaagacccugcugagaagcaccgugguguucaucuuccugcugcuggccuucggccugagcuucuacauccugcugaaccugcaggaccccuucagcagcccccugcugagcaucauccagaccuucagcaugaugcugggcgacaucaacuacagagagagcuuccuggagcccuaccugagaaacgagcuggcccaccccgugcugagcuucgcccagcuggugagcuucaccaucuucgugcccaucgugcugaugaaccugcugaucggccuggccgugggcgacaucgccgaggugcagaagcacgccagccugaagagaaucgccaugcagguggagcugcacaccagccuggagaagaagcugccccugugguuccugagaaagguggaccagaagagcaccaucguguaccccaacaagcccagaagcggcggcaugcuguuccacaucuucugcuuccuguucugcaccggcgagaucagacaggagauccccaacgccgacaagagccuggagauggagauccugaagcagaaguacagacugaaggaccugaccuuccugcuggagaagcagcacgagcugaucaagcugaucauccagaagauggagaucaucagcgagaccgaggacgacgacagccacugcagcuuccaggacagauucaagaaggagcagauggagcagagaaacagcagauggaacaccgugcugagagccgugaaggccaagacccaccaccuggagcccuaa

SEQ ID NO: 25083 - RNA, 2382 nt, Artificial Sequence
  TRPC1__Homo_sapiens__NP_001238774
augauggccgcccuguaccccagcaccgaccugagcggcgccagcagcagcagccugcccagcagccccagcagcagcagccccaacgaggugauggcccugaaggacgugagagaggugaaggaggagaacacccugaacgagaagcuguuccugcuggccugcgacaagggcgacuacuacauggugaagaagauccuggaggagaacagcagcggcgaccugaacaucaacugcguggacgugcugggcagaaacgccgugaccaucaccaucgagaacgagaaccuggacauccugcagcugcugcuggacuacggcugccagagcgccgacgcccugcugguggccaucgacagcgagguggugggcgccguggacauccugcugaaccacagacccaagagaagcagcagacccaccaucgugaagcugauggagagaauccagaaccccgaguacagcaccaccauggacguggcccccgugauccuggccgcccacagaaacaacuacgagauccugaccaugcugcugaagcaggacgugagccugcccaagccccacgccgugggcugcgagugcacccugugcagcgccaagaacaagaaggacagccugagacacagcagauucagacuggacaucuacagaugccuggccagccccgcccugaucaugcugaccgaggaggaccccauccugagagccuucgagcugagcgccgaccugaaggagcugagccugguggagguggaguucagaaacgacuacgaggagcuggccagacagugcaagauguucgccaaggaccugcuggcccaggccagaaacagcagagagcuggaggugauccugaaccacaccagcagcgacgagccccuggacaagagaggccugcuggaggagagaaugaaccugagcagacugaagcuggccaucaaguacaaccagaaggaguucgugagccagagcaacugccagcaguuccugaacaccgugugguucggccagaugagcggcuacagaagaaagcccaccugcaagaagaucaugaccgugcugaccgugggcaucuucuggcccgugcugagccugugcuaccugaucgcccccaagagccaguucggcagaaucauccacacccccuucaugaaguucaucauccacggcgccagcuacuucaccuuccugcugcugcugaaccuguacagccugguguacaacgaggacaagaagaacaccaugggccccgcccuggagagaaucgacuaccugcugauccuguggaucaucggcaugaucuggagcgacaucaagagacugugguacgagggccuggaggacuuccuggaggagagcagaaaccagcugagcuucgugaugaacagccuguaccuggccaccuucgcccugaaggugguggcccacaacaaguuccacgacuucgccgacagaaaggacugggacgccuuccaccccacccugguggccgagggccuguucgccuucgccaacgugcugagcuaccugagacuguucuucauguacaccaccagcagcauccugggcccccugcagaucagcaugggccagaugcugcaggacuucggcaaguuccugggcauguuccugcuggugcuguucagcuucaccaucggccugacccagcuguacgacaagggcuacaccagcaaggagcagaaggacugcgugggcaucuucugcgagcagcagagcaacgacaccuuccacagcuucaucggcaccugcuucgcccuguucugguacaucuucagccuggcccacguggccaucuucgugaccagauucagcuacggcgaggagcugcagagcuucgugggcgccgugaucgugggcaccuacaacguggugguggugaucgugcugaccaagcugcugguggccaugcugcacaagagcuuccagcugaucgccaaccacgaggacaaggaguggaaguucgccagagccaagcuguggcugagcuacuucgacgacaagugcacccugcccccccccuucaacaucauccccagccccaagaccaucugcuacaugaucagcagccugagcaaguggaucugcagccacaccagcaagggcaaggugaagagacagaacagccugaaggaguggagaaaccugaagcagaagagagacgagaacuaccagaaggugaugugcugccuggugcacagauaccugaccagcaugagacagaagaugcagagcaccgaccaggccaccguggagaaccugaacgagcugagacaggaccugagcaaguucagaaacgagaucagagaccugcugggcuucagaaccagcaaguacgccauguucuaccccagaaacuaa

SEQ ID NO: 25084 - RNA, 2766 nt, Artificial Sequence
  TRPC3__Homo_sapiens__NP_001124170
augagcaccaaggugagaaagugcaaggagcaggccagagugaccuuccccgcccccgaggaggaggaggacgagggcgaggacgagggcgccgagccccagagaagaagaagaggcuggagaggcgugaacggcggccuggagcccagaagcgcccccagccagagagagccccacggcuacugccccccccccuucagccacggccccgaccugagcauggagggcagccccagccugagaagaaugaccgugaugagagagaagggcagaagacaggccgugagaggccccgccuucauguucaacgacagaggcaccagccugaccgccgaggaggagagauuccuggacgccgccgaguacggcaacauccccguggugagaaagaugcuggaggagagcaagacccugaacgugaacugcguggacuacaugggccagaacgcccugcagcuggccgugggcaacgagcaccuggaggugaccgagcugcugcugaagaaggagaaccuggccagaaucggcgacgcccugcugcuggccaucagcaagggcuacgugagaaucguggaggccauccugaaccaccccggcuucgccgccagcaagagacugacccugagccccugcgagcaggagcugcaggacgacgacuucuacgccuacgacgaggacggcaccagauucagccccgacaucacccccaucauccuggccgcccacugccagaaguacgagguggugcacaugcugcugaugaagggcgccagaaucgagagaccccacgacuacuucugcaagugcggcgacugcauggagaagcagagacacgacagcuucagccacagcagaagcagaaucaacgccuacaagggccuggccagccccgccuaccugagccugagcagcgaggaccccgugcugaccgcccuggagcugagcaacgagcuggccaagcuggccaacaucgagaaggaguucaagaacgacuacagaaagcugagcaugcagugcaaggacuucguggugggcgugcuggaccugugcagagacagcgaggagguggaggccauccugaacggcgaccuggagagcgccgagccccuggaggugcacagacacaaggccagccugagcagagugaagcuggccaucaaguacgaggugaagaaguucguggcccaccccaacugccagcagcagcugcugaccaucugguacgagaaccugagcggccugagagagcagaccaucgccaucaagugccugguggugcuggugguggcccugggccugcccuuccuggccaucggcuacuggaucgcccccugcagcagacugggcaagauccugagaagccccuucaugaaguucguggcccacgccgccagcuucaucaucuuccugggccugcugguguucaacgccagcgacagauucgagggcaucaccacccugcccaacaucaccgugaccgacuaccccaagcagaucuucagagugaagaccacccaguucaccuggaccgagaugcugaucauggugugggugcugggcaugauguggagcgagugcaaggagcuguggcuggagggccccagagaguacauccugcagcuguggaacgugcuggacuucggcaugcugagcaucuucaucgccgccuucaccgccagauuccuggccuuccugcaggccaccaaggcccagcaguacguggacagcuacgugcaggagagcgaccugagcgaggugacccugccccccgagauccaguacuucaccuacgccagagacaaguggcugcccagcgacccccagaucaucagcgagggccuguacgccaucgccguggugcugagcuucagcagaaucgccuacauccugcccgccaacgagagcuucggcccccugcagaucagccugggcagaaccgugaaggacaucuucaaguucauggugcuguucaucaugguguucuucgccuucaugaucggcauguucauccuguacagcuacuaccugggcgccaaggugaacgccgccuucaccaccguggaggagagcuucaagacccuguucuggagcaucuucggccugagcgaggugaccagcguggugcugaaguacgaccacaaguucaucgagaacaucggcuacgugcuguacggcaucuacaacgugaccauggugguggugcugcugaacaugcugaucgccaugaucaacagcagcuaccaggagaucgaggacgacagcgacguggaguggaaguucgccagaagcaagcuguggcugagcuacuucgacgacggcaagacccugcccccccccuucagccuggugcccagccccaagagcuucguguacuucaucaugagaaucgugaacuuccccaagugcagaagaagaagacugcagaaggacaucgagaugggcaugggcaacagcaagagcagacugaaccuguucacccagagcaacagcagaguguucgagagccacagcuucaacagcauccugaaccagcccaccagauaccagcagaucaugaagagacugaucaagagauacgugcugaaggcccagguggacaaggagaacgacgaggugaacgagggcgagcugaaggagaucaagcaggacaucagcagccugagauacgagcugcuggaggacaagagccaggccaccgaggagcuggccauccugauccacaagcugagcgagaagcugaaccccagcaugcugagaugcgaguaa

SEQ ID NO: 25085 - RNA, 2370 nt, Artificial Sequence
  TRPC4AP__Homo_sapiens__NP_955400
auggccgccgcccccguggccgccggcagcggcgccggcagaggcagaagaagcgccgccaccguggccgccuggggcggcuggggcggcagacccagacccggcaacauccugcugcagcugagacagggccagcugaccggcagaggccuggugagagccgugcaguucaccgagaccuuccugaccgagagagacaagcagagcaaguggagcggcaucccccagcugcugcugaagcugcacaccaccagccaccugcacagcgacuucguggagugccagaacauccugaaggagaucagcccccugcugagcauggaggccauggccuucgugaccgaggagagaaagcugacccaggagaccaccuaccccaacaccuacaucuucgaccuguucggcggcguggaccugcugguggagauccugaugagacccaccaucagcaucagaggccagaagcugaagaucagcgacgagaugagcaaggacugccugagcauccuguacaacaccugcgugugcaccgagggcgugaccaagagacuggccgagaagaacgacuucgugaucuuccuguucacccugaugaccagcaagaagaccuuccugcagaccgccacccugaucgaggacauccugggcgugaagaaggagaugaucagacuggacgaggugcccaaccugagcagccuggugagcaacuucgaccagcagcagcuggccaacuucugcagaauccuggccgugaccaucagcgagauggacaccggcaacgacgacaagcacacccugcuggccaagaacgcccagcagaagaagagccugagccugggccccagcgccgccgagaucaaccaggccgcccugcugagcauccccggcuucguggagagacugugcaagcuggccaccagaaaggugagcgagagcaccggcaccgccagcuuccugcaggagcuggaggagugguacaccuggcuggacaacgcccuggugcuggacgcccugaugagaguggccaacgaggagagcgagcacaaccagggcgccagcgaggagaacggccugccccacaccagcgccagaacccagcugccccagagcaugaagaucaugcacgagaucauguacaagcuggaggugcuguacgugcugugcgugcugcugaugggcagacagagaaaccaggugcacagaaugaucgccgaguucaagcugauccccggccugaacaaccuguucgacaagcugaucuggagaaagcacagcgccagcgcccuggugcugcacggccacaaccagaacugcgacugcagccccgacaucacccugaagauccaguuccugagacugcugcagagcuucagcgaccaccacgagaacaaguaccugcugcugaacaaccaggagcugaacgagcugagcgccaucagccugaaggccaacauccccgagguggaggccgugcugaacaccgacagaagccuggugugcgacggcaagagaggccugcugaccagacugcugcaggugaugaagaaggagcccgccgagagcagcuucagauucuggcaggccagagccguggagagcuuccugagaggcaccaccagcuacgccgaccagauguuccugcugaagagaggccugcuggagcacauccuguacugcaucguggacagcgagugcaagagcagagacgugcugcagagcuacuucgaccugcugggcgagcugaugaaguucaacguggacgccuucaagagauucaacaaguacaucaacaccgacgccaaguuccagguguuccugaagcagaucaacagcagccugguggacagcaacaugcuggugagaugcgugacccugagccuggacagauucgagaaccagguggacaugaagguggccgaggugcugagcgagugcagacugcuggccuacaucagccaggugcccacccagaugagcuuccuguucagacugaucaacaucauccacgugcagacccugacccaggagaacgugagcugccugaacaccagccuggugauccugaugcuggccagaagaaaggagagacugccccuguaccugagacugcugcagagaauggagcacagcaagaaguaccccggcuuccugcugaacaacuuccacaaccugcugagauucuggcagcagcacuaccugcacaaggacaaggacagcaccugccuggagaacagcagcugcaucagcuucagcuacuggaaggagaccgugagcauccugcugaaccccgacagacagagccccagcgcccuggugagcuacaucgaggagcccuacauggacaucgacagagacuucaccgaggaguaa

SEQ ID NO: 25086 - RNA, 2682 nt, Artificial Sequence
  TRPC4__Homo_sapiens__NP_001129427
auggcccaguucuacuacaagagaaacgugaacgcccccuacagagacagaaucccccugagaaucgugagagccgagagcgagcugagccccagcgagaaggccuaccugaacgccguggagaagggcgacuacgccagcgugaagaagagccuggaggaggccgagaucuacuucaagaucaacaucaacugcaucgacccccugggcagaaccgcccugcugaucgccaucgagaacgagaaccuggagcugaucgagcugcugcugagcuucaacguguacgugggcgacgcccugcugcacgccaucagaaaggagguggugggcgccguggagcugcugcugaaccacaagaagcccagcggcgagaagcaggugccccccauccugcuggacaagcaguucagcgaguucacccccgacaucacccccaucauccuggccgcccacaccaacaacuacgagaucaucaagcugcuggugcagaagggcgugagcgugcccagaccccacgaggugagaugcaacugcguggagugcgugagcagcagcgacguggacagccugagacacagcagaagcagacugaacaucuacaaggcccuggccagccccagccugaucgcccugagcagcgaggaccccuuccugaccgccuuccagcugagcugggagcugcaggagcugagcaagguggagaacgaguucaagagcgaguacgaggagcugagcagacagugcaagcaguucgccaaggaccugcuggaccagaccagaagcagcagagagcuggagaucauccugaacuacagagacgacaacagccugaucgaggagcagagcggcaacgaccuggccagacugaagcuggccaucaaguacagacagaaggaguucguggcccagcccaacugccagcagcugcuggccagcagaugguacgacgaguuccccggcuggagaagaagacacugggccgugaagauggugaccugcuucaucaucggccugcuguuccccguguucagcgugugcuaccugaucgcccccaagagcccccugggccuguucaucagaaagcccuucaucaaguucaucugccacaccgccagcuaccugaccuuccuguuccugcugcugcuggccagccagcacaucgacagaagcgaccugaacagacagggccccccccccaccaucguggaguggaugauccugcccugggugcugggcuucaucuggggcgagaucaagcagaugugggacggcggccugcaggacuacauccacgacugguggaaccugauggacuucgugaugaacagccuguaccuggccaccaucagccugaagaucguggccuucgugaaguacagcgcccugaaccccagagagagcugggacauguggcaccccacccugguggccgaggcccuguucgccaucgccaacaucuucagcagccugagacugaucagccuguucaccgccaacagccaccugggcccccugcagaucagccugggcagaaugcugcuggacauccugaaguuccuguucaucuacugccuggugcugcuggccuucgccaacggccugaaccagcuguacuucuacuacgaggagaccaagggccugaccugcaagggcaucagaugcgagaagcagaacaacgccuucagcacccuguucgagacccugcagagccuguucuggagcaucuucggccugaucaaccuguacgugaccaacgugaaggcccagcacgaguucaccgaguucgugggcgccaccauguucggcaccuacaacgugaucagccugguggugcugcugaacaugcugaucgccaugaugaacaacagcuaccagcugaucgccgaccacgccgacaucgaguggaaguucgccagaaccaagcuguggaugagcuacuucgaggagggcggcacccugcccacccccuucaacgugauccccagccccaagagccugugguaccugaucaaguggaucuggacccaccugugcaagaagaagaugagaagaaagcccgagagcuucggcaccaucggcagaagagccgccgacaaccugagaagacaccaccaguaccaggaggugaugagaaaccuggugaagagauacguggccgccaugaucagagacgccaagaccgaggagggccugaccgaggagaacuucaaggagcugaagcaggacaucagcagcuucagauucgaggugcugggccugcugagaggcagcaagcugagcaccauccagagcgccaacgccagcaaggagagcagcaacagcgccgacagcgacgagaagagcgacagcgaggaggagguggccagacagcaggccgccggcccccuggagagaaacauccagcuggagagcagaggccuggccagcagaggcgaccugagcauccccggccugagcgagcagugcgugcugguggaccacagagagagaaacaccgacacccugggccugcaggugggcaagagagugugccccuucaagagcgagaagguggugguggaggacaccgugcccaucauccccaaggagaagcacgccaaggaggaggacagcagcaucgacuacgaccugaaccugcccgacaccgugacccacgaggacuacgugaccaccagacuguaa

SEQ ID NO: 25087 - RNA, 2922 nt, Artificial Sequence
  TRPC5__Homo_sapiens__NP_036603
auggcccagcuguacuacaagaaggugaacuacagccccuacagagacagaaucccccugcagaucgugagagccgagaccgagcugagcgccgaggagaaggccuuccugaacgccguggagaagggcgacuacgccaccgugaagcaggcccugcaggaggccgagaucuacuacaacgugaacaucaacugcauggacccccugggcagaagcgcccugcugaucgccaucgagaacgagaaccuggagaucauggagcugcugcugaaccacagcguguacgugggcgacgcccugcuguacgccaucagaaaggagguggugggcgccguggagcugcugcugagcuacagaagacccagcggcgagaagcaggugcccacccugaugauggacacccaguucagcgaguucacccccgacaucacccccaucaugcuggccgcccacaccaacaacuacgagaucaucaagcugcuggugcagaagagagugaccauccccagaccccaccagaucagaugcaacugcguggagugcgugagcagcagcgagguggacagccugagacacagcagaagcagacugaacaucuacaaggcccuggccagccccagccugaucgcccugagcagcgaggaccccauccugaccgccuucagacugggcugggagcugaaggagcugagcaagguggagaacgaguucaaggccgaguacgaggagcugagccagcagugcaagcuguucgccaaggaccugcuggaccaggccagaagcagcagagagcuggagaucauccugaaccacagagacgaccacagcgaggagcuggacccccagaaguaccacgaccuggccaagcugaagguggccaucaaguaccaccagaaggaguucguggcccagcccaacugccagcagcugcuggccacccugugguacgacggcuuccccggcuggagaagaaagcacuggguggugaagcugcugaccugcaugaccaucggcuuccuguuccccaugcugagcaucgccuaccugaucagccccagaagcaaccugggccuguucaucaagaagcccuucaucaaguucaucugccacaccgccagcuaccugaccuuccuguucaugcugcugcuggccagccagcacaucgugagaaccgaccugcacgugcagggccccccccccaccgugguggaguggaugauccugcccugggugcugggcuucaucuggggcgagaucaaggagaugugggacggcggcuucaccgaguacauccacgacugguggaaccugauggacuucgccaugaacagccuguaccuggccaccaucagccugaagaucguggccuacgugaaguacaacggcagcagacccagagaggagugggagauguggcaccccacccugaucgccgaggcccuguucgccaucagcaacauccugagcagccugagacugaucagccuguucaccgccaacagccaccugggcccccugcagaucagccugggcagaaugcugcuggacauccugaaguuccuguucaucuacugccuggugcugcuggccuucgccaacggccugaaccagcuguacuucuacuacgagaccagagccaucgacgagcccaacaacugcaagggcaucagaugcgagaagcagaacaacgccuucagcacccuguucgagacccugcagagccuguucuggagcguguucggccugcugaaccuguacgugaccaacgugaaggccagacacgaguucaccgaguucgugggcgccaccauguucggcaccuacaacgugaucagccugguggugcugcugaacaugcugaucgccaugaugaacaacagcuaccagcugaucgccgaccacgccgacaucgaguggaaguucgccagaaccaagcuguggaugagcuacuucgacgagggcggcacccugcccccccccuucaacaucauccccagccccaagagcuuccuguaccugggcaacugguucaacaacaccuucugccccaagagagaccccgacggcagaagaagaagaagaaaccugagaagcuucaccgagagaaacgccgacagccugauccagaaccagcacuaccaggaggugaucagaaaccuggugaagagauacguggccgccaugaucagaaacagcaagacccacgagggccugaccgaggagaacuucaaggagcugaagcaggacaucagcagcuucagauacgaggugcuggaccugcugggcaacagaaagcaccccagaagcuucagcaccagcagcaccgagcugagccagagagacgacaacaacgacggcagcggcggcgccagagccaagagcaagagcgugagcuucaaccugggcugcaagaagaagaccugccacggccccccccugaucagaaccaugcccagaagcagcggcgcccagggcaagagcaaggccgagagcagcagcaagagaagcuucaugggccccagccugaagaagcugggccugcuguucagcaaguucaacggccacaugagcgagcccagcagcgagcccauguacaccaucagcgacggcaucgugcagcagcacugcauguggcaggacaucagauacagccagauggagaagggcaaggccgaggccugcagccagagcgagaucaaccugagcgagguggagcugggcgaggugcagggcgccgcccagagcagcgagugcccccuggccugcagcagcagccugcacugcgccagcagcaucugcagcagcaacagcaagcugcuggacagcagcgaggacguguucgagaccuggggcgaggccugcgaccugcugaugcacaaguggggcgacggccaggaggagcaggugaccaccagacuguaa

SEQ ID NO: 25088 - RNA, 2796 nt, Artificial Sequence
  TRPC6__Homo_sapiens__NP_004612
augagccagagccccgccuucggccccagaagaggcagcagccccagaggcgccgccggcgccgccgccagaagaaacgagagccaggacuaccugcugauggacagcgagcugggcgaggacggcugcccccaggccccccugcccugcuacggcuacuaccccugcuucagaggcagcgacaacagacuggcccacagaagacagaccgugcugagagagaagggcagaagacuggccaacagaggccccgccuacauguucagcgacagaagcaccagccugagcaucgaggaggagagauuccuggacgccgccgaguacggcaacauccccguggugagaaagaugcuggaggagugccacagccugaacgugaacugcguggacuacaugggccagaacgcccugcagcuggccguggccaacgagcaccuggagaucaccgagcugcugcugaagaaggagaaccugagcagagugggcgacgcccugcugcuggccaucagcaagggcuacgugagaaucguggaggccauccugagccaccccgccuucgccgagggcaagagacuggccaccagccccagccagagcgagcugcagcaggacgacuucuacgccuacgacgaggacggcaccagauucagccacgacgugacccccaucauccuggccgcccacugccaggaguacgagaucgugcacacccugcugagaaagggcgccagaaucgagagaccccacgacuacuucugcaagugcaacgacugcaaccagaagcagaagcacgacagcuucagccacagcagaagcagaaucaacgccuacaagggccuggccagccccgccuaccugagccugagcagcgaggaccccgugaugaccgcccuggagcugagcaacgagcuggccgugcuggccaacaucgagaaggaguucaagaacgacuacaagaagcugagcaugcagugcaaggacuucguggugggccugcuggaccugugcagaaacaccgaggagguggaggccauccugaacggcgacguggagacccugcagagcggcgaccacggcagacccaaccugagcagacugaagcuggccaucaaguacgaggugaagaaguucguggcccaccccaacugccagcagcagcugcugagcaucugguacgagaaccugagcggccugagacagcagaccauggccgugaaguuccugguggugcuggccguggccaucggccugcccuuccuggcccugaucuacugguucgcccccugcagcaagaugggcaagaucaugagaggccccuucaugaaguucguggcccacgccgccagcuucaccaucuuccugggccugcuggugaugaacgccgccgacagauucgagggcaccaagcugcugcccaacgagaccagcaccgacaacgccaagcagcuguucagaaugaagaccagcugcuucagcuggauggagaugcugaucaucagcugggugaucggcaugaucugggccgagugcaaggagaucuggacccagggccccaaggaguaccuguucgagcuguggaacaugcuggacuucggcaugcuggccaucuucgccgccagcuucaucgccagauucauggccuucuggcacgccagcaaggcccagagcaucaucgacgccaacgacacccugaaggaccugaccaaggugacccugggcgacaacgugaaguacuacaaccuggccagaaucaagugggaccccagcgacccccagaucaucagcgagggccuguacgccaucgccguggugcugagcuucagcagaaucgccuacauccugcccgccaacgagagcuucggcccccugcagaucagccugggcagaaccgugaaggacaucuucaaguucauggugaucuucaucaugguguucguggccuucaugaucggcauguucaaccuguacagcuacuacaucggcgccaagcagaacgaggccuucaccaccguggaggagagcuucaagacccuguucugggccaucuucggccugagcgaggugaagagcguggugaucaacuacaaccacaaguucaucgagaacaucggcuacgugcuguacggcguguacaacgugaccauggugaucgugcugcugaacaugcugaucgccaugaucaacagcagcuuccaggagaucgaggacgacgccgacguggaguggaaguucgccagagccaagcugugguucagcuacuucgaggagggcagaacccugcccgugcccuucaaccuggugcccagccccaagagccuguucuaccugcugcugaagcugaagaaguggaucagcgagcuguuccagggccacaagaagggcuuccaggaggacgccgagaugaacaagaucaacgaggagaagaagcugggcauccugggcagccacgaggaccugagcaagcugagccuggacaagaagcaggugggccacaacaagcagcccagcaucagaagcagcgaggacuuccaccugaacagcuucaacaacccccccagacaguaccagaagaucaugaagagacugaucaagagauacgugcugcaggcccagaucgacaaggagagcgacgaggugaacgagggcgagcugaaggagaucaagcaggacaucagcagccugagauacgagcugcuggaggagaagagccagaacaccgaggaccuggccgagcugaucagagagcugggcgagaagcugagcauggagcccaaccaggaggagaccaacagauaa

SEQ ID NO: 25089 - RNA, 2241 nt, Artificial Sequence
  TRPC7__Homo_sapiens__NP_001161048
augcugagaaacagcaccuucaagaacaugcagagaagacacaccacccugagagagaagggcagaagacaggccaucagaggccccgccuacauguucaacgagaagggcaccagccugacccccgaggaggagagauuccuggacagcgccgaguacggcaacauccccguggugagaaagaugcuggaggagagcaagacccugaacuucaacugcguggacuacaugggccagaacgcccugcagcuggccgugggcaacgagcaccuggaggugaccgagcugcugcugaagaaggagaaccuggccagagugggcgacgcccugcugcuggccaucagcaagggcuacgugagaaucguggaggccauccugaaccaccccgccuucgcccagggccagagacugacccugagcccccuggagcaggagcugagagacgacgacuucuacgccuacgacgaggacggcaccagauucagccacgacaucacccccaucauccuggccgcccacugccaggaguacgagaucgugcacauccugcugcugaagggcgccagaaucgagagaccccacgacuacuucugcaagugcaacgagugcaccgagaagcagagaaaggacagcuucagccacagcagaagcagaaugaacgccuacaagggccuggccagcgccgccuaccugagccugagcagcgaggaccccgugcugaccgcccuggagcugagcaacgagcuggccagacuggccaacaucgagaccgaguucaagcugggcagaacccugagaagccccuucaugaaguucguggcccacgccgugagcuucaccaucuuccugggccugcugguggugaacgccagcgacagauucgagggcgugaagacccugcccaacgagaccuucaccgacuaccccaagcagaucuucagagugaagaccacccaguucagcuggaccgagaugcugaucaugaagugggugcugggcaugaucuggagcgagugcaaggagaucugggaggagggccccagagaguacgugcugcaccuguggaaccugcuggacuucggcaugcugagcaucuucguggccagcuucaccgccagauucauggccuuccugaaggccaccgaggcccagcuguacguggaccagcacgugcaggacgacacccugcacaacgugagccugccccccgagguggccuacuucaccuacgccagagacaagugguggcccagcgacccccagaucaucagcgagggccuguacgccaucgccguggugcugagcuucagcagaaucgccuacauccugcccgccaacgagagcuucggcccccugcagaucagccugggcagaaccgugaaggacaucuucaaguucauggugaucuucaucaugguguucguggccuucaugaucggcauguucaaccuguacagcuacuacagaggcgccaaguacaaccccgccuucaccaccguggaggagagcuucaagacccuguucuggagcaucuucggccugagcgaggugaucagcguggugcugaaguacgaccacaaguucaucgagaacaucggcuacgugcuguacggcguguacaacgugaccauggugguggugcugcugaacaugcugaucgccaugaucaacaacagcuaccaggagaucgaggaggacgccgacguggaguggaaguucgccagagccaagcuguggcugagcuacuucgacgagggcagaacccugcccgcccccuucaaccuggugcccagccccaagagcuucuacuaccugaucaugagaaucaagaugugccugaucaagcugugcaagagcaaggccaagagcugcgagaacgaccuggagaugggcaugcugaacagcaaguucaagaagaccagauaccaggccggcaugagaaacagcgagaaccugaccgccaacaacacccugagcaagcccaccagauaccagaagaucaugaagagacugaucaagagauacgugcugaaggcccagguggacagagagaacgacgaggugaacgagggcgagcugaaggagaucaagcaggacaucagcagccugagauacgagcugcuggaggagaagagccaggccaccggcgagcuggccgaccugauccagcagcugagcgagaaguucggcaagaaccugaacaaggaccaccugagagugaacaagggcaaggacaucuaa

SEQ ID NO: 25090 - RNA, 4929 nt, Artificial Sequence
  TRPM1__Homo_sapiens__NP_001238949
augagcagcuucaagagaggcagccugaagagcagcaccagcggcagccagaagggccagaagagcuggaucgagaagaccuucugcaagagagagugcaucuucgugauccccagcaugaaggacagcaacagaugcugcugcggccaguucaccaaccagcacauccccccccugcccagcgccacccccagcaagaacgaggaggagagcaagcagguggagacccagcccgagaaguggagcguggccaagcacacccagagcuaccccaccgacagcuacggcgugcuggaguuccagggcggcggcuacagcaacaaggccauguacaucagagugagcuacgacaccaagcccgacagccugcugcaccugauggugaaggacuggcagcuggagcugcccaagcugcugaucagcgugcacggcggccugcagaacuucgagaugcagcccaagcugaagcagguguucggcaagggccugaucaaggccgccaugaccaccggcgccuggaucuucaccggcggcgugagcaccggcgugaucagccacgugggcgacgcccugaaggaccacagcagcaagagcagaggcagagugugcgccaucggcaucgcccccuggggcaucguggagaacaaggaggaccuggugggcaaggacgugaccagaguguaccagaccaugagcaacccccugagcaagcugagcgugcugaacaacagccacacccacuucauccuggccgacaacggcacccugggcaaguacggcgccgaggugaagcugagaagacugcuggagaagcacaucagccugcagaagaucaacaccagacugggccagggcgugccccuggugggccuggugguggagggcggccccaacguggugagcaucgugcuggaguaccugcaggaggagccccccauccccguggugaucugcgacggcagcggcagagccagcgacauccugagcuucgcccacaaguacugcgaggagggcggcaucaucaacgagagccugagagagcagcugcuggugaccauccagaagaccuucaacuacaacaaggcccagagccaccagcuguucgccaucaucauggagugcaugaagaagaaggagcuggugaccguguucagaaugggcagcgagggccagcaggacaucgagauggccauccugaccgcccugcugaagggcaccaacgugagcgcccccgaccagcugagccuggcccuggccuggaacagaguggacaucgccagaagccagaucuucguguucggcccccacuggcccccccugggcagccuggccccccccaccgacagcaaggccaccgagaaggagaagaagccccccauggccaccaccaagggcggcagaggcaagggcaagggcaagaagaagggcaaggugaaggaggagguggaggaggagaccgaccccagaaagaucgagcugcugaacugggugaacgcccuggagcaggccaugcuggacgcccuggugcuggacagaguggacuucgugaagcugcugaucgagaacggcgugaacaugcagcacuuccugaccauccccagacuggaggagcuguacaacaccagacugggcccccccaacacccugcaccugcuggugagagacgugaagaagagcaaccugccccccgacuaccacaucagccugaucgacaucggccuggugcuggaguaccugaugggcggcgccuacagaugcaacuacaccagaaagaacuucagaacccuguacaacaaccuguucggccccaagagacccaaggcccugaagcugcugggcauggaggacgacgagccccccgccaagggcaagaagaagaagaagaagaagaaggaggaggagaucgacaucgacguggacgaccccgccgugagcagauuccaguaccccuuccacgagcugauggugugggccgugcugaugaagagacagaagauggccguguuccuguggcagagaggcgaggagagcauggccaaggcccugguggccugcaagcuguacaaggccauggcccacgagagcagcgagagcgaccugguggacgacaucagccaggaccuggacaacaacagcaaggacuucggccagcuggcccuggagcugcuggaccagagcuacaagcacgacgagcagaucgccaugaagcugcugaccuacgagcugaagaacuggagcaacagcaccugccugaagcuggccguggccgccaagcacagagacuucaucgcccacaccugcagccagaugcugcugaccgacauguggaugggcagacugagaaugagaaagaaccccggccugaaggugaucaugggcauccugcugccccccaccauccuguuccuggaguucagaaccuacgacgacuucagcuaccagaccagcaaggagaacgaggacggcaaggagaaggaggaggagaacaccgacgccaacgccgacgccggcagcagaaagggcgacgaggagaacgagcacaagaagcagagaagcauccccaucggcaccaagaucugcgaguucuacaacgcccccaucgugaaguucugguucuacaccaucagcuaccugggcuaccugcugcuguucaacuacgugauccuggugagaauggacggcuggcccagccugcaggaguggaucgugaucagcuacaucgugagccuggcccuggagaagaucagagagauccugaugagcgagcccggcaagcugagccagaagaucaagguguggcugcaggaguacuggaacaucaccgaccugguggccaucagcaccuucaugaucggcgccauccugagacugcagaaccagcccuacaugggcuacggcagagugaucuacugcguggacaucaucuucugguacaucagagugcuggacaucuucggcgugaacaaguaccugggccccuacgugaugaugaucggcaagaugaugaucgacaugcuguacuucguggugaucaugcugguggugcugaugagcuucggcguggccagacaggccauccugcaccccgaggagaagcccagcuggaagcuggccagaaacaucuucuacaugcccuacuggaugaucuacggcgagguguucgccgaccagaucgaccuguacgccauggagaucaacccccccugcggcgagaaccuguacgacgaggagggcaagagacugccccccugcauccccggcgccuggcugacccccgcccugauggccugcuaccugcugguggccaacauccugcuggugaaccugcugaucgccguguucaacaacaccuucuucgaggugaagagcaucagcaaccagguguggaaguuccagagauaccagcugaucaugaccuuccacgacagacccgugcugcccccccccaugaucauccugagccacaucuacaucaucaucaugagacugagcggcagaugcagaaagaagagagagggcgaccaggaggagagagacagaggccugaagcuguuccugagcgacgaggagcugaagagacugcacgaguucgaggagcagugcgugcaggagcacuucagagagaaggaggacgagcagcagagcagcagcgacgagagaaucagagugaccagcgagagaguggagaacaugagcaugagacuggaggagaucaacgagagagagaccuucaugaagaccagccugcagaccguggaccugagacuggcccagcuggaggagcugagcaacagaauggugaacgcccuggagaaccuggccggcaucgacagaagcgaccugauccaggccagaagcagagccagcagcgagugcgaggccaccuaccugcugagacagagcagcaucaacagcgccgacggcuacagccuguacagauaccacuucaacggcgaggagcugcuguucgaggacaccagccugagcaccagccccggcaccggcgugagaaagaagaccugcagcuucagaaucaaggaggagaaggacgugaagacccaccuggugcccgagugccagaacagccugcaccugagccugggcaccagcaccagcgccacccccgacggcagccaccuggccguggacgaccugaagaacgccgaggagagcaagcugggccccgacaucggcaucagcaaggaggacgacgagagacagaccgacagcaagaaggaggagaccaucagccccagccugaacaagaccgacgugauccacggccaggacaagagcgacgugcagaacacccagcugaccguggagaccaccaacaucgagggcaccaucagcuacccccuggaggagaccaagaucaccagauacuuccccgacgagaccaucaacgccugcaagaccaugaagagcagaagcuucguguacagcagaggcagaaagcuggugggcggcgugaaccaggacguggaguacagcagcaucaccgaccagcagcugaccaccgaguggcagugccaggugcagaagaucaccagaagccacagcaccgacauccccuacaucgugagcgaggccgccgugcaggccgagcacaaggagcaguucgccgacaugcaggacgagcaccacguggccgaggccauccccagaauccccagacugagccugaccaucaccgacagaaacggcauggagaaccugcugagcgugaagcccgaccagacccugggcuuccccagccugagaagcaagagccugcacggccaccccagaaacgugaagagcauccagggcaagcuggacagaagcggccacgccagcagcgugagcagccuggugaucgugagcggcaugaccgccgaggagaagaaggugaagaaggagaaggccagcaccgagaccgagugcuaa

SEQ ID NO: 25091 - RNA, 4512 nt, Artificial Sequence
  TRPM2__Homo_sapiens__XP_005261228
auggagcccagcgcccugagaaaggccggcagcgagcaggaggagggcuucgagggccugcccagaagagugaccgaccugggcauggugagcaaccugagaagaagcaacagcagccuguucaagagcuggagacugcagugccccuucggcaacaacgacaagcaggagagccugagcagcuggauccccgagaacaucaagaagaaggagugcguguacuucguggagagcagcaagcugagcgacgccggcaagguggugugccagugcggcuacacccacgagcagcaccuggaggaggccaccaagccccacaccuuccagggcacccagugggaccccaagaagcacgugcaggagaugcccaccgacgccuucggcgacaucguguucaccggccugagccagaaggugaagaaguacgugagagugagccaggacacccccagcagcgugaucuaccaccugaugacccagcacuggggccuggacgugcccaaccugcugaucagcgugaccggcggcgccaagaacuucaacaugaagcccagacugaagagcaucuucagaagaggccuggugaagguggcccagaccaccggcgccuggaucaucaccggcggcagccacaccggcgugaugaagcaggugggcgaggccgugagagacuucagccugagcagcagcuacaaggagggcgagcugaucaccaucggcguggccaccuggggcaccgugcacagaagagagggccugauccaccccaccggcagcuuccccgccgaguacauccuggacgaggacggccagggcaaccugaccugccuggacagcaaccacagccacuucauccugguggacgacggcacccacggccaguacggcguggagaucccccugagaaccagacuggagaaguucaucagcgagcagaccaaggagagaggcggcguggccaucaagauccccaucgugugcguggugcuggagggcggccccggcacccugcacaccaucgacaacgccaccaccaacggcacccccugcguggugguggagggcagcggcagaguggccgacgugaucgcccagguggccaaccugcccgugagcgacaucaccaucagccugauccagcagaagcugagcguguucuuccaggagauguucgagaccuucaccgagagcagaaucguggaguggaccaagaagauccaggacaucgugagaagaagacagcugcugaccguguucagagagggcaaggacggccagcaggacguggacguggccauccugcaggcccugcugaaggccagcagaagccaggaccacuucggccacgagaacugggaccaccagcugaagcuggccguggccuggaacagaguggacaucgccagaagcgagaucuucauggacgaguggcaguggaagcccagcgaccugcaccccaccaugaccgccgcccugaucagcaacaagcccgaguucgugaagcuguuccuggagaacggcgugcagcugaaggaguucgugaccugggacacccugcuguaccuguacgagaaccuggaccccagcugccuguuccacagcaagcugcagaaggugcugguggaggaccccgagagacccgccugcgcccccgccgcccccagacugcagaugcaccacguggcccaggugcugagagagcugcugggcgacuucacccagccccuguaccccagacccagacacaacgacagacugagacugcugcugcccgugccccacgugaagcugaacgugcagggcgugagccugagaagccuguacaagagaagcagcggccacgugaccuucaccauggaccccaucagagaccugcugaucugggccaucgugcagaacagaagagagcuggccggcaucaucugggcccagagccaggacugcaucgccgccgcccuggccugcagcaagauccugaaggagcugagcaaggaggaggaggacaccgacagcagcgaggagaugcuggcccuggccgaggaguacgagcacagagccaucggcguguucaccgagugcuacagaaaggacgaggagagagcccagaagcugcugaccagagugagcgaggccuggggcaagaccaccugccugcagcuggcccuggaggccaaggacaugaaguucgugagccacggcggcauccaggccuuccugaccaaggugugguggggccagcugagcguggacaacggccuguggagagugacccugugcaugcuggccuucccccugcugcugaccggccugaucagcuucagagagaagagacugcaggacgugggcacccccgccgccagagccagagccuucuucaccgcccccguggugguguuccaccugaacauccugagcuacuucgccuuccugugccuguucgccuacgugcugaugguggacuuccagcccgugcccagcuggugcgagugcgccaucuaccuguggcuguucagccuggugugcgaggagaugagacagcuguucuacgaccccgacgagugcggccugaugaagaaggccgcccuguacuucagcgacuucuggaacaagcuggacgugggcgccauccugcuguucguggccggccugaccugcagacugauccccgccacccuguaccccggcagagugauccugagccuggacuucauccuguucugccugagacugaugcacaucuucaccaucagcaagacccugggccccaagaucaucaucgugaagagaaugaugaaggacguguucuucuuccuguuccugcuggccguguggguggugagcuucggcguggccaagcaggccauccugauccacaacgagagaagaguggacuggcuguucagaggcgccguguaccacagcuaccugaccaucuucggccagauccccggcuacaucgacggcgugaacuucaaccccgagcacugcagccccaacggcaccgaccccuacaagcccaagugccccgagagcgacgccacccagcagagacccgccuuccccgaguggcugaccgugcugcugcugugccuguaccugcuguucaccaacauccugcugcugaaccugcugaucgccauguucaacuacaccuuccagcaggugcaggagcacaccgaccagaucuggaaguuccagagacacgaccugaucgaggaguaccacggcagacccgccgcccccccccccuucauccugcugagccaccugcagcuguucaucaagagaguggugcugaagacccccgccaagagacacaagcagcugaagaacaagcuggagaagaacgaggaggccgcccugcugagcugggagaucuaccugaaggagaacuaccugcagaacagacaguuccagcagaagcagagacccgagcagaagaucgaggacaucagcaacaagguggacgccaugguggaccugcuggaccuggacccccugaagagaagcggcagcauggagcagagacuggccagccuggaggagcagguggcccagaccgcccaggcccugcacuggaucgugagaacccugagagccagcggcuucagcagcgaggccgacgugcccacccuggccagccagaaggccgccgaggagcccgacgccgagcccggcggcagaaagaagaccgaggagcccggcgacagcuaccacgugaacgccagacaccugcuguaccccaacugccccgugaccagauuccccgugcccaacgagaaggugcccugggagaccgaguuccugaucuacgacccccccuucuacaccgccgagagaaaggacgccgccgccauggaccccaugggcgacacccuggagccccugagcaccauccaguacaacgugguggacggccugagagacagaagaagcuuccacggccccuacaccgugcaggccggccugccccugaaccccaugggcagaaccggccugagaggcagaggcagccugagcugcuucggccccaaccacacccuguaccccauggugaccagauggagaagaaacgaggacggcgccaucugcagaaagagcaucaagaagaugcuggaggugcugguggugaagcugccccugagcgagcacugggcccugcccggcggcagcagagagcccggcgagaugcugcccagaaagcugaagagaauccugagacaggagcacuggcccagcuucgagaaccugcugaagugcggcauggagguguacaagggcuacauggacgaccccagaaacaccgacaacgccuggaucgagaccguggccgugagcgugcacuuccaggaccagaacgacguggagcugaacagacugaacagcaaccugcacgccugcgacagcggcgccagcaucagauggcaggugguggacagaagaaucccccuguacgccaaccacaagacccugcugcagaaggccgccgccgaguucggcgcccacuacuaa

SEQ ID NO: 25092 - RNA, 5124 nt, Artificial Sequence
  TRPM3__Homo_sapiens__NP_001007472
augcccgagcccuggggcaccguguacuuccugggcaucgcccagguguucagcuuccuguucagcugguggaaccuggagggcgugaugaaccaggccgacgcccccagaccccugaacuggaccaucagaaagcugugccacgccgccuuccugcccagcgugagacugcugaaggcccagaagagcuggaucgagagagccuucuacaagagagagugcgugcacaucauccccagcaccaaggacccccacagaugcugcugcggcagacugaucggccagcacgugggccugacccccagcaucagcgugcugcagaacgagaagaacgagagcagacugagcagaaacgacauccagagcgagaaguggagcaucagcaagcacacccagcugagccccaccgacgccuucggcaccaucgaguuccagggcggcggccacagcaacaaggccauguacgugagagugagcuucgacaccaagcccgaccugcugcugcaccugaugaccaaggaguggcagcuggagcugcccaagcugcugaucagcgugcacggcggccugcagaacuucgagcugcagcccaagcugaagcagguguucggcaagggccugaucaaggccgccaugaccaccggcgccuggaucuucaccggcggcgugaacaccggcgugaucagacacgugggcgacgcccugaaggaccacgccagcaagagcagaggcaagaucugcaccaucggcaucgcccccuggggcaucguggagaaccaggaggaccugaucggcagagacguggugagacccuaccagaccaugagcaaccccaugagcaagcugaccgugcugaacagcaugcacagccacuucauccuggccgacaacggcaccaccggcaaguacggcgccgaggugaagcugagaagacagcuggagaagcacaucagccugcagaagaucaacaccagaaucggccagggcgugcccgugguggcccugaucguggagggcggccccaacgugaucagcaucgugcuggaguaccugagagacaccccccccgugcccgugguggugugcgacggcagcggcagagccagcgacauccuggccuucggccacaaguacagcgaggagggcggccugaucaacgagagccugagagaccagcugcuggugaccauccagaagaccuucaccuacaccagaacccaggcccagcaccuguucaucauccugauggagugcaugaagaagaaggagcugaucaccguguucagaaugggcagcgagggccaccaggacaucgaccuggccauccugaccgcccugcugaagggcgccaacgccagcgcccccgaccagcugagccuggcccuggccuggaacagaguggacaucgccagaagccagaucuucaucuacggccagcaguggcccgugggcagccuggagcaggccaugcuggacgcccuggugcuggacagaguggacuucgugaagcugcugaucgagaacggcgugagcaugcacagauuccugaccaucagcagacuggaggagcuguacaacaccagacacggccccagcaacacccuguaccaccuggugagagacgugaagaagggcaaccugccccccgacuacagaaucagccugaucgacaucggccuggugaucgaguaccugaugggcggcgccuacagaugcaacuacaccagaaagagauucagaacccuguaccacaaccuguucggccccaagagacccaaggcccugaagcugcugggcauggaggacgacaucccccugagaagaggcagaaagaccaccaagaagagagaggaggagguggacaucgaccuggacgaccccgagaucaaccacuuccccuuccccuuccacgagcugauggugugggccgugcugaugaagagacagaagauggcccuguucuucuggcagcacggcgaggaggccauggccaaggcccugguggccugcaagcugugcaaggccauggcccacgaggccagcgagaacgacaugguggacgacaucagccaggagcugaaccacaacagcagagacuucggccagcuggccguggagcugcuggaccagagcuacaagcaggacgagcagcuggccaugaagcugcugaccuacgagcugaagaacuggagcaacgccaccugccugcagcuggccguggccgccaagcacagagacuucaucgcccacaccugcagccagaugcugcugaccgacauguggaugggcagacugagaaugagaaagaacagcggccugaaggugauccugggcauccugcugccccccagcauccugagccuggaguucaagaacaaggacgacaugcccuacaugagccaggcccaggagauccaccugcaggagaaggaggccgaggagcccgagaagcccaccaaggagaaggaggaggaggacauggagcugaccgccaugcugggcagaaacaacggcgagagcagcagaaagaaggacgaggaggaggugcagagcaagcacagacugaucccccugggcagaaagaucuacgaguucuacaacgcccccaucgugaaguucugguucuacacccuggccuacaucggcuaccugaugcuguucaacuacaucgugcuggugaagauggagagauggcccagcacccaggaguggaucgugaucagcuacaucuucacccugggcaucgagaagaugagagagauccugaugagcgagcccggcaagcugcugcagaaggugaagguguggcugcaggaguacuggaacgugaccgaccugaucgccauccugcuguucagcgugggcaugauccugagacugcaggaccagcccuucagaagcgacggcagagugaucuacugcgugaacaucaucuacugguacaucagacugcuggacaucuucggcgugaacaaguaccugggccccuacgugaugaugaucggcaagaugaugaucgacaugauguacuucgugaucaucaugcugguggugcugaugagcuucggcguggccagacaggccauccuguuccccaacgaggagcccagcuggaagcuggccaagaacaucuucuacaugcccuacuggaugaucuacggcgagguguucgccgaccagaucgacccccccugcggccagaacgagaccagagaggacggcaagaucauccagcugccccccugcaagaccggcgccuggaucgugcccgccaucauggccugcuaccugcugguggccaacauccugcuggugaaccugcugaucgccguguucaacaacaccuucuucgaggugaagagcaucagcaaccagguguggaaguuccagagauaccagcugaucaugaccuuccacgagagacccgugcugccccccccccugaucaucuucagccacaugaccaugaucuuccagcaccugugcugcagauggagaaagcacgagagcgaccccgacgagagagacuacggccugaagcuguucaucaccgacgacgagcugaagaaggugcacgacuucgaggagcagugcaucgaggaguacuucagagagaaggacgacagauucaacagcagcaacgacgagagaaucagagugaccagcgagagaguggagaacaugagcaugagacuggaggaggugaacgagagagagcacagcaugaaggccagccugcagaccguggacaucagacuggcccagcuggaggaccugaucggcagaauggccaccgcccuggagagacugaccggccuggagagagccgagagcaacaagaucagaagcagaaccagcagcgacugcaccgacgccgccuacaucgugagacagagcagcuucaacagccaggagggcaacaccuucaagcugcaggagagcaucgaccccgccggcgaggagaccaugagccccaccagccccacccugaugcccagaaugagaagccacagcuucuacagcgugaacaugaaggacaagggcggcaucgagaagcuggagagcaucuucaaggagagaagccugagccugcacagagccaccagcagccacagcguggccaaggagcccaaggcccccgccgcccccgccaacacccuggccaucgugcccgacagcagaagacccagcagcugcaucgacaucuacgugagcgccauggacgagcugcacugcgacaucgacccccuggacaacagcgugaacauccugggccugggcgagcccagcuucagcacccccgugcccagcaccgcccccagcagcagcgccuacgccacccuggcccccaccgacagaccccccagcagaagcaucgacuucgaggacaucaccagcauggacaccagaagcuucagcagcgacuacacccaccugcccgagugccagaaccccugggacagcgagccccccauguaccacaccaucgagagaagcaagagcagcagauaccuggccaccacccccuuccugcuggaggaggcccccaucgugaagagccacagcuucauguucagccccagcagaagcuacuacgccaacuucggcgugcccgugaagaccgccgaguacaccagcaucaccgacugcaucgacaccagaugcgugaacgccccccaggccaucgccgacagagccgccuuccccggcggccugggcgacaagguggaggaccugaccugcugccaccccgagagagaggccgagcugagccaccccagcagcgacagcgaggagaacgaggccaagggcagaagagccaccaucgccaucagcagccaggagggcgacaacagcgagagaacccugagcaacaacaucaccgugcccaagaucgagagagccaacagcuacagcgccgaggagcccagcgcccccuacgcccacaccagaaagagcuucagcaucagcgacaagcuggacagacagagaaacaccgccagccugagaaaccccuuccagagaagcaagagcagcaagcccgagggcagaggcgacagccugagcaugagaagacugagcagaaccagcgccuuccagagcuucgagagcaagcacaacuaa

SEQ ID NO: 25093 - RNA, 3210 nt, Artificial Sequence
  TRPM4__Homo_sapiens__NP_001182156
augguggugcccgagaaggagcagagcuggauccccaagaucuucaagaagaagaccugcaccaccuucaucguggacagcaccgaccccggcggcacccugugccagugcggcagacccagaaccgcccaccccgccguggccauggaggacgccuucggcgccgccguggugaccgugugggacagcgacgcccacaccaccgagaagcccaccgacgccuacggcgagcuggacuucaccggcgccggcagaaagcacagcaacuuccugagacugagcgacagaaccgaccccgccgccguguacagccuggugaccagaaccuggggcuucagagcccccaaccugguggugagcgugcugggcggcagcggcggccccgugcugcagaccuggcugcaggaccugcugagaagaggccuggugagagccgcccagagcaccggcgccuggaucgugaccggcggccugcacaccggcaucggcagacacgugggcguggccgugagagaccaccagauggccagcaccggcggcaccaaggugguggccaugggcguggcccccuggggcguggugagaaacagagacacccugaucaaccccaagggcagcuuccccgccagauacagauggagaggcgaccccgaggacggcgugcaguucccccuggacuacaacuacagcgccuucuuccugguggacgacggcacccacggcugccugggcggcgagaacagauucagacugagacuggagagcuacaucagccagcagaagaccggcgugggcggcaccggcaucgacauccccgugcugcugcugcugaucgacggcgacgagaagaugcugaccagaaucgagaacgccacccaggcccagcugcccugccugcugguggccggcagcggcggcgccgccgacugccuggccgagacccuggaggacacccuggcccccggcagcggcggcgccagacagggcgaggccagagacagaaucagaagauucuuccccaagggcgaccuggaggugcugcaggcccagguggagagaaucaugaccagaaaggagcugcugaccguguacagcagcgaggacggcagcgaggaguucgagaccaucgugcugaaggcccuggugaaggccugcggcagcagcgaggccagcgccuaccuggacgagcugagacuggccguggccuggaacagaguggacaucgcccagagcgagcuguucagaggcgacauccaguggagaagcuuccaccuggaggccagccugauggacgcccugcugaacgacagacccgaguucgugagacugcugaucagccacggccugagccugggccacuuccugacccccaugagacuggcccagcuguacagcgccgcccccagcaacagccugaucagaaaccugcuggaccaggccagccacagcgccggcaccaaggcccccgcccugaagggcggcgccgccgagcugagaccccccgacgugggccacgugcugagaaugcugcugggcaagaugugcgcccccagauaccccagcggcggcgccugggacccccaccccggccagggcuucggcgagagcauguaccugcugagcgacaaggccaccagcccccugagccuggacgccggccugggccaggcccccuggagcgaccugcugcugugggcccugcugcugaacagagcccagauggccauguacuucugggagaugggcagcaacgccgugagcagcgcccugggcgccugccugcugcugagagugauggccagacuggagcccgacgccgaggaggccgccagaagaaaggaccuggccuucaaguucgagggcaugggcguggaccuguucggcgagugcuacagaagcagcgaggugagagccgccagacugcugcugagaagaugcccccuguggggcgacgccaccugccugcagcuggccaugcaggccgacgccagagccuucuucgcccaggacggcgugcagagccugcugacccagaagugguggggcgacauggccagcaccacccccaucugggcccuggugcuggccuucuucugccccccccugaucuacaccagacugaucaccuucagaaagagcgaggaggagcccaccagagaggagcuggaguucgacauggacagcgugaucaacggcgagggccccgugggccugacccccggccuguaccaccugggcagaaccgugcugugcaucgacuucaugguguucaccgugagacugcugcacaucuucaccgugaacaagcagcugggccccaagaucgugaucgugagcaagaugaugaaggacguguucuucuuccuguucuuccugggcguguggcugguggccuacggcguggccaccgagggccugcugagacccagagacagcgacuuccccagcauccugagaagaguguucuacagacccuaccugcagaucuucggccagaucccccaggaggacauggacguggcccugauggagcacagcaacugcagcagcgagcccggcuucugggcccacccccccggcgcccaggccggcaccugcgugagccaguacgccaacuggcugguggugcugcugcuggugaucuuccugcugguggccaacauccugcuggugaaccugcugaucgccauguucagcuacaccuucggcaaggugcagggcaacagcgaccuguacuggaaggcccagagauacagacugaucagagaguuccacagcagacccgcccuggccccccccuucaucgugaucagccaccugagacugcugcugagacagcugugcagaagacccagaagcccccagcccagcagccccgcccuggagcacuucagaguguaccugagcaaggaggccgagagaaagcugcugaccugggagagcgugcacaaggagaacuuccugcuggccagagccagagacaagagagagagcgacagcgagagacugaagagaaccagccagaagguggaccuggcccugaagcagcugggccacaucagagaguacgagcagagacugaaggugcuggagagagaggugcagcagugcagcagagugcugggcuggguggccgaggcccugagcagaagcgcccugcugccccccggcggcccccccccccccgaccugcccggcagcaaggacuaa

SEQ ID NO: 25094 - RNA, 3498 nt, Artificial Sequence
  TRPM5__Homo_sapiens__NP_055370
augcaggacgugcagggccccagacccggcagccccggcgacgccgaggacagaagagagcugggccugcacagaggcgaggugaacuucggcggcagcggcaagaagagaggcaaguucgugagagugcccagcggcguggcccccagcgugcuguucgaccugcugcuggccgaguggcaccugcccgcccccaaccugguggugagccuggugggcgaggagcagcccuucgccaugaagagcuggcugagagacgugcugagaaagggccuggugaaggccgcccagagcaccggcgccuggauccugaccagcgcccugagagugggccuggccagacacgugggccaggccgugagagaccacagccuggccagcaccagcaccaaggugagagugguggccgugggcauggccagccugggcagagugcugcacagaagaauccuggaggaggcccaggaggacuuccccgugcacuaccccgaggacgacggcggcagccagggcccccugugcagccuggacagcaaccugagccacuucauccugguggagcccggcccccccggcaagggcgacggccugaccgagcugagacugagacuggagaagcacaucagcgagcagagagccggcuacggcggcaccggcagcaucgagauccccgugcugugccugcuggugaacggcgaccccaacacccuggagagaaucagcagagccguggagcaggccgcccccuggcugauccuggugggcagcggcggcaucgccgacgugcuggccgcccuggugaaccagccccaccugcuggugcccaagguggccgagaagcaguucaaggagaaguuccccagcaagcacuucagcugggaggacaucgugagauggaccaagcugcugcagaacaucaccagccaccagcaccugcugaccguguacgacuucgagcaggagggcagcgaggagcuggacaccgugauccugaaggcccuggugaaggccugcaagagccacagccaggagccccaggacuaccuggacgagcugaagcuggccguggccugggacagaguggacaucgccaagagcgagaucuucaacggcgacguggaguggaagagcugcgaccuggaggaggugaugguggacgcccuggugagcaacaagcccgaguucgugagacuguucguggacaacggcgccgacguggccgacuuccugaccuacggcagacugcaggagcuguacagaagcgugagcagaaagagccugcuguucgaccugcugcagagaaagcaggaggaggccagacugacccuggccggccugggcacccagcaggccagagagccccccgccggcccccccgccuucagccugcacgaggugagcagagugcugaaggacuuccugcaggacgccugcagaggcuucuaccaggacggcagacccggcgacagaagaagagccgagaagggccccgccaagagacccaccggccagaaguggcugcuggaccugaaccagaagagcgagaaccccuggagagaccuguuccugugggccgugcugcagaacagacacgagauggccaccuacuucugggccaugggccaggagggcguggccgccgcccuggccgccugcaagauccugaaggagaugagccaccuggagaccgaggccgaggccgccagagccaccagagaggccaaguacgagagacuggcccuggaccuguucagcgagugcuacagcaacagcgaggccagagccuucgcccugcuggugagaagaaacagaugcuggagcaagaccaccugccugcaccuggccaccgaggccgacgccaaggccuucuucgcccacgacggcgugcaggccuuccugaccagaaucugguggggcgacauggccgccggcacccccauccugagacugcugggcgccuuccugugccccgcccugguguacaccaaccugaucaccuucagcgaggaggccccccugagaaccggccuggaggaccugcaggaccuggacagccuggacaccgagaagagcccccuguacggccugcagagcagaguggaggagcugguggaggcccccagagcccagggcgacagaggccccagagccguguuccugcugaccagauggagaaaguucuggggcgcccccgugaccguguuccugggcaacguggugauguacuucgccuuccuguuccuguucaccuacgugcugcugguggacuucagaccccccccccagggccccagcggccccgaggugacccuguacuucuggguguucacccuggugcuggaggagaucagacagggcuucuucaccgacgaggacacccaccuggugaagaaguucacccuguacgugggcgacaacuggaacaagugcgacaugguggccaucuuccuguucaucgugggcgugaccugcagaaugcugcccagcgccuucgaggccggcagaaccgugcuggccauggacuucaugguguucacccugagacugauccacaucuucgccauccacaagcagcugggccccaagaucaucgugguggagagaaugaugaaggacguguucuucuuccuguucuuccugagcguguggcugguggccuacggcgugaccacccaggcccugcugcacccccacgacggcagacuggaguggaucuucagaagagugcuguacagacccuaccugcagaucuucggccagaucccccuggacgagaucgacgaggccagagugaacugcagcacccacccccugcugcuggaggacagccccagcugccccagccuguacgccaacuggcuggugauccugcugcuggugaccuuccugcuggugaccaacgugcugcugaugaaccugcugaucgccauguucagcuacaccuuccagguggugcagggcaacgccgacauguucuggaaguuccagagauacaaccugaucguggaguaccacgagagacccgcccuggccccccccuucauccugcugagccaccugagccugacccugagaagaguguucaagaaggaggccgagcacaagagagagcaccuggagagagaccugcccgacccccuggaccagaagguggugaccugggagaccgugcagaaggagaacuuccugagcaagauggagaagagaagaagagacagcgagggcgaggugcugagaaagaccgcccacagaguggacuucaucgccaaguaccugggcggccugagagagcaggagaagagaaucaagugccuggagagccagaucaacuacugcagcgugcuggugagcagcguggccgacgugcuggcccagggcggcggccccagaagcagccagcacugcggcgagggcagccagcugguggccgccgaccacagaggcggccuggacggcugggagcagcccggcgccggccagccccccagcgacaccuaa

SEQ ID NO: 25095 - RNA, 6054 nt, Artificial Sequence
  TRPM6__Homo_sapiens__NP_001170781
augaucauccugagcaagagccagaagagcuggaucaagggcguguucgacaagagagagugcagcaccaucauccccagcagcaagaacccccacagaugcacccccgugugccaggugugccagaaccugaucagaugcuacugcggcagacugaucggcgaccacgccggcaucgacuacagcuggaccaucagcgccgccaagggcaaggagagcgagcaguggagcguggagaagcacaccaccaagagccccaccgacaccuucggcaccaucaacuuccaggacggcgagcacacccaccacgccaaguacaucagaaccagcuacgacaccaagcuggaccaccugcugcaccugaugcugaaggaguggaagauggagcugcccaagcuggugaucagcgugcacggcggcauccagaacuucaccaugcccagcaaguucaaggagaucuucagccagggccuggugaaggccgccgagaccaccggcgccuggaucaucaccgagggcaucaacaccggcgugagcaagcacgugggcgacgcccugaagagccacagcagccacagccugagaaagaucuggaccgugggcaucccccccuggggcgugaucgagaaccagagagaccugaucggcaaggacguggugugccuguaccagacccuggacaacccccugagcaagcugaccacccugaacagcaugcacagccacuucauccugagcgacgacggcaccgugggcaaguacggcaacgagaugaagcugagaagaaaccuggagaaguaccugagccugcagaagauccacugcagaagcagacagggcgugcccguggugggccuggugguggagggcggccccaacgugauccugagcgugugggagaccgugaaggacaaggaccccgugguggugugcgagggcaccggcagagccgccgaccugcuggccuucacccacaagcaccuggccgacgagggcaugcugagaccccaggugaaggaggagaucaucugcaugauccagaacaccuucaacuucagccugaagcagagcaagcaccuguuccagauccugauggagugcauggugcacagagacugcaucaccaucuucgacgccgacagcgaggagcagcaggaccuggaccuggccauccugaccgcccugcugaagggcaccaaccugagcgccagcgagcagcugaaccuggccauggccugggacagaguggacaucgccaagaagcacauccugaucuacgagcagcacuggaagcccgacgcccuggagcaggccaugagcgacgcccuggugauggacagaguggacuucgugaagcugcugaucgaguacggcgugaaccugcacagauuccugaccauccccagacuggaggagcuguacaacaccaagcagggccccaccaacacccugcugcaccaccuggugcaggacgugaagcagcacacccugcugagcggcuacagaaucacccugaucgacaucggccuggugguggaguaccugaucggcagagccuacagaagcaacuacaccagaaagcacuucagagcccuguacaacaaccuguacagaaaguacaagcaccagagacacagcagcggcaacagaaacgagagcgccgagagcacccugcacagccaguucaucagaaccgcccagcccuacaaguucaaggagaagagcaucgugcugcacaagagcagaaagaagagcaaggagcagaacgugagcgacgaccccgagagcaccggcuuccuguaccccuacaacgaccugcuggugugggccgugcugaugaagagacagaagauggccauguucuucuggcagcacggcgaggaggccaccgugaaggccgugaucgccugcauccuguacagagccauggcccacgaggccaaggagagccacaugguggacgacgccagcgaggagcugaagaacuacagcaagcaguucggccagcuggcccuggaccugcuggagaaggccuucaagcagaacgagagaauggccaugacccugcugaccuacgagcugagaaacuggagcaacagcaccugccugaagcuggccgugagcggcggccugagacccuucgugagccacaccugcacccagaugcugcugaccgacauguggaugggcagacugaagaugagaaagaacagcuggcugaagaucaucaucagcaucauccugccccccaccauccugacccuggaguucaagagcaaggccgagaugagccacgugccccagagccaggacuuccaguucaugugguacuacagcgaccagaacgccagcagcagcaaggagagcgccagcgugaaggaguacgaccuggagagaggccacgacgagaagcuggacgagaaccagcacuucggccuggagagcggccaccagcaccugcccuggaccagaaagguguacgaguucuacagcgcccccaucgugaaguucugguucuacaccauggccuaccuggccuuccugaugcuguucaccuacaccgugcugguggagaugcagccccagcccagcgugcaggaguggcuggugagcaucuacaucuucaccaacgccaucgagguggugagagagaucugcaucagcgagcccggcaaguucacccagaaggugaagguguggaucagcgaguacuggaaccugaccgagaccguggccaucggccuguucagcgccggcuucgugcugagauggggcgacccccccuuccacaccgccggcagacugaucuacugcaucgacaucaucuucugguucagcagacugcuggacuucuucgccgugaaccagcacgccggccccuacgugaccaugaucgccaagaugaccgccaacauguucuacaucgugaucaucauggccaucgugcugcugagcuucggcguggccagaaaggccauccugagccccaaggagccccccagcuggagccuggccagagacaucguguucgagcccuacuggaugaucuacggcgagguguacgccggcgagaucgacgugugcagcagccagcccagcugcccccccggcagcuuccugacccccuuccugcaggccguguaccuguucgugcaguacaucaucauggugaaccugcugaucgccuucuucaacaacguguaccuggacauggagagcaucagcaacaaccuguggaaguacaacagauacagauacaucaugaccuaccacgagaagcccuggcugccccccccccugauccugcugagccacgugggccugcugcugagaagacugugcugccacagagccccccacgaccaggaggagggcgacgugggccugaagcuguaccugagcaaggaggaccugaagaagcugcacgacuucgaggagcagugcguggagaaguacuuccacgagaagauggaggacgugaacugcagcugcgaggagagaaucagagugaccagcgagagagugaccgagauguacuuccagcugaaggagaugaacgagaaggugagcuucaucaaggacagccugcugagccuggacagccaggugggccaccugcaggaccugagcgcccugaccguggacacccugaaggugcugagcgccguggacacccugcaggaggacgaggcccugcuggccaagagaaagcacagcaccugcaagaagcugccccacagcuggagcaacgugaucugcgccgaggugcugggcagcauggagaucgccggcgagaagaaguaccaguacuacagcaugcccagcagccugcugagaagccuggccggcggcagacacccccccagagugcagagaggcgcccugcuggagaucaccaacagcaagagagaggccaccaacgugagaaacgaccaggagagacaggagacccagagcagcaucguggugagcggcgugagccccaacagacaggcccacagcaaguacggccaguuccugcuggugcccagcaaccugaagagagugcccuucagcgccgagaccgugcugccccugagcagacccagcgugcccgacgugcuggccaccgagcaggacauccagaccgaggugcuggugcaccugaccggccagacccccguggugagcgacugggccagcguggacgagcccaaggagaagcacgagcccaucgcccaccugcuggacggccaggacaaggccgagcaggugcugcccacccugagcugcacccccgagcccaugaccaugagcagcccccugagccaggccaagaucaugcagaccggcggcggcuacgugaacugggccuucagcgagggcgacgagaccggcguguucagcaucaagaagaaguggcagaccugccugcccagcaccugcgacagcgacagcagcagaagcgagcagcaccagaagcaggcccaggacagcagccugagcgacaacagcaccagaagcgcccagagcagcgagugcagcgaggugggccccuggcugcagcccaacaccagcuucuggaucaacccccugagaagauacagacccuucgccagaagccacagcuucagauuccacaaggaggagaagcugaugaagaucugcaagaucaagaaccugagcggcagcagcgagaucggccagggcgccugggugaaggccaagaugcugaccaaggacagaagacugagcaagaagaagaagaacacccagggccugcaggugcccaucaucaccgugaacgccugcagccagagcgaccagcugaaccccgagcccggcgagaacagcaucagcgaggaggaguacagcaagaacugguucaccgugagcaaguucagccacaccggcguggagcccuacauccaccagaagaugaagaccaaggagaucggccagugcgccauccagaucagcgacuaccugaagcagagccaggaggaccugagcaagaacagccuguggaacagcagaagcaccaaccugaacagaaacagccugcugaagagcagcaucggcguggacaagaucagcgccagccugaagagcccccaggagccccaccaccacuacagcgccaucgagagaaacaaccugaugagacugagccagaccauccccuucacccccgugcagcuguucgccggcgaggagaucaccguguacagacuggaggagagcagcccccugaaccuggacaagagcaugagcagcuggagccagagaggcagagccgccaugauccaggugcugagcagagaggagauggacggcggccugagaaaggccaugagaguggugagcaccuggagcgaggacgacauccugaagcccggccagguguucaucgugaagagcuuccugcccgagguggugagaaccuggcacaagaucuuccaggagagcaccgugcugcaccugugccugagagagauccagcagcagagagccgcccagaagcugaucuacaccuucaaccaggugaagccccagaccauccccuacacccccagauuccuggagguguuccugaucuacugccacagcgccaaccaguggcugaccaucgagaaguacaugaccggcgaguucagaaaguacaacaacaacaacggcgacgagaucacccccaccaacacccuggaggagcugaugcuggccuucagccacuggaccuacgaguacaccagaggcgagcugcuggugcuggaccugcagggcgugggcgagaaccugaccgaccccagcgugaucaagcccgaggugaagcagagcagaggcaugguguucggccccgccaaccugggcgaggacgccaucagaaacuucaucgccaagcaccacugcaacagcugcugcagaaagcugaagcugcccgaccugaagagaaacgacuacagccccgagagaaucaacagcaccuucggccuggagaucaagaucgagagcgccgaggagccccccgccagagagaccggcagaaacagccccgaggacgacaugcagcuguaa

SEQ ID NO: 25096 - RNA, 5598 nt, Artificial Sequence
  TRPM7__Homo_sapiens__NP_060142
augagccagaagagcuggaucgagagcacccugaccaagagagagugcguguacaucauccccagcagcaaggacccccacagaugccugcccggcugccagaucugccagcagcuggugagaugcuucugcggcagacuggugaagcagcacgccugcuucaccgccagccuggccaugaaguacagcgacgugaagcugggcgaccacuucaaccaggccaucgaggaguggagcguggagaagcacaccgagcagagccccaccgacgccuacggcgugaucaacuuccagggcggcagccacagcuacagagccaaguacgugagacugagcuacgacaccaagcccgaggugauccugcagcugcugcugaaggaguggcagauggagcugcccaagcuggugaucagcgugcacggcggcaugcagaaguucgagcugcaccccagaaucaagcagcugcugggcaagggccugaucaaggccgccgugaccaccggcgccuggauccugaccggcggcgugaacaccggcguggccaagcacgugggcgacgcccugaaggagcacgccagcagaagcagcagaaagaucugcaccaucggcaucgcccccuggggcgugaucgagaacagaaacgaccuggugggcagagacgugguggcccccuaccagacccugcugaacccccugagcaagcugaacgugcugaacaaccugcacagccacuucauccugguggacgacggcaccgugggcaaguacggcgccgaggugagacugagaagagagcuggagaagaccaucaaccagcagagaauccacgccagaaucggccagggcgugcccgugguggcccugaucuucgagggcggccccaacgugauccugaccgugcuggaguaccugcaggagagcccccccgugcccgugguggugugcgagggcaccggcagagccgccgaccugcuggccuacauccacaagcagaccgaggagggcggcaaccugcccgacgccgccgagcccgacaucaucagcaccaucaagaagaccuucaacuucggccagaacgaggcccugcaccuguuccagacccugauggagugcaugaagagaaaggagcugaucaccguguuccacaucggcagcgacgagcaccaggacaucgacguggccauccugaccgcccugcugaagggcaccaacgccagcgccuucgaccagcugauccugacccuggccugggacagaguggacaucgccaagaaccacguguucguguacggccagcaguggcuggugggcagccuggagcaggccaugcuggacgcccuggugauggacagaguggccuucgugaagcugcugaucgagaacggcgugagcaugcacaaguuccugaccauccccagacuggaggagcuguacaacaccaagcagggccccaccaaccccaugcuguuccaccuggugagagacgugaagcagggcaaccugccccccggcuacaagaucacccugaucgacaucggccuggugaucgaguaccugaugggcggcaccuacagaugcaccuacaccagaaagagauucagacugaucuacaacagccugggcggcaacaacagaagaagcggcagaaacaccagcagcagcaccccccagcugagaaagagccacgagagcuucggcaacagagccgacaagaaggagaagaugagacacaaccacuucaucaagaccgcccagcccuacagacccaagaucgacaccgugauggaggagggcaagaagaagagaaccaaggacgagaucguggacaucgacgaccccgagaccaagagauuccccuacccccugaacgagcugcugaucugggccugccugaugaagagacaggugauggccagauuccuguggcagcacggcgaggagagcauggccaaggcccugguggccugcaagaucuacagaagcauggccuacgaggccaagcagagcgaccugguggacgacaccagcgaggagcugaagcaguacagcaacgacuucggccagcuggccguggagcugcuggagcagagcuucagacaggacgagaccauggccaugaagcugcugaccuacgagcugaagaacuggagcaacagcaccugccugaagcuggccgugagcagcagacugagacccuucguggcccacaccugcacccagaugcugcugagcgacauguggaugggcagacugaacaugagaaagaacagcugguacaaggugauccugagcauccuggugccccccgccauccugcugcuggaguacaagaccaaggccgagaugagccacaucccccagagccaggacgcccaccagaugaccauggacgacagcgagaacaacuuccagaacaucaccgaggagauccccauggagguguucaaggaggugagaauccuggacagcaacgagggcaagaacgagauggagauccagaugaagagcaagaagcugcccaucaccagaaaguucuacgccuucuaccacgcccccaucgugaaguucugguucaacacccuggccuaccugggcuuccugaugcuguacaccuucguggugcuggugcagauggagcagcugcccagcgugcaggaguggaucgugaucgccuacaucuucaccuacgccaucgagaaggugagagagaucuucaugagcgaggccggcaaggugaaccagaagaucaaggugugguucagcgacuacuucaacaucagcgacaccaucgccaucaucagcuucuucaucggcuucggccugagauucggcgccaaguggaacuucgccaacgccuacgacaaccacguguucguggccggcagacugaucuacugccugaacaucaucuucugguacgugagacugcuggacuuccuggccgugaaccagcaggccggccccuacgugaugaugaucggcaagaugguggccaacauguucuacaucguggugaucauggcccuggugcugcugagcuucggcgugcccagaaaggccauccuguacccccacgaggcccccagcuggacccuggccaaggacaucguguuccaccccuacuggaugaucuucggcgagguguacgccuacgagaucgacgugugcgccaacgacagcgugaucccccagaucugcggccccggcaccuggcugacccccuuccugcaggccguguaccuguucgugcaguacaucaucauggugaaccugcugaucgccuucuucaacaacguguaccugcaggugaaggccaucagcaacaucguguggaaguaccagagauaccacuucaucauggccuaccacgagaagcccgugcugccccccccccugaucauccugagccacaucgugagccuguucugcugcaucugcaagagaagaaagaaggacaagaccagcgacggccccaagcuguuccugaccgaggaggaccagaagaagcugcacgacuucgaggagcagugcguggagauguacuucaacgagaaggacgacaaguuccacagcggcagcgaggagagaaucagagugaccuucgagagaguggagcagaugugcauccagaucaaggaggugggcgacagagugaacuacaucaagagaagccugcagagccuggacagccagaucggccaccugcaggaccugagcgcccugaccguggacacccugaagacccugaccgcccagaaggccagcgaggccagcaaggugcacaacgagaucaccagagagcugagcaucagcaagcaccuggcccagaaccugaucgacgacggccccgugagacccagcguguggaagaagcacggcguggugaacacccugagcagcagccugccccagggcgaccuggagagcaacaaccccuuccacugcaacauccugaugaaggacgacaaggacccccagugcaacaucuucggccaggaccugcccgccgugccccagagaaaggaguucaacuuccccgaggccggcagcagcagcggcgcccuguuccccagcgccgugagcccccccgagcugagacagagacugcacggcguggagcugcugaagaucuucaacaagaaccagaagcugggcagcagcagcaccagcaucccccaccugagcagcccccccaccaaguucuucgugagcacccccagccagcccagcugcaagagccaccuggagaccggcaccaaggaccaggagaccgugugcagcaaggccaccgagggcgacaacaccgaguucggcgccuucgugggccacagagacagcauggaccugcagagauucaaggagaccagcaacaagaucaagauccugagcaacaacaacaccagcgagaacacccugaagagagugagcagccuggccggcuucaccgacugccacagaaccagcauccccgugcacagcaagcaggccgagaagaucagcagaagacccagcaccgaggacacccacgagguggacagcaaggccgcccugauccccgacuggcugcaggacagacccagcaacagagagaugcccagcgaggagggcacccugaacggccugaccagccccuucaagcccgccauggacaccaacuacuacuacagcgccguggagagaaacaaccugaugagacugagccagagcauccccuucacccccgugccccccagaggcgagcccgugaccguguacagacuggaggagagcagccccaacauccugaacaacagcaugagcagcuggagccagcugggccugugcgccaagaucgaguuccugagcaaggaggagaugggcggcggccugagaagagccgugaaggugcagugcaccuggagcgagcacgacauccugaagagcggccaccuguacaucaucaagagcuuccugcccgagguggugaacaccuggagcagcaucuacaaggaggacaccgugcugcaccugugccugagagagauccagcagcagagagccgcccagaagcugaccuucgccuucaaccagaugaagcccaagagcauccccuacagccccagauuccuggagguguuccugcuguacugccacagcgccggccagugguucgccguggaggagugcaugaccggcgaguucagaaaguacaacaacaacaacggcgacgagaucauccccaccaacacccuggaggagaucaugcuggccuucagccacuggaccuacgaguacaccagaggcgagcugcuggugcuggaccugcagggcgugggcgagaaccugaccgaccccagcgugaucaaggccgaggagaagagaagcugcgacaugguguucggccccgccaaccugggcgaggacgccaucaagaacuucagagccaagcaccacugcaacagcugcugcagaaagcugaagcugcccgaccugaagagaaacgacuacacccccgacaagaucaucuucccccaggacgagcccagcgaccugaaccugcagcccggcaacagcaccaaggagagcgagagcaccaacagcgugagacugaugcuguaa

SEQ ID NO: 25097 - RNA, 3315 nt, Artificial Sequence
  TRPM8__Homo_sapiens__NP_076985
augagcuucagagccgccagacugagcaugagaaacagaagaaacgacacccuggacagcaccagaacccuguacagcagcgccagcagaagcaccgaccugagcuacagcgagagcgaccuggugaacuucauccaggccaacuucaagaagagagagugcguguucuucaccaaggacagcaaggccaccgagaacgugugcaagugcggcuacgcccagagccagcacauggagggcacccagaucaaccagagcgagaaguggaacuacaagaagcacaccaaggaguuccccaccgacgccuucggcgacauccaguucgagacccugggcaagaagggcaaguacaucagacugagcugcgacaccgacgccgagauccuguacgagcugcugacccagcacuggcaccugaagacccccaaccuggugaucagcgugaccggcggcgccaagaacuucgcccugaagcccagaaugagaaagaucuucagcagacugaucuacaucgcccagagcaagggcgccuggauccugaccggcggcacccacuacggccugaugaaguacaucggcgagguggugagagacaacaccaucagcagaagcagcgaggagaacaucguggccaucggcaucgccgccuggggcauggugagcaacagagacacccugaucagaaacugcgacgccgagggcuacuuccuggcccaguaccugauggacgacuucaccagagacccccuguacauccuggacaacaaccacacccaccugcugcugguggacaacggcugccacggccaccccaccguggaggccaagcugagaaaccagcuggagaaguacaucagcgagagaaccauccaggacagcaacuacggcggcaagauccccaucgugugcuucgcccagggcggcggcaaggagacccugaaggccaucaacaccagcaucaagaacaagauccccugcguggugguggagggcagcggccagaucgccgacgugaucgccagccugguggagguggaggacgcccugaccagcagcgccgugaaggagaagcuggugagauuccugcccagaaccgugagcagacugcccgaggaggagaccgagagcuggaucaaguggcugaaggagauccuggagugcagccaccugcugaccgugaucaagauggaggaggccggcgacgagaucgugagcaacgccaucagcuacgcccuguacaaggccuucagcaccagcgagcaggacaaggacaacuggaacggccagcugaagcugcugcuggaguggaaccagcuggaccuggccaacgacgagaucuucaccaacgacagaagaugggagagcgccgaccugcaggaggugauguucaccgcccugaucaaggacagacccaaguucgugagacuguuccuggagaacggccugaaccugagaaaguuccugacccacgacgugcugaccgagcuguucagcaaccacuucagcacccugguguacagaaaccugcagaucgccaagaacagcuacaacgacgcccugcugaccuucguguggaagcugguggccaacuucagaagaggcuucagaaaggaggacagaaacggcagagacgagauggacaucgagcugcacgacgugagccccaucaccagacacccccugcaggcccuguucaucugggccauccugcagaacaagaaggagcugagcaaggugaucugggagcagaccagaggcugcacccuggccgcccugggcgccagcaagcugcugaagacccuggccaaggugaagaacgacaucaacgccgccggcgagagcgaggagcuggccaacgaguacgagaccagagccguggagcuguucaccgagugcuacagcagcgacgaggaccuggccgagcagcugcugguguacagcugcgaggccuggggcggcagcaacugccuggagcuggccguggaggccaccgaccagcacuucaucgcccagcccggcgugcagaacuuccugagcaagcagugguacggcgagaucagcagagacaccaagaacuggaagaucauccugugccuguucaucaucccccuggugggcugcggcuucgugagcuucagaaagaagcccguggacaagcacaagaagcugcugugguacuacguggccuucuucaccagccccuucgugguguucagcuggaacgugguguucuacaucgccuuccugcugcuguucgccuacgugcugcugauggacuuccacagcgugccccacccccccgagcuggugcuguacagccugguguucgugcuguucugcgacgaggugagacagugguacgugaacggcgugaacuacuucaccgaccuguggaacgugauggacacccugggccuguucuacuucaucgccggcaucguguucagacugcacagcagcaacaagagcagccuguacagcggcagagugaucuucugccuggacuacaucaucuucacccugagacugauccacaucuucaccgugagcagaaaccugggccccaagaucaucaugcugcagagaaugcugaucgacguguucuucuuccuguuccuguucgccguguggaugguggccuucggcguggccagacagggcauccugagacagaacgagcagagauggagauggaucuucagaagcgugaucuacgagcccuaccuggccauguucggccaggugcccagcgacguggacggcaccaccuacgacuucgcccacugcaccuucaccggcaacgagagcaagccccugugcguggagcuggacgagcacaaccugcccagauuccccgaguggaucaccaucccccuggugugcaucuacaugcugagcaccaacauccugcuggugaaccugcugguggccauguucggcuacaccgugggcaccgugcaggagaacaacgaccagguguggaaguuccagagauacuuccuggugcaggaguacugcagcagacugaacauccccuuccccuucaucguguucgccuacuucuacaugguggugaagaagugcuucaagugcugcugcaaggagaagaacauggagagcagcgugugcugcuucaagaacgaggacaacgagacccuggccugggagggcgugaugaaggagaacuaccuggugaagaucaacaccaaggccaacgacaccagcgaggagaugagacacagauucagacagcuggacaccaagcugaacgaccugaagggccugcugaaggagaucgccaacaagaucaaguaa

SEQ ID NO: 25098 - RNA, 3858 nt, Artificial Sequence
  TRPS1__Homo_sapiens__NP_001269831
augcagagcaacauggugagaaagaagaaccccccccugagaaacguggccagcgagggcgagggccagauccuggagcccaucggcaccgagagcaaggugagcggcaagaacaaggaguucagcgccgaccagaugagcgagaacaccgaccagagcgacgccgccgagcugaaccacaaggaggagcacagccugcacgugcaggaccccagcagcagcagcaagaaggaccugaagagcgccgugcugagcgagaaggccggcuucaacuacgagagccccagcaagggcggcaacuuccccagcuucccccacgacgaggugaccgacagaaacaugcuggccuucagcagccccgccgccggcggcgugugcgagccccugaagagcccccagagagccgaggccgacgacccccaggacauggccugcacccccagcggcgacagccuggagaccaaggaggaccagaagaugagccccaaggccaccgaggagaccggccaggcccagagcggccaggccaacugccagggccugagccccgugagcguggccagcaagaacccccaggugcccagcgacggcggcgugagacugaacaagagcaagaccgaccugcuggugaacgacaaccccgaccccgccccccugagccccgagcugcaggacuucaagugcaacaucugcggcuacggcuacuacggcaacgaccccaccgaccugaucaagcacuucagaaaguaccaccugggccugcacaacagaaccagacaggacgccgagcuggacagcaagauccuggcccugcacaacauggugcaguucagccacagcaaggacuuccagaaggugaacagaagcguguucagcggcgugcugcaggacaucaacagcagcagacccgugcugcugaacggcaccuacgacgugcaggugaccagcggcggcaccuucaucggcaucggcagaaagacccccgacugccagggcaacaccaaguacuucagaugcaaguucugcaacuucaccuacaugggcaacagcagcaccgagcuggagcagcacuuccugcagacccaccccaacaagaucaaggccagccugcccagcagcgagguggccaagcccagcgagaagaacagcaacaagagcauccccgcccugcagagcagcgacagcggcgaccugggcaaguggcaggacaagaucaccgugaaggccggcgacgacacccccgugggcuacagcgugcccaucaagccccuggacagcagcagacagaacggcaccgaggccaccagcuacuacuggugcaaguucugcagcuucagcugcgagagcagcagcagccugaagcugcuggagcacuacggcaagcagcacggcgccgugcagagcggcggccugaaccccgagcugaacgacaagcugagcagaggcagcgugaucaaccagaacgaccuggccaagagcagcgagggcgagaccaugaccaagaccgacaagagcagcagcggcgccaagaagaaggacuucagcagcaagggcgccgaggacaacauggugaccagcuacaacugccaguucugcgacuucagauacagcaagagccacggccccgacgugaucguggugggcccccugcugagacacuaccagcagcugcacaacauccacaagugcaccaucaagcacugccccuucugccccagaggccugugcagccccgagaagcaccugggcgagaucaccuaccccuucgccugcagaaagagcaacugcagccacugcgcccugcugcugcugcaccugagccccggcgccgccggcagcagcagagugaagcaccagugccaccagugcagcuucaccacccccgacguggacgugcugcuguuccacuacgagagcgugcacgagagccaggccagcgacgugaagcaggaggccaaccaccugcagggcagcgacggccagcagagcgugaaggagagcaaggagcacagcugcaccaagugcgacuucaucacccagguggaggaggagaucagcagacacuacagaagagcccacagcugcuacaagugcagacagugcagcuucaccgccgccgacacccagagccugcuggagcacuucaacaccgugcacugccaggagcaggacaucaccaccgccaacggcgaggaggacggccacgccaucagcaccaucaaggaggagcccaagaucgacuucagaguguacaaccugcugacccccgacagcaagaugggcgagcccgugagcgagagcguggugaagagagagaagcuggaggagaaggacggccugaaggagaagguguggaccgagagcagcagcgacgaccugagaaacgugaccuggagaggcgccgacauccugagaggcagccccagcuacacccaggccagccugggccugcugacccccgugagcggcacccaggagcagaccaagacccugagagacagccccaacguggaggccgcccaccuggccagacccaucuacggccuggccguggagaccaagggcuuccugcagggcgcccccgccggcggcgagaagagcggcgcccugccccagcaguaccccgccagcggcgagaacaagagcaaggacgagagccagagccugcugagaagaagaagaggcagcggcguguucugcgccaacugccugaccaccaagaccagccuguggagaaagaacgccaacggcggcuacgugugcaacgccugcggccuguaccagaagcugcacagcacccccagaccccugaacaucaucaagcagaacaacggcgagcagaucaucagaagaagaaccagaaagagacugaaccccgaggcccugcaggccgagcagcugaacaagcagcagagaggcagcaacgaggagcaggugaacggcagcccccuggagagaagaagcgaggaccaccugaccgagagccaccagagagagaucccccugcccagccugagcaaguacgaggcccagggcagccugaccaagagccacagcgcccagcagcccgugcuggugagccagacccuggacauccacaagagaaugcagccccugcacauccagaucaagagcccccaggagagcaccggcgaccccggcaacagcagcagcgugagcgagggcaagggcagcagcgagagaggcagccccaucgagaaguacaugagacccgccaagcaccccaacuacagcccccccggcagccccaucgagaaguaccaguacccccuguucggccugcccuucgugcacaacgacuuccagagcgaggccgacuggcugagauucuggagcaaguacaagcugagcgugcccggcaacccccacuaccugagccacgugcccggccugcccaaccccugccagaacuacgugcccuaccccaccuucaaccugcccccccacuucagcgccgugggcagcgacaacgacaucccccuggaccuggccaucaagcacagcagacccggccccaccgccaacggcgccagcaaggagaagaccaaggccccccccaacgugaagaacgagggcccccugaacguggugaagaccgagaagguggacagaagcacccaggacgagcugagcaccaagugcgugcacugcggcaucguguuccuggacgaggugauguacgcccugcacaugagcugccacggcgacagcggccccuuccagugcagcaucugccagcaccugugcaccgacaaguacgacuucaccacccacauccagagaggccugcacagaaacaacgcccagguggagaagaacggcaagcccaaggaguaa

SEQ ID NO: 25099 - RNA, 2520 nt, Artificial Sequence
  TRPV1__Homo_sapiens__NP_542437
augaagaaguggagcagcaccgaccugggcgccgccgccgacccccugcagaaggacaccugccccgacccccuggacggcgaccccaacagcagacccccccccgccaagccccagcugagcaccgccaagagcagaaccagacuguucggcaagggcgacagcgaggaggccuuccccguggacugcccccacgaggagggcgagcuggacagcugccccaccaucaccgugagccccgugaucaccauccagagacccggcgacggccccaccggcgccagacugcugagccaggacagcguggccgccagcaccgagaagacccugagacuguacgacagaagaagcaucuucgaggccguggcccagaacaacugccaggaccuggagagccugcugcuguuccugcagaagagcaagaagcaccugaccgacaacgaguucaaggaccccgagaccggcaagaccugccugcugaaggccaugcugaaccugcacgacggccagaacaccaccaucccccugcugcuggagaucgccagacagaccgacagccugaaggagcuggugaacgccagcuacaccgacagcuacuacaagggccagaccgcccugcacaucgccaucgagagaagaaacauggcccuggugacccugcugguggagaacggcgccgacgugcaggccgccgcccacggcgacuucuucaagaagaccaagggcagacccggcuucuacuucggcgagcugccccugagccuggccgccugcaccaaccagcugggcaucgugaaguuccugcugcagaacagcuggcagaccgccgacaucagcgccagagacagcgugggcaacaccgugcugcacgcccugguggagguggccgacaacaccgccgacaacaccaaguucgugaccagcauguacaacgagauccugaugcugggcgccaagcugcaccccacccugaagcuggaggagcugaccaacaagaagggcaugaccccccuggcccuggccgccggcaccggcaagaucggcgugcuggccuacauccugcagagagagauccaggagcccgagugcagacaccugagcagaaaguucaccgagugggccuacggccccgugcacagcagccuguacgaccugagcugcaucgacaccugcgagaagaacagcgugcuggaggugaucgccuacagcagcagcgagacccccaacagacacgacaugcugcugguggagccccugaacagacugcugcaggacaagugggacagauucgugaagagaaucuucuacuucaacuuccugguguacugccuguacaugaucaucuucaccauggccgccuacuacagacccguggacggccugccccccuucaagauggagaagaccggcgacuacuucagagugaccggcgagauccugagcgugcugggcggcguguacuucuucuucagaggcauccaguacuuccugcagagaagacccagcaugaagacccuguucguggacagcuacagcgagaugcuguucuuccugcagagccuguucaugcuggccaccguggugcuguacuucagccaccugaaggaguacguggccagcaugguguucagccuggcccugggcuggaccaacaugcuguacuacaccagaggcuuccagcagaugggcaucuacgccgugaugaucgagaagaugauccugagagaccugugcagauucauguucguguacaucguguuccuguucggcuucagcaccgccguggugacccugaucgaggacggcaagaacgacagccugcccagcgagagcaccagccacagauggagaggccccgccugcagaccccccgacagcagcuacaacagccuguacagcaccugccuggagcuguucaaguucaccaucggcaugggcgaccuggaguucaccgagaacuacgacuucaaggccguguucaucauccugcugcuggccuacgugauccugaccuacauccugcugcugaacaugcugaucgcccugaugggcgagaccgugaacaagaucgcccaggagagcaagaacaucuggaagcugcagagagccaucaccauccuggacaccgagaagagcuuccugaagugcaugagaaaggccuucagaagcggcaagcugcugcaggugggcuacacccccgacggcaaggacgacuacagauggugcuucagaguggacgaggugaacuggaccaccuggaacaccaacgugggcaucaucaacgaggaccccggcaacugcgagggcgugaagagaacccugagcuucagccugagaagcagcagagugagcggcagacacuggaagaacuucgcccuggugccccugcugagagaggccagcgccagagacagacagagcgcccagcccgaggagguguaccugagacaguucagcggcagccugaagcccgaggacgccgagguguucaagagccccgccgccagcggcgagaaguaa

SEQ ID NO: 25100 - RNA, 2295 nt, Artificial Sequence
  TRPV2__Homo_sapiens__NP_057197
augaccagccccagcagcagccccguguucagacuggagacccuggacggcggccaggaggacggcagcgaggccgacagaggcaagcuggacuucggcagcggccugccccccauggagagccaguuccagggcgaggacagaaaguucgccccccagaucagagugaaccugaacuacagaaagggcaccggcgccagccagcccgaccccaacagauucgacagagacagacuguucaacgccgugagcagaggcgugcccgaggaccuggccggccugcccgaguaccugagcaagaccagcaaguaccugaccgacagcgaguacaccgagggcagcaccggcaagaccugccugaugaaggccgugcugaaccugaaggacggcgugaacgccugcauccugccccugcugcagaucgacagagacagcggcaacccccagccccuggugaacgcccagugcaccgacgacuacuacagaggccacagcgcccugcacaucgccaucgagaagagaagccugcagugcgugaagcugcugguggagaacggcgccaacgugcacgccagagccugcggcagauucuuccagaagggccagggcaccugcuucuacuucggcgagcugccccugagccuggccgccugcaccaagcagugggacguggugagcuaccugcuggagaacccccaccagcccgccagccugcaggccaccgacagccagggcaacaccgugcugcacgcccuggugaugaucagcgacaacagcgccgagaacaucgcccuggugaccagcauguacgacggccugcugcaggccggcgccagacugugccccaccgugcagcuggaggacaucagaaaccugcaggaccugaccccccugaagcuggccgccaaggagggcaagaucgagaucuucagacacauccugcagagagaguucagcggccugagccaccugagcagaaaguucaccgaguggugcuacggccccgugagagugagccuguacgaccuggccagcguggacagcugcgaggagaacagcgugcuggagaucaucgccuuccacugcaagagcccccacagacacagaaugguggugcuggagccccugaacaagcugcugcaggccaagugggaccugcugauccccaaguucuuccugaacuuccugugcaaccugaucuacauguucaucuucaccgccguggccuaccaccagcccacccugaagaagcaggccgccccccaccugaaggccgaggugggcaacagcaugcugcugaccggccacauccugauccugcugggcggcaucuaccugcuggugggccagcugugguacuucuggagaagacacguguucaucuggaucagcuucaucgacagcuacuucgagauccuguuccuguuccaggcccugcugaccguggugagccaggugcugugcuuccuggccaucgagugguaccugccccugcuggugagcgcccuggugcugggcuggcugaaccugcuguacuacaccagaggcuuccagcacaccggcaucuacagcgugaugauccagaaggugauccugagagaccugcugagauuccugcugaucuaccugguguuccuguucggcuucgccguggcccuggugagccugagccaggaggccuggagacccgaggcccccaccggccccaacgccaccgagagcgugcagcccauggagggccaggaggacgagggcaacggcgcccaguacagaggcauccuggaggccagccuggagcuguucaaguucaccaucggcaugggcgagcuggccuuccaggagcagcugcacuucagaggcauggugcugcugcugcugcuggccuacgugcugcugaccuacauccugcugcugaacaugcugaucgcccugaugagcgagaccgugaacagcguggccaccgacagcuggagcaucuggaagcugcagaaggccaucagcgugcuggagauggagaacggcuacugguggugcagaaagaagcagagagccggcgugaugcugaccgugggcaccaagcccgacggcagccccgacgagagauggugcuucagaguggaggaggugaacugggccagcugggagcagacccugcccacccugugcgaggaccccagcggcgccggcgugcccagaacccuggagaaccccgugcuggccagcccccccaaggaggacgaggacggcgccagcgaggagaacuacgugcccgugcagcugcugcagagcaacuaa

SEQ ID NO: 25101 - RNA, 2376 nt, Artificial Sequence
  TRPV3__Homo_sapiens__NP_001245134
augaaggcccaccccaaggagauggugccccugaugggcaagagaguggccgcccccagcggcaaccccgccauccugcccgagaagagacccgccgagaucacccccaccaagaagagcgcccacuucuuccuggagaucgagggcuucgagcccaaccccaccguggccaagaccagcccccccguguucagcaagcccauggacagcaacaucagacagugcaucagcggcaacugcgacgacauggacagcccccagagcccccaggacgacgugaccgagacccccagcaaccccaacagccccagcgcccagcuggccaaggaggagcagagaagaaagaagagaagacugaagaagagaaucuucgccgccgugagcgagggcugcguggaggagcugguggagcugcugguggagcugcaggagcugugcagaagaagacacgacgaggacgugcccgacuuccugaugcacaagcugaccgccagcgacaccggcaagaccugccugaugaaggcccugcugaacaucaaccccaacaccaaggagaucgugagaauccugcuggccuucgccgaggagaacgacauccugggcagauucaucaacgccgaguacaccgaggaggccuacgagggccagaccgcccugaacaucgccaucgagagaagacagggcgacaucgccgcccugcugaucgccgccggcgccgacgugaacgcccacgccaagggcgccuucuucaaccccaaguaccagcacgagggcuucuacuucggcgagaccccccuggcccuggccgccugcaccaaccagcccgagaucgugcagcugcugauggagcacgagcagaccgacaucaccagcagagacagcagaggcaacaacauccugcacgcccuggugaccguggccgaggacuucaagacccagaacgacuucgugaagagaauguacgacaugauccugcugagaagcggcaacugggagcuggagaccaccagaaacaacgacggccugaccccccugcagcuggccgccaagaugggcaaggccgagauccugaaguacauccugagcagagagaucaaggagaagagacugagaagccugagcagaaaguucaccgacugggccuacggccccgugagcagcagccuguacgaccugaccaacguggacaccaccaccgacaacagcgugcuggagaucaccguguacaacaccaacaucgacaacagacacgagaugcugacccuggagccccugcacacccugcugcacaugaaguggaagaaguucgccaagcacauguucuuccugagcuucugcuucuacuucuucuacaacaucacccugacccuggugagcuacuacagacccagagaggaggaggccaucccccacccccuggcccugacccacaagaugggcuggcugcagcugcugggcagaauguucgugcugaucugggccaugugcaucagcgugaaggagggcaucgccaucuuccugcugagacccagcgaccugcagagcauccugagcgacgccugguuccacuucguguucuucauccaggccgugcuggugauccugagcguguuccuguaccuguucgccuacaaggaguaccuggccugccuggugcuggccauggcccugggcugggccaacaugcuguacuacaccagaggcuuccagagcaugggcauguacagcgugaugauccagaaggugauccugcacgacgugcugaaguuccuguucguguacaucguguuccugcugggcuucggcguggcccuggccagccugaucgagaagugccccaaggacaacaaggacugcagcagcuacggcagcuucagcgacgccgugcuggagcuguucaagcugaccaucggccugggcgaccugaacauccagcagaacagcaaguaccccauccuguuccuguuccugcugaucaccuacgugauccugaccuucgugcugcugcugaacaugcugaucgcccugaugggcgagaccguggagaacgugagcaaggagagcgagagaaucuggagacugcagagagccagaaccauccuggaguucgagaagaugcugcccgaguggcugagaagcagauucagaaugggcgagcugugcaagguggccgaggacgacuucagacugugccugagaaucaacgaggugaaguggaccgaguggaagacccacgugagcuuccugaacgaggaccccggccccgugagaagaaccgccgacuucaacaagauccaggacagcagcagaaacaacagcaagaccacccugaacgccuucgaggagguggaggaguuccccgagaccagcguguaa

SEQ ID NO: 25102 - RNA, 2514 nt, Artificial Sequence
  TRPV4__Homo_sapiens__NP_001170902
auggccgacagcagcgagggccccagagccggccccggcgagguggccgagcugcccggcgacgagagcggcacccccggcgacggcagacccaaccugagaaugaaguuccagggcgccuucagaaagggcgugcccaaccccaucgaccugcuggagagcacccuguacgagagcagcguggugcccggccccaagaaggcccccauggacagccuguucgacuacggcaccuacagacaccacagcagcgacaacaagagauggagaaagaagaucaucgagaagcagccccagagccccaaggcccccgccccccagcccccccccauccugaagguguucaacagacccauccuguucgacaucgugagcagaggcagcaccgccgaccuggacggccugcugcccuuccugcugacccacaagaagagacugaccgacgaggaguucagagagcccagcaccggcaagaccugccugcccaaggcccugcugaaccugagcaacggcagaaacgacaccauccccgugcugcuggacaucgccgagagaaccggcaacaugagagaguucaucaacagccccuucagagacaucuacuacagaggccagaccgcccugcacaucgccaucgagagaagaugcaagcacuacguggagcugcugguggcccagggcgccgacgugcacgcccaggccagaggcagauucuuccagcccaaggacgagggcggcuacuucuacuucggcgagcugccccugagccuggccgccugcaccaaccagccccacaucgugaacuaccugaccgagaacccccacaagaaggccgacaugagaagacaggacagcagaggcaacaccgugcugcacgcccugguggccaucgccgacaacaccagagagaacaccaaguucgugaccaagauguacgaccugcugcugcugaagugcgccagacuguuccccgacagcaaccuggaggccgugcugaacaacgacggccugagcccccugaugauggccgccaagaccggcaagaucggcaucuuccagcacaucaucagaagagaggugaccgacgaggacaccagacaccugagcagaaaguucaaggacugggccuacggccccguguacagcagccuguacgaccugagcagccuggacaccugcggcgaggaggccagcgugcuggagauccugguguacaacagcaagaucgagaacagacacgagaugcuggccguggagcccaucaacgagcugcugagagacaaguggagaaaguucggcgccgugagcuucuacaucaacguggugagcuaccugugcgccauggugaucuucacccugaccgccuacuaccagccccuggagggcaccccccccuaccccuacagaaccaccguggacuaccugagacuggccggcgaggugaucacccuguucaccggcgugcuguucuucuucaccaacaucaaggaccuguucaugaagaagugccccggcgugaacagccuguucaucgacggcagcuuccagcugcuguacuucaucuacagcgugcuggugaucgugagcgccgcccuguaccuggccggcaucgaggccuaccuggccgugaugguguucgcccuggugcugggcuggaugaacgcccuguacuucaccagaggccugaagcugaccggcaccuacagcaucaugauccagaagauccuguucaaggaccuguucagauuccugcugguguaccugcuguucaugaucggcuacgccagcgcccuggugagccugcugaaccccugcgccaacaugaaggugugcaacgaggaccagaccaacugcaccgugcccaccuaccccagcugcagagacagcgagaccuucagcaccuuccugcuggaccuguucaagcugaccaucggcaugggcgaccuggagaugcugagcagcaccaaguaccccgugguguucaucauccugcuggugaccuacaucauccugaccuucgugcugcugcugaacaugcugaucgcccugaugggcgagaccgugggccaggugagcaaggagagcaagcacaucuggaagcugcagugggccaccaccauccuggacaucgagagaagcuuccccguguuccugagaaaggccuucagaagcggcgagauggugaccgugggcaagagcagcgacggcacccccgacagaagauggugcuucagaguggacgaggugaacuggagccacuggaaccagaaccugggcaucaucaacgaggaccccggcaagaacgagaccuaccaguacuacggcuucagccacaccgugggcagacugagaagagacagauggagcagcguggugcccagagugguggagcugaacaagaacagcaaccccgacgaggugguggugccccuggacagcaugggcaaccccagaugcgacggccaccagcagggcuaccccagaaaguggagaaccgacgacgccccccuguaa

SEQ ID NO: 25103 - RNA, 2190 nt, Artificial Sequence
  TRPV5__Homo_sapiens__NP_062815
augggcggcuuccugcccaaggccgagggccccggcagccagcugcagaagcugcugcccagcuuccuggugagagagcaggacugggaccagcaccuggacaagcugcacaugcugcagcagaagagaauccuggagagcccccugcugagagccagcaaggagaacgaccugagcgugcugagacagcugcugcuggacugcaccugcgacgugagacagagaggcgcccugggcgagaccgcccugcacaucgccgcccuguacgacaaccuggaggccgcccuggugcugauggaggccgcccccgagcugguguucgagcccaccaccugcgaggccuucgccggccagaccgcccugcacaucgccguggugaaccagaacgugaaccuggugagagcccugcugaccagaagagccagcgugagcgccagagccaccggcaccgccuucagacacagccccagaaaccugaucuacuucggcgagcacccccugagcuucgccgccugcgugaacagcgaggagaucgugagacugcugaucgagcacggcgccgacaucagagcccaggacagccugggcaacaccgugcugcacauccugauccugcagcccaacaagaccuucgccugccagauguacaaccugcugcugagcuacgacggccacggcgaccaccugcagccccuggaccuggugcccaaccaccagggccugacccccuucaagcuggccggcguggagggcaacaccgugauguuccagcaccugaugcagaagagaagacacauccaguggaccuacggcccccugaccagcauccuguacgaccugaccgagaucgacagcuggggcgaggagcugagcuuccuggagcugguggugagcagcgacaagagagaggccagacagauccuggagcagacccccgugaaggagcuggugagcuucaaguggaacaaguacggcagacccuacuucugcauccuggccgcccuguaccugcuguacaugaucugcuucaccaccugcugcguguacagaccccugaaguucagaggcggcaacagaacccacagcagagacaucaccauccugcagcagaagcugcugcaggaggccuacgagaccagagaggacaucaucagacuggugggcgagcuggugagcaucgugggcgccgugaucauccugcugcuggagauccccgacaucuucagagugggcgccagcagauacuucggcaagaccauccugggcggccccuuccacgugaucaucaucaccuacgccagccuggugcuggugaccauggugaugagacugaccaacaccaacggcgagguggugcccaugagcuucgcccuggugcugggcuggugcagcgugauguacuucaccagaggcuuccagaugcugggccccuucaccaucaugauccagaagaugaucuucggcgaccugaugagauucugcuggcugauggccguggugauccugggcuucgccagcgccuucuacaucaucuuccagaccgaggaccccaccagccugggccaguucuacgacuaccccauggcccuguucaccaccuucgagcuguuccugaccgugaucgacgcccccgccaacuacgacguggaccugcccuucauguucagcaucgugaacuucgccuucaccaucaucgccacccugcugaugcugaaccuguucaucgccaugaugggcgacacccacuggagaguggcccaggagagagacgagcuguggagagcccaggugguggccaccaccgugaugcuggagagaaagcugcccagaugccuguggcccagaagcggcaucugcggcugcgaguucggccugggcgacagaugguuccugagaguggagaaccacaacgaccagaacccccugagagugcugagauacguggagguguucaagaacagcgacaaggaggacgaccaggagcaccccagcgagaagcagcccagcggcgccgagagcggcacccuggccagagccagccuggcccugcccaccagcagccugagcagaaccgccagccagagcagcagccacagaggcugggagauccugagacagaacacccugggccaccugaaccugggccugaaccugagcgagggcgacggcgaggagguguaccacuucuaa

SEQ ID NO: 25104 - RNA, 2298 nt, Artificial Sequence
  TRPV6__Homo_sapiens__NP_061116
augggcccccugcagggcgacggcggccccgcccugggcggcgccgacguggcccccagacugagccccgugagaguguggcccagaccccaggcccccaaggagcccgcccugcaccccaugggccugagccugcccaaggagaagggccugauccugugccuguggagcaaguucugcagaugguuccagagaagagagagcugggcccagagcagagacgagcagaaccugcugcagcagaagagaaucugggagagcccccugcugcuggccgccaaggacaacgacgugcaggcccugaacaagcugcugaaguacgaggacugcaaggugcaccagagaggcgccaugggcgagaccgcccugcacaucgccgcccuguacgacaaccuggaggccgccauggugcugauggaggccgcccccgagcugguguucgagcccaugaccagcgagcuguacgagggccagaccgcccugcacaucgccguggugaaccagaacaugaaccuggugagagcccugcuggccagaagagccagcgugagcgccagagccaccggcaccgccuucagaagaagccccugcaaccugaucuacuucggcgagcacccccugagcuucgccgccugcgugaacagcgaggagaucgugagacugcugaucgagcacggcgccgacaucagagcccaggacagccugggcaacaccgugcugcacauccugauccugcagcccaacaagaccuucgccugccagauguacaaccugcugcugagcuacgacagacacggcgaccaccugcagccccuggaccuggugcccaaccaccagggccugacccccuucaagcuggccggcguggagggcaacaccgugauguuccagcaccugaugcagaagagaaagcacacccaguggaccuacggcccccugaccagcacccuguacgaccugaccgagaucgacagcagcggcgacgagcagagccugcuggagcugaucaucaccaccaagaagagagaggccagacagauccuggaccagacccccgugaaggagcuggugagccugaaguggaagagauacggcagacccuacuucugcaugcugggcgccaucuaccugcuguacaucaucugcuucaccaugugcugcaucuacagaccccugaagcccagaaccaacaacagaaccagccccagagacaacacccugcugcagcagaagcugcugcaggaggccuacaugacccccaaggacgacaucagacuggugggcgagcuggugaccgugaucggcgccaucaucauccugcugguggaggugcccgacaucuucagaaugggcgugaccagauucuucggccagaccauccugggcggccccuuccacgugcugaucaucaccuacgccuucauggugcuggugaccauggugaugagacugaucagcgccagcggcgagguggugcccaugagcuucgcccuggugcugggcuggugcaacgugauguacuucgccagaggcuuccagaugcugggccccuucaccaucaugauccagaagaugaucuucggcgaccugaugagauucugcuggcugauggccguggugauccugggcuucgccagcgccuucuacaucaucuuccagaccgaggaccccgaggagcugggccacuucuacgacuaccccauggcccuguucagcaccuucgagcuguuccugaccaucaucgacggccccgccaacuacaacguggaccugcccuucauguacagcaucaccuacgccgccuucgccaucaucgccacccugcugaugcugaaccugcugaucgccaugaugggcgacacccacuggagaguggcccacgagagagacgagcuguggagagcccagaucguggccaccaccgugaugcuggagagaaagcugcccagaugccuguggcccagaagcggcaucugcggcagagaguacggccugggcgacagaugguuccugagaguggaggacagacaggaccugaacagacagagaauccagagauacgcccaggccuuccacaccagaggcagcgaggaccuggacaaggacagcguggagaagcuggagcugggcugccccuucagcccccaccugagccugcccaugcccagcgugagcagaagcaccagcagaagcagcgccaacugggagagacugagacagggcacccugagaagagaccugagaggcaucaucaacagaggccuggaggacggcgagagcugggaguaccagaucuaa

SEQ ID NO: 25105 - RNA, 11580 nt, Artificial Sequence
  TRRAP__Homo_sapiens__NP_001231509
auggccuucguggccacccagggcgccaccgugguggaccagaccacccugaugaagaaguaccugcaguucguggccgcccugaccgacgugaacacccccgacgagaccaagcugaagaugaugcaggaggugagcgagaacuucgagaacgugaccagcagcccccaguacagcaccuuccuggagcacaucauccccagauuccugaccuuccugcaggacggcgaggugcaguuccugcaggagaagcccgcccagcagcugagaaagcuggugcuggagaucauccacagaauccccaccaacgagcaccugagaccccacaccaagaacgugcugagcgugauguucagauuccuggagaccgagaacgaggagaacgugcugaucugccugagaaucaucaucgagcugcacaagcaguucagaccccccaucacccaggagauccaccacuuccuggacuucgugaagcagaucuacaaggagcugcccaagguggugaacagauacuucgagaacccccaggugauccccgagaacaccgugcccccccccgagauggugggcaugaucaccaccaucgccgugaaggugaaccccgagagagaggacagcgagaccagaacccacagcaucauccccagaggcagccugagccugaaggugcuggccgagcugcccaucaucguggugcugauguaccagcuguacaagcugaacauccacaacgugguggccgaguucgugccccugaucaugaacaccaucgccauccaggugagcgcccaggccagacagcacaagcuguacaacaaggagcuguacgccgacuucaucgccgcccagaucaagacccugagcuuccuggccuacaucaucagaaucuaccaggagcuggugaccaaguacagccagcagauggugaagggcaugcugcagcugcugagcaacugccccgccgagaccgcccaccugagaaaggagcugcugaucgccgccaagcacauccugaccaccgagcugagaaaccaguucauccccugcauggacaagcuguucgacgagagcauccugaucggcagcggcuacaccgccagagagacccugagaccccuggccuacagcacccuggccgaccuggugcaccacgugagacagcaccugccccugagcgaccugagccuggccgugcagcuguucgccaagaacaucgacgacgagagccugcccagcagcauccagaccaugagcugcaagcugcugcugaaccugguggacugcaucagaagcaagagcgagcaggagagcggcaacggcagagacgugcugaugagaaugcuggagguguucgugcugaaguuccacaccaucgccagauaccagcugagcgccaucuucaagaagugcaagccccagagcgagcugggcgccguggaggccgcccugcccggcgugcccaccgcccccgccgcccccggccccgcccccagccccgcccccgugcccgccccccccccccccccccccccccccccccccgccacccccgugacccccgcccccgugccccccuucgagaagcagggcgagaaggacaaggaggacaagcagaccuuccaggugaccgacugcagaagccuggugaagacccuggugugcggcgugaagaccaucaccuggggcaucaccagcugcaaggcccccggcgaggcccaguucauccccaacaagcagcugcagcccaaggagacccagaucuacaucaagcuggugaaguacgccaugcaggcccuggacaucuaccaggugcagaucgccggcaacggccagaccuacaucagaguggccaacugccagaccgugagaaugaaggaggagaaggaggugcuggagcacuucgccggcguguucaccaugaugaacccccugaccuucaaggagaucuuccagaccaccgugcccuacaugguggagagaaucagcaagaacuacgcccugcagaucguggccaacagcuuccuggccaaccccaccaccagcgcccuguucgccaccauccugguggaguaccugcuggacagacugcccgagaugggcagcaacguggagcugagcaaccuguaccugaagcuguucaagcugguguucggcagcgugagccuguucgccgccgagaacgagcagaugcugaagccccaccugcacaagaucgugaacagcagcauggagcuggcccagaccgccaaggagcccuacaacuacuuccugcugcugagagcccuguucagaagcaucggcggcggcagccacgaccugcuguaccaggaguuccugccccugcugcccaaccugcugcagggccugaacaugcugcagagcggccugcacaagcagcacaugaaggaccuguucguggagcugugccugaccgugcccgugagacugagcagccugcugcccuaccugcccaugcugauggacccccuggugagcgcccugaacggcagccagacccuggugagccagggccugagaacccuggagcugugcguggacaaccugcagcccgacuuccuguacgaccacauccagcccgugagagccgagcugaugcaggcccuguggagaacccugagaaaccccgccgacagcaucagccacguggccuacagagugcugggcaaguucggcggcagcaacagaaagaugcugaaggagagccagaagcugcacuacguggugaccgaggugcagggccccagcaucaccguggaguucagcgacugcaaggccagccugcagcugcccauggagaaggccaucgagaccgcccuggacugccugaagagcgccaacaccgagcccuacuacagaagacaggccugggaggugaucaagugcuuccugguggccaugaugagccuggaggacaacaagcacgcccuguaccagcugcuggcccaccccaacuucaccgagaagaccauccccaacgugaucaucagccacagauacaaggcccaggacacccccgccagaaagaccuucgagcaggcccugaccggcgccuucaugagcgccgugaucaaggaccugagacccagcgcccugcccuucguggccagccugaucagacacuacaccaugguggccguggcccagcagugcggccccuuccugcugcccugcuaccaggugggcagccagcccagcaccgccauguuccacagcgaggagaacggcagcaagggcauggacccccuggugcugaucgacgccaucgccaucugcauggccuacgaggagaaggagcugugcaagaucggcgagguggcccuggccgugaucuucgacguggccagcaucauccugggcagcaaggagagagccugccagcugccccuguucagcuacaucguggagagacugugcgccugcugcuacgagcaggccugguacgccaagcugggcggcguggugagcaucaaguuccugauggagagacugccccugaccugggugcugcagaaccagcagaccuuccugaaggcccugcuguucgugaugauggaccugaccggcgaggugagcaacggcgccguggccauggccaagaccacccuggagcagcugcugaugagaugcgccaccccccugaaggacgaggagagagccgaggagaucguggccgcccaggagaagagcuuccaccacgugacccacgaccuggugagagaggugaccagccccaacagcaccgugagaaagcaggccaugcacagccugcaggugcuggcccaggugaccggcaagagcgugaccgugaucauggagccccacaaggaggugcugcaggacauggugccccccaagaagcaccugcugagacaccagcccgccaacgcccagaucggccugauggagggcaacaccuucugcaccacccugcagcccagacuguucaccauggaccugaacgugguggagcacaagguguucuacaccgagcugcugaaccugugcgaggccgaggacagcgcccugaccaagcugcccugcuacaagagccugcccagccuggugccccugagaaucgccgcccugaacgcccuggccgccugcaacuaccugccccagagcagagagaagaucaucgccgcccuguucaaggcccugaacagcaccaacagcgagcugcaggaggccggcgaggccugcaugagaaaguuccuggagggcgccaccaucgagguggaccagauccacacccacaugagaccccugcugaugaugcugggcgacuacagaagccugacccugaacguggugaacagacugaccagcgugaccagacuguuccccaacagcuucaacgacaaguucugcgaccagaugaugcagcaccugagaaaguggauggaggugguggugaucacccacaagggcggccagagaagcgacggcaacgagagcaucagcgagugcggcagaugcccccugagccccuucugccaguucgaggagaugaagaucugcagcgccaucaucaaccuguuccaccugauccccgccgccccccagacccuggugaagccccugcuggagguggugaugaagaccgagagagccaugcugaucgaggccggcagccccuucagagagccccugaucaaguuccugaccagacaccccagccagaccguggagcuguucaugauggaggccacccugaacgacccccaguggagcagaauguucaugagcuuccugaagcacaaggacgccagaccccugagagacgugcuggccgccaaccccaacagauucaucacccugcugcugcccggcggcgcccagaccgccgugagacccggcagccccagcaccagcaccaugagacuggaccugcaguuccaggccaucaagaucaucagcaucaucgugaagaacgacgacagcuggcuggccagccagcacagccuggugagccagcugagaagagugugggugagcgagaacuuccaggagagacacagaaaggagaacauggccgccaccaacuggaaggagcccaagcugcuggccuacugccugcugaacuacugcaagagaaacuacggcgacaucgagcugcuguuccagcugcugagagccuucaccggcagauuccugugcaacaugaccuuccugaaggaguacauggaggaggagauccccaagaacuacagcaucgcccagaagagagcccuguucuucagauucguggacuucaacgaccccaacuucggcgacgagcugaaggccaaggugcugcagcacauccugaaccccgccuuccuguacagcuucgagaagggcgagggcgagcagcugcugggcccccccaaccccgagggcgacaaccccgagagcaucaccagcguguucaucaccaaggugcuggaccccgagaagcaggccgacaugcuggacagccugagaaucuaccugcugcaguacgccacccugcugguggagcacgccccccaccacauccacgacaacaacaagaacagaaacagcaagcugagaagacugaugaccuucgccuggcccugccugcugagcaaggccugcguggaccccgccugcaaguacagcggccaccugcugcuggcccacaucaucgccaaguucgccauccacaagaagaucgugcugcagguguuccacagccugcugaaggcccacgccauggaggccagagccaucgugagacaggccauggccauccugacccccgccgugcccgccagaauggaggacggccaccagaugcugacccacuggaccagaaagaucaucguggaggagggccacaccgugccccagcuggugcacauccugcaccugaucgugcagcacuucaagguguacuaccccgugagacaccaccuggugcagcacauggugagcgccaugcagagacugggcuucacccccagcgugaccaucgagcagagaagacuggccguggaccugagcgagguggugaucaagugggagcugcagagaaucaaggaccagcagcccgacagcgacauggaccccaacagcagcggcgagggcgugaacagcgugagcagcagcaucaagagaggccugagcguggacagcgcccaggaggugaagagauucagaaccgccaccggcgccaucagcgccguguucggcagaagccagagccugcccggcgccgacagccugcuggccaagcccaucgacaagcagcacaccgacaccguggugaacuuccugaucagaguggccugccaggugaacgacaacaccaacaccgccggcagccccggcgaggugcugagcagaagaugcgugaaccugcugaagaccgcccugagacccgacauguggcccaagagcgagcugaagcugcagugguucgacaagcugcugaugaccguggagcagcccaaccaggugaacuacggcaacaucugcaccggccuggaggugcugagcuuccugcugaccgugcugcagagccccgccauccugagcagcuucaagccccugcagagaggcaucgccgccugcaugaccugcggcaacaccaaggugcugagagccgugcacagccugcugagcagacugaugagcaucuuccccaccgagcccagcaccagcagcguggccagcaaguacgaggagcuggagugccuguacgccgccgugggcaaggugaucuacgagggccugaccaacuacgagaaggccaccaacgccaaccccagccagcuguucggcacccugaugauccugaagagcgccugcagcaacaaccccagcuacaucgacagacugaucagcguguucaugagaagccugcagaagauggugagagagcaccugaacccccaggccgccagcggcagcaccgaggccaccagcggcaccagcgagcuggugaugcugagccuggagcuggugaagaccagacuggccgugaugagcauggagaugagaaagaacuucauccaggccauccugaccagccugaucgagaagagccccgacgccaagauccugagagccguggugaagaucguggaggagugggugaagaacaacagccccauggccgccaaccagacccccacccugagagagaagagcauccugcuggugaagaugaugaccuacaucgagaagagauuccccgaggaccuggagcugaacgcccaguuccuggaccuggugaacuacguguacagagacgagacccugagcggcagcgagcugaccgccaagcuggagcccgccuuccugagcggccugagaugcgcccagccccugaucagagccaaguucuucgagguguucgacaacagcaugaagagaagaguguacgagagacugcuguacgugaccugcagccagaacugggaggccaugggcaaccacuucuggaucaagcagugcaucgagcugcugcuggccgugugcgagaagagcacccccaucggcaccagcugccagggcgccaugcugcccagcaucaccaacgugaucaaccuggccgacagccacgacagagccgccuucgccauggugacccacgugaagcaggagcccagagagagagagaacagcgagagcaaggaggaggacguggagaucgacaucgagcuggcccccggcgaccagaccagcacccccaagaccaaggagcugagcgagaaggacaucggcaaccagcugcacaugcugaccaacagacacgacaaguuccuggacacccugagagaggugaagaccggcgcccugcugagcgccuucgugcagcugugccacaucagcaccacccuggccgagaagaccugggugcagcuguuccccagacuguggaagauccugagcgacagacagcagcacgcccuggccggcgagaucagccccuuccugugcagcggcagccaccaggugcagagagacugccagcccagcgcccugaacugcuucguggaggccaugagccagugcgugccccccauccccaucagacccugcgugcugaaguaccugggcaagacccacaaccugugguucagaagcacccugaugcuggagcaccaggccuucgagaagggccugagccugcagaucaagcccaagcagaccaccgaguucuacgagcaggagagcaucacccccccccagcaggagauccuggacagccuggccgagcuguacagccugcugcaggaggaggacaugugggccggccuguggcagaagagaugcaaguacagcgagaccgccaccgccaucgccuacgagcagcacggcuucuucgagcaggcccaggagagcuacgagaaggccauggacaaggccaagaaggagcacgagagaagcaacgccagccccgccaucuuccccgaguaccagcugugggaggaccacuggaucagaugcagcaaggagcugaaccagugggaggcccugaccgaguacggccagagcaagggccacaucaaccccuaccuggugcuggagugcgccuggagagugagcaacuggaccgccaugaaggaggcccuggugcagguggaggugagcugccccaaggagauggccuggaaggugaacauguacagaggcuaccuggccaucugccaccccgaggagcagcagcugagcuucaucgagagacugguggagauggccagcagccuggccaucagagaguggagaagacugccccacguggugagccacgugcacaccccccugcugcaggccgcccagcagaucaucgagcugcaggaggccgcccagaucaacgccggccugcagcccaccaaccugggcagaaacaacagccugcacgacaugaagaccguggugaagaccuggagaaacagacugcccaucgugagcgacgaccugagccacuggagcagcaucuucauguggagacagcaccacuaccagggcaagcccaccuggagcggcaugcacagcagcagcaucgugaccgccuacgagaacagcagccagcacgaccccagcagcaacaacgccaugcugggcgugcacgccagcgccagcgccaucauccaguacggcaagaucgccagaaagcagggccuggugaacguggcccuggacauccugagcagaauccacaccauccccaccgugcccaucguggacugcuuccagaagaucagacagcaggugaagugcuaccugcagcuggccggcgugaugggcaagaacgagugcaugcagggccuggaggugaucgagagcaccaaccugaaguacuucaccaaggagaugaccgccgaguucuacgcccugaagggcauguuccuggcccagaucaacaagagcgaggaggccaacaaggccuucagcgccgccgugcagaugcacgacgugcuggugaaggccugggccauguggggcgacuaccuggagaacaucuucgugaaggagagacagcugcaccugggcgugagcgccaucaccugcuaccugcacgccugcagacaccagaacgagagcaagagcagaaaguaccuggccaaggugcuguggcugcugagcuucgacgacgacaagaacacccuggccgacgccguggacaaguacugcaucggcgugccccccauccaguggcuggccuggaucccccagcugcugaccugccuggugggcagcgagggcaagcugcugcugaaccugaucagccaggugggcagaguguacccccaggccguguacuuccccaucagaacccuguaccugacccugaagaucgagcagagagagagauacaagagcgaccccggccccaucagagccaccgcccccauguggagaugcagcagaaucaugcacaugcagagagagcugcaccccacccugcugagcagccuggagggcaucguggaccagauggugugguucagagagaacuggcacgaggaggugcugagacagcugcagcagggccuggccaagugcuacagcguggccuucgagaagagcggcgccgugagcgacgccaagaucaccccccacacccugaacuucgugaagaagcuggugagcaccuucggcgugggccuggagaacgugagcaacgugagcaccauguucagcagcgccgccagcgagagccuggccagaagagcccaggccaccgcccaggaccccguguuccagaagcugaagggccaguucaccaccgacuucgacuucagcgugcccggcagcaugaagcugcacaaccugaucagcaagcugaagaaguggaucaagauccuggaggccaagaccaagcagcugcccaaguucuuccugaucgaggagaagugcagauuccugagcaacuucagcgcccagaccgccgagguggagauccccggcgaguuccugaugcccaagcccacccacuacuacaucaagaucgccagauucaugcccagaguggagaucgugcagaagcacaacaccgccgccagaagacuguacaucagaggccacaacggcaagaucuaccccuaccuggugaugaacgacgccugccugaccgagagcagaagagaggagagagugcugcagcugcugagacugcugaaccccugccuggagaagagaaaggagaccaccaagagacaccuguucuucaccgugcccagagugguggccgugagcccccagaugagacugguggaggacaaccccagcagccugagccugguggagaucuacaagcagagaugcgccaagaagggcaucgagcacgacaaccccaucagcagauacuacgacagacuggccaccgugcaggccagaggcacccaggccagccaccaggugcugagagacauccugaaggaggugcagagcaacauggugcccagaagcaugcugaaggagugggcccugcacaccuuccccaacgccaccgacuacuggaccuucagaaagauguucaccauccagcuggcccugaucggcuucgccgaguucgugcugcaccugaacagacugaaccccgagaugcugcagaucgcccaggacaccggcaagcugaacguggccuacuucagauucgacaucaacgacgccaccggcgaccuggacgccaacagacccgugcccuucagacugacccccaacaucagcgaguuccugaccaccaucggcgugagcggcccccugaccgccagcaugaucgccguggccagaugcuucgcccagcccaacuucaagguggacggcauccugaagaccgugcugagagacgagaucaucgccuggcacaagaagacccaggaggacaccagcagcccccugagcgccgccggccagcccgagaacauggacagccagcagcuggugagccuggugcagaaggccgugaccgccaucaugaccagacugcacaaccuggcccaguucgagggcggcgagagcaaggugaacacccugguggccgccgccaacagccuggacaaccugugcagaauggaccccgccuggcaccccuggcuguaa

SEQ ID NO: 25106 - RNA, 432 nt, Artificial Sequence
  TSACC__Homo_sapiens__NP_001291755
augggcgagagacccgccggccuggcccagggcaccacccccgugggcgugcagauggagagacacaccagccaccccaacagaaaggugcccgccaaggaggaggccaacgccgugccccugugcagagccaagcccagccccagcuacaucaaccugcaggccagcagcccccccgccaccuuccugaacauccagaccaccaagcugcccagcguggaccacaagcccaaggagugccugggccugcuggagugcauguacgccaaccugcagcugcagacccagcuggcccagcagcagauggccgugcuggagcaccugcaggccagcgugacccagcuggcccccggcagaggcagcaacaacagcagccugcccgcccugagccccaacccccugcugaaccaccugccccaguucagcaaguaa

SEQ ID NO: 25107 - RNA, 3342 nt, Artificial Sequence
  TSC1__Homo_sapiens__NP_001155899
auggcccagcaggccaacgugggcgagcugcuggccaugcuggacagccccaugcugggcgugagagacgacgugaccgccguguucaaggagaaccugaacagcgacagaggccccaugcuggugaacacccugguggacuacuaccuggagaccagcagccagcccgcccugcacauccugaccacccugcaggagccccacgacaagauggacaccgacgugguggugcugaccaccggcgugcuggugcugaucaccaugcugcccaugaucccccagagcggcaagcagcaccugcuggacuucuucgacaucuucggcagacugagcagcuggugccugaagaagcccggccacguggccgagguguaccuggugcaccugcacgccagcguguacgcccuguuccacagacuguacggcauguaccccugcaacuucgugagcuuccugagaagccacuacagcaugaaggagaaccuggagaccuucgaggagguggugaagcccaugauggagcacgugagaauccaccccgagcuggugaccggcagcaaggaccacgagcuggaccccagaagauggaagagacuggagacccacgacguggugaucgagugcgccaagaucagccuggaccccaccgaggccagcuacgaggacggcuacagcgugagccaccagaucagcgccagauucccccacagaagcgccgacgugaccaccagccccuacgccgacacccagaacagcuacggcugcgccaccagcacccccuacagcaccagcagacugaugcugcugaacaugcccggccagcugccccagacccugagcagccccagcaccagacugaucaccgagcccccccaggccacccuguggagccccagcauggugugcggcaugaccaccccccccaccagccccggcaacgugccccccgaccugagccaccccuacagcaagguguucggcaccaccgccggcggcaagggcaccccccugggcacccccgccaccagccccccccccgccccccugugccacagcgacgacuacgugcacaucagccugccccaggccaccgugaccccccccagaaaggaggagagaauggacagcgccagacccugccugcacagacagcaccaccugcugaacgacagaggcagcgaggagccccccggcagcaagggcagcgugacccugagcgaccugcccggcuuccugggcgaccuggccagcgaggaggacagcaucgagaaggacaaggaggaggccgccaucagcagagagcugagcgagaucaccaccgccgaggccgagcccguggugcccagaggcggcuucgacagccccuucuacagagacagccugcccggcagccagagaaagacccacagcgccgccagcagcagccagggcgccagcgugaaccccgagccccugcacagcagccuggacaagcugggccccgacacccccaagcaggccuucacccccaucgaccugcccugcggcagcgccgacgagagccccgccggcgacagagagugccagaccagccuggagaccagcaucuucacccccagccccugcaagauccccccccccaccagagugggcuucggcagcggccagcccccccccuacgaccaccuguucgagguggcccugcccaagaccgcccaccacuucgugaucagaaagaccgaggagcugcugaagaaggccaagggcaacaccgaggaggacggcgugcccagcaccagccccauggaggugcuggacagacugauccagcagggcgccgacgcccacagcaaggagcugaacaagcugccccugcccagcaagagcguggacuggacccacuucggcggcagcccccccagcgacgagaucagaacccugagagaccagcugcugcugcugcacaaccagcugcuguacgagagauucaagagacagcagcacgcccugagaaacagaagacugcugagaaaggugaucaaggccgccgcccuggaggagcacaacgccgccaugaaggaccagcugaagcugcaggagaaggacauccagauguggaaggugagccugcagaaggagcaggccagauacaaccagcugcaggagcagagagacaccauggugaccaagcugcacagccagaucagacagcugcagcacgacagagaggaguucuacaaccagagccaggagcugcagaccaagcuggaggacugcagaaacaugaucgccgagcugagaaucgagcugaagaaggccaacaacaaggugugccacaccgagcugcugcugagccaggugagccagaagcugagcaacagcgagagcgugcagcagcagauggaguuccugaacagacagcugcuggugcugggcgaggugaacgagcuguaccuggagcagcugcagaacaagcacagcgacaccaccaaggagguggagaugaugaaggccgccuacagaaaggagcuggagaagaacagaagccacgugcugcagcagacccagagacuggacaccagccagaagagaauccuggagcuggagagccaccuggccaagaaggaccaccugcugcuggagcagaagaaguaccuggaggacgugaagcugcaggccagaggccagcugcaggccgccgagagcagauacgaggcccagaagagaaucacccagguguucgagcuggagauccuggaccuguacggcagacuggagaaggacggccugcugaagaagcuggaggaggagaaggccgaggccgccgaggccgccgaggagagacuggacugcugcaacgacggcugcagcgacagcauggugggccacaacgaggaggccagcggccacaacggcgagaccaagacccccagacccagcagcgccagaggcagcagcggcagcagaggcggcggcggcagcagcagcagcagcagcgagcugagcacccccgagaagcccccccaccagagagccggccccuucagcagcagaugggagaccaccaugggcgaggccagcgccagcauccccaccaccgugggcagccugcccagcagcaagagcuuccugggcaugaaggccagagagcuguucagaaacaagagcgagagccagugcgacgaggacggcaugaccagcagccugagcgagagccugaagaccgagcugggcaaggaccugggcguggaggccaagaucccccugaaccuggacggcccccaccccagcccccccacccccgacagcgugggccagcugcacaucauggacuacaacgagacccaccacgagcacagcuaa

SEQ ID NO: 25108 - RNA, 1713 nt, Artificial Sequence
  TSC22D1__Homo_sapiens__NP_001230728
augcaccagccccccgagagcaccgccgccgccgccgccgccgccgacaucagcgccagaaagauggcccaccccgccauguuccccagaagaggcagcggcagcggcagcgccagcgcccugaacgccgccggcaccggcgugggcagcaacgccaccagcagcgaggacuuccccccccccagccugcugcagccccccccccccgccgccagcagcaccagcggcccccagcccccccccccccagagccugaaccugcugagccaggcccagcugcaggcccagccccuggcccccggcggcacccagaugaagaagaagagcggcuuccagaucaccagcgugacccccgcccagaucagcgccagcaucagcagcaacaacagcaucgccgaggacaccgagagcuacgacgaccuggacgagagccacaccgaggaccugagcagcagcgagauccuggacgugagccugagcagagccaccgaccugggcgagcccgagagaagcagcagcgaggagacccugaacaacuuccaggaggccgagacccccggcgccgugagccccaaccagccccaccugccccagccccaccugccccaccugccccagcagaacguggugaucaacggcaacgcccacccccaccaccugcaccaccaccaccagauccaccacggccaccaccugcagcacggccaccaccaccccagccacguggccguggccagcgccagcaucaccggcggcccccccagcagccccgugagcagaaagcugagcaccaccggcagcagcgacagcaucacccccguggcccccaccagcgccgugagcagcagcggcagccccgccagcgugaugaccaacaugagagcccccagcaccaccggcggcaucggcaucaacagcgugaccggcaccagcaccgugaacaacgugaacaucaccgccgugggcagcuucaaccccaacgugaccagcagcaugcugggcaacgugaacaucagcaccagcaacauccccagcgccgccggcgugagcgugggccccggcgugaccagcggcgugaacgugaacauccugagcggcaugggcaacggcaccaucagcagcagcgccgccgugagcagcgugcccaacgccgccgccggcaugaccggcggcagcgugagcagccagcagcagcagcccaccgugaacaccagcagauucagaguggugaagcuggacagcagcagcgagcccuucaagaagggcagauggaccugcaccgaguucuacgagaaggagaacgccgugcccgccaccgagggcgugcugaucaacaaggugguggagaccgugaagcagaaccccaucgaggugaccagcgagagagagagcaccagcggcagcagcgugagcagcagcgugagcacccugagccacuacaccgagagcgugggcagcggcgagaugggcgcccccaccgugguggugcagcagcagcagcagcagcagcagcagcagcagcagcagcccgcccugcagggcgugacccugcagcagauggacuucggcagcaccggcccccagagcauccccgccgugagcaucccccagagcaucagccagagccagaucagccaggugcagcugcagagccaggagcugagcuaccugaccaugaagguggugcugcugaucguguaccugugcauguaa

SEQ ID NO: 25109 - RNA, 234 nt, Artificial Sequence
  TSC22D3__Homo_sapiens__NP_001015881
auggaccuggugaagaaccaccugauguacgccgugagagaggagguggagauccugaaggagcagaucagagagcugguggagaagaacagccagcuggagagagagaacacccugcugaagacccuggccagccccgagcagcuggagaaguuccagagcugccugagccccgaggagcccgcccccgagagcccccaggugcccgaggcccccggcggcagcgccguguaa

SEQ ID NO: 25110 - RNA, 1188 nt, Artificial Sequence
  TSC22D4__Homo_sapiens__NP_001289972
augagcggcggcaagaagaagagcagcuuccagaucaccagcgugaccaccgacuacgagggccccggcagccccggcgccagcgacccccccaccccccagccccccaccggccccccccccagacugcccaacggcgagcccagccccgaccccggcggcaagggcacccccagaaacggcagccccccccccggcgcccccagcagcagauucagaguggugaagcugccccacggccugggcgagcccuacagaagaggcagauggaccugcguggacguguacgagagagaccuggagccccacagcuucggcggccugcuggagggcaucagaggcgccagcggcggcgccggcggcagaagccuggacagcagacuggagcuggccagccugggccugggcgcccccaccccccccagcggccugagccagggccccaccagcuggcugagacccccccccaccagccccggcccccaggccagaagcuucaccggcggccugggccagcugguggugcccagcaaggccaaggccgagaagcccccccugagcgccagcagcccccagcagagaccccccgagcccgagaccggcgagagcgccggcaccagcagagccgccaccccccugcccagccugagaguggaggccgaggccggcggcagcggcgccagaacccccccccugagcagaagaaaggccguggacaugagacugagaauggagcugggcgcccccgaggagaugggccaggugcccccccuggacagcagacccagcagccccgcccuguacuucacccacgacgccagccuggugcacaagagccccgaccccuucggcgccguggccgcccagaaguucagccuggcccacagcaugcuggccaucagcggccaccuggacagcgacgacgacagcggcagcggcagccuggugggcaucgacaacaagaucgagcaggccauggaccuggugaagagccaccugauguucgccgugagagaggagguggaggugcugaaggagcagaucagagagcuggccgagagaaacgccgcccuggagcaggagaacggccugcugagagcccuggccagccccgagcagcuggcccagcugcccagcagcggcgugcccagacugggcccccccgcccccaacggccccagcguguaa

SEQ ID NO: 25111 - RNA, 5424 nt, Artificial Sequence
  TSC2__Homo_sapiens__NP_000539
auggccaagcccaccagcaaggacagcggccugaaggagaaguucaagauccugcugggccugggcacccccagacccaaccccagaagcgccgagggcaagcagaccgaguucaucaucaccgccgagauccugagagagcugagcauggagugcggccugaacaacagaaucagaaugaucggccagaucugcgagguggccaagaccaagaaguucgaggagcacgccguggaggcccuguggaaggccguggccgaccugcugcagcccgagagaccccuggaggccagacacgccgugcuggcccugcugaaggccaucgugcagggccagggcgagagacugggcgugcugagagcccuguucuucaaggugaucaaggacuaccccagcaacgaggaccugcacgagagacuggagguguucaaggcccugaccgacaacggcagacacaucaccuaccuggaggaggagcuggccgacuucgugcugcaguggauggacgugggccugagcagcgaguuccugcuggugcuggugaaccuggugaaguucaacagcugcuaccuggacgaguacaucgccagaauggugcagaugaucugccugcugugcgugagaaccgccagcagcguggacaucgaggugagccugcaggugcuggacgccguggugugcuacaacugccugcccgccgagagccugccccuguucaucgugacccugugcagaaccaucaacgugaaggagcugugcgagcccugcuggaagcugaugagaaaccugcugggcacccaccugggccacagcgccaucuacaacaugugccaccugauggaggacagagccuacauggaggacgccccccugcugagaggcgccguguucuucgugggcauggcccuguggggcgcccacagacuguacagccugagaaacagccccaccagcgugcugcccagcuucuaccaggccauggccugccccaacgagguggugagcuacgagaucgugcugagcaucaccagacugaucaagaaguacagaaaggagcugcaggugguggccugggacauccugcugaacaucaucgagagacugcugcagcagcugcagacccuggacagccccgagcugagaaccaucgugcacgaccugcugaccaccguggaggagcugugcgaccagaacgaguuccacggcagccaggagagauacuucgagcugguggagagaugcgccgaccagagacccgagagcagccugcugaaccugaucagcuacagagcccagagcauccaccccgccaaggacggcuggauccagaaccugcaggcccugauggagagauucuucagaagcgagagcagaggcgccgugagaaucaaggugcuggacgugcugagcuucgugcugcugaucaacagacaguucuacgaggaggagcugaucaacagcguggugaucagccagcugagccacauccccgaggacaaggaccaccaggugagaaagcuggccacccagcugcugguggaccuggccgagggcugccacacccaccacuucaacagccugcuggacaucaucgagaaggugauggccagaagccugagccccccccccgagcuggaggagagagacguggccgccuacagcgccagccuggaggacgugaagaccgccgugcugggccugcuggugauccugcagaccaagcuguacacccugcccgccagccacgccaccagaguguacgagaugcuggugagccacauccagcugcacuacaagcacagcuacacccugcccaucgccagcagcaucagacugcaggccuucgacuuccugcugcugcugagagccgacagccugcacagacugggccugcccaacaaggacggcguggugagauucagccccuacugcgugugcgacuacauggagcccgagagaggcagcgagaagaagaccagcggcccccugagcccccccaccggcccccccggccccgcccccgccggccccgccgugagacugggcagcgugcccuacagccugcuguucagagugcugcugcagugccugaagcaggagagcgacuggaaggugcugaagcuggugcugggcagacugcccgagagccugagauacaaggugcugaucuucaccagccccugcagcguggaccagcugugcagcgcccugugcagcaugcugagcggccccaagacccuggagagacugagaggcgcccccgagggcuucagcagaaccgaccugcaccuggccguggugcccgugcugaccgcccugaucagcuaccacaacuaccuggacaagaccaagcagagagagaugguguacugccuggagcagggccugauccacagaugcgccagccagugcgugguggcccugagcaucugcagcguggagaugcccgacaucaucaucaaggcccugcccgugcugguggugaagcugacccacaucagcgccaccgccagcauggccgugccccugcuggaguuccugagcacccuggccagacugccccaccuguacagaaacuucgccgccgagcaguacgccagcguguucgccaucagccugcccuacaccaaccccagcaaguucaaccaguacaucgugugccuggcccaccacgugaucgccaugugguucaucagaugcagacugcccuucagaaaggacuucgugcccuucaucaccaagggccugagaagcaacgugcugcugagcuucgacgacacccccgagaaggacagcuucagagccagaagcaccagccugaacgagagacccaagagccugagaaucgccagaccccccaagcagggccugaacaacagcccccccgugaaggaguucaaggagagcagcgccgccgaggccuucagaugcagaagcaucagcgugagcgagcacguggugagaagcagaauccagaccagccugaccagcgccagccugggcagcgccgacgagaacagcguggcccaggccgacgacagccugaagaaccugcaccuggagcugaccgagaccugccuggacaugauggccagauacguguucagcaacuucaccgccgugcccaagagaagccccgugggcgaguuccugcuggccggcggcagaaccaagaccuggcuggugggcaacaagcuggugaccgugaccaccagcgugggcaccggcaccagaagccugcugggccuggacagcggcgagcugcagagcggccccgagagcagcagcagccccggcgugcacgugagacagaccaaggaggcccccgccaagcuggagagccaggccggccagcaggugagcagaggcgccagagacagagugagaagcaugagcggcggccacggccugagagugggcgcccuggacgugcccgccagccaguuccugggcagcgccaccagccccggccccagaaccgcccccgccgccaagcccgagaaggccagcgccggcaccagagugcccgugcaggagaagaccaaccuggccgccuacgugccccugcugacccagggcugggccgagauccuggugagaagacccaccggcaacaccagcuggcugaugagccuggagaacccccugagccccuucagcagcgacaucaacaacaugccccugcaggagcugagcaacgcccugauggccgccgagagauucaaggagcacagagacaccgcccuguacaagagccugagcgugcccgccgccagcaccgccaagccccccccccugcccagaagcaacaccguggccagcuucagcagccuguaccagagcagcugccagggccagcugcacagaagcgugagcugggccgacagcgccguggugauggaggagggcagccccggcgaggugcccgugcugguggagccccccggccuggaggacguggaggccgcccugggcauggacagaagaaccgacgccuacagcagaagcagcagcgugagcagccaggaggagaagagccugcacgccgaggagcuggugggcagaggcauccccaucgagagaguggugagcagcgagggcggcagacccagcguggaccugagcuuccagcccagccagccccugagcaagagcagcagcagccccgagcugcagacccugcaggacauccugggcgaccccggcgacaaggccgacgugggcagacugagccccgaggugaaggccagaagccagagcggcacccuggacggcgagagcgccgccuggagcgccagcggcgaggacagcagaggccagcccgagggcccccugcccagcagcagccccagaagccccagcggccugagacccagaggcuacaccaucagcgacagcgcccccagcagaagaggcaagagaguggagagagacgcccugaagagcagagccaccgccagcaacgccgagaaggugcccggcaucaaccccagcuucguguuccugcagcuguaccacagccccuucuucggcgacgagagcaacaagcccauccugcugcccaacgagagccagagcuucgagagaagcgugcagcugcuggaccagauccccagcuacgacacccacaagaucgccgugcuguacgugggcgagggccagagcaacagcgagcuggccauccugagcaacgagcacggcagcuacagauacaccgaguuccugaccggccugggcagacugaucgagcugaaggacugccagcccgacaagguguaccugggcggccuggacgugugcggcgaggacggccaguucaccuacugcuggcacgacgacaucaugcaggccguguuccacaucgccacccugaugcccaccaaggacguggacaagcacagaugcgacaagaagagacaccugggcaacgacuucgugagcaucguguacaacgacagcggcgaggacuucaagcugggcaccaucaagggccaguucaacuucgugcacgugaucgugaccccccuggacuacgagugcaaccuggugagccugcagugcagaaaggacauggagggccugguggacaccagcguggccaagaucgugagcgacagaaaccugcccuucguggccagacagauggcccugcacgccaacauggccagccaggugcaccacagcagaagcaaccccaccgacaucuaccccagcaaguggaucgccagacugagacacaucaagagacugagacagagaaucugcgaggaggccgccuacagcaaccccagccugccccuggugcacccccccagccacagcaaggcccccgcccagacccccgccgagcccacccccggcuacgaggugggccagagaaagagacugaucagcagcguggaggacuucaccgaguucguguaa

SEQ ID NO: 25112 - RNA, 1320 nt, Artificial Sequence
  TSEN2__Homo_sapiens__NP_001138865
auggccgaggccguguuccacgcccccaagagaaagagaagaguguacgagaccuacgagagcccccugcccauccccuucggccaggaccacggcccccugaaggaguucaagaucuucagagccgagaugaucaacaacaacgugaucgugagaaacgccgaggacaucgagcagcuguacggcaagggcuacuucggcaagggcauccugagcagaagcagacccagcuucaccaucagcgaccccaagcugguggccaaguggaaggacaugaagaccaacaugcccaucaucaccagcaagagauaccagcacagcguggagugggccgccgagcugaugagaagacagggccaggacgagagcaccgugagaagaauccugaaggacuacaccaagccccuggagcacccccccgugaagagaaacgaggaggcccaggugcacgacaagcugaacagcggcauggugagcaacauggagggcaccgccggcggcgagagacccagcguggugaacggcgacagcggcaagagcggcggcgugggcgaccccagagagccccugggcugccugcaggagggcagcggcugccaccccaccaccgagagcuucgagaagagcgugagagaggacgccagcccccugccccacgugugcugcugcaagcaggacgcccugauccugcagagaggccugcaccacgaggacggcagccagcacaucggccugcugcaccccggcgacagaggccccgaccacgaguacgugcugguggaggaggccgagugcgccaugagcgagagagaggccgcccccaacgaggaggccuucuuccugguguacgcccugggcugccugagcaucuacuacgagaaggagccccugaccaucgugaagcuguggaaggccuucaccguggugcagcccaccuucagaaccaccuacauggccuaccacuacuucagaagcaagggcugggugcccaaggugggccugaaguacggcaccgaccugcugcuguacagaaagggcccccccuucuaccacgccagcuacagcgugaucaucgagcugguggacgaccacuucgagggcagccugagaagaccccugagcuggaagagccuggccgcccugagcagagugagcgugaacgugagcaaggagcugaugcugugcuaccugaucaagcccagcaccaugaccgacaaggagauggagagccccgagugcaugaagagaaucaaggugcaggaggugauccugagcagaugggugagcagcagagagagaagcgaccaggacgaccuguaa

SEQ ID NO: 25113 - RNA, 933 nt, Artificial Sequence
  TSEN34__Homo_sapiens__NP_001269261
augcuggugguggagguggccaacggcagaagccugguguggggcgccgaggccgugcaggcccugagagagagacugggcgugggcggcagaaccgugggcgcccugcccagaggccccagacagaacagcagacugggccugccccugcugcugaugcccgaggaggccagacugcuggccgagaucggcgccgugacccuggugagcgcccccagacccgacagcagacaccacagccuggcccugaccagcuucaagagacagcaggaggagagcuuccaggagcagagcgcccuggccgccgaggccagagagaccagaagacaggagcugcuggagaagaucaccgagggccaggccgccaagaagcagaagcuggagcaggccagcggcgccagcagcagccaggaggccggcagcagccaggccgccaaggaggacgagaccagcgacggccaggccagcggcgagcaggaggaggccggccccagcagcagccaggccggccccagcaacggcguggccccccugcccagaagcgcccugcuggugcagcuggccaccgccagacccagacccgugaaggccagaccccuggacuggagagugcagagcaaggacuggccccacgccggcagacccgcccacgagcugagauacagcaucuacagagaccugugggagagaggcuucuuccugagcgccgccggcaaguucggcggcgacuuccugguguaccccggcgacccccugagauuccacgcccacuacaucgcccagugcugggcccccgaggacaccaucccccugcaggaccugguggccgccggcagacugggcaccagcgugagaaagacccugcugcugugcagcccccagcccgacggcaaggugguguacaccagccugcagugggccagccugcaguaa

SEQ ID NO: 25114 - RNA, 1581 nt, Artificial Sequence
  TSEN54__Homo_sapiens__NP_997229
auggagcccgagcccgagcccgccgccguggaggugcccgccggcagagugcugagcgccagagagcuguucgccgccagaagcagaagccagaagcugccccagagaagccacggccccaaggacuuccugcccgacggcagcgccgcccaggccgagagacugagaagaugcagagaggagcuguggcagcugcuggccgagcagagaguggagagacugggcagccugguggccgccgaguggagacccgaggagggcuucguggagcugaagagccccgccggcaaguucuggcagaccaugggcuucagcgagcagggcagacagagacugcaccccgaggaggcccuguaccugcuggagugcggcagcauccaccuguuccaccaggaccugccccugagcauccaggaggccuaccagcugcugcugaccgaccacaccgugaccuuccugcaguaccagguguucagccaccugaagagacugggcuacguggugagaagauuccagcccagcagcgugcugagccccuacgagagacagcugaaccuggacgccagcgugcagcaccuggaggacggcgacggcaagagaaagagaagcagcagcagccccagaagcaucaacaagaaggccaaggcccuggacaacagccugcagcccaagagccuggccgccagcagccccccccccugcagccagcccagccagugccccgaggagaagccccaggagagcagccccaugaagggccccggcggccccuuccagcugcugggcagccugggccccagccccggccccgccagagagggcgugggcugcagcugggagagcggcagagccgagaacggcgugaccggcgccggcaagagaagauggaacuucgagcagaucagcuuccccaacauggccagcgacagcagacacacccugcugagagcccccgcccccgagcugcugcccgccaacguggccggcagagagaccgacgccgagagcuggugccagaagcugaaccagagaaaggagaagcugagcagaagagagagagagcaccacgccgaggccgcccaguuccaggaggacgugaacgccgaccccgaggugcagagaugcagcagcuggagagaguacaaggagcugcugcagagaagacaggugcagagaagccagagaagagccccccaccuguggggccagcccgugaccccccugcugagccccggccaggccagcagccccgccguggugcugcagcacaucagcgugcugcagaccacccaccugcccgacggcggcgccagacugcuggagaagagcggcggccuggagaucaucuucgacguguaccaggccgacgccguggccaccuucagaaagaacaaccccggcaagcccuacgccagaaugugcaucagcggcuucgacgagcccgugcccgaccugugcagccugaagagacugagcuaccagagcggcgacgugccccugaucuucgcccugguggaccacggcgacaucagcuucuacagcuucagagacuucacccugccccaggacgugggccacuaa

SEQ ID NO: 25115 - RNA, 504 nt, Artificial Sequence
  TSFM__Homo_sapiens__NP_001166166
augagccugcugagaagccugagaguguuccugguggccagaaccggcagcuaccccgccggcagccugcugagacagagcccccagcccagacacaccuucuacgccggccccagacugagcgccagcgccagcagcaaggagcugcugaugaagcugagaagaaagaccggcuacagcuucgugaacugcaagaaggcccuggagaccugcggcggcgaccugaagcaggccgagaucuggcugcacaaggaggcccagaaggagggcuggagcaaggccgccaagcugcagggcagaaagaccaaggagggccugaucggccugcugcaggagggcaacaccaccgugcugguggaggugaacugcgagaccgacuucgugagcagaaaccugaaguuccagcugcuggugcagcagguggcccugggcaccaugaugcacugccagacccugaaggaccagcccagcgccuacagcaaggagaacugggagaagaccuaa

SEQ ID NO: 25116 - RNA, 1173 nt, Artificial Sequence
  TSG101__Homo_sapiens__NP_006283
auggccgugagcgagagccagcugaagaagauggugagcaaguacaaguacagagaccugaccgugagagagaccgugaacgugaucacccuguacaaggaccugaagcccgugcuggacagcuacguguucaacgacggcagcagcagagagcugaugaaccugaccggcaccauccccgugcccuacagaggcaacaccuacaacauccccaucugccuguggcugcuggacaccuaccccuacaacccccccaucugcuucgugaagcccaccagcagcaugaccaucaagaccggcaagcacguggacgccaacggcaagaucuaccugcccuaccugcacgaguggaagcacccccagagcgaccugcugggccugauccaggugaugaucgugguguucggcgacgagccccccguguucagcagacccaucagcgccagcuacccccccuaccaggccaccggcccccccaacaccagcuacaugcccggcaugcccggcggcaucagccccuaccccagcggcuacccccccaaccccagcggcuaccccggcugccccuacccccccggcggccccuaccccgccaccaccagcagccaguaccccagccagccccccgugaccaccgugggccccagcagagacggcaccaucagcgaggacaccaucagagccagccugaucagcgccgugagcgacaagcugagauggagaaugaaggaggagauggacagagcccaggccgagcugaacgcccugaagagaaccgaggaggaccugaagaagggccaccagaagcuggaggagauggugaccagacuggaccaggagguggccgagguggacaagaacaucgagcugcugaagaagaaggacgaggagcugagcagcgcccuggagaagauggagaaccagagcgagaacaacgacaucgacgaggugaucauccccaccgccccccuguacaagcagauccugaaccuguacgccgaggagaacgccaucgaggacaccaucuucuaccugggcgaggcccugagaagaggcgugaucgaccuggacguguuccugaagcacgugagacugcugagcagaaagcaguuccagcugagagcccugaugcagaaggccagaaagaccgccggccugagcgaccuguacuaa

SEQ ID NO: 25117 - RNA, 2097 nt, Artificial Sequence
  TSGA10__Homo_sapiens__NP_878915
augaugagaagcagaagcaagagccccagaagacccagccccaccgccagaggcgccaacugcgacguggagcugcugaagaccaccaccagagacagagaggagcugaagugcaugcuggagaaguacgagagacaccuggccgagauccagggcaacgugaaggugcugaagagcgagagagacaagaucuuccugcuguacgagcaggcccaggaggagaucaccagacugagaagagagaugaugaagagcugcaagagccccaagagcaccaccgcccacgccauccugagaagaguggagaccgagagagacguggccuucaccgaccugagaagaaugaccaccgagagagacagccugagagagagacugaagaucgcccaggagaccgccuucaacgagaaggcccaccuggagcagagaaucgaggagcuggagugcaccgugcacaaccuggacgacgagagaauggagcagaugagcaacaugacccugaugaaggagaccaucagcaccguggagaaggagaugaagagccuggccagaaaggccauggacaccgagagcgagcugggcagacagaaggccgagaacaacagccugagacugcuguacgagaacaccgagaaggaccugagcgacacccagagacaccuggccaagaagaaguacgagcugcagcugacccaggagaagaucaugugccuggacgagaagaucgacaacuucaccagacagaacaucgcccagagagaggagaucagcauccugggcggcacccugaacgaccuggccaaggagaaggagugccugcaggccugccuggacaagaagagcgagaacaucgccagccugggcgagagccuggccaugaaggagaagaccaucagcggcaugaagaacaucaucgccgagauggagcaggccagcagacagugcaccgaggcccugaucgugugcgagcaggacgugagcagaaugagaagacagcuggacgagaccaacgacgagcuggcccagaucgccagagagagagacauccuggcccacgacaacgacaaccugcaggagcaguucgccaaggccaagcaggagaaccaggcccugagcaagaagcugaacgacacccacaacgagcugaacgacaucaagcagaaggugcaggacaccaaccuggaggugaacaagcugaagaacauccugaagagcgaggagagcgagaacagacagaugauggagcagcugagaaaggccaacgaggacgccgagaacugggagaacaaggccagacagagcgaggccgacaacaacacccugaagcuggagcugaucaccgccgaggccgagggcaacagacugaaggagaagguggacagccugaacagagagguggagcagcaccugaacgccgagagaagcuacaagagccagaucagcacccugcacaagagcguggugaagauggaggaggagcugcagaaggugcaguucgagaaggugagcgcccuggccgaccugagcagcaccagagagcugugcaucaagcuggacagcagcaaggagcugcugaacagacagcugguggccaaggaccaggagaucgagaugagagagaacgagcuggacagcgcccacagcgagaucgagcugcugagaagccagauggccaacgagagaaucagcaugcagaaccuggaggcccugcugguggccaacagagacaaggaguaccagagccagaucgcccugcaggagaaggagagcgagauccagcugcugaaggagcaccugugccuggccgagaacaagauggccauccagagcagagacguggcccaguucagaaacguggugacccagcuggaggccgaccuggacaucaccaagagacagcugggcaccgagagauucgagagagagagagccgugcaggagcugagaagacagaacuacagcagcaacgccuaccacaugagcagcaccaugaagcccaacaccaagugccacagccccgagagagcccaccacagaagccccgacagaggccuggacagaagccuggaggagaaccugugcuacagagacuucuaa

SEQ ID NO: 25118 - RNA, 2295 nt, Artificial Sequence
  TSHR__Homo_sapiens__XP_005268094
augagacccgccgaccugcugcagcuggugcugcugcuggaccugcccagagaccugggcggcaugggcugcagcagcccccccugcgagugccaccaggaggaggacuucagagugaccugcaaggacauccagagaauccccagccugccccccagcacccagacccugaagcugaucgagacccaccugagaaccauccccagccacgccuucagcaaccugcccaacaucagcagaaucuacgugagcaucgacgugacccugcagcagcuggagagccacagcuucuacaaccugagcaaggugacccacaucgagaucagaaacaccagaaaccugaccuacaucgaccccgacgcccugaaggagcugccccugcugaaguuccugggcaucuucaacaccggccugaagauguuccccgaccugaccaagguguacagcaccgacaucuucuucauccuggagaucaccgacaaccccuacaugaccagcauccccgugaacgccuuccagggccugugcaacgagacccugacccugaagcuguacaacaacggcuucaccagcgugcagggcuacgccuucaacggcaccaagcuggacgccguguaccugaacaagaacaaguaccugaccgugaucgacaaggacgccuucggcggcguguacagcggccccagccugcuggacgugagccagaccagcgugaccgcccugcccagcaagggccuggagcaccugaaggagcugaucgccagaaacaccuggacccugaagaagcugccccugagccugagcuuccugcaccugaccagagccgaccugagcuaccccagccacugcugcgccuucaagaaccagaagaagaucagaggcauccuggagagccugaugugcaacgagagcagcaugcagagccugagacagagaaagagcgugaacgcccugaacagcccccugcaccaggaguacgaggagaaccugggcgacagcaucgugggcuacaaggagaagagcaaguuccaggacacccacaacaacgcccacuacuacguguucuucgaggagcaggaggacgagaucaucggcuucggccaggagcugaagaacccccaggaggagacccugcaggccuucgacagccacuacgacuacaccaucugcggcgacagcgaggacauggugugcacccccaagagcgacgaguucaaccccugcgaggacaucaugggcuacaaguuccugagaaucguggugugguucgugagccugcuggcccugcugggcaacguguucgugcugcugauccugcugaccagccacuacaagcugaacgugcccagauuccugaugugcaaccuggccuucgccgacuucugcaugggcauguaccugcugcugaucgccagcguggaccuguacacccacagcgaguacuacaaccacgccaucgacuggcagaccggccccggcugcaacaccgccggcuucuucaccguguucgccagcgagcugagcguguacacccugaccgugaucacccuggagagaugguacgccaucaccuucgccaugagacuggacagaaagaucagacugagacacgccugcgccaucauggugggcggcugggugugcugcuuccugcuggcccugcugccccuggugggcaucagcagcuacgccaaggugagcaucugccugcccauggacaccgagaccccccuggcccuggccuacaucguguucgugcugacccugaacaucguggccuucgugaucgugugcugcugcuacgugaagaucuacaucaccgugagaaacccccaguacaaccccggcgacaaggacaccaagaucgccaagagaauggccgugcugaucuucaccgacuucaucugcauggcccccaucagcuucuacgcccugagcgccauccugaacaagccccugaucaccgugagcaacagcaagauccugcuggugcuguucuacccccugaacagcugcgccaaccccuuccuguacgccaucuucaccaaggccuuccagagagacguguucauccugcugagcaaguucggcaucugcaagagacaggcccaggccuacagaggccagagagugccccccaagaacagcaccgacauccaggugcagaaggugacccacgagaugagacagggccugcacaacauggaggacguguacgagcugaucgagaacagccaccugacccccaagaagcagggccagaucagcgaggaguacaugcagaccgugcuguaa

SEQ ID NO: 25119 - RNA, 3099 nt, Artificial Sequence
  TSHZ1__Homo_sapiens__NP_005777
augugcaacgaggagaccgagaucaaggaggcccagagcuaccagaacagccccgugagcagcgccaccaaccaggacgccggcuacggcagccccuucagcgagagcagcgaccagcuggcccacuucaagggcagcagcagcagagaggagaaggaggacccccagugccccgacagcgugagcuacccccaggacagccuggcccagaucaaggccguguacgccaaccuguucagcgagagcugcuggagcagccuggcccuggaccugaagaagagcggcagcaccaccagcaccaacgacgccagccagaaggagagcagcgcccccacccccaccccccccaccugccccgugagcaccaccggccccaccaccagcacccccagcaccagcugcagcagcagcaccagccacagcagcaccaccagcaccagcagcagcagcggcuacgacuggcaccaggccgcccuggccaagacccugcagcagaccagcagcuacggccugcugcccgagcccagccuguucagcaccgugcagcuguacagacagaacaacaagcuguacggcagcguguucaccggcgccagcaaguucagaugcaaggacugcagcgccgccuacgacacccugguggagcugaccgugcacaugaacgagaccggccacuacagagacgacaacagagacaaggacagcgagaagaccaagagauggagcaagcccagaaagagaagccugauggagauggagggcaaggaggacgcccagaaggugcugaagugcauguacugcggccacagcuucgagagccugcaggaccugagcgugcacaugaucaagaccaagcacuaccagaaggugccccugaaggagcccgugcccgccaucaccaagcuggugcccagcaccaagaagagagcccugcaggaccuggccccccccugcagccccgagcccgccggcauggccgccgagguggcccugagcgagagcgccaaggaccagaaggccgccaaccccuacgugacccccaacaacagauacggcuaccagaacggcgccagcuacaccuggcaguucgaggccagaaaggcccagauccugaagugcauggagugcggcagcagccacgacacccugcagcagcugaccgcccacaugauggugaccggccacuuccugaaggugaccaccagcgccagcaagaagggcaagcagcuggugcuggaccccgugguggaggagaagauccagagcaucccccugccccccaccacccacaccagacugcccgccagcagcaucaagaagcagcccgacagccccgccggcagcaccaccagcgaggagaagaaggagcccgagaaggagaagccccccguggccggcgacgccgagaagaucaaggaggagagcgaggacagccuggagaaguucgagcccagcacccuguaccccuaccugagagaggaggaccuggacgacagccccaagggcggccuggacauccugaagagccuggagaacaccgugagcaccgccaucagcaaggcccagaacggcgcccccagcuggggcggcuaccccagcauccacgccgccuaccagcugcccggcaccgugaagccccugcccgccgccgugcagagcgugcaggugcagcccagcuacgccggcggcgugaagagccugagcagcgccgagcacaacgcccugcugcacagccccggcagccugaccccccccccccacaagagcaacgugagcgccauggaggagcugguggagaaggugaccggcaaggugaacaucaagaaggaggagagaccccccgagaaggagaagagcagccuggccaaggccgccagccccaucgccaaggagaacaaggacuuccccaagaccgaggaggugagcggcaagccccagaagaagggccccgaggccgagaccggcaaggccaagaaggagggcccccuggacgugcacacccccaacggcaccgagccccugaaggccaaggugaccaacggcugcaacaaccugggcaucaucauggaccacagccccgagcccagcuucaucaacccccugagcgcccugcagagcaucaugaacacccaccugggcaaggugagcaagcccgugagccccagccuggacccccuggccaugcuguacaagaucagcaacagcaugcuggacaagcccguguaccccgccacccccgugaagcaggccgacgccaucgacagauacuacuacgagaacagcgaccagcccaucgaccugaccaagagcaagaacaagccccuggugagcagcguggccgacagcguggccagcccccugagagagagcgcccugauggacaucagcgacauggugaagaaccugaccggcagacugacccccaagagcagcacccccagcaccgugagcgagaagagcgacgccgacggcagcagcuucgaggaggcccuggacgagcugagccccgugcacaagagaaagggcagacagagcaacuggaacccccagcaccugcugauccugcaggcccaguucgccagcagccugagagagaccaccgagggcaaguacaucaugagcgaccugggcccccaggagagagugcacaucagcaaguucaccggccugagcaugaccaccaucagccacuggcuggccaacgugaaguaccagcugagaagaaccggcggcaccaaguuccugaagaaccuggacaccggccaccccguguucuucugcaacgacugcgccagccaguucagaaccgccagcaccuacaucagccaccuggagacccaccugggcuucagccugaaggaccugagcaagcugccccugaaccagauccaggagcagcagaacgugagcaaggugcugaccaacaagacccugggcccccugggcgccaccgaggaggaccugggcagcaccuuccagugcaagcugugcaacagaaccuucgccagcaagcacgccgugaagcugcaccugagcaagacccacggcaagagccccgaggaccaccugaucuacgugaccgagcuggagaagcaguaa

SEQ ID NO: 25120 - RNA, 3096 nt, Artificial Sequence
  TSHZ2__Homo_sapiens__NP_001180350
augauggccgccgcccugcugcacuacaccggcuacgcccaggaggagcagcugaaggaggaggaggagaucaaggaggaggaggaggaggaggacagcggcagcguggcccagcugcagggcggcaacgacaccggcaccgacgaggagcuggagaccggccccgagcagaagggcugcuucagcuaccagaacagccccggcagccaccugagcaaccaggacgccgagaacgagagccugcugagcgacgccagcgaccaggugagcgacaucaagagcgugugcggcagagacgccagcgacaagaaggcccacacccacgugagacugcccaacgaggcccacaacugcauggacaagaugaccgccguguacgccaacauccugagcgacagcuacuggagcggccugggccugggcuucaagcugagcaacagcgagagaagaaacugcgacaccagaaacggcagcaacaagagcgacuucgacuggcaccaggacgcccugagcaagagccugcagcagaaccugcccagcagaagcgugagcaagcccagccuguucagcagcgugcagcuguacagacagagcagcaagaugugcggcaccguguucaccggcgccagcagauucagaugcagacagugcagcgccgccuacgacacccugguggagcugaccgugcacaugaacgagaccggccacuaccaggacgacaacagaaagaaggacaagcugagacccaccagcuacagcaagcccagaaagagagccuuccaggacauggacaaggaggacgcccagaaggugcugaagugcauguucugcggcgacagcuucgacagccugcaggaccugagcgugcacaugaucaagaccaagcacuaccagaaggugccccugaaggagcccgugcccaccaucagcagcaagauggugacccccgccaagaagagaguguucgacgugaacagacccugcagccccgacagcaccaccggcagcuucgccgacagcuucagcagccagaagaacgccaaccugcagcugagcagcaacaacagauacggcuaccagaacggcgccagcuacaccuggcaguucgaggccugcaagagccagauccugaagugcauggagugcggcagcagccacgacacccugcagcagcugaccacccacaugauggugaccggccacuuccugaaggugaccagcagcgccagcaagaagggcaagcagcuggugcuggacccccuggccguggagaagaugcagagccugagcgaggcccccaacagcgacagccuggcccccaagcccagcagcaacagcgccagcgacugcaccgccagcaccaccgagcugaagaaggagagcaagaaggagagacccgaggagaccagcaaggacgagaagguggugaagagcgaggacuacgaggacccccugcagaagccccuggaccccaccaucaaguaccaguaccugagagaggaggaccuggaggacggcagcaagggcggcggcgacauccugaagagccuggagaacaccgugaccaccgccaucaacaaggcccagaacggcgcccccagcuggagcgccuaccccagcauccacgccgccuaccagcugagcgagggcaccaagcccccccugcccaugggcagccaggugcugcagaucagacccaaccugaccaacaagcugagacccaucgcccccaaguggaaggugaugccccuggugagcaugcccacccaccuggcccccuacacccaggugaagaaggagagcgaggacaaggacgaggccgugaaggagugcggcaaggagagcccccacgaggaggccagcagcuucagccacagcgagggcgacagcuucagaaagagcgagaccccccccgaggccaagaagaccgagcugggcccccugaaggaggaggagaagcugaugaaggagggcagcgagaaggagaagccccagccccuggagcccaccagcgcccugagcaacggcugcgcccuggccaaccacgcccccgcccugcccugcaucaacccccugagcgcccugcagagcgugcugaacaaccaccugggcaaggccaccgagccccugagaagccccagcugcagcagccccagcagcagcaccaucagcauguuccacaagagcaaccugaacgugauggacaagcccgugcugagccccgccagcaccagaagcgccagcgugagcagaagauaccuguucgagaacagcgaccagcccaucgaccugaccaagagcaagagcaagaaggccgagagcagccaggcccagagcugcaugagccccccccagaagcacgcccugagcgacaucgccgacauggugaaggugcugcccaaggccaccacccccaagcccgccagcagcagcagagugccccccaugaagcuggagauggacgugagaagauucgaggacgugagcagcgaggugagcacccugcacaagagaaagggcagacagagcaacuggaacccccagcaccugcugauccugcaggcccaguucgccagcagccuguuccagaccagcgagggcaaguaccugcugagcgaccugggcccccaggagagaaugcagaucagcaaguucaccggccugagcaugaccaccaucagccacuggcuggccaacgugaaguaccagcugagaaagaccggcggcaccaaguuccugaagaacauggacaagggccaccccaucuucuacugcagcgacugcgccagccaguucagaacccccagcaccuacaucagccaccuggagagccaccugggcuuccagaugaaggacaugaccagacugagcguggaccagcagagcaagguggagcaggagaucagcagagugagcagcgcccagagaagccccgagaccaucgccgccgaggaggacaccgacagcaaguucaagugcaagcugugcugcagaaccuucgugagcaagcacgccgugaagcugcaccugagcaagacccacagcaagagccccgagcaccacagccaguucgugaccgacguggacgaggaguaa

SEQ ID NO: 25121 - RNA, 3246 nt, Artificial Sequence
  TSHZ3__Homo_sapiens__NP_065907
augcccagaagaaagcagcaggcccccagaagagccgccgccuacgugagcgaggagcugaaggccgccgcccugguggacgagggccuggaccccgaggagcacaccgccgacggcgagcccagcgccaaguacaugugccccgagaaggagcuggccagagccugccccagcuaccagaacagccccgccgccgaguucagcugccacgagauggacagcgagagccacaucagcgagaccagcgacagaauggccgacuucgagagcggcagcaucaagaacgaggaggagaccaaggaggugaccgugccccuggaggacaccaccgugagcgacagccuggagcagaugaaggccguguacaacaacuuccugagcaacagcuacuggagcaaccugaaccugaaccugcaccagcccagcagcgagaagaacaacggcagcagcagcagcagcagcagcagcagcagcagcugcggcagcggcagcuucgacuggcaccagagcgccauggccaagacccugcagcaggugagccagagcagaaugcugcccgagcccagccuguucagcaccgugcagcuguacagacagagcagcaagcuguacggcagcaucuucaccggcgccagcaaguucagaugcaaggacugcagcgccgccuacgacacccugguggagcugaccgugcacaugaacgagaccggccacuacagagacgacaaccacgagaccgacaacaacaaccccaagagauggagcaagcccagaaagagaagccugcuggagauggagggcaaggaggacgcccagaaggugcugaagugcauguacugcggccacagcuucgagagccugcaggaccugagcgugcacaugaucaagaccaagcacuaccagaaggugccccugaaggagcccgugacccccguggccgccaagaucauccccgccaccagaaagaaggccagccuggagcuggagcugcccagcagccccgacagcaccggcggcacccccaaggccaccaucagcgacaccaacgacgcccugcagaagaacagcaaccccuacaucacccccaacaacagauacggccaccagaacggcgccagcuacgccuggcacuucgaggccagaaagagccagauccugaagugcauggagugcggcagcagccacgacacccugcaggagcugaccgcccacaugauggugaccggccacuucaucaaggugaccaacagcgccaugaagaagggcaagcccaucguggagacccccgugacccccaccaucaccacccugcuggacgagaaggugcagagcgugccccuggccgccaccaccuucaccagccccagcaacacccccgccagcaucagccccaagcugaacguggaggugaagaaggagguggacaaggagaaggccgugaccgacgagaagcccaagcagaaggacaagcccggcgaggaggaggagaagugcgacaucagcagcaaguaccacuaccugaccgagaacgaccuggaggagagccccaagggcggccuggacauccugaagagccuggagaacaccgugaccagcgccaucaacaaggcccagaacggcacccccagcuggggcggcuaccccagcauccacgccgccuaccagcugcccaacaugaugaagcugagccugggcagcagcggcaagagcaccccccugaagcccauguucggcaacagcgagaucgugagccccaccaagaaccagacccuggugagcccccccagcagccagaccagccccaugcccaagaccaacuuccacgccauggaggagcuggugaagaaggugaccgagaagguggccaagguggaggagaagaugaaggagcccgacggcaagcugagcccccccaagagagccacccccagccccugcagcagcgaggugggcgagcccaucaagauggaggccagcagcgacggcggcuucagaagccaggagaacagccccagcccccccagagacggcugcaaggacggcagcccccuggccgagcccguggagaacggcaaggagcuggugaagccccuggccagcagccugagcggcagcaccgccaucaucaccgaccacccccccgagcagcccuucgugaacccccugagcgcccugcagagcgugaugaacauccaccugggcaaggccgccaagcccagccugcccgcccuggaccccaugagcaugcuguucaagaugagcaacagccuggccgagaaggccgccguggccaccccccccccccugcagagcaagaaggccgaccaccuggacagauacuucuaccacgugaacaacgaccagcccaucgaccugaccaagggcaagagcgacaagggcugcagccugggcagcgugcugcugagccccaccagcaccgcccccgccaccagcagcagcaccgugaccaccgccaagaccagcgccguggugagcuucaugagcaacagcccccugagagagaacgcccugagcgacaucagcgacaugcugaagaaccugaccgagagccacaccagcaagagcagcacccccagcagcaucagcgagaagagcgacaucgacggcgccacccuggaggaggccgaggagagcacccccgcccagaagagaaagggcagacagagcaacuggaacccccagcaccugcugauccugcaggcccaguucgccgccagccugagacagaccagcgagggcaaguacaucaugagcgaccugagcccccaggagagaaugcacaucagcagauucaccggccugagcaugaccaccaucagccacuggcuggccaacgugaaguaccagcugagaagaaccggcggcaccaaguuccugaagaaccuggacaccggccaccccguguucuucugcaacgacugcgccagccagaucagaacccccagcaccuacaucagccaccuggagagccaccugggcuucagacugagagaccugagcaagcugagcaccgagcagaucaacagccagaucgcccagaccaagagccccagcgagaagauggugaccagcagccccgaggaggaccugggcaccagcuaccagugcaagcugugcaacagaaccuucgccagcaagcacgccgugaagcugcaccugagcaagacccacggcaagagccccgaggaccaccugcuguacgugagcgagcuggagaagcaguaa

SEQ ID NO: 25122 - RNA, 480 nt, Artificial Sequence
  TSLP__Homo_sapiens__NP_149024
auguuccccuucgcccugcuguacgugcugagcgugagcuucagaaagaucuucauccugcagcuggugggccuggugcugaccuacgacuucaccaacugcgacuucgagaagaucaaggccgccuaccugagcaccaucagcaaggaccugaucaccuacaugagcggcaccaagagcaccgaguucaacaacaccgugagcugcagcaacagaccccacugccugaccgagauccagagccugaccuucaaccccaccgccggcugcgccagccuggccaaggagauguucgccaugaagaccaaggccgcccuggccaucuggugccccggcuacagcgagacccagaucaacgccacccaggccaugaagaagagaagaaagagaaaggugaccaccaacaagugccuggagcaggugagccagcugcagggccuguggagaagauucaacagaccccugcugaagcagcaguaa

SEQ ID NO: 25123 - RNA, 873 nt, Artificial Sequence
  TSNAX__Homo_sapiens__NP_005990
augagcaacaaggagggcagcggcggcuucagaaagagaaagcacgacaacuucccccacaaccagagaagagagggcaaggacgugaacagcagcagccccgugaugcuggccuucaagagcuuccagcaggagcuggacgccagacacgacaaguacgagagacuggugaagcugagcagagacaucaccguggagagcaagagaaccaucuuccugcugcacagaaucaccagcgcccccgacauggaggacauccugaccgagagcgagaucaagcuggacggcgugagacagaagaucuuccagguggcccaggagcugagcggcgaggacaugcaccaguuccacagagccaucaccaccggccugcaggaguacguggaggccgugagcuuccagcacuucaucaagaccagaagccugaucagcauggacgagaucaacaagcagcugaucuucaccaccgaggacaacggcaaggagaacaagacccccagcagcgacgcccaggacaagcaguucggcaccuggagacugagagugacccccguggacuaccugcugggcguggccgaccugaccggcgagcugaugagaaugugcaucaacagcgugggcaacggcgacaucgacacccccuucgaggugagccaguuccugagacagguguacgacggcuucagcuucaucggcaacaccggccccuacgaggugagcaagaagcuguacacccugaagcagagccuggccaagguggagaacgccugcuacgcccugaaggugagaggcagcgagauccccaagcacaugcuggccgacguguucagcgugaagaccgagaugaucgaccaggaggagggcaucagcuaa

SEQ ID NO: 25124 - RNA, 447 nt, Artificial Sequence
  TSN__Homo_sapiens__NP_001248330
augagcgugagcgagaucuucguggagcugcagggcuuccuggccgccgagcaggacaucagagaggagaucagaaagguggugcagagccuggagcagaccgccagagagauccugacccugcugcagggcgugcaccagggcgccggcuuccaggacauccccaagagaugccugaaggccagagagcacuucggcaccgugaagacccaccugaccagccugaagaccaaguuccccgccgagcaguacuacagauuccacgagcacuggagauucgugcugcagagacugguguuccuggccgccuucgugguguaccuggagaccgagacccuggugaccagagaggccgugaccgagauccugggcaucgaggccgugugccagcagagagacugcuggagacugcugcccacccccccccaccugcaccugcaccaguaa

SEQ ID NO: 25125 - RNA, 1182 nt, Artificial Sequence
  TSPAN10__Homo_sapiens__NP_001277141
augcacagacuggcccagggcagaagccaggaccagcccagcagccccgccaccgaggagcccgccaaccugagcagaagacugugcuggggccugagcgugcccgccagcagaauggaggagggcgagagaagcccccugcugagccaggagaccgccggccagaagccccugagcgugcacagaccccccaccagcggcugccugggccccgugcccagagaggaccaggccgaggccuggggcugcagcugcugcccccccgagaccaagcaccaggcccugagcggcacccccaagaagggccccgcccccagccugagccccggcagcagcugcgugaaguaccugaucuuccugagcaacuuccccuucagccugcugggccugcuggcccuggccaucggccuguggggccuggccgugaagggcagccugggcagcgaccugggcggcccccugcccgccgaccccaugcugggccuggcccugggcggccugguggugagcgccgugagccuggccggcuaccugggcgcccugugcgagaacaccugccugcugagaggcuucagcggcggcauccuggccuuccuggugcuggaggccguggccggcgcccuggugguggcccuguggggcccccugcaggacagccuggagcacacccugagaguggccaucgcccacuaccaggacgaccccgaccugagauuccugcuggaccaggugcagcugggccugagaugcugcggcgccgccagcuaccaggacuggcagcagaaccuguacuucaacugcagcagccccggcgugcaggccugcagccugcccgccagcugcugcaucgaccccagagaggacggcgccagcgugaacgaccagugcggcuucggcgugcugagacuggacgccgacgccgcccagagagugguguaccuggagggcugcggccccccccugagaagauggcugagagccaaccuggccgccagcggcggcuacgccaucgccguggugcugcugcagggcgccgagcugcugcuggccgccagacugcugggcgcccuggccgccagaagaggcgccgccuacggccccggcgccagaggcgaggacagagccggcccccagagccccagccccggcgccccccccgccgccaagcccgccagaggcuaa

SEQ ID NO: 25126 - RNA, 762 nt, Artificial Sequence
  TSPAN11__Homo_sapiens__XP_011518982
auggcccacuacaagaccgagcaggacgacuggcugaucaucuaccugaaguaccugcuguucguguucaacuucuucuucugggugggcggcgccgccgugcuggccgugggcaucuggacccugguggagaagagcggcuaccugagcgugcuggccagcagcaccuucgccgccagcgccuacauccugaucuucgccggcgugcuggugauggugaccggcuuccugggcuucggcgccauccugugggagagaaagggcugccugagcaccuacuucugccugcugcuggugaucuuccugguggagcugguggccggcgugcuggcccacguguacuaccagagacugagcgacgagcugaagcagcaccugaacagaacccuggccgagaacuacggccagcccggcgccacccagaucaccgccagcguggacagacugcagcaggacuucaagugcugcggcagcaacagcagcgccgacuggcagcacagcaccuacauccugcugagagaggccgagggcagacaggugcccgacagcugcugcaagaccgugguggugagaugcggccagagagcccaccccagcaacaucuacaagguggagggcggcugccugaccaagcuggagcaguuccuggccgaccaccugcugcugaugggcgccgugggcaucggcguggccugccugcagaucugcggcauggugcugaccugcugccugcaccagagacugcagagacacuucuacuaa

SEQ ID NO: 25127 - RNA, 918 nt, Artificial Sequence
  TSPAN12__Homo_sapiens__XP_011514296
auggccagagaggacagcgugaagugccugagaugccugcuguacgcccugaaccugcuguucuggcugaugagcaucagcgugcuggccgugagcgccuggaugagagacuaccugaacaacgugcugacccugaccgccgagaccagaguggaggaggccgugauccugaccuacuuccccguggugcaccccgugaugaucgccgugugcugcuuccugaucaucgugggcaugcugggcuacugcggcaccgugaagagaaaccugcugcugcuggccugguacuucggcagccugcuggugaucuucugcguggagcuggccugcggcguguggaccuacgagcaggagcugauggugcccgugcaguggagcgacauggugacccugaaggccagaaugaccaacuacggccugcccagauacagauggcugacccacgccuggaacuucuuccagagagaguucaagugcugcggcgugguguacuucaccgacuggcuggagaugaccgagauggacuggccccccgacagcugcugcgugagagaguuccccggcugcagcaagcaggcccaccaggaggaccugagcgaccuguaccaggagggcugcggcaagaagauguacagcuuccugagaggcaccaagcagcugcaggugcugagauuccugggcaucagcaucggcgugacccagauccuggccaugauccugaccaucacccugcugugggcccuguacuacgacagaagagagcccggcaccgaccagaugaugagccugaagaacgacaacagccagcaccugagcugccccagcguggagcugcugaagcccagccugagcagaaucuucgagcacaccagcauggccaacagcuucaacacccacuucgagauggaggagcuguaa

SEQ ID NO: 25128 - RNA, 615 nt, Artificial Sequence
  TSPAN13__Homo_sapiens__NP_055214
auggugugcggcggcuucgccugcagcaagaacugccugugcgcccugaaccugcuguacacccuggugagccugcugcugaucggcaucgccgccuggggcaucggcuucggccugaucagcagccugagaguggugggcguggugaucgccgugggcaucuuccuguuccugaucgcccuggugggccugaucggcgccgugaagcaccaccaggugcugcuguucuucuacaugaucauccugcugcugguguucaucgugcaguucagcgugagcugcgccugccuggcccugaaccaggagcagcagggccagcugcuggaggugggcuggaacaacaccgccagcgccagaaacgacauccagagaaaccugaacugcugcggcuucagaagcgugaaccccaacgacaccugccuggccagcugcgugaagagcgaccacagcugcagccccugcgcccccaucaucggcgaguacgccggcgaggugcugagauucgugggcggcaucggccuguucuucagcuucaccgagauccugggcguguggcugaccuacagauacagaaaccagaaggaccccagagccaaccccagcgccuuccuguaa

SEQ ID NO: 25129 - RNA, 444 nt, Artificial Sequence
  TSPAN14__Homo_sapiens__NP_001121781
augcacuacuacagauacagcaacgccaaggugagcugcugguacaaguaccugcuguucagcuacaacaucaucuucuggaaccagugcugcggcgccuacggccccgaggacugggaccugaacguguacuucaacugcagcggcgccagcuacagcagagagaagugcggcgugcccuucagcugcugcgugcccgaccccgcccagaagguggugaacacccagugcggcuacgacgugagaauccagcugaagagcaagugggacgagagcaucuucaccaagggcugcauccaggcccuggagagcuggcugcccagaaacaucuacaucguggccggcguguucaucgccaucagccugcugcagaucuucggcaucuuccuggccagaacccugaucagcgacaucgaggccgugaaggccggccaccacuucuaa

SEQ ID NO: 25130 - RNA, 735 nt, Artificial Sequence
  TSPAN16__Homo_sapiens__NP_001269438
auggccgagauccacacccccuacagcagccugaagaagcugcugagccugcugaacggcuucguggccgugagcggcaucauccuggugggccugggcaucggcggcaagugcggcggcgccagccugaccaacgugcugggccugagcagcgccuaccugcugcacgugggcaaccugugccuggugaugggcugcaucaccgugcugcugggcugcgccggcugguacggcgccaccaaggagagcagaggcacccugcuguucugcauccugagcauggugaucgugcugaucauggaggugaccgccgccaccguggugcugcuguucuuccccaucgugggcgacguggcccuggagcacaccuucgugacccugagaaagaacuacagaggcuacaacgagcccgacgacuacagcacccaguggaaccuggugauggagaagcugaagugcugcggcgugaacaacuacaccgacuucagcggcagcagcuucgagaugaccaccggccacaccuaccccagaagcugcugcaagagcaucggcagcgugagcugcgacggcagagacgugagccccaacgugauccaccagaagggcugcuuccacaagcugcugaagaucaccaagacccagagcuucacccugagcggcagcagccugggcgccgccgugauccagcugcccggcauccuggccacccugcugcuguucaucaagcugggcuaa

SEQ ID NO: 25131 - RNA, 777 nt, Artificial Sequence
  TSPAN18__Homo_sapiens__XP_006718435
augcccgaggagcugcccagauggagcaccauggagggcgacugccugagcugcaugaaguaccugauguucguguucaacuucuucaucuuccugggcggcgccugccugcuggccaucggcaucugggugaugguggaccccaccggcuucagagagaucguggccgccaacccccugcugcugaccggcgccuacauccugcuggccaugggcggccugcuguuccugcugggcuuccugggcugcugcggcgccgugagagagaacaagugccugcugcuguucuucuuccuguucauccugaucaucuuccuggccgagcugagcgccgccauccuggccuucaucuucagagagaaccugaccagagaguucuucaccaaggagcugaccaagcacuaccagggcaacaacgacaccgacguguucagcgccaccuggaacagcgugaugaucaccuucggcugcugcggcgugaacggccccgaggacuucaaguucgccagcguguucagacugcugacccuggacagcgaggaggugcccgaggccugcugcagaagagagccccagagcagagacggcgugcugcugagcagagaggagugccugcugggcagaagccuguuccugaacaagcagggcugcuacaccgugauccugaacaccuucgagaccuacguguaccuggccggcgcccuggccaucggcgugcuggccaucgagcuguucgccaugaucuucgccaugugccuguucagaggcauccaguaa

SEQ ID NO: 25132 - RNA, 633 nt, Artificial Sequence
  TSPAN31__Homo_sapiens__NP_005972
auggugugcggcggcuucgccugcagcaagaacgcccugugcgcccugaacgugguguacaugcuggugagccugcugcugaucggcguggccgccuggggcaagggccugggccuggugagcagcauccacaucaucggcggcgugaucgccgugggcguguuccugcugcugaucgccguggccggccuggugggcgccgugaaccaccaccaggugcugcuguucuucuacaugaucauccugggccugguguucaucuuccaguucgugaucagcugcagcugccuggccaucaacagaagcaagcagaccgacgugaucaacgccagcuggugggugaugagcaacaagaccagagacgagcuggagagaagcuucgacugcugcggccuguucaaccugaccacccuguaccagcaggacuacgacuucugcaccgccaucugcaagagccagagccccaccugccagaugugcggcgagaaguuccugaagcacagcgacgaggcccugaagauccugggcggcgugggccuguucuucagcuucaccgagauccugggcguguggcuggccaugagauucagaaaccagaaggaccccagagccaaccccagcgccuuccuguaa

SEQ ID NO: 25133 - RNA, 963 nt, Artificial Sequence
  TSPAN32__Homo_sapiens__NP_620591
augggccccuggagcagagugagaguggccaagugccagaugcuggugaccugcuucuucauccugcugcugggccugagcguggccaccauggugacccugaccuacuucggcgcccacuucgccgugaucagaagagccagccuggagaagaaccccuaccaggccgugcaccagugggccuucagcgccggccugagccuggugggccugcugacccugggcgccgugcugagcgccgccgccaccgugagagaggcccagggccugauggccggcggcuuccugugcuucagccuggccuucugcgcccaggugcaggugguguucuggagacugcacagccccacccagguggaggacgccaugcuggacaccuacgaccugguguacgagcaggccaugaagggcaccagccacgugagaagacaggagcuggccgccauccaggacguguuccugugcugcggcaagaagagccccuucagcagacugggcagcaccgaggccgaccugugccagggcgaggaggccgccagagaggacugccugcagggcaucagaagcuuccugagaacccaccagcagguggccagcagccugaccagcaucggccuggcccugaccgugagcgcccugcuguucagcagcuuccugugguucgccaucagaugcggcugcagccuggacagaaagggcaaguacacccugacccccagagccugcggcagacagccccaggagcccagccugcugagaugcagccagggcggccccacccacugccugcacagcgaggccguggccaucggccccagaggcugcagcggcagccugagauggcugcaggagagcgacgccgccccccugccccugagcugccaccuggccgcccacagagcccugcagggcagaagcagaggcggccugagcggcugccccgagagaggccugagcgacuaa

SEQ ID NO: 25134 - RNA, 852 nt, Artificial Sequence
  TSPAN33__Homo_sapiens__NP_848657
auggccagaagacccagagcccccgccgccagcggcgaggaguucagcuucgugagcccccuggugaaguaccugcuguucuucuucaacaugcuguucugggugaucagcauggugaugguggccgugggcguguacgccagacugaugaagcacgccgaggccgcccuggccugccuggccguggaccccgccauccugcugaucguggugggcgugcugauguuccugcugaccuucugcggcugcaucggcagccugagagagaacaucugccugcugcagaccuucagccugugccugaccgccguguuccugcugcagcuggccgccggcauccugggcuucguguucagcgacaaggccagaggcaaggugagcgagaucaucaacaacgccaucgugcacuacagagacgaccuggaccugcagaaccugaucgacuucggccagaagaaguucagcugcugcggcggcaucagcuacaaggacuggagccagaacauguacuucaacugcagcgaggacaaccccagcagagagagaugcagcgugcccuacagcugcugccugcccacccccgaccaggccgugaucaacaccaugugcggccagggcaugcaggccuucgacuaccuggaggccagcaaggugaucuacaccaacggcugcaucgacaagcuggugaacuggauccacagcaaccuguuccugcugggcggcguggcccugggccuggccaucccccagcuggugggcauccugcugagccagauccuggugaaccagaucaaggaccagaucaagcugcagcuguacaaccagcagcacagagccgaccccugguacuaa

SEQ ID NO: 25135 - RNA, 717 nt, Artificial Sequence
  TSPAN4__Homo_sapiens__XP_005253159
auggccagagccugccugcaggccgugaaguaccugauguucgccuucaaccugcuguucuggcugggcggcugcggcgugcugggcgugggcaucuggcuggccgccacccagggcagcuucgccacccugagcagcagcuuccccagccugagcgccgccaaccugcugaucaucaccggcgccuucgugauggccaucggcuucgugggcugccugggcgccaucaaggagaacaagugccugcugcugaccuucuuccugcugcugcugcugguguuccugcuggaggccaccaucgccauccuguucuucgccuacaccgacaagaucgacagauacgcccagcaggaccugaagaagggccugcaccuguacggcacccagggcaacgugggccugaccaacgccuggagcaucauccagaccgacuucagaugcugcggcgugagcaacuacaccgacugguucgagguguacaacgccaccagagugcccgacagcugcugccuggaguucagcgagagcugcggccugcacgcccccggcaccugguggaaggcccccugcuacgagaccgugaagguguggcugcaggagaaccugcuggccgugggcaucuucggccugugcaccgcccuggugcagauccugggccugaccuucgccaugaccauguacugccagguggugaaggccgacaccuacugcgccuaa

SEQ ID NO: 25136 - RNA, 738 nt, Artificial Sequence
  TSPAN6__Homo_sapiens__NP_003261
auggccagccccagcagaagacugcagaccaagcccgugaucaccugcuucaagagcgugcugcugaucuacaccuucaucuucuggaucaccggcgugauccugcuggccgugggcaucuggggcaaggugagccuggagaacuacuucagccugcugaacgagaaggccaccaacgugcccuucgugcugaucgccaccggcaccgugaucauccugcugggcaccuucggcugcuucgccaccugcagagccagcgccuggaugcugaagcuguacgccauguuccugacccugguguuccugguggagcugguggccgccaucgugggcuucguguucagacacgagaucaagaacagcuucaagaacaacuacgagaaggcccugaagcaguacaacagcaccggcgacuacagaagccacgccguggacaagauccagaacacccugcacugcugcggcgugaccgacuacagagacuggaccgacaccaacuacuacagcgagaagggcuuccccaagagcugcugcaagcuggaggacugcaccccccagagagacgccgacaaggugaacaacgagggcugcuucaucaaggugaugaccaucaucgagagcgagaugggcgugguggccggcaucagcuucggcguggccugcuuccagcugaucggcaucuuccuggccuacugccugagcagagccaucaccaacaaccaguacgagaucguguaa

SEQ ID NO: 25137 - RNA, 750 nt, Artificial Sequence
  TSPAN7__Homo_sapiens__NP_004606
auggccagcagaagaauggagaccaagcccgugaucaccugccugaagacccugcugaucaucuacagcuucguguucuggaucaccggcgugauccugcuggccgugggcguguggggcaagcugacccugggcaccuacaucagccugaucgccgagaacagcaccaacgcccccuacgugcugaucggcaccggcaccaccaucgugguguucggccuguucggcugcuucgccaccugcagaggcagccccuggaugcugaagcuguacgccauguuccugagccugguguuccuggccgagcugguggccggcaucagcggcuucguguucagacacgagaucaaggacaccuuccugagaaccuacaccgacgccaugcagaccuacaacggcaacgacgagagaagcagagccguggaccacgugcagagaagccugagcugcugcggcgugcagaacuacaccaacuggagcaccagccccuacuuccuggagcacggcaucccccccagcugcugcaugaacgagaccgacugcaacccccaggaccugcacaaccugaccguggccgccaccaaggugaaccagaagggcugcuacgaccuggugaccagcuucauggagaccaacaugggcaucaucgccggcguggccuucggcaucgccuucagccagcugaucggcaugcugcuggccugcugccugagcagauucaucaccgccaaccaguacgagaugguguaa

SEQ ID NO: 25138 - RNA, 714 nt, Artificial Sequence
  TSPAN8__Homo_sapiens__XP_006719646
auggccggcgugagcgccugcaucaaguacagcauguucaccuucaacuuccuguucuggcugugcggcauccugauccuggcccuggccaucugggugagagugagcaacgacagccaggccaucuucggcagcgaggacgugggcagcagcagcuacguggccguggacauccugaucgccgugggcgccaucaucaugauccugggcuuccugggcugcugcggcgccaucaaggagagcagaugcaugcugcugcuguucuucaucggccugcugcugauccugcugcugcagguggccaccggcauccugggcgccguguucaagagcaagagcgacagaaucgugaacgagacccuguacgagaacaccaagcugcugagcgccaccggcgagagcgagaagcaguuccaggaggccaucaucguguuccaggaggaguucaagugcugcggccuggugaacggcgccgccgacuggggcaacaacuuccagcacuaccccgagcugugcgccugccuggacaagcagagacccugccagagcuacaacggcaagcagguguacaaggagaccugcaucagcuucaucaaggacuuccuggccaagaaccugaucaucgugaucggcaucagcuucggccuggccgugaucgagauccugggccugguguucagcauggugcuguacugccagaucggcaacaaguaa

SEQ ID NO: 25139 - RNA, 720 nt, Artificial Sequence
  TSPAN9__Homo_sapiens__NP_001161792
auggccagaggcugccugugcugccugaaguacaugauguuccuguucaaccugaucuucuggcugugcggcugcggccugcugggcgugggcaucuggcugagcgugagccagggcaacuucgccaccuucagccccagcuuccccagccugagcgccgccaaccuggugaucgccaucggcaccaucgugauggugaccggcuuccugggcugccugggcgccaucaaggagaacaagugccugcugcugagcuucuucaucgugcugcuggugauccugcuggccgagcugauccugcugauccuguucuucguguacauggacaaggugaacgagaacgccaagaaggaccugaaggagggccugcugcuguaccacaccgagaacaacgugggccugaagaacgccuggaacaucauccaggccgagaugagaugcugcggcgugaccgacuacaccgacugguaccccgugcugggcgagaacaccgugcccgacagaugcugcauggagaacagccagggcugcggcagaaacgccaccaccccccuguggagaaccggcugcuacgagaaggugaagaugugguucgacgacaacaagcacgugcugggcaccgugggcaugugcauccugaucaugcagauccugggcauggccuucagcaugacccuguuccagcacauccacagaaccggcaagaaguacgacgccuaa

SEQ ID NO: 25140 - RNA, 1806 nt, Artificial Sequence
  TSPEAR__Homo_sapiens__NP_001258966
augagcuuccccgccagcagaaucuucagccagugcgaccuguuccccgaggaguucagcaucguggugacccugagagugcccaaccugccccccaagagaaacgaguaccugcugaccgugguggccgaggagagcgaccugcugcugcugggccugagacugagccccgcccagcugcacuuccuguuccugagagaggacaccgccggcgccuggcagaccagagugagcuucagaagccccgcccugguggacggcagauggcacacccuggugcuggccgugagcgccggcguguucagccugaccaccgacugcggccugcccguggacaucauggccgacgugcccuuccccgccacccugagcgugaagggcgccagauucuucgugggcagcagaagaagagccaagggccuguucaugggccuggugagacagcuggugcugcugcccggcagcgacgccacccccagacugugccccagcagaaacgccccccuggccgugcugagcauccccagagugcugcaggcccugaccggcaagcccgaggacaacgaggugcugaaguaccccuacgagaccaacaucagagugacccugggcccccagccccccugcaccgagguggaggacgcccaguucugguucgacgccagcagaaagggccuguaccugugcgugggcaacgagugggugagcgugcuggccgccaaggagagacuggacuacguggaggagcaccagaaccugagcaccaacagcgagacccugggcaucgagguguucagaaucccccaggugggccuguucguggccaccgccaacagaaaggccaccagcgccguguacaaguggaccgaggagaaguucgugagcuaccagaacauccccacccaccaggcccaggccuggagacacuucaccaucggcaagaagaucuuccuggccguggccaacuucgagcccgacgagaagggccaggaguucagcgugaucuacaaguggagccacagaaagcugaaguucacccccuaccagagcaucgccacccacagcgccagagacugggaggccuucgagguggacggcgagcacuuccuggccguggccaaccacagagagggcgacaaccacaacaucgacagcgugaucuacaaguggaaccccgccaccagacuguucgaggccaaccagaccaucgccaccagcggcgccuacgacugggaguucuucagcgugggccccuacagcuuccuggugguggccaacaccuucaacggcaccagcaccaaggugcacagccaccuguacaucagacugcugggcagcuuccagcuguuccagagcuuccccaccuucggcgccgccgacugggagguguuccagaucggcgagagaaucuuccuggccguggccaacagccacagcuacgacguggagaugcaggugcagaacgacagcuacgugaucaacagcgugaucuacgagcugaacgugaccgcccaggccuucgugaaguuccaggacauccugaccugcagcgcccuggacugggaguucuucagcgugggcgaggacuacuuccuggugguggccaacagcuucgacggcagaaccuucagcgugaacagcaucaucuacagauggcagggcuacgagggcuucguggccgugcacagccugcccaccgugggcugcagagacugggaggccuucagcaccaccgccggcgccuaccugaucuacagcagcgccaaggagccccugagcagagugcugagacugagaaccagauaa

SEQ ID NO: 25141 - RNA, 513 nt, Artificial Sequence
  TSPO2__Homo_sapiens__XP_011512699
augagacugcagggcgccaucuucgugcugcugccccaccugggccccauccugguguggcuguucaccagagaccacaugagcggcuggugcgagggccccagaaugcugagcuggugccccuucuacaaggugcugcugcuggugcagaccgccaucuacagcguggugggcuacgccagcuaccugguguggaaggaccugggcggcggccugggcuggccccuggcccugccccugggccuguacgccgugcagcugaccaucagcuggaccgugcuggugcuguucuucaccgugcacaaccccggccuggcccugcugcaccugcugcugcuguacggccugguggugagcaccgcccugaucuggcaccccaucaacaagcuggccgcccugcugcugcugcccuaccuggccuggcugaccgugaccagcgcccugaccuaccaccuguggagagacagccugugccccgugcaccagccccagcccaccgagaagagcgacuaa

SEQ ID NO: 25142 - RNA, 510 nt, Artificial Sequence
  TSPO__Homo_sapiens__NP_001243459
auggccccccccugggugcccgccaugggcuucacccuggcccccagccugggcugcuucgugggcagcagauucgugcacggcgagggccugagaugguacgccggccugcagaagcccagcuggcaccccccccacugggugcugggccccguguggggcacccuguacagcgccaugggcuacggcagcuaccugguguggaaggagcugggcggcuucaccgagaaggccguggugccccugggccuguacaccggccagcuggcccugaacugggccuggccccccaucuucuucggcgccagacagaugggcugggcccugguggaccugcugcuggugagcggcgccgccgccgccaccaccguggccugguaccaggugagcccccuggccgccagacugcuguaccccuaccuggccuggcuggccuucaccaccacccugaacuacugcguguggagagacaaccacggcuggagaggcggcagaagacugcccgaguaa

SEQ ID NO: 25143 - RNA, 927 nt, Artificial Sequence
  TSPY10__Homo_sapiens__NP_001269398
augagacccgagggcagccugaccuacagagugcccgagagacugagacagggcuucugcggcgugggcagagccgcccaggcccuggugugcgccagcgccaaggagggcaccgccuucagaauggaggccgugcaggagggcgccgccggcguggagagcgagcaggccgcccugggcgaggaggccgugcugcugcuggacgacaucauggccgagguggaggugguggccgaggaggagggccugguggagagaagagaggaggcccagagagcccagcaggccgugcccggccccggccccaugacccccgagagcgcccuggaggagcugcuggccgugcagguggagcuggagcccgugaacgcccaggccagaaaggccuucagcagacagagagagaagauggagagaagaagaaagccccaccuggacagaagaggcgccgugauccagagcgugcccggcuucugggccaacgugaucgccaaccacccccagaugagcgcccugaucaccgacgaggacgaggacaugcugagcuacauggugagccuggagguggaggaggagaagcaccccgugcaccugugcaagaucaugcuguucuucagaagcaaccccuacuuccagaacaaggugaucaccaaggaguaccuggugaacaucaccgaguacagagccagccacagcacccccaucgagugguaccccgacuacgagguggaggccuacagaagaagacaccacaacagcagccugaacuucuucaacugguucagcgaccacaacuucgccggcagcaacaagaucgccgagauccugugcaaggaccuguggagaaacccccugcaguacuacaagagaaugaagccccccgaggagggcaccgagaccagcggcgacagccagcugcugagcuaa

SEQ ID NO: 25144 - RNA, 927 nt, Artificial Sequence
  TSPY1__Homo_sapiens__NP_003299
augagacccgagggcagccugaccuacagagugcccgagagacugagacagggcuucugcggcgugggcagagccgcccaggcccuggugugcgccagcgccaaggagggcaccgccuucagaauggaggccgugcaggagggcgccgccggcguggagagcgagcaggccgcccugggcgaggaggccgugcugcugcuggacgacaucauggccgagguggaggugguggccgaggaggagggccugguggagagaagagaggaggcccagagagcccagcaggccgugcccggccccggccccaugacccccgagagcgcccccgaggagcugcuggccgugcagguggagcuggagcccgugaacgcccaggccagaaaggccuucagcagacagagagagaagauggagagaagaagaaagccccaccuggacagaagaggcgccgugauccagagcgugcccggcuucugggccaacgugaucgccaaccacccccagaugagcgcccugaucaccgacgaggacgaggacaugcugagcuacauggugagccuggaggugggcgaggagaagcaccccgugcaccugugcaagaucaugcuguucuucagaagcaaccccuacuuccagaacaaggugaucaccaaggaguaccuggugaacaucaccgaguacagagccagccacagcacccccaucgagugguaccccgacuacgagguggaggccuacagaagaagacaccacaacagcagccugaacuucuucaacugguucagcgaccacaacuucgccggcagcaacaagaucgccgagauccugugcaaggaccuguggagaaacccccugcaguacuacaagagaaugaagccccccgaggagggcaccgagaccagcggcgacagccagcugcugagcuaa

SEQ ID NO: 25145 - RNA, 867 nt, Artificial Sequence
  TSPY3__Homo_sapiens__XP_011542306
augagacccgagggcagccugaccuacagagugcccgagagacugagacagggcuucugcggcgugggcagagccgcccaggcccuggugugcgccagcgccaaggagggcaccgccuucagaauggaggccgugcaggagggcgccgccggcguggagagcgagcaggccgcccugggcgaggaggccgugcugcugcuggacgacaucauggccgagguggaggugguggccgaggaggagggccugguggagagaagagaggaggcccagagagcccagcaggccgugcccggccccggccccaugacccccgagagcgcccuggaggagcugcuggccgugcagguggagcuggagcccgugaacgcccaggccagaaaggccuucagcagacagagagagaagauggagagaagaagaaagccccaccuggacagaagaggcgccgugauccagagcgugcccggcuucugggccaacgugaucgccaaccacccccagaugagcgcccugaucaccgacgaggacgaggacaugcugagcuacauggugagccuggagguggaggaggagaagcaccccgugcaccugugcaagaucaugcuguucuucagaagcaaccccuacuuccagaacaaggugaucaccaaggaguaccuggugaacaucaccggccugcugaucccccugcagcugagcggcaucagaaucaugaaguggagaagaaucgccgccgacaccaccaccgccgcccugaccagcagcaccggcagccugaccaccaccagccaggaccugaccagacugcugagaagcuacgugagaaccugcggcgccauccccugcaacaccaccagaggcuaa

SEQ ID NO: 25146 - RNA, 945 nt, Artificial Sequence
  TSPY4__Homo_sapiens__NP_001157943
augagacccgagggcagccugaccuacagagugcccgagagacugagacagggcuucugcggcgugggcagagccgcccaggcccuggugugcgccagcgccaaggagggcaccgccuucagaauggaggccgugcaggagggcgccgccggcguggagagcgagcaggccgcccugggcgaggaggccgugcugcugcuggacgacaucauggccgagguggaggugguggccgagguggaggugguggccgaggaggagggccugguggagagaagagaggaggcccagagagcccagcaggccgugcccggccccggccccaugacccccgagagcgcccuggaggagcugcuggccgugcagguggagcuggagcccgugaacgcccaggccagaaaggccuucagcagacagagagagaagauggagagaagaagaaagccccaccuggacagaagaggcgccgugauccagagcgugcccggcuucugggccaacgugaucgccaaccacccccagaugagcgcccugaucaccgacgaggacgaggacaugcugagcuacauggugagccuggagguggaggaggagaagcaccccgugcaccugugcaagaucaugcuguucuucagaagcaaccccuacuuccagaacaaggugaucaccaaggaguaccuggugaacaucaccgaguacagagccagccacagcacccccaucgagugguaccccgacuacgagguggaggccuacagaagaagacaccacaacagcagccugaacuucuucaacugguucagcgaccacaacuucgccggcagcaacaagaucgccgagauccugugcaaggaccuguggagaaacccccugcaguacuacaagagaaugaagccccccgaggagggcaccgagaccagcggcgacagccagcugcugagcuaa

SEQ ID NO: 25147 - RNA, 1314 nt, Artificial Sequence
  TSPYL1__Homo_sapiens__NP_003300
augagcggccuggacggcgugaagagaaccaccccccugcagacccacagcaucaucaucagcgaccaggugcccagcgaccaggacgcccaccaguaccugagacugagagaccagagcgaggccacccaggugauggccgagcccggcgagggcggcagcgagaccguggcccugcccccccccccccccagcgaggagggcggcgugccccaggacgccgccggcagaggcggcaccccccagaucagaguggugggcggcagaggccacguggccaucaaggccggccaggaggagggccagccccccgccgagggccuggccgccgccagcguggugauggccgccgacagaagccugaagaagggcgugcagggcggcgagaaggcccuggagaucugcggcgcccagagaagcgccagcgagcugaccgccggcgccgaggccgaggccgaggaggugaagaccggcaagugcgccaccgugagcgccgccguggccgagagagagagcgccgagguggugaaggagggccuggccgagaaggaggugauggaggagcagauggagguggaggagcagccccccgagggcgaggagaucgagguggccgaggaggacagacuggaggaggaggccagagaggaggagggccccuggccccugcacgaggcccugagaauggacccccuggaggccauccagcuggagcuggacaccgugaacgcccaggccgacagagccuuccagcagcuggagcacaaguucggcagaaugagaagacacuaccuggagagaagaaacuacaucauccagaacauccccggcuucuggaugaccgccuucagaaaccacccccagcugagcgccaugaucagaggccaggacgccgagaugcugagauacaucaccaaccuggaggugaaggagcugagacaccccagaaccggcugcaaguucaaguucuucuucagaagaaaccccuacuucagaaacaagcugaucgugaaggaguacgaggugagaagcagcggcagaguggugagccugagcacccccaucaucuggagaagaggccacgagccccagagcuucaucagaagaaaccaggaccugaucugcagcuucuucaccugguucagcgaccacagccugcccgagagcgacaagaucgccgagaucaucaaggaggaccuguggcccaacccccugcaguacuaccugcugagagagggcgugagaagagccagaagaagaccccugagagagcccguggagauccccagacccuucggcuuccagagcggcuaa

SEQ ID NO: 25148 - RNA, 2082 nt, Artificial Sequence
  TSPYL2__Homo_sapiens__NP_071400
auggacagacccgacgagggcccccccgccaagaccagaagacugagcagcagcgagagcccccagagagacccccccccccccccccccccccccccccugcugagacugccccugccccccccccagcagagacccagacugcaggaggagaccgaggccgcccaggugcuggccgacaugagaggcgugggccugggccccgcccugcccccccccccccccuacgugauccuggaggagggcggcaucagagccuacuucacccugggcgccgagugccccggcugggacagcaccaucgagagcggcuacggcgaggcccccccccccaccgagagccuggaggcccugcccacccccgaggccagcggcggcagccuggagaucgacuuccagguggugcagagcagcagcuucggcggcgagggcgcccuggagaccugcagcgccgugggcugggccccccagagacugguggaccccaagagcaaggaggaggccaucaucaucguggaggacgaggacgaggacgagagagagagcaugagaagcagcagaagaagaagaagaagaagaagaagaaagcagagaaaggugaagagagagagcagagagagaaacgccgagagaauggagagcauccugcaggcccuggaggacauccagcuggaccuggaggccgugaacaucaaggccggcaaggccuuccugagacugaagagaaaguucauccagaugagaagacccuuccuggagagaagagaccugaucauccagcacauccccggcuucugggugaaggccuuccugaaccaccccagaaucagcauccugaucaacagaagagacgaggacaucuucagauaccugaccaaccugcaggugcaggaccugagacacaucagcaugggcuacaagaugaagcuguacuuccagaccaaccccuacuucaccaacauggugaucgugaaggaguuccagagaaacagaagcggcagacuggugagccacagcacccccaucagauggcacagaggccaggagccccaggccagaagacacggcaaccaggacgccagccacagcuucuucagcugguucagcaaccacagccugcccgaggccgacagaaucgccgagaucaucaagaacgaccugugggugaacccccugagauacuaccugagagagagaggcagcagaaucaagagaaagaagcaggagaugaagaagagaaagaccagaggcagaugcgagguggugaucauggaggacgcccccgacuacuacgccguggaggacaucuucagcgagaucagcgacaucgacgagaccauccacgacaucaagaucagcgacuucauggagaccaccgacuacuucgagaccaccgacaacgagaucaccgacaucaacgagaacaucugcgacagcgagaaccccgaccacaacgaggugcccaacaacgagaccaccgacaacaacgagagcgccgacgaccacgagaccaccgacaacaacgagagcgccgacgacaacaacgagaaccccgaggacaacaacaagaacaccgacgacaacgaggagaaccccaacaacaacgagaacaccuacggcaacaacuucuucaagggcggcuucuggggcagccacggcaacaaccaggacagcagcgacagcgacaacgaggccgacgaggccagcgacgacgaggacaacgacggcaacgagggcgacaacgagggcagcgacgacgacggcaacgagggcgacaacgagggcagcgacgacgacgacagagacaucgaguacuacgagaaggugaucgaggacuucgacaaggaccaggccgacuacgaggacgugaucgagaucaucagcgacgagagcguggaggaggagggcaucgaggagggcauccagcaggacgaggacaucuacgaggagggcaacuacgaggaggagggcagcgaggacgugugggaggagggcgaggacagcgacgacagcgaccuggaggacgugcugcaggugcccaacggcugggccaaccccggcaagagaggcaagaccggcuaa

SEQ ID NO: 25149 - RNA, 1245 nt, Artificial Sequence
  TSPYL4__Homo_sapiens__NP_067680
augagcggccuggacggcggcaacaagcugccccuggcccagaccggcggccuggccgcccccgaccacgccagcggcgaccccgacagagaccagugccagggccugagagaggagaccgaggccacccaggugauggccaacaccggcggcggcagccuggagaccguggccgagggcggcgccagccaggaccccguggacugcggccccgcccugagagugcccguggccggcagcagaggcggcgccgccaccaaggccggccaggaggacgccccccccagcaccaagggccuggaggccgccagcgccgccgaggccgccgacagcagccagaagaacggcugccagcugggcgagcccagaggccccgccggccagaaggcccuggaggccugcggcgccggcggccugggcagccagaugauccccggcaagaaggccaaggaggugaccaccaagaagagagccaucagcgccgccguggagaaggagggcgaggccggcgccgccauggaggagaagaagguggugcagaaggagaagaagguggccggcggcgugaaggaggagaccagacccagagcccccaagaucaacaacugcauggacagccuggaggccaucgaccaggagcugagcaacgugaacgcccaggccgacagagccuuccugcagcuggagagaaaguucggcagaaugagaagacugcacaugcagagaagaagcuucaucauccagaacauccccggcuucugggugaccgccuucagaaaccacccccagcugagccccaugaucagcggccaggacgaggacaugcugagauacaugaucaaccuggagguggaggagcugaagcaccccagagccggcugcaaguucaaguucaucuuccagggcaaccccuacuucagaaacgagggccuggugaaggaguacgagagaagaagcagcggcagaguggugagccugagcacccccaucagauggcacagaggccaggacccccaggcccacauccacagaaacagagagggcaacaccauccccagcuucuucaacugguucagcgaccacagccugcuggaguucgacagaaucgccgagaucaucaagggcgagcuguggcccaacccccugcaguacuaccugaugggcgagggccccagaagaggcaucagaggcccccccagacagcccguggagagcgccagaagcuucagauuccagagcggcuaa

SEQ ID NO: 25150 - RNA, 1254 nt, Artificial Sequence
  TSPYL5__Homo_sapiens__NP_277047
augagcggcagaagcagaggcagaaagagcagcagagccaagaacagaggcaagggcagagccaaggccagagugagacccgcccccgacgacgcccccagagaccccgaccccagccaguaccagagccugggcgaggacacccaggccgcccaggugcaggccggcgccggcuggggcggccuggaggccgccgccagcgcccagcugcugagacugggcgaggaggccgccugcagacugccccuggacugcggccuggcccugagagccagagccgccggcgaccacggccaggccgccgccagacccggccccggcaaggccgccagccugagcgagagacuggccgccgacaccguguucgugggcaccgccggcaccgugggcagacccaagaacgcccccagagugggcaacagaagaggccccgccggcaagaaggcccccgagaccugcagcaccgccggcagaggcccccaggugaucgccggcggcagacagaagaagggcgccgccggcgagaacaccagcgugagcgccggcgaggagaagaaggaggagagagacgccggcagcggcccccccgccaccgagggcagcauggacacccuggagaacgugcagcugaagcuggagaacaugaacgcccaggccgacagagccuaccugagacugagcagaaaguucggccagcugagacugcagcaccuggagagaagaaaccaccugauccagaacauccccggcuucuggggccaggccuuccagaaccacccccagcuggccagcuuccugaacagccaggagaaggaggugcugagcuaccugaacagccuggagguggaggagcugggccuggccagacugggcuacaagaucaaguucuacuucgacagaaaccccuacuuccagaacaaggugcugaucaaggaguacggcugcggccccagcggccagguggugagcagaagcacccccauccaguggcugcccggccacgaccugcagagccugagccagggcaaccccgagaacaacagaagcuucuucggcugguucagcaaccacagcagcaucgagagcgacaagaucguggagaucaucaacgaggagcuguggcccaacccccugcaguucuaccugcugagcgagggcgccagaguggagaagggcaaggagaaggagggcagacagggccccggcaagcagcccauggagaccacccagcccggcgugagccagagcaacuaa

SEQ ID NO: 25151 - RNA, 2415 nt, Artificial Sequence
  TSR1__Homo_sapiens__NP_060598
auggccgcccacagacccggcccccugaagcagcagaacaaggcccacaagggcggcagacacagaggcagaggcagcgcccagagagacggcaagggcagacuggcccugaagacccugagcaagaaggugagaaaggagcugagcagaguggaccagagacacagagccagccagcugagaaagcagaagaaggaggccgugcuggccgagaagagacagcugggcggcaaggacggccccccccaccaggugcugguggugccccugcacagcagaaucagccugcccgaggccaugcagcugcugcaggacagagacaccggcaccgugcaccugaacgagcugggcaacacccagaacuucaugcugcugugccccagacugaagcacagaugguucuucaccagcgccagacccggcgaccugcacguggugcuggacauggccaagguggccgacaccauccuguuccugcuggacccccuggagggcugggacagcaccggcgacuacugccugagcugccuguucgcccagggccugcccaccuacacccuggccgugcagggcaucagcggccugccccugaagaagcagaucgacaccagaaagaagcugagcaaggccguggagaagagauucccccacgacaagcugcugcugcuggacacccagcaggaggccggcaugcugcugagacagcuggccaaccagaagcagcagcaccuggccuucagagacagaagagccuaccuguucgcccacgccguggacuucgugcccagcgaggagaacaaccuggugggcacccugaagaucagcggcuacgugagaggccagacccugaacgugaacagacugcugcacaucgugggcuacggcgacuuccagaugaagcagaucgacgcccccggcgaccccuucccccugaaccccagaggcaucaagccccagaaggaccccgacauggccauggagaucugcgccaccgacgccguggacgacauggaggagggccugaaggugcugaugaaggccgaccccggcagacaggagagccugcaggccgaggugauccccgaccccauggagggcgagcagaccuggcccaccgaggaggagcugagcgaggccaaggacuuccugaaggagagcagcaagguggugaagaaggugcccaagggcaccagcagcuaccaggccgaguggauccuggacggcggcagccagagcggcggcgagggcgacgaguacgaguacgacgacauggagcacgaggacuucauggaggaggagagccaggacgagagcagcgaggaggaggaggaguacgagaccaugaccaucggcgagagcgugcacgacgaccuguacgacaagaagguggacgaggaggccgaggccaagaugcuggagaaguacaagcaggagagacuggaggagauguuccccgacgagguggacacccccagagacguggccgccagaaucagauuccagaaguacagaggccugaagagcuucagaaccagccccugggaccccaaggagaaccugccccaggacuacgccagaaucuuccaguuccagaacuucaccaacaccagaaagagcaucuucaaggagguggaggagaaggagguggagggcgccgaggugggcugguacgugacccugcacgugagcgaggugcccgugagcgugguggagugcuucagacagggcaccccccugaucgccuucagccugcugccccacgagcagaagaugagcgugcugaacaugguggugagaagagaccccggcaacaccgagcccgugaaggccaaggaggagcugaucuuccacugcggcuucagaagauucagagccagcccccuguucagccagcacaccgccgccgacaagcacaagcugcagagauuccugaccgccgacauggcccugguggccaccguguacgcccccaucaccuucccccccgccagcgugcugcuguucaagcagaagagcaacggcaugcacagccugaucgccaccggccaccugaugagcguggaccccgacagaauggugaucaagagaguggugcugagcggccaccccuucaagaucuucaccaagauggccguggugagauacauguucuucaacagagaggacgugcugugguucaagcccguggagcugagaaccaaguggggcagaagaggccacaucaaggagccccugggcacccacggccacaugaagugcagcuucgacggcaagcugaagagccaggacaccgugcugaugaaccuguacaagagaguguuccccaaguggaccuacgaccccuacgugcccgagcccgugcccuggcugaagagcgagaucagcagcaccgugccccagggcggcauggaguaa

SEQ ID NO: 25152 - RNA, 1164 nt, Artificial Sequence
  TSSC1__Homo_sapiens__NP_003301
auggaggacgacgcccccgugaucuacggccuggaguuccaggccagagcccugaccccccagaccgccgagaccgacgccaucagauuccuggugggcacccagagccugaaguacgacaaccagauccacaucaucgacuucgacgacgagaacaacaucaucaacaagaacgugcugcugcaccaggccggcgagaucuggcacaucagcgccagccccgccgacagaggcgugcugaccaccugcuacaacagaaccagcgacagcaaggugcugaccugcgccgccguguggagaaugcccaaggagcuggagagcggcagccacgagagccccgacgacagcagcagcaccgcccagacccuggagcugcugugccaccuggacaacaccgcccacggcaacauggccugcguggugugggagcccaugggcgacggcaagaagaucaucagccuggccgacaaccacauccugcugugggaccugcaggagagcagcagccaggccgugcuggccagcagcgccagccuggagggcaagggccagcugaaguucaccagcggcagauggagcccccaccacaacugcacccagguggccaccgccaacgacaccacccugagaggcugggacaccagaagcaugagccagaucuacugcaucgagaacgcccacggccagcuggugagagaccuggacuucaaccccaacaagcaguacuaccuggccagcugcggcgacgacugcaaggugaaguucugggacaccagaaacgugaccgagcccgugaagacccuggaggagcacagccacuggguguggaacgugagauacaaccacagccacgaccagcuggugcugaccggcagcagcgacagcagagugauccugagcaacauggugagcaucagcagcgagcccuucggccaccugguggacgacgacgacaucagcgaccaggaggaccacagaagcgaggagaagagcaaggagccccugcaggacaacgugaucgccaccuacgaggagcacgaggacagcguguacgccguggacuggagcagcgccgaccccuggcuguucgccagccugagcuacgacggcagacuggugaucaacagagugcccagagcccugaaguaccacauccugcuguaa

SEQ ID NO: 25153 - RNA, 1104 nt, Artificial Sequence
  TSSK1B__Homo_sapiens__NP_114417
auggacgacgccgccgugcugaagagaagaggcuaccugcugggcaucaaccugggcgagggcagcuacgccaaggugaagagcgccuacagcgagagacugaaguucaacguggccaucaagaucaucgacagaaagaaggcccccgccgacuuccuggagaaguuccugcccagagagaucgagauccuggccaugcugaaccacugcagcaucaucaagaccuacgagaucuucgagaccagccacggcaagguguacaucgugauggagcuggccgugcagggcgaccugcuggagcugaucaagaccagaggcgcccugcacgaggacgaggccagaaagaaguuccaccagcugagccuggccaucaaguacugccacgaccuggacguggugcacagagaccugaagugcgacaaccugcugcuggacaaggacuucaacaucaagcugagcgacuucagcuucagcaagagaugccugagagacgacagcggcagaauggcccugagcaagaccuucugcggcagccccgccuacgccgcccccgaggugcugcagggcauccccuaccagcccaagguguacgacaucuggagccugggcgugauccuguacaucauggugugcggcagcaugcccuacgacgacagcaacaucaagaagaugcugagaauccagaaggagcacagagugaacuuccccagaagcaagcaccugaccggcgagugcaaggaccugaucuaccacaugcugcagcccgacgugaacagaagacugcacaucgacgagauccugagccacugcuggaugcagcccaaggccagaggcagccccagcguggccaucaacaaggagggcgagagcagcagaggcaccgagccccuguggacccccgagcccggcagcgacaagaagagcgccaccaagcuggagcccgagggcgaggcccagccccaggcccagcccgagaccaagcccgagggcaccgccaugcagaugagcagacagagcgagauccugggcuuccccagcaagcccagcaccauggagaccgaggagggccccccccagcagccccccgagaccagagcccaguaa

SEQ ID NO: 25154 - RNA, 1077 nt, Artificial Sequence
  TSSK2__Homo_sapiens__NP_443732
auggacgacgccaccgugcugagaaagaagggcuacaucgugggcaucaaccugggcaagggcagcuacgccaaggugaagagcgccuacagcgagagacugaaguucaacguggccgugaagaucaucgacagaaagaagacccccaccgacuucguggagagauuccugcccagagagauggacauccuggccaccgugaaccacggcagcaucaucaagaccuacgagaucuucgagaccagcgacggcagaaucuacaucaucauggagcugggcgugcagggcgaccugcuggaguucaucaagugccagggcgcccugcacgaggacguggccagaaagauguucagacagcugagcagcgccgugaaguacugccacgaccuggacaucgugcacagagaccugaagugcgagaaccugcugcuggacaaggacuucaacaucaagcugagcgacuucggcuucagcaagagaugccugagagacagcaacggcagaaucauccugagcaagaccuucugcggcagcgccgccuacgccgcccccgaggugcugcagagcauccccuaccagcccaagguguacgacaucuggagccugggcgugauccuguacaucauggugugcggcagcaugcccuacgacgacagcgacaucagaaagaugcugagaauccagaaggagcacagaguggacuuccccagaagcaagaaccugaccugcgagugcaaggaccugaucuacagaaugcugcagcccgacgugagccagagacugcacaucgacgagauccugagccacagcuggcugcagccccccaagcccaaggccaccagcagcgccagcuucaagagagagggcgagggcaaguacagagccgagugcaagcuggacaccaagaccggccugagacccgaccacagacccgaccacaagcugggcgccaagacccagcacagacugcugguggugcccgagaacgagaacagaauggaggacagacuggccgagaccagcagagccaaggaccaccacaucagcggcgccgaggugggcaaggccagcaccuaa

SEQ ID NO: 25155 - RNA, 1017 nt, Artificial Sequence
  TSSK4__Homo_sapiens__NP_001171668
augggcaagggcgacgugcuggaggccgcccccaccaccaccgccuaccacagccugauggacgaguacggcuacgaggugggcaaggccaucggccacggcagcuacggcagcguguacgaggccuucuacaccaagcagaaggugaugguggccgugaagaucaucagcaagaagaaggccagcgacgacuaccugaacaaguuccugcccagagagauccaggugaugaaggugcugagacacaaguaccugaucaacuucuacagagccaucgagagcaccagcagaguguacaucauccuggagcuggcccagggcggcgacgugcuggaguggauccagagauacggcgccugcagcgagccccuggccggcaagugguucagccagcugacccugggcaucgccuaccugcacagcaagagcaucgugcacagacugaugcccagccugagcgccgccggcagagaccugaagcuggagaaccugcugcuggacaagugggagaacgugaagaucagcgacuucggcuucgccaagauggugcccagcaaccagcccgugggcugcagccccagcuacagacaggugaacugcuucagccaccugagccagaccuacugcggcagcuucgccuacgccugccccgagauccugagaggccugcccuacaaccccuuccugagcgacaccuggagcaugggcgugauccuguacacccuggugguggcccaccugcccuucgacgacaccaaccugaagaagcugcugagagagacccagaaggaggugaccuuccccgccaaccacaccaucagccaggagugcaagaaccugauccugcagaugcugagacaggccaccaagagagccaccauccuggacaucaucaaggacagcugggugcugaaguuccagcccgagcagcccacccacgagaucagacugcuggaggccaugugccagcugcacaacaccaccaagcagcaccagagccugcagaucaccaccuaa

SEQ ID NO: 25156 - RNA, 966 nt, Artificial Sequence
  TSTA3__Homo_sapiens__NP_003304
augggcgagccccagggcagcaugagaauccuggugaccggcggcagcggccuggugggcaaggccauccagaaggugguggccgacggcgccggccugcccggcgaggacuggguguucgugagcagcaaggacgccgaccugaccgacaccgcccagaccagagcccuguucgagaaggugcagcccacccacgugauccaccuggccgccauggugggcggccuguucagaaacaucaaguacaaccuggacuucuggagaaagaacgugcacaugaacgacaacgugcugcacagcgccuucgaggugggcgccagaaagguggugagcugccugagcaccugcaucuuccccgacaagaccaccuaccccaucgacgagaccaugauccacaacggccccccccacaacagcaacuucggcuacagcuacgccaagagaaugaucgacgugcagaacagagccuacuuccagcaguacggcugcaccuucaccgccgugauccccaccaacguguucggcccccacgacaacuucaacaucgaggacggccacgugcugcccggccugauccacaaggugcaccuggccaagagcagcggcagcgcccugaccguguggggcaccggcaaccccagaagacaguucaucuacagccuggaccuggcccagcuguucaucugggugcugagagaguacaacgagguggagcccaucauccugagcgugggcgaggaggacgaggugagcaucaaggaggccgccgaggccgugguggaggccauggacuuccacggcgaggugaccuucgacaccaccaagagcgacggccaguucaagaagaccgccagcaacagcaagcugagaaccuaccugcccgacuucagauucacccccuucaagcaggccgugaaggagaccugcgccugguucaccgacaacuacgagcaggccagaaaguaa

SEQ ID NO: 25157 - RNA, 330 nt, Artificial Sequence
  TSTD1__Homo_sapiens__NP_001106676
auggccggcgcccccaccgugagccugcccgagcugagaagccugcuggccagcggcagagccagacuguucgacgugagaagcagagaggaggccgccgccggcaccauccccggcgcccugaacauccccgugagcgagcuggagagcgcccugcagauggagcccgccgccuuccaggcccuguacagcgccgagaagcccaagcuggaggacgagcaccugguguucuucugccagaugggcaagagaggccugcaggccacccagcuggccagaagccugggcuacaccggcuacggcgagguguggcugcuggccggcagauaa

SEQ ID NO: 25158 - RNA, 894 nt, Artificial Sequence
  TST__Homo_sapiens__NP_003303
auggugcaccaggugcuguacagagcccuggugagcaccaaguggcuggccgagagcaucagaaccggcaagcugggccccggccugagagugcuggacgccagcugguacagccccggcaccagagaggccagaaaggaguaccuggagagacacgugcccggcgccagcuucuucgacaucgaggagugcagagacaccgccagccccuacgagaugaugcugcccagcgaggccggcuucgccgaguacgugggcagacugggcaucagcaaccacacccacguggugguguacgacggcgagcaccugggcagcuucuacgcccccagagugugguggauguucagaguguucggccacagaaccgugagcgugcugaacggcggcuucagaaacuggcugaaggagggccaccccgugaccagcgagcccagcagacccgagcccgccguguucaaggccacccuggacagaagccugcugaagaccuacgagcaggugcuggagaaccuggagagcaagagauuccagcugguggacagcagaagccagggcagauuccugggcaccgagcccgagcccgacgccgugggccuggacagcggccacaucagaggcgccgugaacaugcccuucauggacuuccugaccgaggacggcuucgagaagggccccgaggagcugagagcccuguuccagaccaagaagguggaccugagccagccccugaucgccaccugcagaaagggcgugaccgccugccacguggcccuggccgccuaccugugcggcaagcccgacguggccguguacgacggcagcuggagcgagugguucagaagagccccccccgagagcagagugagccagggcaagagcgagaaggccuaa

SEQ ID NO: 25159 - RNA, 3966 nt, Artificial Sequence
  TTBK1__Homo_sapiens__NP_115927
augcagugccuggccgccgcccugaaggacgagaccaacaugagcggcggcggcgagcaggccgacauccugcccgccaacuacguggugaaggacagauggaaggugcugaagaagaucggcggcggcggcuucggcgagaucuacgaggccauggaccugcugaccagagagaacguggcccugaagguggagagcgcccagcagcccaagcaggugcugaagauggagguggccgugcugaagaagcugcagggcaaggaccacgugugcagauucaucggcugcggcagaaacgagaaguucaacuacguggugaugcagcugcagggcagaaaccuggccgaccugagaagaagccagcccagaggcaccuucacccugagcaccacccugagacugggcaagcagauccuggagagcaucgaggccauccacagcgugggcuuccugcacagagacaucaagcccagcaacuucgccaugggcagacugcccagcaccuacagaaagugcuacaugcuggacuucggccuggccagacaguacaccaacaccaccggcgacgugagaccccccagaaacguggccggcuucagaggcaccgugagauacgccagcgugaacgcccacaagaacagagagaugggcagacacgacgaccuguggagccuguucuacaugcugguggaguucgccgugggccagcugcccuggagaaagaucaaggacaaggagcaggugggcaugaucaaggagaaguacgagcacagaaugcugcugaagcacaugcccagcgaguuccaccuguuccuggaccacaucgccagccuggacuacuucaccaagcccgacuaccagcugaucaugagcguguucgagaacagcaugaaggagagaggcaucgccgagaacgaggccuucgacugggagaaggccggcaccgacgcccugcugagcaccagcaccagcacccccccccagcagaacaccagacagaccgccgccauguucggcguggugaacgugacccccgugcccggcgaccugcugagagagaacaccgaggacgugcugcagggcgagcaccugagcgaccaggagaacgccccccccauccugcccggcagacccagcgagggccugggccccagcccccaccuggugccccaccccggcggccccgaggccgaggugugggaggagaccgacgugaacagaaacaagcugagaaucaacaucggcaagagccccugcguggaggaggagcagagcagaggcaugggcgugcccagcagccccgugagagccccccccgacagccccaccacccccgugagaagccugagauacagaagagugaacagccccgagagcgagagacugagcaccgccgacggcagaguggagcugcccgagagaagaagcagaauggaccugcccggcagccccagcagacaggccugcagcagccagcccgcccagaugcugagcguggacaccggccacgccgacagacaggccagcggcagaauggacgugagcgccagcguggagcaggaggcccugagcaacgccuucagaagcgugccccuggccgaggaggaggacuucgacagcaaggagugggugaucaucgacaaggagaccgagcugaaggacuucccccccggcgccgagcccagcaccagcggcaccaccgacgaggagcccgaggagcugagaccccugcccgaggagggcgaggagagaagaagacugggcgccgagcccaccgugagacccagaggcagaagcaugcaggcccuggccgaggaggaccugcagcaccugcccccccagccccugcccccccagcugagccagggcgacggcagaagcgagaccagccagccccccacccccggcagccccagccacagcccccugcacagcggccccagacccagaagaagagagagcgaccccaccggcccccagagacagguguucagcguggccccccccuucgaggugaacggccugcccagagccgugccccugagccugcccuaccaggacuucaagagagaccugagcgacuacagagagagagccagacugcugaacagagugagaagagugggcuucagccacaugcugcugaccaccccccaggugccccuggcccccgugcagccccaggccaacggcaaggaggaggaggaggaggaggaggaggacgaggaggaggaggaggaggacgaggaggaggaggaggaggaggaggaggaggaggaggaggaggaggaggaggaggaggaggaggaggaggccgccgccgccguggcccugggcgaggugcugggccccagaagcggcagcagcagcgagggcagcgagagaagcaccgacagaagccaggagggcgcccccagcacccugcuggccgacgaccagaaggagagcagaggcagagccagcauggccgacggcgaccuggagcccgaggagggcagcaagacccuggugcuggugagccccggcgacaugaagaagagccccgugaccgccgagcuggcccccgaccccgaccugggcacccuggccgcccugaccccccagcacgagagaccccagcccaccggcagccagcuggacgugagcgagcccggcacccugagcagcgugcugaagagcgagcccaagccccccggccccggcgccggccugggcgccggcaccgugaccaccggcgugggcggcguggccgugaccagcagccccuucaccaagguggagagaaccuucgugcacaucgccgagaagacccaccugaacgugaugagcagcggcggccaggcccugagaagcgaggaguucagcgccggcggcgagcugggccuggagcuggccagcgacggcggcgccguggaggagggcgccagagccccccuggagaacggccuggcccugagcggccugaacggcgccgagaucgagggcagcgcccugagcggcgcccccagagagacccccagcgagauggccaccaacagccugcccaacggccccgcccuggccgacggccccgcccccgugagcccccuggagcccagccccgagaagguggccaccaucagccccagaagacacgccaugcccggcagcagacccagaagcagaauccccgugcugcugagcgaggaggacaccggcagcgagcccagcggcagccugagcgccaaggagagauggagcaagagagccagaccccagcaggaccuggccagacuggugauggagaagagacagggcagacugcugcugagacuggccagcggcgccagcagcagcagcagcgaggagcagagaagagccagcgagacccugagcggcaccggcagcgaggaggacacccccgccagcgagcccgccgccgcccugcccagaaagagcggcagagccgccgccaccagaagcagaauccccagacccaucggccugagaaugcccaugcccguggccgcccagcagcccgccagcagaagccacggcgccgcccccgcccuggacaccgccaucaccagcagacugcagcugcagaccccccccggcagcgccaccgccgccgaccugagacccaagcagccccccggcagaggccugggccccggcagagcccaggccggcgccagaccccccgcccccagaagccccagacugcccgccagcaccagcgccgccagaaacgccagcgccagccccagaagccagagccugagcagaagagagagccccagccccagccaccaggccagacccggcgugcccccccccagaggcgugccccccgccagagcccagcccgacggcacccccagccccggcggcagcaagaagggccccagaggcaagcugcaggcccagagagccaccaccaagggcagagccggcggcgccgagggcagagccggcgccagauaa

SEQ ID NO: 25160 - RNA, 3735 nt, Artificial Sequence
  TTBK2__Homo_sapiens__NP_775771
augagcggcggcggcgagcagcuggacauccugagcgugggcauccuggugaaggagagauggaaggugcugagaaagaucggcggcggcggcuucggcgagaucuacgacgcccuggacaugcugaccagagagaacguggcccugaagguggagagcgcccagcagcccaagcaggugcugaagauggagguggccgugcugaagaagcugcagggcaaggaccacgugugcagauucaucggcugcggcagaaacgacagauucaacuacguggugaugcagcugcagggcagaaaccuggccgaccugagaagaagccagagcagaggcaccuucaccaucagcaccacccugagacugggcagacagauccuggagagcaucgagagcauccacagcgugggcuuccugcacagagacaucaagcccagcaacuucgccaugggcagauuccccagcaccugcagaaagugcuacaugcuggacuucggccuggccagacaguucaccaacagcugcggcgacgugagaccccccagagccguggccggcuucagaggcaccgugagauacgccagcaucaacgcccacagaaacagagagaugggcagacacgacgaccuguggagccuguucuacaugcugguggaguucguggugggccagcugcccuggagaaagaucaaggacaaggagcaggugggcagcaucaaggagagauacgaccacagacugaugcugaagcaccugccccccgaguucagcaucuuccuggaccacaucagcagccuggacuacuucaccaagcccgacuaccagcugcugaccagcguguucgacaacagcaucaagaccuucggcgugaucgagagcgaccccuucgacugggagaagaccggcaacgacggcagccugaccaccaccaccaccagcaccaccccccagcugcacaccagacugacccccgccgccaucggcaucgccaacgccacccccauccccggcgaccugcugagagagaacaccgacgagguguuccccgacgagcagcugagcgacggcgagaacggcauccccgugggcgugagccccgacaagcugcccggcagccugggccaccccagaccccaggagaaggacgugugggaggagauggacgccaacaagaacaagaucaagcugggcaucugcaaggccgccaccgaggaggagaacagccacggccaggccaacggccugcugaacgcccccagccugggcagccccaucagagugagaagcgagaucacccagcccgacagagacaucccccuggugagaaagcugagaagcauccacagcuucgagcuggagaagagacugacccuggagcccaagcccgacaccgacaaguuccuggagaccugccuggagaagaugcagaaggacaccagcgccggcaaggagagcauccugcccgcccugcugcacaagcccugcgugcccgccgugagcagaaccgaccacaucuggcacuacgacgaggaguaccugcccgacgccagcaagcccgccagcgccaacacccccgagcaggccgacggcggcggcagcaacggcuucaucgccgugaaccugagcagcugcaagcaggagaucgacagcaaggagugggugaucguggacaaggagcaggaccugcaggacuucagaaccaacgaggccgugggccacaagaccaccggcagccccagcgacgaggagcccgaggugcugcaggugcuggaggccagcccccaggacgagaagcugcagcugggccccugggccgagaacgaccaccugaagaaggagaccagcggcguggugcuggcccugagcgccgagggcccccccaccgccgccagcgagcaguacaccgacagacuggagcugcagcccggcgccgccagccaguucaucgccgccacccccaccagccugauggaggcccaggccgagggcccccugaccgccaucaccauccccagacccagcguggccagcacccagagcaccagcggcagcuuccacugcggccagcagcccgagaagaaggaccugcagcccauggagcccaccguggagcuguacagccccagagagaacuucagcggccugguggugaccgagggcgagccccccagcggcggcagcagaaccgaccugggccugcagaucgaccacaucggccacgacaugcugcccaacaucagagagagcaacaagagccaggaccugggccccaaggagcugcccgaccacaacagacugguggugagagaguucgagaaccugcccggcgagaccgaggagaagagcauccugcuggagagcgacaacgaggacgagaagcugagcagaggccagcacugcaucgagaucagcagccugcccggcgaccuggugaucguggagaaggaccacagcgccaccaccgagccccuggacgugaccaagacccagaccuucagcguggugcccaaccaggacaagaacaacgagaucaugaagcugcugaccgugggcaccagcgagaucagcagcagagacaucgacccccacguggagggccagaucggccagguggccgagaugcagaagaacaagaucagcaaggacgacgacaucaugagcgaggaccugcccggccaccagggcgaccugagcaccuuccugcaccaggagggcaagagagagaagaucacccccagaaacggcgagcuguuccacugcgugagcgagaacgagcacggcgcccccaccagaaaggacauggugagaagcagcuucgugaccagacacagcagaauccccgugcuggcccaggagaucgacagcacccuggagagcagcagccccgugagcgccaaggagaagcugcugcagaagaaggccuaccagcccgaccuggugaagcugcugguggagaagagacaguucaagagcuuccugggcgaccugagcagcgccagcgacaagcugcuggaggagaagcuggccaccgugcccgcccccuucugcgaggaggaggugcugacccccuucagcagacugaccguggacagccaccugagcagaagcgccgaggacagcuuccugagccccaucaucagccagagcagaaagagcaagauccccagacccgugagcugggugaacaccgaccaggugaacagcagcaccagcagccaguucuuccccagacccccccccggcaagccccccaccagacccggcguggaggccagacugagaagauacaaggugcugggcagcagcaacagcgacagcgaccuguucagcagacuggcccagauccugcagaacggcagccagaagcccagaagcaccacccagugcaagagccccggcagcccccacaaccccaagaccccccccaagagccccguggugcccagaagaagccccagcgccagccccagaagcagcagccugcccagaaccagcagcagcagccccagcagagccggcagaccccaccacgaccagagaagcagcagcccccaccugggcagaagcaagagcccccccagccacagcggcagcagcagcagcagaagaagcugccagcaggagcacugcaagcccagcaagaacggccugaagggcagcggcagccugcaccaccacagcgccagcaccaagaccccccagggcaagagcaagcccgccagcaagcugagcagauaa

SEQ ID NO: 25161 - RNA, 2118 nt, Artificial Sequence
  TTC12__Homo_sapiens__NP_060338
auggacgccgacaaggagaaggaccugcagaaguuccugaagaacguggacgagaucagcaaccugauccaggagaugaacagcgacgaccccguggugcagcagaaggccgugcuggagaccgagaagagacugcugcugauggaggaggaccaggaggaggacgagugcagaaccacccugaacaagaccaugaucagccccccccagaccgccaugaagagcgccgaggagaucaacagcgaggccuuccuggccagcguggagaaggacgccaaggagagagccaagagaagaagagagaacaaggugcuggccgacgcccugaaggagaagggcaacgaggccuucgccgagggcaacuacgagaccgccauccugagauacagcgagggccuggagaagcugaaggacaugaaggugcuguacaccaacagagcccaggccuacaugaagcuggaggacuacgagaaggcccugguggacugcgagugggcccugaagugcgacgagaagugcaccaaggccuacuuccacaugggcaaggccaaccuggcccugaagaacuacagcgugagcagagagugcuacaagaagauccuggagaucaaccccaagcugcagacccaggugaagggcuaccugaaccagguggaccugcaggagaaggccgaccugcaggagaaggaggcccacgagcugcuggacagcggcaagaacaccgccgugaccaccaagaaccugcuggagacccugagcaagcccgaccagaucccccuguucuacgccggcggcaucgagauccugaccgagaugaucaacgagugcaccgagcagacccuguucagaaugcacaacggcuucagcaucaucagcgacaacgaggugaucagaagaugcuucagcaccgccggcaacgacgccguggaggagauggugugcgugagcgugcugaagcuguggcaggccgugugcagcagaaacgaggagaaccagagagugcuggugauccaccacgacagagccagacugcuggccgcccugcugagcagcaaggugcuggccaucagacagcagagcuucgcccugcugcugcaccuggcccagaccgagagcggcagaagccugaucaucaaccaccuggaccugaccagacugcuggaggcccuggugagcuuccuggacuucagcgacaaggaggccaacaccgccaugggccuguucaccgaccuggcccuggaggagagauuccaggugugguuccaggccaaccugcccggcgugcugcccgcccugaccggcgugcugaagaccgaccccaaggugagcagcagcagcgcccugugccagugcaucgccaucaugggcaaccugagcgccgagcccaccaccagaagacacauggccgccugcgaggaguucggcgacggcugccugagccugcuggccagaugcgaggaggacguggaccuguucagagaggugaucuacacccugcugggccugaugaugaaccugugccugcaggcccccuucgugagcgaggugugggccguggaggugagcagaagaugccugagccugcugaacagccaggacggcggcauccugaccagagccgccggcgugcugagcagaacccugagcagcagccugaagaucguggaggaggcccugagagccggcguggugaagaagaugaugaaguuccugaagaccggcggcgagaccgccagcagauacgccaucaagauccuggccaucugcaccaacagcuaccacgaggccagagaggaggugaucagacuggacaagaagcugagcgugaugaugaagcugcugagcagcgaggacgaggugcuggugggcaacgccgcccugugccugggcaacugcauggaggugcccaacguggccagcagccugcugaagaccgaccugcugcaggugcugcugaagcuggccggcagcgacacccagaagaccgccgugcaggugaacgccggcaucgcccugggcaagcugugcaccgccgagcccagauucgccgcccagcugagaaagcugcacggccuggagauccugaacagcaccaugaaguacaucagcgacagcuaa

SEQ ID NO: 25162 - RNA, 3426 nt, Artificial Sequence
  TTC17__Homo_sapiens__NP_060729
auggccgccgccgugggcgugagaggcagauacgagcugccccccugcagcggccccggcuggcugcugagccugagcgcccugcugagcguggccgccagaggcgccuucgccaccacccacuggguggugaccgaggacggcaagauccagcagcagguggacagccccaugaaccugaagcacccccacgaccuggugauccugaugagacaggaggccaccgugaacuaccugaaggagcuggagaagcagcugguggcccagaagauccacaucgaggagaacgaggacagagacaccggccuggagcagagacacaacaaggaggaccccgacugcaucaaggccaaggugccccugggcgaccuggaccuguacgacggcaccuacaucacccuggagagcaaggacaucagccccgaggacuacaucgacaccgagagccccgugccccccgaccccgagcagcccgacugcaccaagauccuggagcugcccuacagcauccacgccuuccagcaccugagaggcgugcaggagagagugaaccugagcgccccccugcugcccaaggaggaccccaucuucaccuaccugagcaagagacugggcagaagcaucgacgacaucggccaccugauccacgagggccugcagaagaacaccagcagcugggugcuguacaacauggccagcuucuacuggagaaucaagaacgagcccuaccaggugguggagugcgccaugagagcccugcacuucagcagcagacacaacaaggacaucgcccuggugaaccuggccaacgugcugcacagagcccacuucagcgccgacgccgccgugguggugcacgccgcccuggacgacagcgacuucuucaccagcuacuacacccugggcaacaucuacgccaugcugggcgaguacaaccacagcgugcugugcuacgaccacgcccugcaggccagacccggcuucgagcaggccaucaagagaaagcacgccgugcugugccagcagaagcuggagcagaagcuggaggcccagcacagaagccugcagagaacccugaacgagcugaaggaguaccagaagcagcacgaccacuaccugagacagcaggagauccuggagaagcacaagcugauccaggaggagcagauccugagaaacaucauccacgagacccagauggccaaggaggcccagcugggcaaccaccagaucugcagacuggugaaccagcagcacagccugcacugccagugggaccagcccgugagauaccacagaggcgacaucuucgagaacguggacuacgugcaguucggcgaggacagcagcaccagcagcaugaugagcgugaacuucgacgugcagagcaaccagagcgacaucaacgacagcgugaagagcagccccguggcccacagcauccuguggaucuggggcagagacagcgacgccuacagagacaagcagcacauccuguggcccaagagagccgacugcaccgagagcuaccccagagugcccgugggcggcgagcugcccaccuacuuccugccccccgagaacaagggccugagaauccacgagcugagcagcgacgacuacagcaccgaggaggaggcccagacccccgacugcagcaucaccgacuucagaaagagccacacccugagcuaccuggugaaggagcuggaggugagaauggaccugaaggccaagaugcccgacgaccacgccagaaagauccugcugagcagaaucaacaacuacaccauccccgaggaggagaucggcagcuuccuguuccacgccaucaacaagcccaacgcccccaucuggcugauccugaacgaggccggccuguacuggagagccgugggcaacagcaccuucgccaucgccugccugcagagagcccugaaccuggccccccugcaguaccaggacgugccccuggugaaccuggccaaccugcugauccacuacggccugcaccuggacgccaccaagcugcugcugcaggcccuggccaucaacagcagcgagccccugaccuuccugagccugggcaacgccuaccuggcccugaagaacaucagcggcgcccuggaggccuucagacaggcccugaagcugaccaccaagugccccgagugcgagaacagccugaagcugaucagaugcaugcaguucuaccccuuccuguacaacaucaccagcagcgugugcagcggcaccgugguggaggagagcaacggcagcgacgagauggagaacagcgacgagaccaagaugagcgaggagauccuggcccugguggacgaguuccagcaggccuggccccuggagggcuucggcggcgcccuggagaugaagggcagaagacuggaccugcagggcaucagagugcugaagaagggcccccaggacggcguggccagaagcagcugcuacggcgacugcagaagcgaggacgacgaggccaccgaguggaucaccuuccaggugaagagagugaagaagcccaagggcgaccacaagaagacccccggcaagaagguggagaccggccagaucgagaacggccacagauaccaggccaaccuggagaucaccggccccaagguggccagccccggcccccagggcaagaagagagacuaccagagacugggcuggcccagccccgacgagugccugaagcugagauggguggagcugaccgccaucgugagcaccuggcuggccgugagcagcaagaacaucgacaucaccgagcacaucgacuucgccacccccauccagcagcccgccauggagccccugugcaacggcaaccugcccaccagcaugcacacccuggaccaccugcacggcgugagcaacagagccagccugcacuacaccggcgagagccagcugaccgaggugcugcagaaccugggcaaggaccaguacccccagcagagccuggagcagaucggcaccagaaucgccaaggugcuggagaagaaccagaccagcugggugcugagcagcauggccgcccuguacuggagagugaagggccagggcaagaaggccaucgacugccugagacaggcccugcacuacgccccccaccagaugaaggacgugccccugaucagccuggccaacauccugcacaacgccaagcuguggaacgacgccgugaucguggccaccauggccguggagaucgccccccacuucgccgugaaccacuucacccugggcaacguguacguggccauggaggaguucgagaaggcccuggugugguacgagagcacccugaagcugcagcccgaguucgugcccgccaagaacagaauccagaccauccagugccaccugaugcugaagaagggcagaagaagccccuaa

SEQ ID NO: 25163 - RNA, 1143 nt, Artificial Sequence
  TTC19__Homo_sapiens__NP_060245
auguucagacugcugagcuggagccugggcagaggcuuccugagagccgccggcagaagaugcagaggcugcagcgccagacugcugcccggccuggccggcggccccggccccgaggugcaggugccccccagcagaguggccccccacggcagaggccccggccugcugccccugcuggccgcccuggccugguucagcagacccgccgccgccgaggaggaggagcagcagggcgccgacggcgccgccgccgaggacggcgccgacgaggccgaggccgagaucauccagcugcugaagagagccaagcugagcaucaugaaggacgagcccgaggaggccgagcugauccugcacgacgcccugagacuggccuaccagaccgacaacaagaaggccaucaccuacaccuacgaccugauggccaaccuggccuucaucagaggccagcuggagaacgccgagcagcuguucaaggccaccaugagcuaccugcugggcggcggcaugaagcaggaggacaacgccaucaucgagaucagccugaagcuggccagcaucuacgccgcccagaacagacaggaguucgccguggccggcuacgaguucugcaucagcacccuggaggagaagaucgagagagagaaggagcuggccgaggacaucaugagcguggaggagaaggccaacacccaccugcugcugggcaugugccuggacgccugcgccagauaccugcuguucagcaagcagcccagccaggcccagagaauguacgagaaggcccugcagaucagcgaggagauccagggcgagagacacccccagaccaucgugcugaugagcgaccuggccaccacccuggacgcccagggcagauucgacgaggccuacaucuacaugcagagagccagcgaccuggccagacagaucaaccaccccgagcugcacauggugcugagcaaccuggccgccgugcugaugcacagagagagauacacccaggccaaggagaucuaccaggaggcccugaagcaggccaagcugaagaaggacgagaucagcgugcagcacaucagagaggagcuggccgagcugagcaagaagagcagaccccugaccaacagcgugaagcuguaa

SEQ ID NO: 25164 - RNA, 879 nt, Artificial Sequence
  TTC1__Homo_sapiens__NP_001269429
augggcgagaagagcgagaacugcggcgugcccgaggaccugcugaacggccugaaggugaccgacacccaggaggccgagugcgccggcccccccgugcccgaccccaagaaccagcacagccagagcaagcugcugagagacgacgaggcccaccugcaggaggaccagggcgaggaggagugcuuccacgacugcagcgccagcuucgaggaggagcccggcgccgacaagguggagaacaagagcaacgaggacgugaacagcagcgagcuggacgaggaguaccugaucgagcuggagaagaacaugagcgacgaggagaagcagaagagaagagaggagagcaccagacugaaggaggagggcaacgagcaguucaagaagggcgacuacaucgaggccgagagcagcuacagcagagcccuggagaugugccccagcugcuuccagaaggagagaagcauccuguucagcaacagagccgccgccagaaugaagcaggacaagaaggagauggccaucaacgacugcagcaaggccauccagcugaaccccagcuacaucagagccauccugagaagagccgagcuguacgagaagaccgacaagcuggacgaggcccuggaggacuacaagagcauccuggagaaggaccccagcauccaccaggccagagaggccugcaugagacugcccaagcagaucgaggagagaaacgagagacugaaggaggagaugcugggcaagcugaaggaccugggcaaccuggugcugagacccuucggccugagcaccgagaacuuccagaucaagcaggacagcagcaccggcagcuacagcaucaacuucgugcagaaccccaacaacaacagauaa

SEQ ID NO: 25165 - RNA, 3951 nt, Artificial Sequence
  TTC21B__Homo_sapiens__NP_079029
auggacagccaggagcugaagacccugaucaacuacuacugccaggagagauacuuccaccacgugcugcugguggccagcgagggcaucaagagauacggcagcgaccccguguucagauucuaccacgccuacggcacccugauggagggcaagacccaggaggcccugagagaguucgaggccaucaagaacaagcaggacgugagccugugcagccugcuggcccugaucuacgcccacaagaugagccccaaccccgacagagaggccauccuggagagcgacgccagagugaaggagcagagaaagggcgccggcgagaaggcccuguaccacgccggccuguuccuguggcacaucggcagacacgacaaggccagagaguacaucgacagaaugaucaagaucagcgacggcagcaagcagggccacgugcugaaggccuggcuggacaucaccagaggcaaggagcccuacaccaagaaggcccugaaguacuucgaggagggccugcaggacggcaacgacaccuucgcccugcugggcaaggcccagugccuggagaugagacagaacuacagcggcgcccuggagaccgugaaccagaucaucgugaacuuccccagcuuccugcccgccuucgugaagaagaugaagcugcagcuggcccugcaggacugggaccagaccguggagaccgcccagagacugcugcugcaggacagccagaacguggaggcccugagaaugcaggcccuguacuacgugugcagagagggcgacaucgagaaggccagcaccaagcuggagaaccugggcaacacccuggacgccauggagccccagaacgcccagcuguucuacaacaucacccuggccuucagcagaaccugcggcagaagccagcugauccugcagaagauccagacccugcuggagagagccuucagccugaacccccagcagagcgaguucgccaccgagcugggcuaccagaugauccugcagggcagagugaaggaggcccugaagugguacaagaccgccaugacccuggacgagaccagcgugagcgcccuggugggcuucauccagugccagcugaucgagggccagcugcaggacgccgaccagcagcuggaguuccugaacgagauccagcagagcaucggcaagagcgccgagcugaucuaccugcacgccgugcuggccaugaagaagaacaagagacaggaggaggugaucaaccugcugaacgacgugcuggacacccacuucagccagcuggagggccugccccugggcauccaguacuucgagaagcugaaccccgacuuccugcuggagaucgugauggaguaccugagcuucugccccaugcagcccgccagccccggccagccccugugcccccugcugagaagaugcaucagcgugcuggagaccguggugagaaccgugcccggccugcugcagaccguguuccugaucgccaaggugaaguaccugagcggcgacaucgaggccgccuucaacaaccugcagcacugccuggagcacaaccccagcuacgccgacgcccaccugcugcuggcccagguguaccugagccaggagaaggugaagcugugcagccagagccuggagcugugccugagcuacgacuucaaggugagagacuacccccuguaccaccugaucaaggcccagagccagaagaagaugggcgagaucgccgacgccaucaagacccugcacauggccaugagccugcccggcaugaagagaaucggcgccagcaccaagagcaaggacagaaagaccgagguggacaccagccacagacugagcaucuuccuggagcugaucgacgugcacagacugaacggcgagcagcacgaggccaccaaggugcugcaggacgccauccacgaguucagcggcaccagcgaggaggugagagugaccaucgccaacgccgaccuggcccuggcccagggcgacaucgagagagcccugagcauccugcagaacgugaccgccgagcagcccuacuucaucgaggccagagagaagauggccgacaucuaccugaagcacagaaaggacaagaugcuguacaucaccugcuucagagagaucgccgagagaauggccaaccccagaagcuuccugcugcugggcgacgccuacaugaacauccuggagcccgaggaggccaucguggccuacgagcaggcccugaaccagaaccccaaggacggcacccuggccagcaagaugggcaaggcccugaucaagacccacaacuacagcauggccaucaccuacuacgaggccgcccugaagaccggccagaagaacuaccugugcuacgaccuggccgagcugcugcugaagcugaagugguacgacaaggccgagaaggugcugcagcacgcccuggcccacgagcccgugaacgagcugagcgcccugauggaggacggcagaugccaggugcugcuggccaagguguacagcaagauggagaagcugggcgacgccaucaccgcccugcagcaggccagagagcugcaggccagagugcugaagagagugcagauggagcagcccgacgccgugcccgcccagaagcaccuggccgccgagaucugcgccgagaucgccaagcacagcguggcccagagagacuacgagaaggccaucaaguucuacagagaggcccuggugcacugcgagaccgacaacaagaucaugcuggagcuggccagacuguaccuggcccaggacgaccccgacagcugccugagacagugcgcccugcugcugcagagcgaccaggacaacgaggccgccaccaugaugauggccgaccugauguucagaaagcaggacuacgagcaggccguguuccaccugcagcagcugcuggagagaaagcccgacaacuacaugacccugagcagacugaucgaccugcugagaagaugcggcaagcuggaggacgugcccagauucuucagcauggccgagaagagaaacagcagagccaagcuggagcccggcuuccaguacugcaagggccuguaccugugguacaccggcgagcccaacgacgcccugagacacuucaacaaggccagaaaggacagagacuggggccagaacgcccuguacaacaugaucgagaucugccugaaccccgacaacgagaccgugggcggcgagguguucgagaaccuggacggcgaccugggcaacagcaccgagaagcaggagagcgugcagcuggccgugagaaccgccgagaagcugcugaaggagcugaagccccagaccgugcagggccacgugcagcugagaaucauggagaacuacugccugauggccaccaagcagaagagcaacguggagcaggcccugaacaccuucaccgagaucgccgccagcgagaaggagcacauccccgcccugcugggcauggccaccgccuacaugauccugaagcagacccccagagccagaaaccagcugaagagaaucgccaagaugaacuggaacgccaucgacgccgaggaguucgagaagagcuggcugcugcuggccgacaucuacauccagagcgccaaguacgacauggccgaggaccugcugaagagaugccugagacacaacagaagcugcugcaaggccuacgaguacaugggcuacaucauggagaaggagcaggccuacaccgacgccgcccugaacuacgagauggccuggaaguacagcaacagaaccaaccccgccgugggcuacaagcuggccuucaacuaccugaaggccaagagauacguggacagcaucgacaucugccaccaggugcuggaggcccaccccaccuaccccaagaucagaaaggacauccuggacaaggccagagccagccugagacccuaa

SEQ ID NO: 25166 - RNA, 7446 nt, Artificial Sequence
  TTC28__Homo_sapiens__NP_001138890
auggagcagagccccccccccgcccccgagcccacccagggccccacccccgccagaagcagaagaagaagagagcccgagagcccccccgccagcgcccccaucccccuguucggcgccgacaccaucggccagagaagccccgacggccccgugcugagcaaggccgaguucguggagaaggugagacagagcaaccaggccugccacgacggcgacuuccacaccgccaucgugcuguacaacgaggcccuggccguggacccccagaacugcauccuguacagcaacagaagcgccgccuacaugaagauccagcaguacgacaaggcccuggacgacgccaucaaggccagacugcugaaccccaaguggcccaaggccuacuucagacagggcguggcccugcaguaccugggcagacacgccgacgcccuggccgccuucgccagcggccuggcccaggaccccaagagccugcagcugcuggugggcaugguggaggccgccaugaagagccccaugagagacagccuggagcccaccuaccagcagcugcagaagaugaagcuggacaagagccccuucgugguggugagcguggugggccaggagcugcugaccgccggccaccacggcgccagcgugguggugcuggaggccgcccugaagaucggcaccugcagccugaagcugagaggcagcguguucagcgcccugagcagcgccuacuggagccugggcaacaccgagaagagcaccggcuacaugcagcaggaccuggacguggccaagacccugggcgaccagaccggcgagugcagagcccacggcaaccugggcagcgccuucuucagcaagggcaacuacagagaggcccugaccaaccacagacaccagcuggugcuggccaugaagcugaaggacagagaggccgccagcagcgcccugagcagccugggccacguguacaccgccaucggcgacuaccccaacgcccuggccagccacaagcagugcgugcugcuggccaagcagagcaaggacgagcugagcgaggccagagagcugggcaacaugggcgccguguacaucgccaugggcgacuucgagaacgccgugcagugccacgagcagcaccugaagaucgccaaggaccugggcaacaagagagaggaggccagagccuacagcaaccugggcagcgccuaccacuacagaagaaacuucgacaaggccaugagcuaccacaacuacgugcuggagcuggcccaggagcugauggagaaggccaucgagaugagagccuacgccggccugggccacgccgccagaugcaugcaggaccuggagagagccaagcaguaccacgagcagcagcugggcaucgccgaggaccugaaggacagagccgccgagggcagagccagcagcaaccugggcaucauccaccagaugaagggcgacuacgacaccgcccugaagcugcacaagacccaccugugcaucgcccaggagcugagcgacuacgccgcccagggcagagccuacggcaacaugggcaacgccuacaacgcccugggcauguacgaccaggccgugaaguaccacagacaggagcugcagaucagcauggaggugaacgacagagccagccaggccagcacccacggcaaccuggccguggccuaccaggcccugggcgcccacgacagagcccugcagcacuaccagaaccaccugaacaucgccagagagcugagagacauccagagcgaggccagagcccugagcaaccugggcaacuuccacugcagcagaggcgaguacgugcaggccgcccccuacuacgagcaguaccugagacuggcccccgaccugcaggacauggagggcgagggcaaggugugccacaaccugggcuacgcccacuacugccugggcaacuaccaggaggccgugaaguacuacgagcaggaccuggcccuggccaaggaccugcacgacaagcugagccaggccaaggccuacugcaaccugggccuggccuucaaggcccugcugaacuucagcaaggccgaggagugccagaaguaccugcugagccuggcccagagccugaacaacagccaggccaaguucagagcccugggcaaccugggcgacaucuucaucugcaagaaggacaucaacggcgccaucaaguucuacgagcagcagcugggccuggcccaccaggugaaggacagaagacuggaggccagcgccuacgccgcccugggcaccgccuacagaaugauccagaaguacgacaaggcccugggcuaccacacccaggagcuggagguguaccaggagcugagcgaccugcccggcgagugcagagcccacggccaccuggccgccguguacauggcccugggcaaguacaccauggccuucaagugcuacgaggagcagcuggaccugggccagaagcugaaggaccccagccuggaggcccagguguacggcaacaugggcaucaccaagaugaacaugaacgugauggaggaggccaucggcuacuucgagcagcagcuggccaugcugcagcagcugagcggcaacgagagcgugcuggacagaggcagagccuacggcaaccugggcgacugcuacgaggcccugggcgacuacgaggaggccaucaaguacuacgagcaguaccugagcguggcccagagccugaacagaaugcaggaccaggccaaggccuacagaggccugggcaacggccacagagccaugggcagccugcagcaggcccuggugugcuucgagaagagacuggugguggcccacgagcugggcgaggccuucaacaaggcccaggccuacggcgagcugggcagccugcacagccagcugggcaacuacgagcaggccaucagcugccuggagagacagcugaacaucgccagagacaugaaggacagagcccuggagagcgacgccgccugcggccugggcggcguguaccagcagaugggcgaguacgacaccgcccugcaguaccaccagcuggaccugcagaucgccgaggagaccaacaaccccaccugccagggcagagccuacggcaaccugggccugaccuacgagagccugggcaccuucgagagagccgugguguaccaggagcagcaccugagcaucgccgcccagaugaacgaccuggccgccaagaccgugagcuacagcagccugggcagaacccaccacgcccugcagaacuacagccaggccgugauguaccugcaggagggccugagacuggccgagcagcugggcagaagagaggacgaggccaagaucagacacggccugggccugagccugugggccagcggcaaccuggaggaggcccagcaccagcuguacagagccagcgcccuguucgagaccaucagacacgaggcccagcugagcaccgacuacaagcugagccuguucgaccugcagaccagcagcuaccaggcccugcagagagugcuggugagccugggccaccacgacgaggcccuggccguggccgagagaggcagaaccagagccuucgccgaccugcugguggagagacagaccggccagcaggacagcgaccccuacagccccgugaccaucgaccagauccuggagauggugaacggccagagaggccuggugcuguacuacagccuggccgccggcuaccuguacagcuggcugcuggcccccggcgccggcaucgugaaguuccacgagcacuaccugggcgagaacaccguggagaacagcagcgacuuccaggccagcagcagcgugacccugcccaccgccaccggcagcgcccuggagcagcacaucgccagcgugagagaggcccugggcguggagagccacuacagcagagccugcgccagcagcgagaccgagagcgaggccggcgacaucauggaccagcaguucgaggagaugaacaacaagcugaacagcgugaccgaccccaccggcuuccugagaauggugagaagaaacaaccuguucaacagaagcugccagagcaugaccagccuguucagcaacaccgugagccccacccaggacggcaccagcagccugcccagaagacagagcagcuucgccaagcccccccugagagcccuguacgaccugcugaucgcccccauggagggcggccugaugcacagcagcggccccgugggcagacacagacagcugauccuggugcuggagggcgagcuguaccugauccccuucgcccugcugaagggcagcagcagcaacgaguaccuguacgagagauucggccugcuggccgugcccagcaucagaagccugagcgugcagagcaagagccaccugagaaagaacccccccaccuacagcagcagcaccagcauggccgccgugaucggcaaccccaagcugcccagcgccgugauggacagauggcuguggggccccaugcccagcgccgaggaggaggccuacauggugagcgagcugcugggcugccagccccuggugggcagcguggccaccaaggagagagugaugagcgcccugacccaggccgagugcgugcacuucgccacccacaucagcuggaagcugagcgcccuggugcugacccccagcauggacggcaaccccgccagcagcaagagcagcuucggccaccccuacaccauccccgagagccugagagugcaggacgacgccagcgacggcgagagcaucagcgacugccccccccugcaggagcugcugcugaccgccgccgacgugcuggaccugcagcugcccgugaagcugguggugcugggcagcagccaggagagcaacagcaaggugaccgccgacggcgugaucgcccugaccagagccuuccuggccgccggcgcccagugcgugcuggugagccuguggcccgugcccguggccgccagcaagauguucauccacgccuucuacagcagccugcugaacggccugaaggccagcgccgcccugggcgaggccaugaagguggugcagagcagcaaggccuucagccaccccagcaacugggccggcuucaugcugaucggcagcgacgugaagcugaacagccccagcagccugaucggccaggcccugaccgagauccugcagcaccccgagagagccagagacgcccugagagugcugcugcaccugguggagaagagccugcagagaauccagaacggccagagaaacgccauguacaccagccagcagagcguggagaacaaggugggcggcauccccggcuggcaggcccugcugaccgccgugggcuucagacuggacccccccaccagcggccugcccgccgccguguucuuccccaccagcgaccccggcgacagacugcagcagugcagcagcacccugcagagccugcugggccugcccaaccccgcccugcaggcccugugcaagcugaucaccgccagcgagaccggcgagcagcugaucagcagagccgugaagaacauggugggcaugcugcaccaggugcuggugcagcugcaggccggcgagaaggagcaggaccuggccagcgcccccauccaggugagcaucagcgugcagcuguggagacugcccggcugccacgaguuccuggccgcccugggcuucgaccugugcgaggugggccaggaggaggugauccugaagaccggcaagcaggccaacagaagaaccgugcacuucgcccugcagagccugcugagccuguucgacagcaccgagcugcccaagagacugagccuggacagcagcagcagccuggagagccuggccagcgcccagagcgugagcaacgcccugccccugggcuaccagcagccccccuucagccccaccggcgccgacagcaucgccagcgacgccaucagcguguacagccugagcagcaucgccagcagcaugagcuucgugagcaagcccgagggcggcagcgagggcggcggccccggcggcagacaggaccacgacagaagcaagaacgccuaccugcagagaagcacccugcccagaagccagcugcccccccagaccagacccgccggcaacaaggacgaggaggaguacgagggcuucagcaucaucagcaacgagccccuggccaccuaccaggagaacagaaacaccugcuucagccccgaccacaagcagccccagcccggcaccgccggcggcaugagagugagcgugagcagcaagggcagcaucagcacccccaacagccccgugaagaugacccugauccccagccccaacagccccuuccagaaggugggcaagcuggccagcagcgacaccggcgagagcgaccagagcagcaccgagaccgacagcaccgugaagagccaggaggagagcaaccccaagcuggacccccaggagcuggcccagaagauccuggaggagacccagagccaccugaucgccguggagagacugcagagaagcggcggccaggugagcaagagcaacaaccccgaggacggcgugcaggcccccagcagcaccgccguguucagagccagcgagaccagcgccuucagcagacccgugcugagccaccagaagagccagcccagccccgugaccgugaagcccaagccccccgccagaagcagcagccugcccaaggugagcagcggcuacagcagccccaccaccagcgagaugagcaucaaggacagccccagccagcacagcggcagacccagccccggcugcgacagccagaccagccagcuggaccagccccuguucaagcugaaguaccccagcagccccuacagcgcccacaucagcaagagccccagaaacaugagccccagcagcggccaccagagccccgccggcagcgcccccagccccgcccugagcuacagcagcgccggcagcgccagaagcagccccgccgacgcccccgacaucgacaagcugaagauggccgccaucgacgagaaggugcaggccgugcacaaccugaagauguucuggcagagcaccccccagcacagcaccggccccaugaagaucuucagaggcgcccccggcaccaugaccagcaagagagacgugcugagccugcugaaccugagccccagacacaacaagaaggaggagggcguggacaagcuggagcugaaggagcugagccugcagcagcacgacggcgccccccccaaggccccccccaacggccacuggagaaccgagaccaccagccugggcagccugccccugcccgccggcccccccgccaccgcccccgccagaccccugagacugcccagcggcaacggcuacaaguuccugagccccggcagauucuuccccagcagcaagugcuaa

SEQ ID NO: 25167 - RNA, 1506 nt, Artificial Sequence
  TTC29__Homo_sapiens__NP_001287690
augauccccauguucaccgugacccuggaggacagcggcacccuguggaagagccugcacagcagcagcgagagcgagaugaccacccugcccccccugcccaugaccagacccaagcugaccgcccuggccagacagaagcugcccugcagcagcagaaagauccccagaagccagcugaucaaggagaaggacgacaucgaccacuaccuggaggugaacuucaagggccugagcaaggaggagguggccgccuacagaaacagcuacaagaagaacaucugcguggacaugcugagagacggcuaccacaagagcuucaccgagcuguucgcccugauggagagaugggacgcccugagagaggccgccagagugagaagccuguucuggcugcagaagccccuggaggagcagcccgacaagcuggacuaccuguaccacuaccugaccagagccgaggacgccgagagaaaggagagcuucgaggacgugcacaacaaccuguacgcccuggccugcuacuucaacaacagcgaggacaagugggugagaaaccacuucuacgagagaugcuucaagaucgcccagcugaucaagaucgacugcggcaagaaggaggccgaggcccacaugcacaugggccugcuguacgaggaggacggccagcugcuggaggccgccgagcacuacgaggccuuccaccagcugacccagggcagaaucuggaaggacgagaccggcagaagccugaaccugcuggccugcgagagccugcugagaaccuacagacugcugagcgacaagaugcuggagaacaaggaguacaagcaggccaucaagauccugaucaaggccagcgagaucgccaaggagggcagcgacaagaagauggaggccgaggccagcuacuaccugggccuggcccaccuggccgccgaggaguacgagaccgcccugaccgugcuggacaccuacugcaagaucagcaccgaccuggacgacgaccugagccugggcagaggcuacgaggccaucgccaaggugcugcagagccagggcgagaugaccgaggccaucaaguaccugaagaaguucgugaagaucgccagaaacaacuuccagagccuggaccuggugagagccagcaccaugcugggcgacaucuacaacgagaagggcuacuacaacaaggccagcgagugcuuccagcaggccuucgacaccaccguggagcugaugagcaugccccugauggacgagaccaaggugcacuacggcaucgccaaggcccaccagaugaugcugaccgugaacaacuacaucgagagcgccgaccugaccagccugaacuaccugcugagcuggaaggagagcagaggcaacaucgagcccgaccccgugaccgaggaguucagaggcagcaccguggaggccgugagccagaacagcgagagacuggaggagcugagcagauuccccggcgaccagaagaacgagaccuaa

SEQ ID NO: 25168 - RNA, 4695 nt, Artificial Sequence
  TTC37__Homo_sapiens__NP_055454
augagcagcaaggaggugaagaccgcccugaagagcgccagagacgccaucagaaacaaggaguacaaggaggcccugaagcacugcaagaccgugcugaagcaggagaagaacaacuacaacgccuggguguucaucggcguggccgccgccgagcuggagcagcccgaccaggcccagagcgccuacaagaaggccgccgagcuggagcccgaccagcugcuggccuggcagggccuggccaaccuguacgagaaguacaaccacaucaacgccaaggacgaccugcccggcguguaccagaagcugcuggaccuguacgagagcguggacaagcagaaguggugcgacgugugcaagaagcugguggaccuguacuaccaggagaagaagcaccuggagguggccagaaccuggcacaagcugaucaagaccagacaggagcagggcgccgagaacgaggagcugcaccagcuguggagaaagcugacccaguuccuggccgagagcaccgaggaccagaacaacgagacccagcagcugcuguucaccgccuucgagaacgcccugggccugagcgacaagauccccagcgaggaccaccaggugcuguacagacacuucauccagagccugagcaaguucccccacgagagcgccagacugaagaaggccugcgagggcaugaucaacaucuaccccaccgugcaguacccccuggaggugcugugccugcaccugaucgagagcggcaaccugaccgacgagggccagcaguacugcugcagacugguggagauggacagcaagagcggccccggccugaucggccugggcaucaaggcccugcaggacaagaaguacgaggacgccgugagaaaccugaccgagggccugaaggagagccccgugugcaccagcggcugguaccaccuggccgaggcccaggugaagaugcacagacccaaggaggccgugcugagcugcagccaggcccugaagaucguggacaaccugggcgccagcggcaacagccuguaccagagaaaccugugccugcaccugaaggccgaggcccugaucaagcugagcgacuacgacagcagcgaggaggccaucagaacccuggaccagaucagcgacgccgacaacauccccggccugcuggugcugaagagccuggccuacagaaacaagggcagcuucgacgaggccgccaagaucauggaggaccugcugagcagcuaccccgaccuggccgaggugcacgcccuggaggcccugauccacuucaccaagaaggacuaccugcaggccgagaagugcuuccagagagcccuggagaaggacaccgagguggccgaguaccacuaccagcugggccugaccuacugguucaugggcgaggagaccagaaaggacaagaccaaggcccugacccacuuccugaaggccgccagacuggacaccuacaugggcaagguguucugcuaccugggccacuacuacagagacguggugggcgacaagaacagagccagaggcugcuacagaaaggccuucgagcuggacgacaccgacgccgagagcggcgccgccgccguggaccugagcguggagcuggaggacauggagauggcccuggccauccugaccaccgugacccagaaggccagcgccggcaccgccaagugggccuggcugagaagaggccuguacuaccugaaggccggccagcacagccaggccguggccgaccugcaggccgcccugagagccgaccccaaggacuucaacugcugggagagccugggcgaggccuaccugagcagaggcggcuacaccaccgcccugaagagcuucaccaaggccagcgagcugaaccccgagagcaucuacagcguguucaagguggccgccauccagcagauccugggcaaguacaaggaggccguggcccaguaccagaugaucaucaagaagaaggaggacuacgugcccgcccugaagggccugggcgagugccaccugaugauggccaaggccgcccugguggacuaccuggacggcaaggccguggacuacaucgagaaggcccuggaguacuucaccugcgcccugcagcacagagccgacgugagcugccuguggaagcuggccggcgacgccugcaccugccuguacgccguggcccccagcaaggugaacgugcacgugcugggcgugcugcugggccagaaggagggcaagcaggugcugaagaagaacgagcugcugcaccugggcggcagaugcuacggcagagcccugaagcugaugagcaccagcaacaccuggugcgaccugggcaucaacuacuacagacaggcccagcaccuggccgagaccggcagcaacaugaacgaccugaaggagcugcuggagaagagccugcacugccugaagaaggccgugagacuggacagcaacaaccaccuguacuggaacgcccugggcgugguggccugcuacagcggcaucggcaacuacgcccuggcccagcacugcuucaucaagagcauccagagcgagcagaucaacgccguggccuggaccaaccugggcgugcuguaccugaccaacgagaacaucgagcaggcccacgaggccuucaagauggcccagagccuggaccccagcuaccugaugugcuggaucggccaggcccugaucgccgaggccgugggcagcuacgacaccauggaccuguucagacacaccaccgagcugaacaugcacaccgagggcgcccugggcuacgccuacugggugugcaccacccugcaggacaagagcaacagagagaccgagcuguaccaguacaacauccugcagaugaacgccauccccgccgcccaggugauccugaacaaguacguggagagaauccagaacuacgcccccgccuucaccaugcugggcuaccugaacgagcaccugcagcugaagaaggaggccgccaacgccuaccagagagccauccugcugcugcagaccgccgaggaccaggacaccuacaacguggccaucagaaacuacggcagacugcugugcagcaccggcgaguacgacaaggccauccaggccuucaagagcaccccccuggaggugcuggaggacaucaucggcuucgcccuggcccuguucaugaagggccuguacaaggagagcagcaaggccuacgagagagcccugagcaucguggagagcgagcaggacaaggcccacauccugaccgcccuggccaucaccgaguacaagcagggcaagaccgacguggccaagacccugcuguucaagugcagcauccugaaggagcccaccaccgagagccugcaggcccugugcgcccugggccuggccaugcaggacgccacccugagcaaggccgcccugaacgagcugcugaagcacaucaagcacaaggacagcaacuaccagagaugccugcugaccagcgccaucuacgcccugcagggcagaagcguggccgugcagaagcagaucagcaaggccgugcacagcaaccccggcgaccccgcccuguggagccugcugagcagagugguggcccaguacgcccagagaaacgccaagggcggcgugguggccggcaacguggcccacauccuggacagcaaccacggcaagaaggcccugcuguacaccgccgugaaccagcuggccaugggcagcagcagcgccgaggacgagaagaacaccgcccugaagaccauccagaaggccgcccugcugagccccggcgaccccgccaucugggccggccugauggccgccugccacgccgacgacaagcuggcccuggugaacaacacccagcccaagagaaucgaccuguaccuggcccugcugagcgccgugagcgccagcaucaaggacgagaaguucuucgagaacuacaaccagagccuggagaaguggagccugagccaggccgugaccggccugaucgacaccggcagaaucagcgaggccgagacccugugcaccaagaaccugaagagcaaccccgaccagcccgccgugauccugcugcugagacaggugcagugcaagccccugcuggagagccagaagccccugcccgacgccgugcuggaggagcugcagaagaccgugaugagcaacagcaccagcgugcccgccuggcaguggcuggcccacguguaccagagccagggcaugaugagagccgccgagaugugcuacagaaagagccugcagcuggccagccagagaggcagcuggagcggcaagcugagcagccugcugagacuggcccugcuggcccugaaggugugcauggccaacaucagcaacgaccacuggcccagccuggugcaggaggccaccaccgaggcccugaagcugugcuucugcccccuggccgugcugcugcaggcccugcugcaguucaagagaaagaugggcgccagagagaccagaagacugcuggagagagugguguaccagcccggcuaccccaagagcaucgccagcaccgccagaugguaccugcugagacaccuguacgccaaggacgacuacgagcugaucgacgugcuggugaacaacgccaagacccacggcgacaccagagcccuggagcugaaccagagacugagcagccaguaa

SEQ ID NO: 25169 - RNA, 1734 nt, Artificial Sequence
  TTC39A__Homo_sapiens__NP_001284592
augaccagcgccggcggcgcccccggcgcccugcccgccggcacccccgagagcagccugcacgaggcccuggaccagugcaugaccgcccuggaccuguuccugaccaaccaguucagcgaggcccugagcuaccugaagcccagaaccaaggagagcauguaccacagccugaccuacgccaccauccuggagaugcaggccaugaugaccuucgacccccaggacauccugcuggccggcaacaugaugaaggaggcccagaugcugugccagagacacagaagaaagagcagcgugaccgacagcuucagcagccuggugaacagacccacccugggccaguucaccgaggaggagauccacgccgaggugugcuacgccgagugccugcugcagagagccgcccugaccuuccugcaggacgagaacauggugagcuucaucaagggcggcaucaaggugagaaacagcuaccagaccuacaaggagcuggacagccuggugcagagcagccaguacugcaagggcgagaaccacccccacuucgagggcggcgugaagcugggcgugggcgccuucaaccugacccugagcaugcugcccaccagaauccugagacugcuggaguucgugggcuucagcggcaacaaggacuacggccugcugcagcuggaggagggcgccagcggccacagcuucagaagcgugcugugcgugaugcugcugcugugcuaccacaccuuccugaccuucgugcugggcaccggcaacgugaacaucgaggaggccgagaagcugcugaagcccuaccugaacagauaccccaagggcgccaucuuccuguucuucgccggcagaaucgaggugaucaagggcaacaucgacgccgccaucagaagauucgaggagugcugcgaggcccagcagcacuggaagcaguuccaccacaugugcuacugggagcugauguggugcuucaccuacaagggccaguggaagaugagcuacuucuacgccgaccugcugagcaaggagaacugcuggagcaaggccaccuacaucuacaugaaggccgccuaccugagcauguucggcaaggaggaccacaagcccuucggcgacgacgagguggagcuguucagagccgugcccggccugaagcugaagaucgccggcaagagccugcccaccgagaaguucgccaucagaaagagcagaagauacuucagcagcaaccccaucagccugcccgugcccgcccuggagaugauguacaucuggaacggcuacgccgugaucggcaagcagcccaagcugaccgacggcauccuggagaucaucaccaaggccgaggagaugcuggagaagggccccgagaacgaguacagcguggacgacgagugccuggugaagcugcugaagggccugugccugaaguaccugggcagagugcaggaggccgaggagaacuucagaagcaucagcgccaacgagaagaagaucaaguacgaccacuaccugauccccaacgcccugcuggagcuggcccugcugcugauggagcaggacagaaacgaggaggccaucaagcugcuggagagcgccaagcagaacuacaagaacuacagcauggagagcagaacccacuucagaauccaggccgccacccugcaggccaagagcagccuggagaacagcagcagaagcauggugagcagcgugagccuguaa

SEQ ID NO: 25170 - RNA, 2010 nt, Artificial Sequence
  TTC39B__Homo_sapiens__NP_001161812
auggacgccgugcuggccugcagacugagaggcagaggcaacagaguggccgcccugagacccagacccagacccggcggcagcgccggccccagccccuucgcccugcugugcgccggccugagccccgagcccagagccggcgugggcagcgaguuccccgccugguuccugggcggcagcagccagagaagaaacauggcccugcugggcagcagagccgagcuggaggccgacgaggacguguucgaggacgcccuggagaccaucagcaucagcagccacagcgacauggccaccagcagccugcacuucgccagcugcgacacccagcaggcccccagacagagaggcgccagcaccgugagcagcagcagcagcaccaagguggaccugaagagcggccuggaggagugcgccguggcccugaaccuguuccugagcaacaaguucaccgacgcccuggagcugcugagacccugggccaaggagagcauguaccacgcccugggcuacagcaccaucguggugcugcaggccgugcugaccuucgagcagcaggacauccagaacggcaucagcgccaugaaggacgcccugcagaccugccagaaguacagaaagaaguacaccgugguggagagcuucagcagccugcugagcagaggcagccuggagcagcugagcgaggaggagaugcacgccgagaucugcuacgccgagugccugcugcagaaggccgcccugaccuucgugcaggacgagaacaugaucaacuucaucaagggcggccugaagaucagaaccagcuaccagaucuacaaggagugccugagcauccugcacgagauccagaagaacaagcugcagcaggaguucuucuacgaguucgagggcggcgugaagcugggcagcggcgccuucaaccugaugcugagccugcugcccgccagaaucaucagacugcuggaguucaucggcuucagcggcaacagagagcugggccugcugcagcugagagagggcgccagcggcagaagcaugagaagcgcccugugcugccugaccauccuggccuuccacaccuacaucagccugauccugggcaccggcgaggugaacguggccgaggccgagagacugcuggcccccuuccugcagcaguuccccaacgugagaagcguguuccagagcgcccaggagguguuccagaagugcaucagcgugcaggaggaguggaagcaguuccaccaccugugcuacugggagcugauguggaucaacguguuccagcagaacuggaugcaggccuacuacuacagcgaccugcugugcaaggagagcaaguggagcaaggccaccuacguguuccugaaggccgccauccugagcaugcugcccgaggaggacgugguggccaccaacgagaacguggugacccuguucagacagguggacagccugaagcagagaaucgccggcaagagcauccccaccgagaaguucgccgugagaaaggccagaagauacagcgccagccugcccgcccccgugaagcugauccugcccgcccuggagaugauguacguguggaacggcuucagcaucgugagcaagagaaaggaccugagcgagaaccugcuggugaccguggagaaggccgaggccgcccugcagagccagaacuucaacagcuucagcguggacgacgagugccuggugaagcugcugaagggcugcugccugaagaaccugcagagaccccugcaggccgagcugugcuacaaccacgugguggagagcgagaagcugcugaaguacgaccacuaccuggugcccuucacccuguucgagcuggccagccuguacaagagccagggcgagaucgacaaggccaucaaguuccuggagaccgccagaaacaacuacaaggacuacagccuggagagcagacugcacuucagaauccaggccgcccugcaccuguggagaaagcccagcagcgacuaa

SEQ ID NO: 25171 - RNA, 6078 nt, Artificial Sequence
  TTC3__Homo_sapiens__NP_001001894
auggacaacuucgccgagggcgacuucaccguggccgacuacgcccugcuggaggacugcccccacguggacgacugcguguucgccgccgaguucaugagcaacgacuacgugagagugacccagcuguacugcgacggcgugggcgugcaguacaaggacuacauccagagcgagagaaaccuggaguucgacaucugcagcaucuggugcagcaagcccaucagcgugcugcaggacuacugcgacgccaucaagaucaacaucuucuggccccugcuguuccagcaccagaacagcagcgugaucagcagacugcaccccugcguggacgccaacaacagcagagccagcgagaucaaccugaagaagcugcagcaccuggagcugauggaggacaucguggaccuggccaagaagguggccaacgacagcuuccugaucggcggccugcugagaaucggcugcaagaucgagaacaagauccuggccauggaggaggcccugaacuggaucaaguacgccggcgacgugaccauccugaccaagcugggcagcaucgacaacugcuggcccaugcugagcaucuucuucaccgaguacaaguaccacaucaccaagaucgugauggaggacugcaaccugcuggaggagcugaagacccagagcugcauggacugcaucgaggagggcgagcugaugaagaugaagggcaacgaggaguucagcaaggagagauucgacaucgccaucaucuacuacaccagagccaucgaguacagacccgagaacuaccugcuguacggcaacagagcccugugcuuccugagaaccggccaguucagaaacgcccugggcgacggcaagagagccaccauccugaagaacaccuggcccaagggccacuacagauacugcgacgcccugagcaugcugggcgaguacgacugggcccugcaggccaacaucaaggcccagaagcugugcaagaacgaccccgagggcaucaaggaccugauccagcagcacgugaagcugcagaagcagaucgaggaccugcagggcagaaccgccaacaaggaccccaucaaggccuucuacgagaacagagccuacacccccagaagccugagcgcccccaucuucaccaccagccugaacuucguggagaaggagagagacuucagaaagaucaaccacgagauggccaacggcggcaaccagaaccugaagguggccgacgaggcccugaagguggacgacugcgacugccaccccgaguucagcccccccagcagccagccccccaagcacaagggcaagcagaagagcagaaacaacgagagcgagaaguucagcagcagcagcccccugacccugcccgccgaccugaagaacauccuggagaagcaguucagcaagagcagcagagccgcccaccaggacuucgccaacaucaugaagaugcugagaagccugauccaggacggcuacauggcccugcuggagcagagaugcagaagcgccgcccaggccuucaccgagcugcugaacggccuggacccccagaagaucaagcagcugaaccuggccaugaucaacuacgugcuggugguguacggccuggccaucagccugcugggcaucggccagcccgaggagcugagcgaggccgagaaccaguucaagagaaucaucgagcacuaccccagcgagggccuggacugccuggccuacugcggcaucggcaagguguaccugaagaagaacagauuccuggaggcccugaaccacuucgagaaggccagaacccugaucuacagacugcccggcgugcugaccuggcccaccagcaacgugaucaucgaggagagccagccccagaagaucaagaugcugcuggagaaguucguggaggagugcaaguucccccccgugcccgacgccaucugcugcuaccagaagugccacggcuacagcaagauccagaucuacaucaccgaccccgacuucaagggcuucaucagaaucagcugcugccaguacugcaagaucgaguuccacaugaacugcuggaagaagcugaagaccaccaccuucaacgacaagaucgacaaggacuuccugcagggcaucugccugacccccgacugcgagggcgugaucagcaagaucaucaucuucagcagcggcggcgaggugaagugcgaguucgagcacaaggugaucaaggagaaggugccccccagacccauccugaagcagaagugcagcagccuggagaagcugagacugaaggaggacaagaagcugaagagaaagauccagaagaaggaggccaagaagcuggcccaggagagaauggaggaggaccugagagagagcaacccccccaagaacgaggagcagaaggagaccguggacaacgugcagagaugccaguuccuggacgacagaauccugcagugcaucaagcaguacgccgacaagaucaagagcggcauccagaacaccgccaugcugcugaaggagcugcugagcuggaaggugcugagcaccgaggacuacaccaccugcuucagcagcagaaacuuccugaacgaggccguggacuacgugaucagacaccugauccaggagaacaacagagugaagaccagaaucuuccugcacgugcugagcgagcugaaggagguggagcccaagcuggccgccuggauccagaagcugaacagcuucggccuggacgccaccggcaccuucuucagcagauacggcgccagccugaagcugcuggacuucagcaucaugaccuuccuguggaacgagaaguacggccacaagcuggacagcaucgagggcaagcagcuggacuacuucagcgagcccgccagccugaaggaggccagaugccugaucuggcugcuggaggagcacagagacaaguuccccgcccugcacagcgcccuggacgaguucuucgacaucauggacagcagaugcaccgugcugagaaagcaggacagcggcgaggcccccuucagcagcaccaaggugaagaacaagagcaagaagaagaagcccaaggacagcaagcccaugcuggugggcagcggcaccaccagcgugaccagcaacaacgagaucaucaccagcagcgaggaccacagcaacagaaacagcgacagcgccggccccuucgccgugcccgaccaccugagacaggacguggaggaguucgaggcccuguacgaccagcacagcaacgaguacguggugagaaacaagaagcugugggacaugaaccccaagcagaagugcagcacccuguacgacuacuucagccaguuccuggaggagcacggcccccuggacaugagcaacaagauguucagcgccgaguacgaguucuuccccgaggagaccagacagauccuggagaaggccggcggccugaagcccuuccugcugggcugccccagauucguggugaucgacaacugcaucgcccugaagaagguggccagcagacugaagaagaagagaaagaagaagaacaucaagaccaagguggaggagaucagcaaggccggcgaguacgugagagugaagcugcagcugaaccccgccgccagagaguucaagcccgacgugaagagcaagcccgugagcgacagcagcagcgcccccgccuucgagaacgugaagcccaagcccgugagcgccaacagccccaagcccgccugcgaggacgugaaggccaagcccgugagcgacaacagcagcagacaggugagcgaggacggccagcccaagggcgugagcagcaacagccccaagcccggcagcgaggacgccaacuacaagagagugagcugcaacagccccaagcccgugcuggaggacgugaagcccaccuacugggcccagagccaccuggugaccggcuacugcaccuaccugcccuuccagagauucgacaucacccagaccccccccgccuacaucaacgugcugcccggccugccccaguacaccagcaucuacaccccccuggccagccugagccccgaguaccagcugcccagaagcgugcccguggugcccagcuucguggccaacgacagagccgacaagaacgccgccgccuacuucgagggccaccaccugaacgccgagaacguggccggccaccagaucgccagcgagacccagauccuggagggcagccugggcaucagcgugaagagccacugcagcaccggcgacgcccacaccgugcugagcgagagcaacagaaacgacgagcacugcggcaacagcaacaacaagugcgaggugauccccgagagcaccagcgccgugaccaacaucccccacgugcagaugguggccauccaggugagcuggaacaucauccaccaggaggugaacaccgagcccuacaaccccuucgaggagagacagggcgagaucagcagaaucgagaaggagcaccaggugcugcaggaccagcugcaggagguguacgagaacuacgagcagaucaagcugaagggccuggaggagaccagagaccuggaggagaagcugaagagacaccuggaggagaacaagaucagcaagaccgagcuggacugguuccugcaggaccuggagagagagaucaagaaguggcagcaggagaagaaggagauccaggagagacugaagagccugaagaagaagaucaagaaggugagcaacgccagcgagauguacacccagaagaacgacggcaaggagaaggagcacgagcugcaccuggaccagagccuggagaucagcaacacccugaccaacgagaagaugaagaucgaggaguacaucaagaagggcaaggaggacuacgaggagagccaccagagagccguggccgccgaggugagcgugcuggagaacuggaaggagagcgagguguacaagcugcagaucauggagagccaggccgaggccuuccugaagaagcugggccugaucagcagagaccccgccgccuaccccgacauggagagcgacaucagaagcugggagcuguuccugagcaacgugaccaaggagaucgagaaggccaagagccaguucgaggagcagaucaaggccaucaagaacggcagcagacugagcgagcugagcaaggugcagaucagcgagcugagcuuccccgccugcaacaccgugcaccccgagcugcugcccgagagcagcggcgacgacggccagggccuggugaccagcgccagcgacgugaccggcaaccacgccgcccugcacagagaccccagcguguucagcgccggcgacagccccggcgaggcccccagcgcccugcugcccggccccccccccggccagcccgaggccacccagcugaccggccccaagagagccggccaggccgcccugagcgagagaagccccguggccgacagaaagcagcccgugccccccggcagagccgccagaagcagccagagccccaagaagcccuucaacagcaucaucgagcaccugagcgugguguuccccugcuacaacagcaccgagcuggccggcuucaucaagaaggugagaagcaagaacaagaacagccugagcggccugagcaucgacgagaucgugcagagagugaccgagcacauccuggacgagcagaagaagaagaagcccaaccccggcaaggacaagagaaccuacgagcccagcagcgccacccccgugaccagaagcagccagggcagccccagcguggugguggcccccagccccaagaccaagggccagaaggccgaggacgugcccgugagaaucgcccugggcgccagcagcugcgagaucugccacgagguguucaagagcaagaacgugagagugcugaagugcggccacaaguaccacaagggcugcuucaagcaguggcugaagggccagagcgccugccccgccugccagggcagagaccugcugaccgaggagagccccagcggcagaggcuggcccagccagaaccaggagcugcccagcugcagcagcagauaa

SEQ ID NO: 25172 - RNA, 1323 nt, Artificial Sequence
  TTC5__Homo_sapiens__NP_612385
augauggccgacgaggaggaggaggugaagcccauccugcagaagcugcaggagcugguggaccagcuguacagcuucagagacugcuacuucgagacccacagcguggaggacgccggcagaaagcagcaggacgugcagaaggagauggagaagacccugcagcagauggaggagguggugggcagcgugcagggcaaggcccaggugcugaugcugaccggcaaggcccugaacgugacccccgacuacagccccaaggccgaggagcugcugagcaaggccgugaagcuggagcccgagcugguggaggccuggaaccagcugggcgagguguacuggaagaagggcgacguggccgccgcccacaccugcuucagcggcgcccugacccacugcagaaacaaggugagccugcagaaccugagcauggugcugagacagcugagaaccgacaccgaggacgagcacagccaccacgugauggacagcgugagacaggccaagcuggccgugcagauggacgugcacgacggcagaagcugguacauccugggcaacagcuaccugagccuguacuucagcaccggccagaaccccaagaucagccagcaggcccugagcgccuacgcccaggccgagaagguggacagaaaggccagcagcaaccccgaccugcaccugaacagagccacccugcacaaguacgaggagagcuacggcgaggcccuggagggcuucagcagagccgccgcccuggaccccgccuggcccgagcccagacagagagagcagcagcugcuggaguuccuggacagacugaccagccugcuggagagcaagggcaaggugaagaccaagaagcugcagagcaugcugggcagccugagacccgcccaccugggccccugcagcgacggccacuaccagagcgccagcggccagaaggugacccuggagcugaagccccugagcacccugcagcccggcgugaacagcggcgccgugauccugggcaaggugguguucagccugaccaccgaggagaaggugcccuucaccuucggccugguggacagcgacggccccugcuacgccgugaugguguacaacaucgugcagagcuggggcgugcugaucggcgacagcguggccauccccgagcccaaccugagacugcacagaauccagcacaagggcaaggacuacagcuucagcagcgugagaguggagaccccccugcugcugguggugaacggcaagccccagggcagcagcagccaggccguggccaccguggccagcagaccccagugcgaguaa

SEQ ID NO: 25173 - RNA, 3972 nt, Artificial Sequence
  TTC6__Homo_sapiens__XP_011535733
auguacgccuaccccgaguucaccaagcuguucuggaacaccgccgcccccaaguucagcgugcccgagagcgugaugaaggagacccuguaccccaaguacgagagcgugcaggccagcagacugcugaccgacaagcugagcuacaagagcagcgugaucacccugcaccagcacagcagaaccaacuucuggugcuuccugcccagaaagagcgccagcuucgagagcauccagaagugguucagcgcccagcccacccagcugagaagagugaagagcagcguggaccugagaaaggagaagaucaucgccccccuggagaucaagaacgacaugcagagcagcaucaaggaggugauguuccagaaggccaaggagcugaagagacagcugcagcugaccaagcagaacaagaccgaggagcccaacuacgugaaggagagcaucgacgacaucuucgacaacaugugcgagaagcacagccugagaaaccugagccugacccugaucgaggccagcaagaaggccggcaucagcuacaucguguaccccaagaagaagaagaugagauggaagaagagacugaagcagcagaagcugaucuucgugcacgaggagcugagcaagccccccaagagccuggagagaagcgccagccacggcauccugcccggccagaagaaguaccuguucaaggugccccuguacgagagacagaucagaugccccagccugccccuguaccugaacuucgagaaguucgugcaggccaagggcggcauccccgagaacaucgaccccagaaccugggcccuggacagacugaucgaguacaaggacgccagcauccccgugaaggagaaggacgacaagaucagcgugcccgaggacccccccgagagagugaaggagccccccaagcugaagcugaacgacuacguggagagcgaccugccccaggaggugaucaaguacuacgagagcgaggugaagauccugaccgaggagaucaacgacaagaccaaguaccccgccuucgccuacugcagaagaggcgccaucuacagaaagcugggcaagcugcagagcgccaugaacgaccugcagagagugauccugcuggagccccuguuccugaacgccuacuggcacagacaccugaucuaccuguuccaggacaagaucaacgaggcccuggacgaccugaacuacauccacaaguacaacaagaacaacaccgaggccuaccugagcaaggccgagaucuacagaggcaagaaggacaucacccuggccauccugaacuacacccaggccaucaagagcacccccaccgacgccgacaucuacuucagaagaggcgagauguacgagaucaccaacaaggugcuggccaucgacgacuucagcaagugcaucuucuacgaccccaagagaaccgacgcccugcugaagagaggccuguucuacugcgagaacgagaacugguucgccgccaucgaggacuucaccgcccugcugaacaucgaccaccagaacagccaggccagaaccuacagaggcaucgccuacgugaaguggaaguucuacaaggaggccacccaggacuucagcgccgccauccaccuggaccccaacaacuggcuggcccuguacuacagaggcugccuguucagaaagagcaaccccuucagagcccugcaggacuacagcgugagcgcccugaucaacgacggcuacgagaaccugggcugcuuccugcacagaggcaucguguacgcccaccugaagcuguggcugcuggccaucugcgacuucgagaccgugaucagccuggagagaaccaucacccuggccuacgugaacaucggccugauccaccugcugcaccuggacaacuacaccgaggccaucuggcaguucagcgaggccaucagaaucgacccccugugcauccagagcuaccugugcagagccgagaccuacuucaagcugcacaagcugaagaaggccgugaacgagcugagcagagccauccaccugcagcccgacggcauccagcuguacaucagaagaggccaguaccugcugaugaugaaguacuacgaccuggccaaguucaccaucuaccagaucgccgagauggacaagggccugagcgagcugagccccaugcagcaggcccugaucuacagcuucugcgagaaccacgacaaggccaucgaggugcuggacggcaucagcuggaacagagccgagaugaccaugugcgcccugcuggccaaggugcagaugaaggccaagagaaccaaggaggccguggaggugcugaagaaggcccuggacgccaucagccacagcgacaagggccccgacgccaccgccaucagcgccgacugccuguacaaccugggccugugcuacauggaggagggcaaccugcagauggccuucgacagcuucaccaaggccgugaaggccaaccccgacuucgccgagagcuucuaccagagaggccugugcaaggugaagcugcacaaggacagcagcauccuggacuucaacagagccaucacccugaaccccaagcacuaccaggagaugcacaccggcggccugggcgccuaccugagcagaguggccuucuacggccugaagggcagauacagcaaggccauccugaacugcaacaaggccaucaagaucuaccccgagagcgugagagccuaccuguacagaggcgugcugaaguacuacaacaagaccuacaagcuggccaucaccgaccugaccaccgccaucagcauggacaagaacagcuacaccgccuucuacaacagagcccugugcuacaccaagaucagagagcugcagauggcccugaccgacuacggcaucgugcugcugcuggacgccaccgagaccgugaagcugaacaccuuccugaacagaggccugaucuacguggagcugggccaguacggcuucgcccuggaggacuucaagcaggccgcccugaucagcagaaccaacggcagccugugccacgccaccgccaugugccaccacagaaucaacgaguucgaggaggccgugaacuucuucaccugggcccugaagaucaaccccugcuuccuggacgccuacgugggcagaggcaacagcuacauggaguacggccacgacgaggccaccaagcaggcccagaaggacuuccugaaggcccugcacaucaaccccgccuacaucaaggccagaaucagcuucggcuacaaccugcaggcccagggcaaguuccagaaggccuggaaccacuucaccaucgccaucgacaccgaccccaagaacuaccuggccuacgagggcagagccguggugugccugcagaugggcaacaacuucgccgccaugcaggacaucaacgccgccaugaagaucagcaccaccgccgaguuccugaccaacagaggcgugauccacgaguucaugggccacaagcagaacgccaugaaggacuaccaggacgccaucacccugaaccccaaguacagccuggccuacuucaacgccggcaacaucuacuuccaccacagacaguucagccaggccagcgacuacuucagcaaggcccugaaguucgaccccgagaacgaguacgugcugaugaacagagccaucaccaacaccauccugaagaaguacgaggaggccaaggaggacuucgccaacgugaucgagagcugccccuucugggccgccguguacuucaacagagcccacuucuacuacugccugaagcaguacgagcuggccgaggaggaccugaacaaggcccugagccugaagcccaacgacgcccugguguacaacuucagagccaaggugagaggcaagaucggccugaucgaggaggccauggccgacuacaaccaggcccuggaccuggaggacuacgccagcgugaucuaa

SEQ ID NO: 25174 - RNA, 2475 nt, Artificial Sequence
  TTC7A__Homo_sapiens__NP_001275882
auggugcccagcagcagcagaacccccggcuucaagcagagcagccaccaccugagacugcccaagugcugggacuacagagacgacuucggcaagcugcugcuggccgaggcccugcuggagcagugccugaaggagaaccacgccaagaucaaggacagcaugccccugcuggagaagaacgagcccaagaugagcgaggccaagaacuaccugagcagcauccugaaccacggcagacugagcccccaguacaugugcgaggccaugcugauccugggcaagcugcacuacguggagggcagcuacagagacgccaucagcauguacgccagagccggcaucgacgacaugagcauggagaacaagccccuguaccagaugagacugcugagcgaggccuucgugaucaagggccugagccuggagagacugcccaacagcaucgccagcagauucagacugaccgagagagaggaggaggugaucaccugcuucgagagagccagcuggaucgcccagguguuccugcaggagcuggagaagaccaccaacaacagcaccagcagacaccugaagggcugccacccccuggacuacgagcugaccuacuuccuggaggccgcccugcagagcgccuacgugaagaaccugaagaagggcaacaucgugaagggcaugagagagcugagagaggugcugagaaccguggagaccaaggccacccagaacuucaaggugauggccgccaagcaccuggccggcgugcugcugcacagccugagcgaggagugcuacuggagcccccugagccacccccugcccgaguucaugggcaaggaggagagcagcuucgccacccaggcccugagaaagccccaccuguacgagggcgacaaccuguacugccccaaggacaacaucgaggaggcccugcugcugcugcugaucagcgagagcauggccaccagagacguggugcugagcagagugcccgagcaggaggaggacagaaccgugagccugcagaacgccgccgccaucuacgaccugcugagcaucacccugggcagaagaggccaguacgugaugcugagcgagugccuggagagagccaugaaguucgccuucggcgaguuccaccugugguaccagguggcccugagcaugguggccugcggcaagagcgccuacgccgugagccugcugagagagugcgugaagcugagacccagcgaccccaccgugccccugauggccgccaaggugugcaucggcagccugagauggcuggaggaggccgagcacuucgccaugauggugaucagccugggcgaggaggccggcgaguuccugcccaagggcuaccuggcccugggccugaccuacagccugcaggccaccgacgccacccugaagagcaagcaggacgagcugcacagaaaggcccugcagacccuggagagagcccagcagcuggcccccagcgacccccaggugauccuguacgugagccugcagcuggcccuggugagacagaucagcagcgccauggagcagcugcaggaggcccugaaggugagaaaggacgacgcccacgcccugcaccugcuggcccugcuguucagcgcccagaagcaccaccagcacgcccuggacguggugaacauggccaucaccgagcaccccgagaacuucaaccugauguucaccaaggugaagcuggagcaggugcugaagggccccgaggaggcccuggugaccugcagacaggugcugagacuguggcagacccuguacagcuucagccagcugggcggccuggagaaggacggcagcuucggcgagggccugaccaugaagaagcagagcggcaugcaccugacccugcccgacgcccacgacgccgacagcggcagcagaagagccagcagcaucgccgccagcagacuggaggaggccaugagcgagcugaccaugcccagcagcgugcugaagcagggccccaugcagcuguggaccacccuggagcagaucuggcugcaggccgccgagcuguucauggagcagcagcaccugaaggaggccggcuucugcauccaggaggccgccggccuguuccccaccagccacagcgugcuguacaugagaggcagacuggccgaggugaagggcaaccuggaggaggccaagcagcuguacaaggaggcccugaccgugaaccccgacggcgugagaaucaugcacagccugggccugaugcugagcagacugggccacaagagccuggcccagaaggugcugagagacgccguggagagacagagcaccugccacgaggccuggcagggccugggcgaggugcugcaggcccagggccagaacgaggccgccguggacugcuuccugaccgcccuggagcuggaggccagcagccccgugcugcccuucagcaucauccccagagagcuguaa

SEQ ID NO: 25175 - RNA, 2532 nt, Artificial Sequence
  TTC7B__Homo_sapiens__NP_001010854
auggccaccaagaaggccggcagcagacuggagaccgagaucgagagaugcagaagcgagugccagugggagagaauccccgagcuggugaagcagcugagcgccaagcugaucgccaacgacgacauggccgagcugcugcugggcgagagcaagcuggagcaguaccugaaggagcacccccugagacagggcgccagccccagaggccccaagccccagcugaccgaggugagaaagcaccugaccgccgcccuggacagaggcaaccugaagagcgaguuccugcaggagagcaaccugaucauggccaagcugaacuacguggagggcgacuacaaggaggcccugaacaucuacgccagagugggccuggacgaccugccccugaccgccgugccccccuacagacugagagugaucgccgaggccuacgccaccaagggccugugccuggagaagcugcccaucagcagcagcaccagcaaccugcacguggacagagagcaggacgugaucaccugcuacgagaaggccggcgacaucgcccugcuguaccugcaggagaucgagagagugauccugagcaacauccagaacagaagccccaagcccggccccgccccccacgaccaggagcugggcuucuuccuggagaccggccugcagagagcccacgugcuguacuucaagaacggcaaccugaccagaggcgugggcagauucagagagcugcugagagccguggagaccagaaccacccagaaccugagaaugaccaucgccagacagcuggccgagauccugcugagaggcaugugcgagcagagcuacuggaacccccuggaggacccccccugccagagcccccuggacgacccccugagaaagggcgccaacaccaagaccuacacccugaccagaagagccagaguguacagcggcgagaacaucuucugcccccaggagaacaccgaggaggcccugcugcugcugcugaucagcgagagcauggccaacagagacgccgugcugagcagaauccccgagcacaagagcgacagacugaucagccugcagagcgccagcgugguguacgaccugcugaccaucgcccugggcagaagaggccaguacgagaugcugagcgagugccuggagagagccaugaaguucgccuucgaggaguuccaccugugguaccaguucgcccugagccugauggccgccggcaagagcgccagagccgugaaggugcugaaggagugcaucagacugaagcccgacgacgccaccaucccccugcuggccgccaagcugugcaugggcagccugcacuggcuggaggaggccgagaaguucgccaagaccgugguggacgugggcgagaagaccagcgaguucaaggccaagggcuaccuggcccugggccugaccuacagccugcaggccaccgacgccagccugagaggcaugcaggaggugcugcagagaaaggcccugcuggccuuccagagagcccacagccugagccccaccgaccaccaggccgccuucuaccuggcccugcagcuggccaucagcagacagauccccgaggcccugggcuacgugagacaggcccugcagcugcagggcgacgacgccaacagccugcaccugcuggcccugcugcugagcgcccagaagcacuaccacgacgcccugaacaucaucgacauggcccugagcgaguaccccgagaacuucauccugcuguucagcaaggugaagcugcagagccugugcagaggccccgacgaggcccugcugaccugcaagcacaugcugcagaucuggaagagcugcuacaaccugaccaaccccagcgacagcggcagaggcagcagccugcuggacagaaccaucgccgacagaagacagcugaacaccaucacccugcccgacuucagcgaccccgagaccggcagcgugcacgccaccagcguggccgccagcagaguggagcaggcccugagcgagguggccagcagccugcagagcagcgcccccaagcagggcccccugcaccccuggaugacccuggcccagaucuggcugcacgccgccgagguguacaucggcaucggcaagcccgccgaggccaccgccugcacccaggaggccgccaaccuguuccccaugagccacaacgugcuguacaugagaggccagaucgccgagcugagaggcagcauggacgaggccagaagaugguacgaggaggcccuggccaucagccccacccacgugaagagcaugcagagacuggcccugauccugcaccagcugggcagauacagccuggccgagaagauccugagagacgccgugcaggugaacagcaccgcccacgagguguggaacggccugggcgaggugcugcaggcccagggcaacgacgccgccgccaccgagugcuuccugaccgcccuggagcuggaggccagcagccccgccgugcccuucaccaucauccccagagugcuguaa

SEQ ID NO: 25176 - RNA, 1596 nt, Artificial Sequence
  TTC8__Homo_sapiens__NP_001275710
augagcagcgagauggagccccugcugcuggccuggagcuacuucagaagaagaaaguuccagcugugcgccgaccugugcacccagaugcuggagaagagccccuacgaccaggccgccuggauccugaaggccagagcccugaccgagaugguguacaucgacgagaucgacguggaccaggagggcaucgccgagaugaugcuggacgagaacgccaucgcccaggugcccagacccggcaccagccugaagcugcccggcaccaaccagaccggcggccccagccaggccgugagacccaucacccaggccggcagacccaucaccggcuuccugagacccagcacccagagcggcagacccggcaccauggagcaggccaucagaacccccagaaccgccuacaccgccagacccaucaccagcagcagcggcagauucgugagacugggcaccgccagcaugcugaccagccccgacggccccuucaucaaccugagcagacugaaccugaccaaguacagccagaagcccaagcuggccaaggcccuguucgaguacaucuuccaccacgagaacgacgugaagaccauccaccuggaggacguggugcugcaccugggcaucuaccccuuccugcugagaaacaagaaccacaucgagaagaacgcccuggaccuggccgcccugagcaccgagcacagccaguacaaggacuggugguggaaggugcagaucggcaagugcuacuacagacugggcauguacagagaggccgagaagcaguucaagagcgcccugaagcagcaggagaugguggacaccuuccuguaccuggccaagguguacgugagccuggaccagcccgugaccgcccugaaccuguucaagcagggccuggacaaguuccccggcgaggugacccugcugugcggcaucgccagaaucuacgaggagaugaacaacaugagcagcgccgccgaguacuacaaggaggugcugaagcaggacaacacccacguggaggccaucgccugcaucggcagcaaccacuucuacagcgaccagcccgagaucgcccugagauucuacagaagacugcugcagaugggcaucuacaacggccagcuguucaacaaccugggccugugcugcuucuacgcccagcaguacgacaugacccugaccagcuucgagagagcccugagccuggccgagaacgaggaggaggccgccgacgugugguacaaccugggccacguggccgugggcaucggcgacaccaaccuggcccaccagugcuucagacuggcccuggugaacaacaacaaccacgccgaggccuacaacaaccuggccgugcuggagaugagaaagggccacguggagcaggccagagcccugcugcagaccgccagcagccuggccccccacauguacgagccccacuucaacuucgccaccaucagcgacaagaucggcgaccugcagagaagcuacguggccgcccagaagagcgaggccgccuuccccgaccacguggacacccagcaccugaucaagcagcugagacagcacuucgccaugcuguaa

SEQ ID NO: 25177 - RNA, 720 nt, Artificial Sequence
  TTC9B__Homo_sapiens__NP_689692
augcagagaggcgcccugagccccgugcugaugcugagcgccgcccccgagcccccccccagacccccccccgcccugagcccccccggcagcggccccggcagcggcagcagacacggcagcgccagacccggccccacccccgagcccagcggcagccugggcgccgcccuggacagcagccugagagccgccguggccuucaaggccgagggccagagaugcuacagagagaagaaguucagagaggccaucggcaaguaccacagagcccugcugcagcugaaggccgcccagggcgccagacccagcggccugcccgcccccgcccccggccccaccagcagccccggccccgccagacugagcgaggagcagagaagacugguggagagcaccgagguggagugcuacgacagccugaccgccugccugcugcagagcgagcuggugaacuacgagagagugagagaguacugccugaaggugcuggagaagcagcagggcaacuucaaggccaccuacagagccggcaucgccuucuaccaccugggcgacuacgccagagcccugagauaccugcaggaggccagaagcagagagcccaccgacaccaacgugcugagauacauccagcugacccagcugaagaugaacagaugcagccugcagagagaggacagcggcgccggcagccagaccagagacgugaucggcuaa

SEQ ID NO: 25178 - RNA, 516 nt, Artificial Sequence
  TTC9C__Homo_sapiens__NP_776171
auggagaagagacugcaggaggcccagcuguacaaggaggagggcaaccagagauacagagagggcaaguacagagacgccgugagcagauaccacagagcccugcugcagcugagaggccuggaccccagccugcccagcccccugcccaaccugggcccccagggccccgcccugacccccgagcaggagaacauccugcacaccacccagaccgacugcuacaacaaccuggccgccugccugcugcagauggagcccgugaacuacgagagagugagagaguacagccagaaggugcuggagagacagcccgacaacgccaaggcccuguacagagccggcguggccuucuuccaccugcaggacuacgaccaggccagacacuaccugcuggccgccgugaacagacagcccaaggacgccaacgugagaagauaccugcagcugacccagagcgagcugagcagcuaccacagaaaggagaagcagcuguaccugggcauguucggcuaa

SEQ ID NO: 25179 - RNA, 669 nt, Artificial Sequence
  TTC9__Homo_sapiens__NP_056166
auggagagaaagggcagcgccgccggcgccaagggcaaccccagcccccccgccgccggcgagggccagagacccccccccccccugugcgugcccggcggcggcggcggcgcccccgccagaggccaggugggcgccgccgccgagcccgccgagcugaucagaagagcccacgaguucaagagccagggcgcccagugcuacaaggacaagaaguucagagaggccaucggcaaguaccacagagcccugcuggagcugaagggccugcugcccccccccggcgagagagagagagacagcagacccgccagccccgccggcgcccugaagcccggcagacugagcgaggagcagagcaagaccguggaggccaucgagaucgacugcuacaacagccuggccgccugccugcugcaggccgagcuggugaacuacgagagagugaaggaguacugccugaaggugcugaagaaggagggcgagaacuucaaggcccuguacagaagcggcguggccuucuaccaccugggcgacuacgacaaggcccuguacuaccugaaggaggccagaacccagcagcccaccgacaccaacgugaucagauacauccagcugaccgagaugaagcugagcagaugcagccagagagagaaggaggccauguaa

SEQ ID NO: 25180 - RNA, 2718 nt, Artificial Sequence
  TTF1__Homo_sapiens__XP_006717336
auggagggcgagagcagcagauucgagauccacacccccgugagcgacaagaagaagaagaagugcagcauccacaaggagagaccccagaagcacagccacgagaucuucagagacagcagccuggugaacgagcagagccagaucaccagaagaaagaagagaaagaaggacuuccagcaccugaucagcagcccccugaagaagagcagaaucugcgacgagaccgccaacgccaccagcacccugaagaagagaaagaagagaagauacagcgcccuggagguggacgaggaggccggcgugaccguggugcugguggacaaggagaacaucaacaacacccccaagcacuucagaaaggacguggacguggugugcguggacaugagcaucgagcagaagcugcccagaaagcccaagaccgacaaguuccaggugcuggccaagagccacgcccacaagagcgaggcccugcacagcaaggugagagagaagaagaacaagaagcaccagagaaaggccgccagcugggagagccagagagccagagacacccugccccagagcgagagccaccaggaggagagcuggcugagcgugggccccggcggcgagaucaccgagcugcccgccagcgcccacaagaacaagagcaagaagaagaagaagaagagcagcaacagagaguacgagacccuggccaugcccgagggcagccaggccggcagagaggccggcaccgacaugcaggagagccagcccaccgugggccuggacgacgagaccccccagcugcugggccccacccacaagaagaagagcaagaagaagaagaagaagaagagcaaccaccaggaguucgaggcccuggccaugcccgagggcagccaggugggcagcgaggugggcgccgacaugcaggagagcagacccgccgugggccugcacggcgagaccgccggcauccccgcccccgccuacaagaacaagagcaagaagaagaagaagaagagcaaccaccaggaguucgaggccguggccaugcccgagagccuggagagcgccuaccccgagggcagccaggugggcagcgaggugggcaccguggagggcagcaccgcccugaagggcuucaaggagagcaacagcaccaagaagaagagcaagaagagaaagcugaccagcgugaagagagccagagugagcggcgacgacuucagcgugcccagcaagaacagcgagagcacccuguucgacagcguggagggcgacggcgccaugauggaggagggcgugaagagcagacccagacagaagaagacccaggccugccuggccagcaagcacgugcaggaggcccccagacuggagcccgccaacgaggagcacaacguggagaccgccgaggacagcgagaucagauaccugagcgccgacagcggcgacgccgacgacagcgacgccgaccugggcagcgccgugaagcagcugcaggaguucauccccaacaucaaggacagagccaccagcaccaucaagagaauguacagagacgaccuggagagauucaaggaguucaaggcccagggcguggccaucaaguucggcaaguucagcgugaaggagaacaagcagcuggagaagaacguggaggacuuccuggcccugaccggcaucgagagcgccgacaagcugcuguacaccgacagauaccccgaggagaagagcgugaucaccaaccugaagagaagauacagcuucagacugcacaucggcagaaacaucgccagacccuggaagcugaucuacuacagagccaagaagauguucgacgugaacaacuacaagggcagauacagcgagggcgacaccgagaagcugaagauguaccacagccugcugggcaacgacuggaagaccaucggcgagaugguggccagaagcagccugagcguggcccugaaguucagccagaucagcagccagagaaacagaggcgccuggagcaagagcgagaccagaaagcugaucaaggccguggaggaggugauccugaagaagaugagcccccaggagcugaaggagguggacagcaagcugcaggagaaccccgagagcugccugagcaucgugagagagaagcuguacaagggcaucagcuggguggagguggaggccaaggugcagaccagaaacuggaugcagugcaagagcaaguggaccgagauccugaccaagagaaugaccaacggcagaagaaucuacuacggcaugaacgcccugagagccaaggugagccugaucgagagacuguacgagaucaacguggaggacaccaacgagaucgacugggaggaccuggccagcgccaucggcgacgugccccccagcuacgugcagaccaaguucagcagacugaaggccguguacgugcccuucuggcagaagaagaccuuccccgagaucaucgacuaccuguacgagaccacccugccccugcugaaggagaagcuggagaagaugauggagaagaagggcaccaagauccagacccccgccgcccccaagcagguguuccccuucagagacaucuucuacuacgaggacgacagcgagggcgaggacaucgagaaggagagcgagggccaggcccccugcauggcccacgccugcaacagcagcacccugggcggccagggcagauggaucaucuaa

SEQ ID NO: 25181 - RNA, 3453 nt, Artificial Sequence
  TTF2__Homo_sapiens__XP_011540606
auggccagaaucaaggagagagccagcaccugcgccggccagaccagagccgccagcugcggcccccccagcagcauccccgugagccacugccugcugcacgaggacuucgugguggagcugcagggccugcugcugccccaggacaagaaggaguacagacuguucuucagaugcaucagaagcaaggccgagggcaagagauggugcggcagcauccccuggcaggaccccgacagcaaggagcacagcgugagcaacaagagccagcacgccagcgagaccuuccaccacagcagcaacuggcugagaaaccccuucaaggugcuggacaagaaccaggagcccgcccuguggaagcagcugaucaagggcgagggcgaggagaagaaggccgacaagaagcagagagagaagggcgaccagcuguucgaccagaagaaggagcagaagcccgagaugauggagaaggaccugagcagcggccuggugcccaagaagaagcagagcguggugcaggagaagaagcaggaggagggcgccgagauccagugcgaggccgagaccggcggcacccacaagagagacuucagcgagaucaagagccagcagugccagggcaacgagcugaccagacccagcgccagcagccaggagaagagcagcggcaagagccaggacgugcagagagagagcgagccccugagagagaaggugacccagcugcugccccagaacgugcacagccacaacagcaucagcaagccccagaagggcggcccccugaacaaggaguacaccaacugggaggccaaggagaccaaggccaaggacggccccagcauccaggccacccagaagagccugccccagggccacuuccaggagagacccgagacccacagcgugcccgcccccggcggccccgccgcccaggccgcccccgccgcccccggccugagccugggcgagggcagagaggccgccaccagcagcgacgacgaggaggaggacgacgugguguucgugagcagcaagcccggcagcccccugcuguucgacagcacccuggaccuggagaccaaggagaaccugcaguuccccgacagaagcgugcagagaaaggugagccccgccagcggcgugagcaagaagguggagcccagcgaccccguggccagaagaguguaccugaccacccagcugaagcagaagaagagcacccuggccagcgugaacauccaggcccugcccgacaagggccagaagcugaucaagcagauccaggagcuggaggaggugcugagcggccugacccugagccccgagcagggcaccaacgagaagagcaacagccaggugccccagcagagccacuucaccaagaccaccaccggccccccccaccuggugcccccccagccccugcccagaagaggcacccagcccgugggcagccuggagcugaagagcgccugccaggugaccgccggcggcagcagccagugcuacagaggcaacaccuaccuguacgccggccacaccaaccaggaccacgugcacgccguguggaagaucaccagcgaggccaucggccagcugcacagaagccuggagagcugccccggcgagaccgugguggccgaggaccccgccggccugaaggugccccugcugcugcaccagaagcaggcccuggccuggcugcuguggagagagagccagaagccccagggcggcauccuggccgacgacaugggccugggcaagacccugaccaugaucgcccugauccugacccagaagaaccaggagaagaaggaggagaaggagaagagcaccgcccugaccuggcugagcaaggacgacagcugcgacuucaccagccacggcacccugaucaucugccccgccagccugauccaccacuggaagaacgagguggagaagagagugaacagcaacaagcugagaguguaccuguaccacggccccaacagagacagcagagccagagugcugagcaccuacgacaucgugaucaccaccuacagccugguggccaaggagauccccaccaacaagcaggaggccgagauccccggcgccaaccugaacguggagggcaccagcaccccccugcugagaaucgccugggccagaaucauccuggacgaggcccacaacgugaagaaccccagagugcagaccagcaucgccgugugcaagcugcaggccugcgccagaugggccgugaccggcacccccauccagaacaaccugcuggacauguacagccugcugaaguuccugagaugcagccccuucgacgaguucaaccuguggagaagccagguggacaacggcagcaagaagggcggcgagagacugagcauccugaccaagagccugcugcugagaagaaccaaggaccagcuggacagcaccggcagaccccuggugauccugccccagagaaaguuccagcugcaccaccugaagcugagcgaggacgaggagaccguguacaacguguucuucgccagaagcagaagcgcccugcagagcuaccugaagagacacgagagcagaggcaaccagagcggcagaagccccaacaaccccuucagcagaguggcccuggaguucggcagcgaggagcccagacacagcgaggccgccgacagccccagaagcagcaccgugcacauccugagccagcugcugagacugagacagugcugcugccaccugagccugcugaagagcgcccuggaccccauggagcugaagggcgagggccuggugcugagccuggaggagcagcugagcgcccugacccugagcgagcugagagacagcgagcccagcagcaccgugagccugaacggcaccuucuucaagauggagcuguucgagggcaugagagagagcaccaagaucagcagccugcuggccgagcuggaggccauccagagaaacagcgccagccagaagagcgugaucgugagccaguggaccaacaugcugaaggugguggcccugcaccugaagaagcacggccugaccuacgccaccaucgacggcagcgugaaccccaagcagagaauggaccugguggaggccuucaaccacagcagaggcccccaggugaugcugaucagccugcuggccggcggcgugggccugaaccugaccggcggcaaccaccuguuccugcuggacaugcacuggaaccccagccuggaggaccaggccugcgacagaaucuacagagugggccagcagaaggacguggugauccacagauucgugugcgagggcaccguggaggagaagauccugcagcugcaggagaagaagaaggaccuggccaagcaggugcugagcggcagcggcgagagcgugaccaagcugacccuggccgaccugagagugcuguucggcaucuaa

SEQ ID NO: 25182 - RNA, 3270 nt, Artificial Sequence
  TTI1__Homo_sapiens__NP_001290386
auggccguguucgacacccccgaggaggccuucggcgugcugagacccgugugcgugcagcugaccaagacccagaccguggagaacguggagcaccugcagaccagacugcaggccgugagcgacagcgcccugcaggagcugcagcaguacauccuguucccccugagauucacccugaagacccccggccccaagagagagagacugauccagagcgugguggagugccugaccuucgugcugagcagcaccugcgugaaggagcaggagcugcugcaggagcuguucagcgagcugagcgccugccuguacagccccagcagccagaagcccgccgccgugagcgaggagcugaagcuggccgugauccagggccugagcacccugaugcacagcgccuacggcgacaucauccugaccuucuacgagcccagcauccugcccagacugggcuucgccgugagccugcugcugggccuggccgagcaggagaagagcaagcagaucaagaucgccgcccugaagugccugcaggugcugcugcugcagugcgacugccaggaccaccccagaagccuggacgagcuggagcagaagcagcugggcgaccuguucgccagcuuccugcccggcaucagcaccgcccugaccagacugaucaccggcgacuucaagcagggccacagcaucguggugagcagccugaagaucuucuacaagaccgugagcuucaucauggccgacgagcagcugaagagaaucagcaaggugcaggccaagcccgccguggagcacagaguggccgagcugaugguguacagagaggccgacugggugaagaagaccggcgacaagcugaccauccugaucaagaagaucaucgagugcgugagcgugcacccccacuggaaggugagacuggagcugguggagcugguggaggaccugcugcugaagugcagccagagccugguggagugcgccggcccccugcugaaggcccuggugggccuggugaacgacgagagccccgagauccaggcccagugcaacaaggugcugagacacuucgccgaccagaaggugguggugggcaacaaggcccuggccgacauccugagcgagagccugcacagccuggccaccagccugcccagacugaugaacagccaggacgaccagggcaaguucagcacccugagccugcugcugggcuaccugaagcugcugggccccaagaucaacuucgugcugaacagcguggcccaccugcagagacugagcaaggcccugauccaggugcuggagcuggacguggccgacaucaagaucguggaggagagaagauggaacagcgacgaccugaacgccagccccaagaccagcgccacccagcccuggaacagaauccagagaagauacuucagauucuucaccgacgagagaaucuucaugcugcugagacaggugugccagcugcugggcuacuacggcaaccuguaccugcugguggaccacuucauggagcuguaccaccagagcgugguguacagaaagcaggccgccaugauccugaacgagcuggugaccggcgccgccggccuggagguggaggaccugcacgagaagcacaucaagaccaaccccgaggagcugagagagaucgugaccagcauccuggaggaguacaccagccaggagaacugguaccuggugaccugccuggagaccgaggagaugggcgaggagcugaugauggagcaccccggccugcaggccaucaccagcggcgagcacaccugccaggugaccagcuuccuggccuucagcaagcccagccccaccaucugcagcaugaacagcaacaucuggcagaucugcauccagcuggagggcaucggccaguucgccuacgcccugggcaaggacuucugccugcugcugaugagcgcccuguaccccgugcuggagaaggccggcgaccagacccugcugaucagccagguggccaccagcaccaugauggacgugugcagagccugcggcuacgacagccugcagcaccugaucaaccagaacagcgacuaccuggugaacggcaucagccugaaccugagacaccuggcccugcacccccacacccccaaggugcuggaggugaugcugagaaacagcgacgccaaccugcugccccugguggccgacguggugcaggacgugcuggccacccuggaccaguucuacgacaagagagccgccagcuucgugagcgugcugcacgcccugauggccgcccuggcccagugguuccccgacaccggcaaccugggccaccugcaggagcagagccugggcgaggagggcagccaccugaaccagagacccgccgcccuggagaagagcaccaccaccgccgaggacaucgagcaguuccugcugaacuaccugaaggagaaggacguggccgacggcaacgugagcgacuucgacaacgaggaggaggagcagagcgugccccccaagguggacgagaacgacaccagacccgacguggagcccccccugccccugcagauccagaucgccauggacgugauggagagaugcauccaccugcugagcgacaagaaccugcagaucagacugaaggugcuggacgugcuggaccugugcgugguggugcugcagagccacaagaaccagcugcugccccuggcccaccaggccuggcccagccuggugcacagacugaccagagacgccccccuggccgugcugagagccuucaaggugcugagaacccugggcagcaagugcggcgacuuccugagaagcagauucugcaaggacgugcugcccaagcuggccggcagccuggugacccaggcccccaucagcgccagagccggccccguguacagccacacccuggccuucaagcugcagcuggccgugcugcagggccugggcccccugugcgagagacuggaccugggcgagggcgaccugaacaagguggccgacgccugccugaucuaccugagcgugaagcagcccgugaagcugcaggaggccgccagaagcguguuccugcaccugaugaagguggaccccgacagcaccugguuccugcugaacgagcuguacugccccgugcaguucacccccccccaccccagccugcaccccgugcagcugcacggcgccagcggccagcagaaccccuacaccaccaacgugcugcagcugcugaaggagcugcaguaa

SEQ ID NO: 25183 - RNA, 1527 nt, Artificial Sequence
  TTI2__Homo_sapiens__NP_079391
auggagcuggacagcgcccuggaggcccccagccaggaggacagcaaccugagcgaggagcugagccacagcgccuucggccaggccuucagcaagauccugcacugccuggccagacccgaggccagaagaggcaacgugaaggacgccgugcugaaggaccugggcgaccugaucgaggccaccgaguucgacagacuguucgagggcaccggcgccagacugagaggcaugcccgagacccugggccagguggccaaggcccuggagaaguacgccgcccccagcaaggaggaggagggcggcggcgacggccacagcgaggccgccgagaaggccgcccaggugggccugcuguuccugaagcugcugggcaagguggagaccgccaagaacagccuggugggccccgccuggcagaccggccugcaccaccuggccggccccguguacaucuucgccaucacccacagccuggagcagcccuggaccacccccagaagcagagagguggccagagaggugcugaccagccugcugcaggugaccgagugcggcagcguggccggcuuccugcacggcgagaacgaggacgagaagggcagacugagcgugauccugggccugcugaagcccgaccuguacaaggagagcuggaagaacaaccccgccaucaagcacguguucagcuggacccugcagcaggugaccagacccuggcugagccagcaccuggagagagugcugcccgccagccuggugaucagcgacgacuaccagaccgagaacaagauccugggcgugcacugccugcaccacaucgugcugaacgugcccgccgccgaccugcugcaguacaacagagcccaggugcuguaccacgccaucagcaaccaccuguacacccccgagcaccaccugauccaggccgugcugcugugccugcuggaccuguuccccauccuggagaagacccugcacuggaagggcgacggcgccagacccaccacccacugcgacgaggugcugagacugauccugacccacauggagcccgagcacagacugcugcugagaagaaccuacgccagaaaccugcccgccuucgugaacagacugggcauccugaccgugagacaccugaagagacuggagagagugaucaucggcuaccuggagguguacgacggccccgaggaggaggccagacugaagauccuggagacccugaagcugcugaugcagcacaccuggcccagagugagcugcagacugguggugcugcugaaggcccugcugaagcugaucugcgacguggccagagaccccaaccugacccccgagagcgugaagagcgcccugcugcaggaggccaccgacugccugauccugcuggacagaugcagccagggcagagugaagggccugcuggccaagaucccccagagcugcgaggacagaaagguggugaacuacaucagaaaggugcagcaggugagcgagggcgcccccuacaacggcaccuaa

SEQ ID NO: 25184 - RNA, 2574 nt, Artificial Sequence
  TTK__Homo_sapiens__XP_011534401
auggagagcgaggaccugagcggcagagagcugaccaucgacagcaucaugaacaaggugagagacaucaagaacaaguucaagaacgaggaccugaccgacgagcugagccugaacaagaucagcgccgacaccaccgacaacagcggcaccgugaaccagaucaugaugauggccaacaaccccgaggacuggcugagccugcugcugaagcuggagaagaacagcgugccccugagcgacgcccugcugaacaagcugaucggcagauacagccaggccaucgaggcccugccccccgacaaguacggccagaacgagagcuucgccagaauccaggugagauucgccgagcugaaggccauccaggagcccgacgacgccagagacuacuuccagauggccagagccaacugcaagaaguucgccuucgugcacaucagcuucgcccaguucgagcugagccagggcaacgugaagaagagcaagcagcugcugcagaaggccguggagagaggcgccgugccccuggagaugcuggagaucgcccugagaaaccugaaccugcagaagaagcagcugcugagcgaggaggagaagaagaaccugagcgccagcaccgugcugaccgcccaggagagcuucagcggcagccugggccaccugcagaacagaaacaacagcugcgacagcagaggccagaccaccaaggccagauuccuguacggcgagaacaugcccccccaggacgccgagaucggcuacagaaacagccugagacagaccaacaagaccaagcagagcugccccuucggcagagugcccgugaaccugcugaacagccccgacugcgacgugaagaccgacgacagcguggugcccugcuucaugaagagacagaccagcagaagcgagugcagagaccugguggugcccggcagcaagcccagcggcaacgacagcugcgagcugagaaaccugaagagcgugcagaacagccacuucaaggagccccuggugagcgacgagaagagcagcgagcugaucaucaccgacagcaucacccugaagaacaagaccgagagcagccugcuggccaagcuggaggagaccaaggaguaccaggagcccgaggugcccgagagcaaccagaagcaguggcagagcaagagaaagagcgagugcaucaaccagaaccccgccgccagcagcaaccacuggcagauccccgagcuggccagaaaggugaacaccgagcagaagcacaccaccuucgagcagcccguguucagcgugagcaagcagagcccccccaucagcaccagcaagugguucgaccccaagagcaucugcaagacccccagcagcaacacccuggacgacuacaugagcugcuucagaacccccguggugaagaacgacuucccccccgccugccagcugagcacccccuacggccagcccgccugcuuccagcagcagcagcaccagauccuggccaccccccugcagaaccugcaggugcuggccagcagcagcgccaacgagugcaucagcgugaagggcagaaucuacagcauccugaagcagaucggcagcggcggcagcagcaagguguuccaggugcugaacgagaagaagcagaucuacgccaucaaguacgugaaccuggaggaggccgacaaccagacccuggacagcuacagaaacgagaucgccuaccugaacaagcugcagcagcacagcgacaagaucaucagacuguacgacuacgagaucaccgaccaguacaucuacauggugauggagugcggcaacaucgaccugaacagcuggcugaagaagaagaagagcaucgaccccugggagagaaagagcuacuggaagaacaugcuggaggccgugcacaccauccaccagcacggcaucgugcacagcgaccugaagcccgccaacuuccugaucguggacggcaugcugaagcugaucgacuucggcaucgccaaccagaugcagcccgacaccaccagcguggugaaggacagccaggugggcaccgugaacuacaugccccccgaggccaucaaggacaugagcagcagcagagagaacggcaagagcaagagcaagaucagccccaagagcgacguguggagccugggcugcauccuguacuacaugaccuacggcaagacccccuuccagcagaucaucaaccagaucagcaagcugcacgccaucaucgaccccaaccacgagaucgaguuccccgacauccccgagaaggaccugcaggacgugcugaagugcugccugaagagagaccccaagcagagaaucagcauccccgagcugcuggcccaccccuacgugcagauccagacccaccccgugaaccagauggccaagggcaccaccgaggagaugaaguacgugcugggccagcuggugggccugaacagccccaacagcauccugaaggccgccaagacccuguacgagcacuacagcggcggcgagagccacaacagcagcagcagcaagaccuucgagaagaagagaggcaagaaguaa

SEQ ID NO: 25185 - RNA, 1134 nt, Artificial Sequence
  TTL__Homo_sapiens__NP_714923
auguacaccuucguggugagagacgagaacagcagcguguacgccgaggugagcagacugcugcuggccaccggccacuggaagagacugagaagagacaaccccagauucaaccugaugcugggcgagagaaacagacugcccuucggcagacugggccacgagcccggccuggugcagcuggugaacuacuacagaggcgccgacaagcugugcagaaaggccagccuggugaagcugaucaagaccagccccgagcuggccgagagcugcaccugguuccccgagagcuacgugaucuaccccaccaaccugaagacccccguggcccccgcccagaacggcauccagccccccaucagcaacagcagaaccgacgagagagaguucuuccuggccagcuacaacagaaagaaggaggacggcgagggcaacguguggaucgccaagagcagcgccggcgccaagggcgagggcauccugaucagcagcgaggccagcgagcugcuggacuucaucgacaaccagggccaggugcacgugauccagaaguaccuggagcacccccugcugcuggagcccggccacagaaaguucgacaucagaagcugggugcugguggaccaccaguacaacaucuaccuguacagagagggcgugcugagaaccgccagcgagcccuaccacguggacaacuuccaggacaagaccugccaccugaccaaccacugcauccagaaggaguacagcaagaacuacggcaaguacgaggagggcaacgagauguucuucaaggaguucaaccaguaccugaccagcgcccugaacaucacccuggagagcagcauccugcugcagaucaagcacaucaucagaaacugccugcugagcguggagcccgccaucagcaccaagcaccugcccuaccagagcuuccagcuguucggcuucgacuucaugguggacgaggagcugaagguguggcugaucgaggugaacggcgcccccgccugcgcccagaagcuguacgccgagcugugccagggcaucguggacaucgccaucagcagcguguuccccccccccgacguggagcagccccagacccagcccgccgccuucaucaagcuguaa

SEQ ID NO: 25186 - RNA, 1578 nt, Artificial Sequence
  TTLL10__Homo_sapiens__XP_011539472
auggaccacagcugcaccagauucauccacagaagaggcccccccaccagaaccagagccggcuucaagagaggcaagagacccagaauccagcagagacccagagccagagugagcggcaccauccccgccagcagacugcaccccgcccccgccagccagcccggccccugccccgcccccggccacugccccgugggccccgcccacgagagacccaugggcagcagccaggaggagggccugagaugccagcccagccagcccgaccacgacgccgacggccacugcggccccgaccuggagggcgccgagagagccagcgccacccccggcccccccggccugcugaacagccacagacccgccgacagcgacgacaccaacgccgccggccccagcgccgcccugcuggagggccugcugcugggcggcggcaagcccagcccccacagcaccagacccggccccuucuucuacaucggcggcagcaacggcgccaccaucaucagcagcuacugcaagagcaagggcuggcagagaauccacgacagcagaagagacgacuacacccugaaguggugcgaggugaagagcagagacagcuacggcagcuucagagagggcgagcagcugcuguaccagcugcccaacaacaagcugcugaccaccaagaucggccugcugagcacccugagaggcagagccagagccaugagcaaggccagcaaggugcccggcggcgugcaggccagacuggagaaggacgccgccgcccccgcccuggaggaccugcccuggaccagccccggcuaccugagaccccagagagugcugagaauggaggaguucuuccccgagaccuacagacuggaccugaagcacgagagagaggccuucuucacccuguucgacgagacccagaucuggaucugcaagcccaccgccagcaaccagggcaagggcaucuuccugcugagaaaccaggaggagguggccgcccugcaggccaagaccagaagcauggaggacgaccccauccaccacaagacccccuucagaggcccccaggccagaguggugcagagaugcggcggcggcugccccgagggcuacauccagaacccccugcugguggacggcagaaaguucgacgugagaagcuaccugcugaucgccugcaccacccccuacaugaucuucuucggccacggcuacgccagacugacccugagccuguacgacccccacagcagcgaccugggcggccaccugaccaaccaguucaugcagaagaagagcccccuguacaugcugcugaaggagcacaccguguggagcauggagcaccugaacagauacaucagcgacaccuucuggaaggccagaggccuggccaaggacuggguguucaccacccugaagagacugugcagccugagcuggcagugccugagccccgccgccagcaagggccccgacggcaagcccagcagaggcagcgugggcaccagccccgccggcagccuggccgugggcagcggcgacagcagcgccagcgugaccgccaccauguaa

SEQ ID NO: 25187 - RNA, 2403 nt, Artificial Sequence
  TTLL11__Homo_sapiens__NP_001132914
auggccgccgccgccagcgugaccggcagagugaccugggccgccagccccaugagaagccugggccugggcagaagacugagccugcccggccccagacuggacgccgugaccgccgccgugaaccccagccugagcgaccacggcaacggccugggcagaggcaccagaggcagcggcugcagcggcggcagccugguggccgacuggggcggcggcgccgccgccgccgccgccguggcccuggcccuggcccccgcccugagcaccaugagaagaggcagcagcgagagcgagcuggccgccagaugggaggccgaggccguggccgccgccaaggccgccgccaaggccgaggccgaggccaccgccgagaccguggccgagcaggugagaguggacgccggcgccgccggcgagcccgagugcaaggccggcgaggagcagcccaaggugcuggcccccgcccccgcccagcccagcgccgccgaggagggcaacacccaggugcugcagagacccccccccacccugccccccagcaagcccaagcccgugcagggccugugcccccacggcaagcccagagacaagggcagaagcugcaagagaagcagcggccacggcagcggcgagaacggcagccagagacccgugaccguggacagcagcaaggccagaaccagccuggacgcccugaagaucagcaucagacagcugaaguggaaggaguuccccuucggcagaagacugcccugcgacaucuacuggcacggcgugagcuuccacgacaacgacaucuucagcggccaggugaacaaguuccccggcaugaccgagauggugagaaagaucacccugagcagagccgugagaaccaugcagaaccuguuccccgaggaguacaacuucuaccccagaagcuggauccugcccgacgaguuccagcuguucguggcccaggugcagauggugaaggacgacgaccccagcuggaagcccaccuucaucgugaagcccgacggcggcugccagggcgacggcaucuaccugaucaaggaccccagcgacaucagacuggccggcacccugcagagcagacccgccguggugcaggaguacaucugcaagccccugcugaucgacaagcugaaguucgacaucagacuguacgugcugcugaagagccuggacccccuggagaucuacaucgccaaggacggccugagcagauucugcaccgagcccuaccaggagcccacccccaagaaccugcacagaaucuucaugcaccugaccaacuacagccugaacauccacagcggcaacuucauccacagcgacagcgccagcaccggcagcaagagaaccuucagcagcauccugugcagacugagcagcaagggcguggacaucaagaagguguggagcgacaucaucagcguggugaucaagaccgugaucgcccugacccccgagcugaagguguucuaccagagcgacauccccaccggcagacccggccccaccugcuuccagauccugggcuucgacauccugcugaugaagaaccugaagcccauccugcuggaggugaacgccaaccccagcaugagaaucgagcacgagcacgagcugagccccggcguguucgagaacgugcccagccugguggacgaggaggugaagguggccgugaucagagacacccugagacugauggacccccugaagaagaagagagagaaccagagccagcagcuggagaagcccuucgccggcaaggaggacgcccuggacggcgagcugaccagcgcccccgacugcaacgccaaccccgaggcccaccugcccagcaucugccugaagcagguguuccccaaguacgccaagcaguucaacuaccugagacugguggacagaauggccaaccuguucaucagauuccugggcaucaagggcaccaugaagcugggccccaccggcuucagaaccuucaucagaagcugcaagcugagcagcagcagccugagcauggccgccguggacauccuguacaucgacaucaccagaagauggaacagcaugacccuggaccagagagacagcggcaugugccugcaggccuucguggaggccuucuucuuccuggcccagagaaaguucaagaugcugccccugcacgagcagguggccagccugaucgaccugugcgaguaccaccugagccugcuggacgagaagagacuggugugcggcagaggcgugcccagcggcggcagacccccccacagaggccccccccaggagcccagccccagcgcccagcccgccggcgacaaccccccccccagaaccagcugcgccaacaagcugagccaccccagacacacccugagcuaa

SEQ ID NO: 25188 - RNA, 1935 nt, Artificial Sequence
  TTLL12__Homo_sapiens__NP_055955
auggaggccgagagaggccccgagagaagacccgccgagagaagcagccccggccagacccccgaggagggcgcccaggcccuggccgaguucgccgcccugcacggccccgcccugagagccagcggcgugcccgagagauacuggggcagacugcugcacaagcuggagcacgagguguucgacgccggcgagguguucggcaucaugcagguggaggagguggaggaggaggaggacgaggccgccagagaggugagaaagcagcagcccaaccccggcaacgagcugugcuacaaggugaucgugaccagagagagcggccugcaggccgcccaccccaacagcaucuuccugaucgaccacgccuggaccugcagaguggagcacgccagacagcagcugcagcaggugcccggccugcugcacagaauggccaaccugaugggcaucgaguuccacggcgagcugcccagcaccgaggccguggcccuggugcuggaggagauguggaaguucaaccagaccuaccagcuggcccacggcaccgccgaggagaagaugcccgugugguacaucauggacgaguucggcagcagaauccagcacgccgacgugcccagcuucgccaccgcccccuucuucuacaugccccagcagguggccuacacccugcuguggccccugagagaccuggacaccggcgaggaggugaccagagacuucgccuacggcgagaccgacccccugaucagaaagugcaugcugcugcccugggcccccaccgacaugcuggaccugagcagcugcacccccgagccccccgccgagcacuaccaggccauccuggaggagaacaaggagaagcugccccuggacaucaaccccguggugcacccccacggccacaucuucaagguguacaccgacgugcagcagguggccagcagccugacccaccccagauucacccugacccagagcgaggccgacgccgacauccuguucaacuucagccacuucaaggacuacagaaagcugagccaggagagacccggcgugcugcugaaccaguuccccugcgagaaccugcugaccgugaaggacugccuggccagcaucgccagaagagccggcggccccgagggcccccccuggcugcccagaaccuucaaccugagaaccgagcugccccaguucgugagcuacuuccagcagagagagagauggggcgaggacaaccacuggaucugcaagcccuggaaccuggccagaagccuggacacccacgugaccaagagccugcacagcaucaucagacacagagagagcacccccaagguggugagcaaguacaucgagagccccgugcuguuccugagagaggacgugggcaaggugaaguucgacaucagauacaucgugcugcugagaagcgugagaccccugagacuguucguguacgacguguucuggcugagauucagcaacagagccuucgcccugaacgaccuggacgacuacgagaagcacuucaccgugaugaacuacgaccccgacguggugcugaagcaggugcacugcgaggaguucauccccgaguucgagaagcaguaccccgaguuccccuggaccgacgugcaggccgagaucuucagagccuucaccgagcuguuccagguggccugcgccaagccccccccccugggccugugcgacuaccccagcagcagagccauguacgccguggaccugaugcugaagugggacaacggccccgacggcagaagagugaugcagccccagauccuggaggugaacuucaaccccgacugcgagagagccugcagauaccaccccaccuucuucaacgacguguucagcacccuguuccuggaccagcccggcggcugccacgugaccugccugguguaa

SEQ ID NO: 25189 - RNA, 1272 nt, Artificial Sequence
  TTLL1__Homo_sapiens__NP_036395
auggccggcaaggugaagugggugaccgacaucgagaagagcgugcugaucaacaacuucgagaagagaggcugggugcaggugaccgagaacgaggacuggaacuucuacuggaugagcgugcagaccaucagaaacguguucagcguggaggccggcuacagacugagcgacgaccagaucgugaaccacuuccccaaccacuacgagcugaccagaaaggaccugauggugaagaacaucaagagauacagaaaggagcuggagaaggagggcagcccccuggccgagaaggacgagaacggcaaguaccuguaccuggacuucgugcccgugaccuacaugcugcccgccgacuacaaccuguucguggaggaguucagaaagagccccagcagcaccuggaucaugaagcccugcggcaaggcccagggcaagggcaucuuccugaucaacaagcugagccagaucaagaaguggagcagagacagcaagaccagcagcuucgugagccagagcaacaaggaggccuacgugaucagccuguacaucaacaacccccugcugaucggcggcagaaaguucgaccugagacuguacgugcuggugagcaccuacagaccccugagaugcuacauguacaagcugggcuucugcagauucugcaccgugaaguacacccccagcaccagcgagcuggacaacauguucgugcaccugaccaacguggccauccagaagcacggcgaggacuacaaccacauccacggcggcaaguggaccgugagcaaccugagacuguaccuggagagcaccagaggcaaggaggugaccagcaagcuguucgacgagauccacuggaucaucgugcagagccugaaggccguggcccccgugaugaacaacgacaagcacugcuucgagugcuacggcuacgacaucaucaucgacgacaagcugaagcccuggcugaucgaggugaacgccagccccagccugaccagcagcaccgccaacgacagaauccugaaguacaaccugaucaacgacacccugaacaucgccgugcccaacggcgagauccccgacugcaaguggaacaagagcccccccaaggaggugcugggcaacuacgagauccuguacgacgaggagcuggcccagggcgacggcgccgacagagagcugagaagcagacagggccagagccugggccccagagccggcagaagcagagacagcggcagagccgugcugaccaccuggaaguaa

SEQ ID NO: 25190 - RNA, 2748 nt, Artificial Sequence
  TTLL3__Homo_sapiens__NP_001021100
augcagggccccgacgccccccugcugcugagcgccagagagcugggccccggcagaagaggcagcgccagcugguacagacaggagggcggcgccgugugcaacuggcugagaaagccccagccccuggagcccagaaccagcuuccccagcgccagaagaagcgaguucagaccccccagaagacugcccugggccggccccgccagcgcccagagcgaggagggccacgccggcggcagaugccaggccggcagccccgcccccgccagaagacugagcggcgccuucaagacccuggugcccggcacccacgcccagggcgccagcgacacccacccccugggccccccccacacccccgugcuggaccccagcccccaggacggcuuccccgugcuguggagaggcagcagcaaggccagccacaugaacagacugagaaacgccaagaucuacguggagagagccgugaagcagaagaagaucuucaccauccagggcugcuaccccgugaucagaugccugcugagaagaagaggcuggguggagaagaagauggugcacagaagcggccccacccugcugcccccccagaaggaccuggacagcagcgccaugggcgacagcgacaccaccgaggacgaggacgaggacgaggacgaggaguuccagcccagccagcuguucgacuucgacgaccugcugaaguucgacgaccuggacggcacccacgcccugauggugggccugugccugaaccugagaaaccugcccugguucgacgagguggacgccaacagcuucuuccccagaugcuacugccugggcgccgaggacgacaagaaggccuucaucgaggacuucuggcugaccgccgccagaaacgugcugaagcugguggugaagagcgaguggaagagcuaccccauccaggccguggaggaggaggccagcggcgacaagcagcccaagaagcaggagaagaaccccgugcuggugagccccgaguucguggacgaggcccugugcgccugcgaggaguaccugagcaaccuggcccacauggacaucgacaaggaccuggaggccccccuguaccugacccccgagggcuggagccuguuccugcagagauacuaccagguggugcacgagggcgccgagcugagacaccuggacacccaggugcagagaugcgaggacauccugcagcagcugcaggccguggugccccagaucgacauggagggcgacagaaacaucuggaucgugaagcccggcgccaagagcagaggcagaggcaucaugugcauggaccaccuggaggagaugcugaagcuggugaacggcaaccccguggugaugaaggacggcaaguggguggugcagaaguacaucgagagaccccugcugaucuucggcaccaaguucgaccugagacagugguuccuggugaccgacuggaacccccugaccgugugguucuacagagacagcuacaucagauucagcacccagcccuucagccugaagaaccuggacaacagcgugcaccugugcaacaacagcauccagaagcaccuggagaacagcugccacagacacccccugcugccccccgacaacauguggagcagccagagauuccaggcccaccugcaggagaugggcgcccccaacgccuggagcaccaucaucgugcccggcaugaaggacgccgugauccacgcccugcagaccagccaggacaccgugcagugcagaaaggccagcuucgagcuguacggcgccgacuucguguucggcgaggacuuccagcccuggcugaucgagaucaacgccagccccaccauggcccccagcaccgccgugaccgccagacugugcgccggcgugcaggccgacacccugagaguggugaucgacagaaugcuggacagaaacugcgacaccggcgccuucgagcugaucuacaagcagcccgccguggaggugccccaguacgugggcaucagacugcugguggagggcuucaccaucaagaagcccauggccaugugccacagaagaaugggcgugagacccgccgugccccugcugacccagagaggcagcggcgaggccagacaccacuuccccagccugcacaccaaggcccagcugcccagcccccacgugcugagacaccagggccaggugcugagaagacagcacagcaagcuggugggcaccaaggcccugagcaccaccggcaaggcccugagaacccugcccaccgccaagguguucaucagccugccccccaaccuggacuucaagguggcccccagcauccugaagcccagaaaggcccccgcccugcugugccugagaggcccccagcuggaggugcccugcugccugugcccccugaagagcgagcaguuccuggcccccgugggcagaagcagacccaaggccaacagcagacccgacugcgacaagcccagagccgaggccugccccaugaagagacugagcccccugaagccccugccccuggugggcaccuuccagagaagaagaggccugggcgacaugaagcugggcaagccccugcugagauuccccaccgcccuggugcuggaccccacccccaacaagaagaagcaggugaaguaccugggccuggacagcaucgccgugggcggcagcagaguggacggcgccagacccugcacccccggcagcaccgccagagccuaa

SEQ ID NO: 25191 - RNA, 3600 nt, Artificial Sequence
  TTLL4__Homo_sapiens__NP_055455
auggccagcgccggcacccagcacuacagcaucggccugagacagaagaacagcuucaagcagagcggccccagcggcaccgugcccgccaccccccccgagaagcccagcgagggcagaguguggccccaggcccaccagcaggugaagcccaucuggaagcuggagaagaagcagguggagacccugagcgccggccugggccccggccugcugggcgugcccccccagcccgccuacuucuucugccccagcacccugugcagcagcggcaccaccgccgugaucgccggccacagcagcagcugcuaccugcacagccugcccgaccuguucaacagcacccugcuguacagaagaagcagcuacagacagaagcccuaccagcagcuggagagcuucugccugagaagcagccccagcgagaagagccccuucagccugccccagaagagccugcccgugagccugaccgccaacaaggccaccagcagcaugguguucagcauggcccagcccauggccagcagcagcaccgagcccuaccugugccuggccgccgccggcgagaaccccagcggcaagagccuggccagcgccaucagcggcaagauccccagcccccugagcagcagcuacaagcccaugcugaacaacaacagcuucauguggcccaacagcacccccgugccccugcugcagaccacccagggccugaagcccgugagcccccccaagauccagcccgugagcuggcaccacagcggcggcaccggcgacugcgccccccagcccguggaccacaaggugcccaagagcaucggcaccgugcccgccgacgccagcgcccacaucgcccugagcaccgccagcagccacgacaccagcaccaccagcguggccagcagcugguacaacagaaacaaccuggccaugagagccgagccccugagcugcgcccuggacgacagcagcgacagccaggaccccaccaaggagaucagauucaccgaggccgugagaaagcugaccgccagaggcuucgagaagaugcccagacagggcugccagcuggagcagagcagcuuccugaaccccagcuuccaguggaacgugcugaacagaagcagaagauggaagccccccgccgugaaccagcaguucccccaggaggacgccggcagcgugagaagagugcugcccggcgccagcgacacccugggccuggacaacaccguguucugcaccaagagaaucagcauccaccugcuggccagccacgccagcggccugaaccacaaccccgccugcgagagcgugaucgacagcagcgccuucggcgagggcaaggcccccggcccccccuucccccagacccugggcaucgccaacguggccaccagacugagcagcauccagcugggccagagcgagaaggagagacccgaggaggccagagagcuggacagcagcgacagagacaucagcagcgccaccgaccugcagcccgaccaggccgagaccgaggacaccgaggaggagcugguggacggccuggaggacugcugcagcagagacgagaacgaggaggaggagggcgacagcgagugcagcagccugagcgccgugagccccagcgagagcguggccaugaucagcagaagcugcauggagauccugaccaagccccugagcaaccacgagaagguggugagacccgcccugaucuacagccuguuccccaacgugccccccaccaucuacuucggcaccagagacgagagaguggagaagcugcccugggagcagagaaagcugcugagauggaagaugagcaccgugacccccaacaucgugaagcagaccaucggcagaagccacuucaagaucagcaagagaaacgacgacuggcugggcugcuggggccaccacaugaagagccccagcuucagaagcaucagagagcaccagaagcugaaccacuuccccggcagcuuccagaucggcagaaaggacagacuguggagaaaccugagcagaaugcagagcagauucggcaagaaggaguucagcuucuucccccagagcuucauccugccccaggacgccaagcugcugagaaaggccugggagagcagcagcagacagaaguggaucgugaagccccccgccagcgccagaggcaucggcauccaggugauccacaaguggagccagcugcccaagagaagaccccugcuggugcagagauaccugcacaagcccuaccugaucagcggcagcaaguucgaccugagaaucuacguguacgugaccagcuacgacccccugagaaucuaccuguucagcgacggccuggugagauucgccagcugcaaguacagccccagcaugaagagccugggcaacaaguucaugcaccugaccaacuacagcgugaacaagaagaacgccgaguaccaggccaacgccgacgagauggccugccagggccacaagugggcccugaaggcccuguggaacuaccugagccagaagggcgugaacagcgacgccaucugggagaagaucaaggacgugguggugaagaccaucaucagcagcgagcccuacgugaccagccugcugaagauguacgugagaagacccuacagcugccacgagcuguucggcuucgacaucaugcuggacgagaaccugaagcccugggugcuggaggugaacaucagccccagccugcacagcagcagcccccuggacaucagcaucaagggccagaugaucagagaccugcugaaccuggccggcuucgugcugcccaacgccgaggacaucaucagcagccccagcagcugcagcagcagcaccaccagccugcccaccagccccggcgacaagugcagaauggcccccgagcacgugaccgcccagaagaugaagaaggccuacuaccugacccagaagauccccgaccaggacuucuacgccagcgugcuggacgugcugacccccgacgacgugagaauccugguggagauggaggacgaguucagcagaagaggccaguucgagagaaucuuccccagccacaucagcagcagauaccugagauucuucgagcagcccagauacuucaacauccugaccacccagugggagcagaaguaccacggcaacaagcugaagggcguggaccugcugagaagcuggugcuacaagggcuuccacaugggcguggugagcgacagcgcccccguguggagccugcccaccagccugcugaccaucagcaaggacgacgugauccugaacgccuucagcaagagcgagaccagcaagcugggcaagcagagcagcugcgaggugagccugcugcugagcgaggacggcaccacccccaagagcaagaagacccaggccggccugagccccuacccccagaagcccagcagcagcaaggacagcgaggacaccagcaaggagcccagccugagcacccagacccugcccgugaucaagugcagcggccagaccagcagacugagcgccagcagcaccuuccagagcaucagcgacagccugcuggccgugagccccuaa

SEQ ID NO: 25192 - RNA, 3846 nt, Artificial Sequence
  TTLL5__Homo_sapiens__NP_055887
augcccaucgugauggccagagaccuggaggagaccgccagcagcagcgaggacgaggaggugaucagccaggaggaccaccccugcaucauguggaccggcggcugcagaagaauccccgugcugguguuccacgccgacgccauccugaccaaggacaacaacaucagagugaucggcgagagauaccaccugagcuacaagaucgugagaaccgacagcagacuggugagaagcauccugaccgcccacggcuuccacgaggugcaccccagcagcaccgacuacaaccugauguggaccggcagccaccugaagcccuuccugcugagaacccugagcgaggcccagaaggugaaccacuuccccagaagcuacgagcugaccagaaaggacagacuguacaagaacaucaucagaaugcagcacacccacggcuucaaggccuuccacauccugccccagaccuuccugcugcccgccgaguacgccgaguucugcaacagcuacagcaaggacagaggccccuggaucgugaagcccguggccagcagcagaggcagaggcguguaccugaucaacaaccccaaccagaucagccuggaggagaacauccuggugagcagauacaucaacaacccccugcugaucgacgacuucaaguucgacgugagacuguacgugcuggugaccagcuacgacccccuggugaucuaccuguacgaggagggccuggccagauucgccaccgugagauacgaccagggcgccaagaacaucagaaaccaguucaugcaccugaccaacuacagcgugaacaagaagagcggcgacuacgugagcugcgacgaccccgagguggaggacuacggcaacaaguggagcaugagcgccaugcugagauaccugaagcaggagggcagagacaccaccgcccugauggcccacguggaggaccugaucaucaagaccaucaucagcgccgagcuggccaucgccaccgccugcaagaccuucgugccccacagaagcagcugcuucgagcuguacggcuucgacgugcugaucgacagcacccugaagcccuggcugcuggaggugaaccugagccccagccuggccugcgacgccccccuggaccugaagaucaaggccagcaugaucagcgacauguucaccguggugggcuucgugugccaggaccccgcccagagagccagcaccagacccaucuaccccaccuucgagagcagcagaagaaaccccuuccagaagccccagagaugcagaccccugagcgccagcgacgccgagaugaagaaccuggugggcagcgccagagagaagggccccggcaagcugggcggcagcgugcugggccugagcauggaggagaucaaggugcugagaagagugaaggaggagaacgacagaagaggcggcuucaucagaaucuuccccaccagcgagaccugggagaucuacggcagcuaccuggagcacaagaccagcaugaacuacaugcuggccaccagacuguuccaggacagaaugaccgccgacggcgcccccgagcugaagaucgagagccugaacagcaaggccaagcugcacgccgcccuguacgagagaaagcugcugagccuggaggugagaaagagaagaagaagaagcagcagacugagagccaugagacccaaguaccccgugaucacccagcccgccgagaugaacgugaagaccgagaccgagagcgaggaggaggaggagguggcccuggacaacgaggacgaggagcaggaggccagccaggaggagagcgccggcuuccugagagagaaccaggccaaguacacccccagccugaccgcccugguggagaacacccccaaggagaacagcaugaaggugagagaguggaacaacaagggcggccacugcugcaagcuggagacccaggagcuggagcccaaguucaaccugaugcagauccugcaggacaacggcaaccugagcaagaugcaggccagaaucgccuucagcgccuaccugcagcacgugcagaucagacugaugaaggacagcggcggccagaccuucagcgccagcugggccgccaaggaggacgagcagauggagcugguggugagauuccugaagagagccagcaacaaccugcagcacagccugagaauggugcugcccagcagaagacuggcccugcuggagagaagaagaauccuggcccaccagcugggcgacuucaucaucguguacaacaaggagaccgagcagauggccgagaagaagagcaagaagaagguggaggaggaggaggaggacggcgugaacauggagaacuuccaggaguucaucagacaggccagcgaggccgagcuggaggaggugcugaccuucuacacccagaagaacaagagcgccagcguguuccugggcacccacagcaagaucagcaagaacaacaacaacuacagcgacagcggcgccaagggcgaccaccccgagaccaucauggaggaggugaagaucaagccccccaagcagcagcagaccaccgagauccacagcgacaagcugagcagauucaccaccagcgccgagaaggaggccaagcugguguacagcaacagcagcagcggccccaccgccacccugcagaagauccccaacacccaccugagcagcgugaccaccagcgaccugagccccggccccugccaccacagcagccugagccagauccccagcgccauccccagcaugccccaccagcccaccauccugcugaacaccgugagcgccagcgccagccccugccugcaccccggcgcccagaacauccccagccccaccggccugcccagaugcagaagcggcagccacaccaucggccccuucagcagcuuccagagcgccgcccacaucuacagccagaagcugagcagacccagcagcgccaaggccggcagcugcuaccugaacaagcaccacagcggcaucgccaagacccagaaggagggcgaggacgccagccuguacagcaagagauacaaccagagcauggugaccgccgagcugcagagacuggccgagaagcaggccgccagacaguacagccccagcagccacaucaaccugcugacccagcaggugaccaaccugaaccuggccaccggcaucaucaacagaagcagcgccagcgccccccccacccugagacccaucaucagccccagcggccccaccuggagcacccagagcgacccccaggcccccgagaaccacagcagcagccccggcagcagaagccugcagaccggcggcuucgccugggagggcgagguggagaacaacguguacagccaggccaccggcguggugccccagcacaaguaccaccccaccgccggcagcuaccagcugcaguucgcccugcagcagcuggagcagcagaagcugcagagcagacagcugcuggaccagagcagagccagacaccaggccaucuucggcagccagacccugcccaacagcaaccuguggaccaugaacaacggcgccggcugcagaaucagcagcgccaccgccagcggccagaagcccaccacccugccccagaagguggugcccccccccagcagcugcgccagccuggugcccaagcccccccccaaccacgagcaggugcugagaagagccaccagccagaaggccagcaagggcagcagcgccgagggccagcugaacggccugcagagcagccugaaccccgccgccuucgugcccaucaccagcagcaccgaccccgcccacaccaagaucuaa

SEQ ID NO: 25193 - RNA, 2676 nt, Artificial Sequence
  TTLL6__Homo_sapiens__NP_001124390
augggcgcccugcugcugcaccccagcagaagaggccccgccggcgugguggccagcuggaccagcagccccgccggcagagacggcggcgugggcaucgccggcgccugguacuuccccagagccagcagccaggccagagagaugccccagugccccacccuggagagccaggagggcgagaacagcgaggagaagggcgacagcagcaaggaggaccccaaggagaccguggcccuggccuucgugagagagaaccccggcgcccagaacggccugcagaacgcccagcagcagggcaagaagaagagaaagaagaagagacuggugaucaaccugagcagcugcagauacgagagcgugagaagagccgcccagcaguacggcuucagagagggcggcgaggacgacgacuggacccuguacuggaccgacuacagcgugagccuggagagagugauggagaugaagagcuaccagaagaucaaccacuuccccggcaugagcgagaucugcagaaaggaccugcuggccagaaacaugagcagaaugcugaagauguuccccaaggacuucagauucuuccccagaaccuggugccugcccgccgacuggggcgaccugcagaccuacagcagaagcagaaagaacaagaccuacaucugcaagcccgacagcggcugccagggcaagggcaucuucaucaccagaaccgugaaggagaucaagcccggcgaggacaugaucugccagcuguacaucagcaagcccuucaucaucgacggcuucaaguucgaccugagaaucuacgugcuggugaccagcugcgacccccugagaaucuucguguacaacgagggccuggccagauucgccaccaccagcuacagcagacccugcaccgacaaccuggacgacaucugcaugcaccugaccaacuacagcaucaacaagcacagcagcaacuucagcagagacgcccacagcggcagcaagagaaagcugagcaccuucagcgccuaccuggaggaccacagcuacaacguggagcagaucuggagagacaucgaggacgugaucaucaagacccugaucagcgcccaccccaucaucagacacaacuaccacaccugcuuccccaaccacacccugaacagcgccugcuucgagauccugggcuucgacauccugcuggaccacaagcugaagcccuggcugcuggaggugaaccacagccccagcuucagcaccgacagcagacuggacaaggaggugaaggacggccugcuguacgacacccuggugcugaucaaccuggagagcugcgacaagaagaaggugcuggaggaggagagacagagaggccaguuccugcagcagugcugcagcagagagaugagaaucgaggaggccaagggcuucagagccgugcagcugaagaagaccgagaccuacgagaaggagaacugcggcggcuucagacugaucuaccccagccugaacagcgagaaguacgagaaguucuuccaggacaacaacagccuguuccagaacaccguggccagcagagccagagaggaguacgccagacagcugauccaggagcugagacugaagagagagaagaagcccuuccagaugaagaagaagguggagaugcagggcgagagcgccggcgagcaggugagaaagaagggcaugagaggcuggcagcagaagcagcagcagaaggacaaggccgccacccaggccagcaagcaguacauccagccccugacccuggugagcuacacccccgaccugcugcugagcgugagaggcgagagaaagaacgagaccgacagcagccugaaccaggaggcccccaccgaggaggccagcagcguguuccccaagcugaccagcgccaagcccuucagcagccugcccgaccugagaaacaucaaccugagcagcagcaagcuggagcccagcaagcccaacuucagcaucaaggaggccaagagcgccagcgccgugaacguguucaccggcaccgugcaccugaccagcguggagaccacccccgagagcaccacccagcugagcaucagccccaagagcccccccacccuggccgugaccgccagcagcgaguacagcggccccgagaccgacagaguggugagcuucaagugcaagaagcagcagacccccccccaccugacccagaagaagaugcugaagagcuuccugcccaccaagagcaagagcuucugggagagccccaacaccaacuggacccugcugaagagcgacaugaacaagccccaccugaucagcgagcugcugaccaagcugcagcugagcggcaagcugagcuucuuccccgcccacuacaaccccaagcugggcaugaacaaccugagccagaaccccagccugcccggcgagugccacagcagaagcgacagcagcggcgagaagagacagcuggacgugagcagccugcugcugcagagcccccagagcuacaacgugacccugagagaccugcuggugaucgccacccccgcccagcuggaccccagacccugcagaagccacgccagcgccaugagagaccccugcaugcaggaccaggaggccuacagccacugccugaucagcggccagaagggcugcgagagaagcuaa

SEQ ID NO: 25194 - RNA, 2490 nt, Artificial Sequence
  TTLL7__Homo_sapiens__XP_011540457
augcccagccugccccaggagggcgugauccagggccccagcccccuggaccugaacaccgagcugcccuaccagagcaccaugaagagaaaggugagaaagaagaagaagaagggcaccaucaccgccaacguggccggcaccaaguucgagaucgugagacuggugaucgacgagaugggcuucaugaagacccccgacgaggacgagaccagcaaccugaucuggugcgacagcgccgugcagcaggagaagaucagcgagcugcagaacuaccagagaaucaaccacuuccccggcaugggcgagaucugcagaaaggacuuccuggccagaaacaugaccaagaugaucaagagcagaccccuggacuacaccuucgugcccagaaccuggaucuuccccgccgaguacacccaguuccagaacuacgugaaggagcugaagaagaagagaaagcagaagaccuucaucgugaagcccgccaacggcgccaugggccacggcaucagccugaucagaaacggcgacaagcugcccagccaggaccaccugaucgugcaggaguacaucgagaagcccuuccugauggagggcuacaaguucgaccugagaaucuacauccuggugaccagcugcgacccccugaagaucuuccuguaccacgacggccuggugagaaugggcaccgagaaguacaucccccccaacgagagcaaccugacccagcuguacaugcaccugaccaacuacagcgugaacaagcacaacgagcacuucgagagagacgagaccgagaacaagggcagcaagagaagcaucaagugguucaccgaguuccugcaggccaaccagcacgacguggccaaguucuggagcgacaucagcgagcugguggugaagacccugaucguggccgagccccacgugcugcacgccuacagaaugugcagacccggccagccccccggcagcgagagcgugugcuucgaggugcugggcuucgacauccugcuggacagaaagcugaagcccuggcugcuggagaucaacagagcccccagcuucggcaccgaccagaagaucgacuacgacgugaagagaggcgugcugcugaacgcccugaagcugcugaacaucagaaccagcgacaagagaagaaaccuggccaagcagaaggccgaggcccagagaagacuguacggccagaacagcaucaagagacugcugcccggcagcagcgacugggagcagcagagacaccagcuggagagaagaaaggaggagcugaaggagagacuggcccaggugagaaagcagaucagcagagaggagcacgagaacagacacaugggcaacuacagaagaaucuacccccccgaggacaaggcccugcuggagaaguacgagaaccugcuggccguggccuuccagaccuuccugagcggcagagccgccagcuuccagagagagcugaacaacccccugaagagaaugaaggaggaggacauccuggaccugcuggagcagugcgagaucgacgacgagaagcugaugggcaagaccaccaagaccagaggccccaagccccugugcagcaugcccgagagcaccgagaucaugaagagacccaaguacugcagcagcgacagcagcuacgacagcagcagcagcagcagcgagagcgacgagaacgagaaggaggaguaccagaacaagaagagagagaagcaggugaccuacaaccugaagcccagcaaccacuacaagcugauccagcagcccagcagcaucagaagaagcgugagcugccccagaagcaucagcgcccagagccccagcagcggcgacaccagacccuucagcgcccagcagaugaucagcgugagcagacccaccagcgccagcagaagccacagccugaacagagccagcagcuacaugagacaccugccccacagcaacgacgccugcagcaccaacagccaggugagcgagagccugagacagcugaagaccaaggagcaggaggacgaccugaccagccagacccuguucgugcugaaggacaugaagaucagauuccccggcaagagcgacgccgagagcgagcugcugaucgaggacaucaucgacaacuggaaguaccacaagaccaagguggccagcuacuggcugaucaagcuggacagcgugaagcagagaaaggugcuggacaucgugaagaccagcaucagaaccgugcugcccagaaucuggaaggugcccgacguggaggaggugaaccuguacagaaucuucaacagaguguucaacagacugcuguggagcagaggccagggccuguggaacugcuucugcgacagcggcuaccugcugcccggcagcacccaguucuuccugagaacccccaccuacaaccugaaguacaacagccccggcaugaccagaagcaacgugcuguucaccagcagauacggccaccuguaa

SEQ ID NO: 25195 - RNA, 2424 nt, Artificial Sequence
  TTLL8__Homo_sapiens__XP_011529043
augaagaccagcagacuguggaagguggccagaagcgagggccccggcggcgccggcgugagaggcgccaagggcaagcugagcgaggccagcauggagcccgagagaaagggccugagccuggccagcagcagcgacggcgacggcagagaggagaacaagcugaagcagggcaucagccaggaccuggccagcagcagcagacuggacagauacaagaucgccagacagcugaccgagaaggccaucaaggagaagaagaucuucagcaucuacggccacuaccccguggugagagccgcccugagaagaaagggcuggguggagaagaaguuccacuuccugcccaaggugauccccgacguggaggacgagggcgccagagugaacgacgacaccugcgccaaggugaaggagaaccaggagauggcccuggagaagaccgacaacauccacgacgugaugagcagacuggugaagaacgagaugcccuaccugcuguggaccaucaagagagacaucaucgacuaccacagccugaccuacgaccagaugcugaaccacuacgccaagaccgccagcuucaccaccaagaucggccugugcgugaacaugagaagccugcccugguacgugcccgccaaccccgacagcuucuuccccagaugcuacagccugugcaccgagagcgagcagcaggaguuccuggaggacuucagaagaaccauggccagcagcauccugaaguggguggugagccaccagagcugcagcagaagcagcagaagcaagcccagagaccagagagaggaggccggcagcagcgaccugagcagcagacaggacgccgagaacgccgaggccaagcugagaggccugcccggccagcugguggacaucgccugcaaggugugccaggccuaccugggccagcuggagcacgaggacaucgacaccagcgccgacgccguggaggaccugaccgaggccgagugggaggaccugacccagcaguacuacagccuggugcacggcgacgccuucaucagcaacagcagaaacuacuucagccagugccaggcccugcugaacagaaucaccagcgugaacccccagaccgacaucgacggccugagaaacaucuggaucaucaagcccgccgccaagagcagaggcagagacaucgugugcauggacagaguggaggagauccuggagcuggccgccgccgaccacccccugagcagagacaacaaguggguggugcagaaguacaucgagaccccccugcugaucugcgacaccaaguucgacaucagacagugguuccuggugaccgacuggaacccccugaccaucugguucuacaaggagagcuaccugagauucagcacccagagauucagccuggacaagcuggacagcgccauccaccugugcaacaacgccgugcagaaguaccugaagaacgacgugggcagaagcccccugcugcccgcccacaacauguggaccagcaccagauuccaggaguaccugcagagacagggcagaggcgccguguggggcagcgugaucuaccccagcaugaagaaggccaucgcccacgccaugaagguggcccaggaccacguggagcccagaaagaacagcuucgagcuguacggcgccgacuucgugcugggcagagacuucagacccuggcugaucgagaucaacagcagccccaccaugcaccccagcacccccgugaccgcccagcugugcgcccaggugcaggaggacaccaucaagguggccguggacagaagcugcgacaucggcaacuucgagcugcuguggagacagcccgugguggagcccccccccuucagcggcagcgaccugugcguggccggcgugagcgugagaagagccagaagacaggugcugcccgugugcaaccugaaggccagcgccagccugcuggacgcccagccccugaaggccagaggccccagcgccaugcccgaccccgcccagggcccccccagccccgcccugcagagagaccugggccugaaggaggagaagggccugccccuggcccugcuggccccccugagaggcgccgccgagagcggcggcgccgcccagcccaccagaaccaaggccgccggcaagguggagcugcccgccugccccugcagacacguggacagccaggcccccaacaccggcgugcccguggcccagcccgccaagagcugggaccccaaccagcugaacgcccacccccuggagcccgugcugagaggccugaagaccgccgagggcgcccugagacccccccccggcggcaagggccaccagagagaggccgccggcggccuggcccagugccagaucaccaugcugaagagaaaggaccugcugugccuguaa

SEQ ID NO: 25196 - RNA, 1320 nt, Artificial Sequence
  TTLL9__Homo_sapiens__NP_001008409
auggugcccagcagagaggcccugcugggccccggcaccaccgccaucagaugccccaagaagcugcagaaccagaacuacaagggccacggccugagcaagggcaaggagagagagcagagagccagcaucagauucaagaccacccugaugaacacccugauggacgugcugagacacagacccggcuggguggaggugaaggacgagggcgagugggacuucuacuggugcgacgugagcuggcugagagagaacuucgaccacaccuacauggacgagcacgugagaaucagccacuucagaaaccacuacgagcugaccagaaagaacuacauggugaagaaccugaagagauucagaaagcagcuggagagagaggccggcaagcuggaggccgccaagugcgacuucuuccccaagaccuucgagaugcccugcgaguaccaccuguucguggaggaguucagaaagaaccccggcaucaccuggaucaugaagcccguggccagaagccagggcaagggcaucuuccuguucagaagacugaaggacaucguggacuggagaaaggacaccagaagcagcgacgaccagaaggacgacauccccguggagaacuacguggcccagagauacaucgagaaccccuaccugaucggcggcagaaaguucgaccugagaguguacgugcuggugaugagcguguucgccgagugccugcuguggagcggccacagaagacaggacgugcaccugaccaacguggccgugcagaagaccagccccgacuaccaccccaagaagggcugcaaguggacccugcagagauucagacaguaccuggccagcaagcacggccccgaggccguggagacccuguucagagacaucgacaacaucuucgugaagagccugcagagcgugcagaaggugaucaucagcgacaagcacugcuucgagcuguacggcuacgacauccugaucgaccaggaccugaagcccuggcugcuggaggugaacgccagccccagccugaccgccagcagccaggaggacuacgagcugaagaccugccugcuggaggacacccugcacgugguggacauggaggccagacugaccggcagagagaagagagugggcggcuucgaccugauguggaacgacggccccgugagcagagaggagggcgcccccgaccugagcggcaugggcaacuucgugaccaacacccaccugggcugcgugaacgacagaaagaagcagcugagacagcuguucugcagccugcaggugcagaagaaggccagcagcuaa

SEQ ID NO: 25197 - RNA, 837 nt, Artificial Sequence
  TTPA__Homo_sapiens__NP_000361
auggccgaggccagaagccagcccagcgccggcccccagcugaacgcccugcccgaccacagcccccugcugcagcccggccuggccgcccugagaagaagagccagagaggccggcgugccccuggccccccugccccugaccgacagcuuccugcugagauuccugagagccagagacuucgaccuggaccuggccuggagacugcugaagaacuacuacaaguggagagccgagugccccgagaucagcgccgaccugcaccccagaagcaucaucggccugcugaaggccggcuaccacggcgugcugagaagcagagaccccaccggcagcaaggugcugaucuacagaaucgcccacugggaccccaagguguucaccgccuacgacguguucagagugagccugaucaccagcgagcugaucgugcaggagguggagacccagagaaacggcaucaaggccaucuucgaccuggagggcuggcaguucagccacgccuuccagaucacccccagcguggccaagaagaucgccgccgugcugaccgacagcuucccccugaaggugagaggcauccaccugaucaacgagcccgugaucuuccacgccguguucagcaugaucaagcccuuccugaccgagaagaucaaggagagaauccacaugcacggcaacaacuacaagcagagccugcugcagcacuuccccgacauccugccccuggaguacggcggcgaggaguucagcauggaggacaucugccaggaguggaccaacuucaucaugaagagcgaggacuaccugagcagcaucagcgagagcauccaguaa

SEQ ID NO: 25198 - RNA, 444 nt, Artificial Sequence
  TTR__Homo_sapiens__NP_000362
auggccagccacagacugcugcugcugugccuggccggccugguguucgugagcgaggccggccccaccggcaccggcgagagcaagugcccccugauggugaaggugcuggacgccgugagaggcagccccgccaucaacguggccgugcacguguucagaaaggccgccgacgacaccugggagcccuucgccagcggcaagaccagcgagagcggcgagcugcacggccugaccaccgaggaggaguucguggagggcaucuacaagguggagaucgacaccaagagcuacuggaaggcccugggcaucagccccuuccacgagcacgccgaggugguguucaccgccaacgacagcggccccagaagauacaccaucgccgcccugcugagccccuacagcuacagcaccaccgccguggugaccaaccccaaggaguaa

SEQ ID NO: 25199 - RNA, 1383 nt, Artificial Sequence
  TTYH1__Homo_sapiens__NP_001005367
augggcgccccccccggcuacagacccagcgccugggugcaccugcugcaccagcugcccagagccgacuuccagcugagacccgugcccagcguguucgccccccaggagcaggaguaccagcaggcccugcugcugguggccgcccuggccggccugggccugggccugagccugaucuucaucgccguguaccugaucagauucugcugcugcagaccccccgagccccccggcagcaagauccccagccccggcggcggcugcgugaccuggagcugcaucguggcccugcuggccggcugcaccggcaucggcaucggcuucuacggcaacagcgagaccagcgacggcgugagccagcugagcagcgcccugcugcacgccaaccacacccugagcaccaucgaccaccuggugcuggagaccguggagagacugggcgaggccgugagaaccgagcugaccacccuggaggaggugcuggagcccagaaccgagcugguggccgccgccagaggcgccagaagacaggccgaggccgccgcccagcagcugcagggccuggccuucuggcagggcgugccccugagcccccugcagguggccgagaacgugagcuucguggaggaguacagauggcuggccuacgugcugcugcugcugcuggagcugcuggugugccuguucacccugcugggccuggccaagcagagcaaguggcuggugaucgugaugaccgugaugagccugcuggugcuggugcugagcuggggcagcaugggccuggaggccgccaccgccgugggccugagcgacuucugcagcaaccccgaccccuacgugcugaaccugacccaggaggagaccggccugagcagcgacauccugagcuacuaccugcugugcaacagagccgugagcaaccccuuccagcagagacugacccugagccagagagcccuggccaacauccacagccagcugcugggccuggagagagaggccgugccccaguuccccagcgcccagaagccccugcugagccuggaggagacccugaacgugaccgagggcaacuuccaccagcugguggcccugcugcacugcagaagccugcacaaggacuacggcgccgcccugagaggccugugcgaggacgcccuggagggccugcuguuccugcugcuguucagccugcugagcgccggcgcccuggccaccgcccugugcagccugcccagagccugggcccuguucccccccagaaaccccagcgcccugugcagcggcagcagacugagcgagccccugcugcccgccggccuggagcccggcagcccccugagaagcuuccccggcugcagaagaagaccccacuaa

SEQ ID NO: 25200 - RNA, 1605 nt, Artificial Sequence
  TTYH2__Homo_sapiens__NP_116035
augcaggccgccagaguggacuacaucgcccccuggugggugguguggcugcacagcgugccccacgugggccugagacugcagcccgugaacagcaccuucagccccggcgacgagagcuaccaggagagccugcuguuccugggccugguggccgccgugugccugggccugaaccugaucuuccugguggccuaccuggugugcgccugccacugcagaagagacgacgccgugcagaccaagcagcaccacagcugcugcaucaccuggaccgccgugguggccggccugaucugcugcgccgccgugggcgugggcuucuacggcaacagcgagaccaacgacggcgccuaccagcugauguacagccuggacgacgccaaccacaccuucagcggcaucgacgcccuggugagcggcaccacccagaagaugaagguggaccuggagcagcaccuggccagacugagcgagaucuucgccgccagaggcgacuaccugcagacccugaaguucauccagcagauggccggcagcgugguggugcagcugagcggccugcccguguggagagaggugaccauggagcugaccaagcugagcgaccagaccggcuacguggaguacuacagauggcugagcuaccugcugcuguucauccuggaccuggugaucugccugaucgccugccugggccuggccaagagaagcaagugccugcuggccagcaugcugugcugcggcgcccugagccugcugcugagcugggccagccuggccgccgacggcagcgccgccguggccaccagcgacuucugcguggcccccgacaccuucauccugaacgugaccgagggccagaucagcaccgaggugaccagauacuaccuguacugcagccagagcggcagcagccccuuccagcagacccugaccaccuuccagagagcccugaccaccaugcagauccagguggccggccugcugcaguucgccgugccccuguucagcaccgccgaggaggaccugcuggccauccagcugcugcugaacagcagcgagagcagccugcaccagcugaccgccaugguggacugcagaggccugcacaaggacuaccuggacgcccuggccggcaucugcuacgacggccugcagggccugcuguaccugggccuguucagcuuccuggccgcccuggccuucagcaccaugaucugcgccggccccagagccuggaagcacuucaccaccagaaacagagacuacgacgacaucgacgacgacgaccccuucaacccccaggccuggagaauggccgcccacagcccccccagaggccagcugcacagcuucugcagcuacagcagcggccugggcagccagaccagccugcagccccccgcccagaccaucagcaacgcccccgugagcgaguacaugaaccaggccaugcuguucggcagaaaccccagauacgagaacgugccccugaucggcagagccagccccccccccaccuacagccccagcaugagagccaccuaccugagcguggccgacgagcaccugagacacuacggcaaccaguuccccgccuaa

SEQ ID NO: 25201 - RNA, 1356 nt, Artificial Sequence
  TUBA1A__Homo_sapiens__NP_001257328
augagagagugcaucagcauccacgugggccaggccggcgugcagaucggcaacgccugcugggagcuguacugccuggagcacggcauccagcccgacggccagaugcccagcgacaagaccaucggcggcggcgacgacagcuucaacaccuucuucagcgagaccggcgccggcaagcacgugcccagagccguguucguggaccuggagcccaccgugaucgacgaggugagaaccggcaccuacagacagcuguuccaccccgagcagcugaucaccggcaaggaggacgccgccaacaacuacgccagaggccacuacaccaucggcaaggagaucaucgaccuggugcuggacagaaucagaaagcuggccgaccagugcaccggccugcagggcuuccugguguuccacagcuucggcggcggcaccggcagcggcuucaccagccugcugauggagagacugagcguggacuacggcaagaagagcaagcuggaguucagcaucuaccccgccccccaggugagcaccgccgugguggagcccuacaacagcauccugaccacccacaccacccuggagcacagcgacugcgccuucaugguggacaacgaggccaucuacgacaucugcagaagaaaccuggacaucgagagacccaccuacaccaaccugaacagacugaucggccagaucgugagcagcaucaccgccagccugagauucgacggcgcccugaacguggaccugaccgaguuccagaccaaccuggugcccuaccccagaauccacuucccccuggccaccuacgcccccgugaucagcgccgagaaggccuaccacgagcagcugagcguggccgagaucaccaacgccugcuucgagcccgccaaccagauggugaagugcgaccccagacacggcaaguacauggccugcugccugcuguacagaggcgacguggugcccaaggacgugaacgccgccaucgccaccaucaagaccaagagaaccauccaguucguggacuggugccccaccggcuucaaggugggcaucaacuaccagccccccaccguggugcccggcggcgaccuggccaaggugcagagagccgugugcaugcugagcaacaccaccgccaucgccgaggccugggccagacuggaccacaaguucgaccugauguacgccaagagagccuucgugcacugguacgugggcgagggcauggaggagggcgaguucagcgaggccagagaggacauggccgcccuggagaaggacuacgaggaggugggcguggacagcguggagggcgagggcgaggaggagggcgaggaguacuaa

SEQ ID NO: 25202 - RNA, 1356 nt, Artificial Sequence
  TUBA1B__Homo_sapiens__NP_006073
augagagagugcaucagcauccacgugggccaggccggcgugcagaucggcaacgccugcugggagcuguacugccuggagcacggcauccagcccgacggccagaugcccagcgacaagaccaucggcggcggcgacgacagcuucaacaccuucuucagcgagaccggcgccggcaagcacgugcccagagccguguucguggaccuggagcccaccgugaucgacgaggugagaaccggcaccuacagacagcuguuccaccccgagcagcugaucaccggcaaggaggacgccgccaacaacuacgccagaggccacuacaccaucggcaaggagaucaucgaccuggugcuggacagaaucagaaagcuggccgaccagugcaccggccugcagggcuuccugguguuccacagcuucggcggcggcaccggcagcggcuucaccagccugcugauggagagacugagcguggacuacggcaagaagagcaagcuggaguucagcaucuaccccgccccccaggugagcaccgccgugguggagcccuacaacagcauccugaccacccacaccacccuggagcacagcgacugcgccuucaugguggacaacgaggccaucuacgacaucugcagaagaaaccuggacaucgagagacccaccuacaccaaccugaacagacugaucagccagaucgugagcagcaucaccgccagccugagauucgacggcgcccugaacguggaccugaccgaguuccagaccaaccuggugcccuaccccagaauccacuucccccuggccaccuacgcccccgugaucagcgccgagaaggccuaccacgagcagcugagcguggccgagaucaccaacgccugcuucgagcccgccaaccagauggugaagugcgaccccagacacggcaaguacauggccugcugccugcuguacagaggcgacguggugcccaaggacgugaacgccgccaucgccaccaucaagaccaagagaagcauccaguucguggacuggugccccaccggcuucaaggugggcaucaacuaccagccccccaccguggugcccggcggcgaccuggccaaggugcagagagccgugugcaugcugagcaacaccaccgccaucgccgaggccugggccagacuggaccacaaguucgaccugauguacgccaagagagccuucgugcacugguacgugggcgagggcauggaggagggcgaguucagcgaggccagagaggacauggccgcccuggagaaggacuacgaggaggugggcguggacagcguggagggcgagggcgaggaggagggcgaggaguacuaa

SEQ ID NO: 25203 - RNA, 1245 nt, Artificial Sequence
  TUBA1C__Homo_sapiens__NP_001290046
augcccagcgacaagaccaucggcggcggcgacgacagcuucaacaccuucuucagcgagaccggcgccggcaagcacgugcccagagccguguucguggaccuggagcccaccgugaucgacgaggugagaaccggcaccuacagacagcuguuccaccccgagcagcugaucaccggcaaggaggacgccgccaacaacuacgccagaggccacuacaccaucggcaaggagaucaucgaccuggugcuggacagaaucagaaagcuggccgaccagugcaccggccugcagggcuuccugguguuccacagcuucggcggcggcaccggcagcggcuucaccagccugcugauggagagacugagcguggacuacggcaagaagagcaagcuggaguucagcaucuaccccgccccccaggugagcaccgccgugguggagcccuacaacagcauccugaccacccacaccacccuggagcacagcgacugcgccuucaugguggacaacgaggccaucuacgacaucugcagaagaaaccuggacaucgagagacccaccuacaccaaccugaacagacugaucagccagaucgugagcagcaucaccgccagccugagauucgacggcgcccugaacguggaccugaccgaguuccagaccaaccuggugcccuaccccagaauccacuucccccuggccaccuacgcccccgugaucagcgccgagaaggccuaccacgagcagcugaccguggccgagaucaccaacgccugcuucgagcccgccaaccagauggugaagugcgaccccagacacggcaaguacauggccugcugccugcuguacagaggcgacguggugcccaaggacgugaacgccgccaucgccaccaucaagaccaagagaaccauccaguucguggacuggugccccaccggcuucaaggugggcaucaacuaccagccccccaccguggugcccggcggcgaccuggccaaggugcagagagccgugugcaugcugagcaacaccaccgccguggccgaggccugggccagacuggaccacaaguucgaccugauguacgccaagagagccuucgugcacugguacgugggcgagggcauggaggagggcgaguucagcgaggccagagaggacauggccgcccuggagaaggacuacgaggaggugggcgccgacagcgccgacggcgaggacgagggcgaggaguacuaa

SEQ ID NO: 25204 - RNA, 1353 nt, Artificial Sequence
  TUBA3D__Homo_sapiens__NP_525125
augagagagugcaucagcauccacgugggccaggccggcgugcagaucggcaacgccugcugggagcuguacugccuggagcacggcauccagcccgacggccagaugcccagcgacaagaccaucggcggcggcgacgacagcuucaacaccuucuucagcgagaccggcgccggcaagcacgugcccagagccguguucguggaccuggagcccaccgugguggacgaggugagaaccggcaccuacagacagcuguuccaccccgagcagcugaucaccggcaaggaggacgccgccaacaacuacgccagaggccacuacaccaucggcaaggagaucguggaccuggugcuggacagaaucagaaagcuggccgaccugugcaccggccugcagggcuuccugaucuuccacagcuucggcggcggcaccggcagcggcuucgccagccugcugauggagagacugagcguggacuacggcaagaagagcaagcuggaguucgccaucuaccccgccccccaggugagcaccgccgugguggagcccuacaacagcauccugaccacccacaccacccuggagcacagcgacugcgccuucaugguggacaacgaggccaucuacgacaucugcagaagaaaccuggacaucgagagacccaccuacaccaaccugaacagacugaucggccagaucgugagcagcaucaccgccagccugagauucgacggcgcccugaacguggaccugaccgaguuccagaccaaccuggugcccuaccccagaauccacuucccccuggccaccuacgcccccgugaucagcgccgagaaggccuaccacgagcagcugagcguggccgagaucaccaacgccugcuucgagcccgccaaccagauggugaagugcgaccccagacacggcaaguacauggccugcugcaugcuguacagaggcgacguggugcccaaggacgugaacgccgccaucgccaccaucaagaccaagagaaccauccaguucguggacuggugccccaccggcuucaaggugggcaucaacuaccagccccccaccguggugcccggcggcgaccuggccaaggugcagagagccgugugcaugcugagcaacaccaccgccaucgccgaggccugggccagacuggaccacaaguucgaccugauguacgccaagagagccuucgugcacugguacgugggcgagggcauggaggagggcgaguucagcgaggccagagaggaccuggccgcccuggagaaggacuacgaggaggugggcguggacagcguggaggccgaggccgaggagggcgaggaguacuaa

SEQ ID NO: 25205 - RNA, 1302 nt, Artificial Sequence
  TUBA4A__Homo_sapiens__NP_001265481
augggcaacgccugcugggagcuguacugccuggagcacggcauccagcccgacggccagaugcccagcgacaagaccaucggcggcggcgacgacagcuucaccaccuucuucugcgagaccggcgccggcaagcacgugcccagagccguguucguggaccuggagcccaccgugaucgacgagaucagaaacggccccuacagacagcuguuccaccccgagcagcugaucaccggcaaggaggacgccgccaacaacuacgccagaggccacuacaccaucggcaaggagaucaucgaccccgugcuggacagaaucagaaagcugagcgaccagugcaccggccugcagggcuuccugguguuccacagcuucggcggcggcaccggcagcggcuucaccagccugcugauggagagacugagcguggacuacggcaagaagagcaagcuggaguucagcaucuaccccgccccccaggugagcaccgccgugguggagcccuacaacagcauccugaccacccacaccacccuggagcacagcgacugcgccuucaugguggacaacgaggccaucuacgacaucugcagaagaaaccuggacaucgagagacccaccuacaccaaccugaacagacugaucagccagaucgugagcagcaucaccgccagccugagauucgacggcgcccugaacguggaccugaccgaguuccagaccaaccuggugcccuaccccagaauccacuucccccuggccaccuacgcccccgugaucagcgccgagaaggccuaccacgagcagcugagcguggccgagaucaccaacgccugcuucgagcccgccaaccagauggugaagugcgaccccagacacggcaaguacauggccugcugccugcuguacagaggcgacguggugcccaaggacgugaacgccgccaucgccgccaucaagaccaagagaagcauccaguucguggacuggugccccaccggcuucaaggugggcaucaacuaccagccccccaccguggugcccggcggcgaccuggccaaggugcagagagccgugugcaugcugagcaacaccaccgccaucgccgaggccugggccagacuggaccacaaguucgaccugauguacgccaagagagccuucgugcacugguacgugggcgagggcauggaggagggcgaguucagcgaggccagagaggacauggccgcccuggagaaggacuacgaggaggugggcaucgacagcuacgaggacgaggacgagggcgaggaguaa

SEQ ID NO: 25206 - RNA, 1152 nt, Artificial Sequence
  TUBA8__Homo_sapiens__NP_001180343
augaucgaccuggagcccaccgugguggacgaggugagagccggcaccuacagacagcuguuccaccccgagcagcugaucaccggcaaggaggacgccgccaacaacuacgccagaggccacuacaccgugggcaaggagagcaucgaccuggugcuggacagaaucagaaagcugaccgacgccugcagcggccugcagggcuuccugaucuuccacagcuucggcggcggcaccggcagcggcuucaccagccugcugauggagagacugagccuggacuacggcaagaagagcaagcuggaguucgccaucuaccccgccccccaggugagcaccgccgugguggagcccuacaacagcauccugaccacccacaccacccuggagcacagcgacugcgccuucaugguggacaacgaggccaucuacgacaucugcagaagaaaccuggacaucgagagacccaccuacaccaaccugaacagacugaucagccagaucgugagcagcaucaccgccagccugagauucgacggcgcccugaacguggaccugaccgaguuccagaccaaccuggugcccuaccccagaauccacuucccccuggugaccuacgcccccaucaucagcgccgagaaggccuaccacgagcagcugagcguggccgagaucaccagcagcugcuucgagcccaacagccagauggugaagugcgaccccagacacggcaaguacauggccugcugcaugcuguacagaggcgacguggugcccaaggacgugaacguggccaucgccgccaucaagaccaagagaaccauccaguucguggacuggugccccaccggcuucaaggugggcaucaacuaccagccccccaccguggugcccggcggcgaccuggccaaggugcagagagccgugugcaugcugagcaacaccaccgccaucgccgaggccugggccagacuggaccacaaguucgaccugauguacgccaagagagccuucgugcacugguacgugggcgagggcauggaggagggcgaguucagcgaggccagagaggaccuggccgcccuggagaaggacuacgaggaggugggcaccgacagcuucgaggaggagaacgagggcgaggaguucuaa

SEQ ID NO: 25207 - RNA, 1356 nt, Artificial Sequence
  TUBB1__Homo_sapiens__NP_110400
augagagagaucgugcacauccagaucggccagugcggcaaccagaucggcgccaaguucugggagaugaucggcgaggagcacggcaucgaccuggccggcagcgacagaggcgccagcgcccugcagcuggagagaaucagcguguacuacaacgaggccuacggcagaaaguacgugcccagagccgugcugguggaccuggagcccggcaccauggacagcaucagaagcagcaagcugggcgcccuguuccagcccgacagcuucgugcacggcaacagcggcgccggcaacaacugggccaagggccacuacaccgagggcgccgagcugaucgagaacgugcuggagguggugagacacgagagcgagagcugcgacugccugcagggcuuccagaucgugcacagccugggcggcggcaccggcagcggcaugggcacccugcugaugaacaagaucagagaggaguaccccgacagaaucaugaacagcuucagcgugaugcccagccccaaggugagcgacaccgugguggagcccuacaacgccgugcugagcauccaccagcugaucgagaacgccgacgccugcuucugcaucgacaacgaggcccuguacgacaucugcuucagaacccugaagcugaccacccccaccuacggcgaccugaaccaccuggugagccugaccaugagcggcaucaccaccagccugagauuccccggccagcugaacgccgaccugagaaagcuggccgugaacauggugcccuuccccagacugcacuucuucaugcccggcuucgccccccugaccgcccagggcagccagcaguacagagcccugagcguggccgagcugacccagcagauguucgacgccagaaacaccauggccgccugcgaccugagaagaggcagauaccugaccguggccugcaucuucagaggcaagaugagcaccaaggagguggaccagcagcugcugagcgugcagaccagaaacagcagcugcuucguggaguggauccccaacaacgugaagguggccgugugcgacaucccccccagaggccugagcauggccgccaccuucaucggcaacaacaccgccauccaggagaucuucaacagagugagcgagcacuucagcgccauguucaagagaaaggccuucgugcacugguacaccagcgagggcauggacaucaacgaguucggcgaggccgagaacaacauccacgaccuggugagcgaguaccagcaguuccaggacgccaaggccgugcuggaggaggacgaggaggugaccgaggaggccgagauggagcccgaggacaagggccacuaa

SEQ ID NO: 25208 - RNA, 1338 nt, Artificial Sequence
  TUBB2A__Homo_sapiens__NP_001060
augagagagaucgugcacauccaggccggccagugcggcaaccagaucggcgccaaguucugggaggugaucagcgacgagcacggcaucgaccccaccggcagcuaccacggcgacagcgaccugcagcuggagagaaucaacguguacuacaacgaggccgccggcaacaaguacgugcccagagccauccugguggaccuggagcccggcaccauggacagcgugagaagcggccccuucggccagaucuucagacccgacaacuucguguucggccagagcggcgccggcaacaacugggccaagggccacuacaccgagggcgccgagcugguggacagcgugcuggacguggugagaaaggagagcgagagcugcgacugccugcagggcuuccagcugacccacagccugggcggcggcaccggcagcggcaugggcacccugcugaucagcaagaucagagaggaguaccccgacagaaucaugaacaccuucagcgugaugcccagccccaaggugagcgacaccgugguggagcccuacaacgccacccugagcgugcaccagcugguggagaacaccgacgagaccuacagcaucgacaacgaggcccuguacgacaucugcuucagaacccugaagcugaccacccccaccuacggcgaccugaaccaccuggugagcgccaccaugagcggcgugaccaccugccugagauuccccggccagcugaacgccgaccugagaaagcuggccgugaacauggugcccuuccccagacugcacuucuucaugcccggcuucgccccccugaccagcagaggcagccagcaguacagagcccugaccgugcccgagcugacccagcagauguucgacagcaagaacaugauggccgccugcgaccccagacacggcagauaccugaccguggccgccaucuucagaggcagaaugagcaugaaggagguggacgagcagaugcugaacgugcagaacaagaacagcagcuacuucguggaguggauccccaacaacgugaagaccgccgugugcgacaucccccccagaggccugaagaugagcgccaccuucaucggcaacagcaccgccauccaggagcuguucaagagaaucagcgagcaguucaccgccauguucagaagaaaggccuuccugcacugguacaccggcgagggcauggacgagauggaguucaccgaggccgagagcaacaugaacgaccuggugagcgaguaccagcaguaccaggacgccaccgccgacgagcagggcgaguucgaggaggaggagggcgaggacgaggccuaa

SEQ ID NO: 25209 - RNA, 1338 nt, Artificial Sequence
  TUBB2B__Homo_sapiens__NP_821080
augagagagaucgugcacauccaggccggccagugcggcaaccagaucggcgccaaguucugggaggugaucagcgacgagcacggcaucgaccccaccggcagcuaccacggcgacagcgaccugcagcuggagagaaucaacguguacuacaacgaggccaccggcaacaaguacgugcccagagccauccugguggaccuggagcccggcaccauggacagcgugagaagcggccccuucggccagaucuucagacccgacaacuucguguucggccagagcggcgccggcaacaacugggccaagggccacuacaccgagggcgccgagcugguggacagcgugcuggacguggugagaaaggagagcgagagcugcgacugccugcagggcuuccagcugacccacagccugggcggcggcaccggcagcggcaugggcacccugcugaucagcaagaucagagaggaguaccccgacagaaucaugaacaccuucagcgugaugcccagccccaaggugagcgacaccgugguggagcccuacaacgccacccugagcgugcaccagcugguggagaacaccgacgagaccuacugcaucgacaacgaggcccuguacgacaucugcuucagaacccugaagcugaccacccccaccuacggcgaccugaaccaccuggugagcgccaccaugagcggcgugaccaccugccugagauuccccggccagcugaacgccgaccugagaaagcuggccgugaacauggugcccuuccccagacugcacuucuucaugcccggcuucgccccccugaccagcagaggcagccagcaguacagagcccugaccgugcccgagcugacccagcagauguucgacagcaagaacaugauggccgccugcgaccccagacacggcagauaccugaccguggccgccaucuucagaggcagaaugagcaugaaggagguggacgagcagaugcugaacgugcagaacaagaacagcagcuacuucguggaguggauccccaacaacgugaagaccgccgugugcgacaucccccccagaggccugaagaugagcgccaccuucaucggcaacagcaccgccauccaggagcuguucaagagaaucagcgagcaguucaccgccauguucagaagaaaggccuuccugcacugguacaccggcgagggcauggacgagauggaguucaccgaggccgagagcaacaugaacgaccuggugagcgaguaccagcaguaccaggacgccaccgccgacgagcagggcgaguucgaggaggaggagggcgaggacgaggccuaa

SEQ ID NO: 25210 - RNA, 1137 nt, Artificial Sequence
  TUBB3__Homo_sapiens__NP_001184110
auggacagcgugagaagcggcgccuucggccaccuguucagacccgacaacuucaucuucggccagagcggcgccggcaacaacugggccaagggccacuacaccgagggcgccgagcugguggacagcgugcuggacguggugagaaaggagugcgagaacugcgacugccugcagggcuuccagcugacccacagccugggcggcggcaccggcagcggcaugggcacccugcugaucagcaaggugagagaggaguaccccgacagaaucaugaacaccuucagcguggugcccagccccaaggugagcgacaccgugguggagcccuacaacgccacccugagcauccaccagcugguggagaacaccgacgagaccuacugcaucgacaacgaggcccuguacgacaucugcuucagaacccugaagcuggccacccccaccuacggcgaccugaaccaccuggugagcgccaccaugagcggcgugaccaccagccugagauuccccggccagcugaacgccgaccugagaaagcuggccgugaacauggugcccuuccccagacugcacuucuucaugcccggcuucgccccccugaccgccagaggcagccagcaguacagagcccugaccgugcccgagcugacccagcagauguucgacgccaagaacaugauggccgccugcgaccccagacacggcagauaccugaccguggccaccguguucagaggcagaaugagcaugaaggagguggacgagcagaugcuggccauccagagcaagaacagcagcuacuucguggaguggauccccaacaacgugaagguggccgugugcgacaucccccccagaggccugaagaugagcagcaccuucaucggcaacagcaccgccauccaggagcuguucaagagaaucagcgagcaguucaccgccauguucagaagaaaggccuuccugcacugguacaccggcgagggcauggacgagauggaguucaccgaggccgagagcaacaugaacgaccuggugagcgaguaccagcaguaccaggacgccaccgccgaggaggagggcgagauguacgaggacgacgaggaggagagcgaggcccagggccccaaguaa

SEQ ID NO: 25211 - RNA, 1470 nt, Artificial Sequence
  TUBB4A__Homo_sapiens__NP_001276056
augagaagaggcgccgccgacagagagaccgagggccccugcagcgccgugagcgccgccagcagcacccuggccgccgccgccgcccccagagccagagccaccgccgccgccagcacccugagcgccaccgccaugagagagaucgugcaccugcaggccggccagugcggcaaccagaucggcgccaaguucugggaggugaucagcgacgagcacggcaucgaccccaccggcaccuaccacggcgacagcgaccugcagcuggagagaaucaacguguacuacaacgaggccaccggcggcaacuacgugcccagagccgugcugguggaccuggagcccggcaccauggacagcgugagaagcggccccuucggccagaucuucagacccgacaacuucguguucggccagagcggcgccggcaacaacugggccaagggccacuacaccgagggcgccgagcugguggacgccgugcuggacguggugagaaaggaggccgagagcugcgacugccugcagggcuuccagcugacccacagccugggcggcggcaccggcagcggcaugggcacccugcugaucagcaagaucagagaggaguuccccgacagaaucaugaacaccuucagcguggugcccagccccaaggugagcgacaccgugguggagcccuacaacgccacccugagcgugcaccagcugguggagaacaccgacgagaccuacugcaucgacaacgaggcccuguacgacaucugcuucagaacccugaagcugaccacccccaccuacggcgaccugaaccaccuggugagcgccaccaugagcggcgugaccaccugccugagauuccccggccagcugaacgccgaccugagaaagcuggccgugaacauggugcccuuccccagacugcacuucuucaugcccggcuucgccccccugaccagcagaggcagccagcaguacagagcccugaccgugcccgagcugacccagcagauguucgacgccaagaacaugauggccgccugcgaccccagacacggcagauaccugaccguggccgccguguucagaggcagaaugagcaugaaggagguggacgagcagaugcugagcgugcagagcaagaacagcagcuacuucguggaguggauccccaacaacgugaagaccgccgugugcgacaucccccccagaggccugaagauggccgccaccuucaucggcaacagcaccgccauccaggagcuguucaagagaaucagcgagcaguucaccgccauguucagaagaaaggccuuccugcacugguacaccggcgagggcauggacgagauggaguucaccgaggccgagagcaacaugaacgaccuggugagcgaguaccagcaguaccaggacgccaccgccgaggagggcgaguucgaggaggaggccgaggaggagguggccuaa

SEQ ID NO: 25212 - RNA, 1338 nt, Artificial Sequence
  TUBB4B__Homo_sapiens__NP_006079
augagagagaucgugcaccugcaggccggccagugcggcaaccagaucggcgccaaguucugggaggugaucagcgacgagcacggcaucgaccccaccggcaccuaccacggcgacagcgaccugcagcuggagagaaucaacguguacuacaacgaggccaccggcggcaaguacgugcccagagccgugcugguggaccuggagcccggcaccauggacagcgugagaagcggccccuucggccagaucuucagacccgacaacuucguguucggccagagcggcgccggcaacaacugggccaagggccacuacaccgagggcgccgagcugguggacagcgugcuggacguggugagaaaggaggccgagagcugcgacugccugcagggcuuccagcugacccacagccugggcggcggcaccggcagcggcaugggcacccugcugaucagcaagaucagagaggaguaccccgacagaaucaugaacaccuucagcguggugcccagccccaaggugagcgacaccgugguggagcccuacaacgccacccugagcgugcaccagcugguggagaacaccgacgagaccuacugcaucgacaacgaggcccuguacgacaucugcuucagaacccugaagcugaccacccccaccuacggcgaccugaaccaccuggugagcgccaccaugagcggcgugaccaccugccugagauuccccggccagcugaacgccgaccugagaaagcuggccgugaacauggugcccuuccccagacugcacuucuucaugcccggcuucgccccccugaccagcagaggcagccagcaguacagagcccugaccgugcccgagcugacccagcagauguucgacgccaagaacaugauggccgccugcgaccccagacacggcagauaccugaccguggccgccguguucagaggcagaaugagcaugaaggagguggacgagcagaugcugaacgugcagaacaagaacagcagcuacuucguggaguggauccccaacaacgugaagaccgccgugugcgacaucccccccagaggccugaagaugagcgccaccuucaucggcaacagcaccgccauccaggagcuguucaagagaaucagcgagcaguucaccgccauguucagaagaaaggccuuccugcacugguacaccggcgagggcauggacgagauggaguucaccgaggccgagagcaacaugaacgaccuggugagcgaguaccagcaguaccaggacgccaccgccgaggaggagggcgaguucgaggaggaggccgaggaggagguggccuaa

SEQ ID NO: 25213 - RNA, 1230 nt, Artificial Sequence
  TUBB6__Homo_sapiens__NP_001290455
augagagagaucgugcacauccaggccggccagugcggcaaccagaucggcaccaaguucugggaggugaucagcgacgagcacggcaucgaccccgccggcggcuacgugggcgacagcgcccugcagcuggagagaaucaacguguacuacaacgagagcagcugccagaccggcgccggcaacaacugggccaagggccacuacaccgagggcgccgagcugguggacgccgugcuggacguggugagaaaggagugcgagcacugcgacugccugcagggcuuccagcugacccacagccugggcggcggcaccggcagcggcaugggcacccugcugaucagcaagaucagagaggaguuccccgacagaaucaugaacaccuucagcgugaugcccagccccaaggugagcgacaccgugguggagcccuacaacgccacccugagcgugcaccagcugguggagaacaccgacgagaccuacugcaucgacaacgaggcccuguacgacaucugcuucagaacccugaagcugaccacccccaccuacggcgaccugaaccaccuggugagcgccaccaugagcggcgugaccaccagccugagauuccccggccagcugaacgccgaccugagaaagcuggccgugaacauggugcccuuccccagacugcacuucuucaugcccggcuucgccccccugaccagcagaggcagccagcaguacagagcccugaccgugcccgagcugacccagcagauguucgacgccagaaacaugauggccgccugcgaccccagacacggcagauaccugaccguggccaccguguucagaggccccaugagcaugaaggagguggacgagcagaugcuggccauccagagcaagaacagcagcuacuucguggaguggauccccaacaacgugaagguggccgugugcgacaucccccccagaggccugaagauggccagcaccuucaucggcaacagcaccgccauccaggagcuguucaagagaaucagcgagcaguucagcgccauguucagaagaaaggccuuccugcacugguucaccggcgagggcauggacgagauggaguucaccgaggccgagagcaacaugaacgaccuggugagcgaguaccagcaguaccaggacgccaccgccaacgacggcgaggaggccuucgaggacgaggaggaggagaucgacggcuaa

SEQ ID NO: 25214 - RNA, 729 nt, Artificial Sequence
  TUBB__Homo_sapiens__NP_001280142
augagagagaucgugcacauccaggccggccagugcggcaaccagaucggcgccaaguucugggaggugaucagcgacgagcacggcaucgaccccaccggcaccuaccacggcgacagcgaccugcagcuggacagaaucagcguguacuacaacgaggccaccggcggcaaguacgugcccagagccauccugguggaccuggagcccggcaccauggacagcgugagaagcggccccuucggccagaucuucagacccgacaacuucguguucggccagagcggcgccggcaacaacugggccaagggccacuacaccgagggcgccgagcugguggacagcgugcuggacguggugagaaaggagguggacgagcagaugcugaacgugcagaacaagaacagcagcuacuucguggaguggauccccaacaacgugaagaccgccgugugcgacaucccccccagaggccugaagauggccgugaccuucaucggcaacagcaccgccauccaggagcuguucaagagaaucagcgagcaguucaccgccauguucagaagaaaggccuuccugcacugguacaccggcgagggcauggacgagauggaguucaccgaggccgagagcaacaugaacgaccuggugagcgaguaccagcaguaccaggacgccaccgccgaggaggaggaggacuucggcgaggaggccgaggaggaggccuaa

SEQ ID NO: 25215 - RNA, 1197 nt, Artificial Sequence
  TUBD1__Homo_sapiens__NP_001180538
augagcaucgugaccgugcagcugggccagugcggcaaccagaucggcuucgagguguucgacgcccugcugagcgacagccacagcagccagggccugugcagcaugagagagaacgaggccuaccaggccagcugcaaggagagauucuucagcgaggaggagaacggcgugcccaucgccagagccgugcugguggacauggagcccaaggugaucaaccagaugcugagcaaggccgcccagagcggccaguggaaguacggccagcacgccugcuucugccagaagcagggcagcggcaacaacugggccuacggcuacagcgugcacggccccagacacgaggagagcaucaugaacaucaucagaaaggagguggagaagugcgacagcuucagcggcuucuucaucaucaugagcauggccggcggcaccggcagcggccugggcgccuucgugacccagaaccuggaggaccaguacagcaacagccugaagaugaaccagaucaucuggcccuacggcaccggcgaggugaucgugcagaacuacaacagcauccugacccugagccaccuguacagaagcagcgacgcccugcugcugcacgagaacgacgccauccacaagaucugcgccaagcugaugaacaucaagcagaucagcuucagcgacaucaaccaggugcuggcccaccagcugggcagcguguuccagcccaccuacagcgccgagagcagcuuccacuacagaagaaacccccugggcaucgacagacacguguggcccccccugagcggccugcccccccugagcaagaugagccugaacaaggaccugcacuucaacaccagcaucgccaaccuggugauccugagaggcaaggacgugcagagcgccgacguggagggcuucaaggaccccgcccuguacaccagcuggcugaagcccgugaacgccuucaacguguggaagacccagagagccuucagcaaguacgagaagagcgccgugcuggugagcaacagccaguuccuggugaagccccuggacaugaucgugggcaaggccuggaacauguucgccagcaaggccuacauccaccaguacaccaaguucggcaucgaggaggaggacuuccuggacagcuucaccagccuggagcaggugguggccagcuacugcaaccuguaa

SEQ ID NO: 25216 - RNA, 1428 nt, Artificial Sequence
  TUBE1__Homo_sapiens__NP_057346
augacccagagcgugguggugcaggugggccagugcggcaaccagaucggcugcugcuucugggaccuggcccugagagagcacgccgccgugaaccagaagggcaucuacgacgaggccaucagcagcuucuucagaaacguggacaccagaguggugggcgacggcggcagcaucagcaagggcaagaucugcagccugaaggccagagccgugcugaucgacauggaggagggcguggugaacgagauccugcagggcccccugagagacguguucgacaccaagcagcugaucaccgacaucagcggcagcggcaacaacugggccgugggccacaagguguucggcagccuguaccaggaccagauccuggagaaguucagaaagagcgccgagcacugcgacugccugcagugcuucuucaucauccacagcaugggcggcggcaccggcagcggccugggcaccuuccugcugaaggugcuggaggacgaguuccccgagguguacagauucgugaccagcaucuaccccagcggcgaggacgacgugaucaccagccccuacaacagcauccuggccaugaaggagcugaacgagcacgccgacugcgugcugcccaucgacaaccagagccuguucgacaucaucagcaagaucgaccugauggugaacagcggcaagcugggcaccaccgugaagcccaagagccuggugaccagcagcagcggcgcccugaagaagcagcacaagaagcccuucgacgccaugaacaacaucguggccaaccugcugcugaaccugaccagcagcgccagauucgagggcagccugaacauggaccugaacgagaucagcaugaaccuggugcccuucccccagcugcacuaccuggugagcagccugaccccccuguacacccugaccgacgugaacaucccccccagaagacuggaccagauguucagcgacgccuucagcaaggaccaccagcugcugagagccgaccccaagcacagccuguaccuggccugcgcccugauggugagaggcaacgugcagaucagcgaccugagaagaaacaucgagagacugaagcccagccugcaguucgugagcuggaaccaggagggcuggaagaccagccugugcagcgugccccccgugggccacagccacagccugcuggcccuggccaacaacaccugcgugaagcccaccuucauggagcugaaggagagauucaugagacuguacaagaagaaggcccaccugcaccacuaccugcagguggagggcauggaggagagcugcuucaccgaggccgugagcagccugagcgcccugauccaggaguacgaccagcuggacgccaccaagaacaugcccgugcaggaccugcccagacugagcaucgccauguaa

SEQ ID NO: 25217 - RNA, 1356 nt, Artificial Sequence
  TUBG1__Homo_sapiens__NP_001061
augcccagagagaucaucacccugcagcugggccagugcggcaaccagaucggcuucgaguucuggaagcagcugugcgccgagcacggcaucagccccgagggcaucguggaggaguucgccaccgagggcaccgacagaaaggacguguucuucuaccaggccgacgacgagcacuacauccccagagccgugcugcuggaccuggagcccagagugauccacagcauccugaacagccccuacgccaagcuguacaaccccgagaacaucuaccugagcgagcacggcggcggcgccggcaacaacugggccagcggcuucagccagggcgagaagauccacgaggacaucuucgacaucaucgacagagaggccgacggcagcgacagccuggagggcuucgugcugugccacagcaucgccggcggcaccggcagcggccugggcagcuaccugcuggagagacugaacgacagauaccccaagaagcuggugcagaccuacagcguguuccccaaccaggacgagaugagcgacgugguggugcagcccuacaacagccugcugacccugaagagacugacccagaacgccgacugcgugguggugcuggacaacaccgcccugaacagaaucgccaccgacagacugcacauccagaaccccagcuucagccagaucaaccagcuggugagcaccaucaugagcgccagcaccaccacccugagauaccccggcuacaugaacaacgaccugaucggccugaucgccagccugauccccacccccagacugcacuuccugaugaccggcuacaccccccugaccaccgaccagagcguggccagcgugagaaagaccaccgugcuggacgugaugagaagacugcugcagcccaagaacgugauggugagcaccggcagagacagacagaccaaccacugcuacaucgccauccugaacaucauccagggcgagguggaccccacccaggugcacaagagccugcagagaaucagagagagaaagcuggccaacuucauccccuggggccccgccagcauccagguggcccugagcagaaagagccccuaccugcccagcgcccacagagugagcggccugaugauggccaaccacaccagcaucagcagccuguucgagagaaccugcagacaguacgacaagcugagaaagagagaggccuuccuggagcaguucagaaaggaggacauguucaaggacaacuucgacgagauggacaccagcagagagaucgugcagcagcugaucgacgaguaccacgccgccaccagacccgacuacaucagcuggggcacccaggagcaguaa

SEQ ID NO: 25218 - RNA, 1356 nt, Artificial Sequence
  TUBG2__Homo_sapiens__NP_057521
augcccagagagaucaucacccugcagcugggccagugcggcaaccagaucggcuucgaguucuggaagcagcugugcgccgagcacggcaucagccccgagggcaucguggaggaguucgccaccgagggcaccgacagaaaggacguguucuucuaccaggccgacgacgagcacuacauccccagagccgugcugcuggaccuggagcccagagugauccacagcauccugaacagccccuacgccaagcuguacaaccccgagaacaucuaccugagcgagcacggcggcggcgccggcaacaacugggccagcggcuucagccagggcgagaagauccacgaggacaucuucgacaucaucgacagagaggccgacggcagcgacagccuggagggcuucgugcugugccacagcaucgccggcggcaccggcagcggccugggcagcuaccugcuggagagacugaacgacagauaccccaagaagcuggugcagaccuacagcguguuccccuaccaggacgagaugagcgacgugguggugcagcccuacaacagccugcugacccugaagagacugacccagaacgccgacugcgugguggugcuggacaacaccgcccugaacagaaucgccaccgacagacugcacauccagaaccccagcuucagccagaucaaccagcuggugagcaccaucaugagcgccagcaccaccacccugagauaccccggcuacaugaacaacgaccugaucggccugaucgccagccugauccccacccccagacugcacuuccugaugaccggcuacaccccccugaccaccgaccagagcguggccagcgugagaaagaccaccgugcuggacgugaugagaagacugcugcagcccaagaacgugauggugagcaccggcagagacagacagaccaaccacugcuacaucgccauccugaacaucauccagggcgagguggaccccacccaggugcacaagagccugcagagaaucagagagagaaagcuggccaacuucauccccuggggccccgccagcauccagguggcccugagcagaaagagccccuaccugcccagcgcccacagagugagcggccugaugauggccaaccacaccagcaucagcagccuguucgagagcagcugccagcaguucgacaagcugagaaagagagacgccuuccuggagcaguucagaaaggaggacauguucaaggacaacuucgacgagauggacagaagcagagagguggugcaggagcugaucgacgaguaccacgccgccacccagcccgacuacaucagcuggggcacccaggagcaguaa

SEQ ID NO: 25219 - RNA, 2793 nt, Artificial Sequence
  TUBGCP2__Homo_sapiens__NP_001243546
augagcgaguucagaauccaccacgacgugaacgagcugcugagccugcugagagugcacggcggcgacggcgccgagguguacaucgaccugcugcagaagaacagaacccccuacgugaccaccaccgugagcgcccacagcgccaaggugaagaucgccgaguucagcagaacccccgaggacuuccugaagaaguacgacgagcugaagagcaagaacaccagaaaccuggacccccugguguaccugcugagcaagcugaccgaggacaaggagacccugcaguaccugcagcagaacgccaaggagagagccgagcuggccgccgccgccgugggcagcagcaccaccagcaucaacgugcccgccgccgccagcaagaucagcaugcaggagcuggaggagcugagaaagcagcugggcagcguggccaccggcagcacccugcagcagagccuggagcugaagagaaagaugcugagagacaagcagaacaagaagaacagcggccagcaccugcccaucuuccccgccuggguguacgagagacccgcccugaucggcgacuuccugaucggcgccggcaucagcaccgacaccgcccugcccaucgugcugcugagauggaaccuggcccugagccccagacugaagugcagcggcgugaucagcgcccacugcaaccugcaccugcccggcacccugccccuggccagccaggagagcgccgugguggaggaccugcuguacgugcuggugggcguggacggcagauacgugagcgcccagccccuggccggcagacagagcagaaccuuccugguggaccccaaccuggaccugagcaucagagagcuggugcacagaauccugcccguggccgccagcuacagcgccgugaccagauucaucgaggagaagagcagcuucgaguacggccaggugaaccacgcccuggccgccgccaugagaacccuggugaaggagcaccugauccuggugagccagcuggagcagcugcacagacagggccugcugagccugcagaagcugugguucuacauccagcccgccaugagaaccauggacauccuggccagccuggccaccagcguggacaagggcgagugccugggcggcagcacccugagccugcugcacgacagaagcuucagcuacaccggcgacagccaggcccaggagcugugccuguaccugaccaaggccgccagcgcccccuacuucgaggugcuggagaaguggaucuacagaggcaucauccacgaccccuacagcgaguucaugguggaggagcacgagcugagaaaggagagaauccaggaggacuacaacgacaaguacugggaccagagauacaccaucgugcagcagcagauccccagcuuccugcagaagauggccgacaagauccugagcaccggcaaguaccugaacguggugagagagugcggccacgacgugaccugccccguggccaaggagaucaucuacacccugaaggagagagccuacguggagcagaucgagaaggccuucaacuacgccagcaaggugcugcuggacuuccugauggaggagaaggagcugguggcccaccugagaagcaucaagagauacuuccugauggaccagggcgacuucuucgugcacuucauggaccuggccgaggaggagcugagaaagcccguggaggacaucaccccccccagacuggaggcccugcuggagcuggcccugagaaugagcaccgccaacaccgaccccuucaaggacgaccugaagaucgaccugaugccccacgaccugaucacccagcugcugagagugcuggccaucgagaccaagcaggagaaggccauggcccacgccgaccccaccgagcuggcccugagcggccuggaggccuucagcuucgacuacaucgugaaguggccccugagccugaucaucaacagaaaggcccugaccagauaccagaugcuguucagacacauguucuacugcaagcacguggagagacagcugugcagcguguggaucagcaacaagaccgccaagcagcacagccugcacagcgcccagugguucgccggcgccuucacccugagacagagaaugcugaacuucgugcagaacauccaguacuacaugauguucgaggugauggagcccaccuggcacauccuggagaagaaccugaagagcgccagcaacaucgacgacgugcugggccaccacaccggcuuccuggacaccugccugaaggacugcaugcugaccaaccccgagcugcugaagguguucagcaagcugaugagcgugugcgugauguucaccaacugcaugcagaaguucacccagagcaugaagcuggacggcgagcugggcggccagacccuggagcacagcaccgugcugggccugcccgccggcgccgaggagagagccagaaaggagcuggccagaaagcaccuggccgagcacgccgacaccgugcagcuggugagcggcuucgaggccaccaucaacaaguucgacaagaacuucagcgcccaccugcuggaccugcuggccagacugagcaucuacagcaccagcgacugcgagcacggcauggccagcgugaucagcagacuggacuucaacggcuucuacaccgagagacuggagagacugagcgccgagagaagccagaaggccaccccccaggugcccgugcugagaggcccccccgcccccgcccccagaguggccgugaccgcccaguaa

SEQ ID NO: 25220 - RNA, 2724 nt, Artificial Sequence
  TUBGCP3__Homo_sapiens__NP_006313
auggccacccccgaccagaagagccccaacgugcugcugcagaaccugugcugcagaauccugggcagaagcgaggccgacguggcccagcaguuccaguacgccgugagagugaucggcagcaacuucgcccccaccguggagagagacgaguuccugguggccgagaagaucaagaaggagcugaucagacagagaagagaggccgacgccgcccuguucagcgagcugcacagaaagcugcacagccagggcgugcugaagaacaaguggagcauccuguaccugcugcugagccugagcgaggaccccagaagacagcccagcaaggugagcagcuacgccacccuguucgcccaggcccugcccagagacgcccacagcacccccuacuacuacgccagaccccagacccugccccugagcuaccaggacagaagcgcccagagcgcccagagcagcggcagcgugggcagcagcggcaucagcagcaucggccugugcgcccugagcggccccgcccccgccccccagagccugcugcccggccagagcaaccaggcccccggcgugggcgacugccugagacagcagcugggcagcagacuggccuggacccugaccgccaaccagcccagcagccaggccaccaccagcaagggcgugcccagcgccgugagcagaaacaugaccagaagcagaagagagggcgacaccggcggcaccauggagaucaccgaggccgcccuggugagagacauccuguacguguuccagggcaucgacggcaagaacaucaagaugaacaacaccgagaacugcuacaagguggagggcaaggccaaccugagcagaagccugagagacaccgccgugagacugagcgagcugggcuggcugcacaacaagaucagaagauacaccgaccagagaagccuggacagaagcuucggccuggugggccagagcuucugcgccgcccugcaccaggagcugagagaguacuacagacugcugagcgugcugcacagccagcugcagcuggaggacgaccagggcgugaaccugggccuggagagcagccugacccugagaagacugcugguguggaccuacgaccccaagaucagacugaagacccuggccgcccugguggaccacugccagggcagaaagggcggcgagcuggccagcgccgugcacgccuacaccaagaccggcgaccccuacaugagaagccuggugcagcacauccugagccuggugagccaccccgugcugagcuuccuguacagauggaucuacgacggcgagcuggaggacaccuaccacgaguucuucguggccagcgaccccaccgugaagaccgacagacuguggcacgacaaguacacccugagaaagagcaugauccccagcuucaugaccauggaccagagcagaaaggugcugcugaucggcaagagcaucaacuuccugcaccaggugugccacgaccagacccccaccaccaagaugaucgccgugaccaagagcgccgagagcccccaggacgccgccgaccuguucaccgaccuggagaacgccuuccagggcaagaucgacgccgccuacuucgagaccagcaaguaccugcuggacgugcugaacaagaaguacagccugcuggaccacaugcaggccaugagaagauaccugcugcugggccagggcgacuucaucagacaccugauggaccugcugaagcccgagcuggugagacccgccaccacccuguaccagcacaaccugaccggcauccuggagaccgccgugagagccaccaacgcccaguucgacagccccgagauccugagaagacuggacgugagacugcuggaggugagccccggcgacaccggcugggacguguucagccuggacuaccacguggacggccccaucgccaccguguucaccagagagugcaugagccacuaccugagaguguucaacuuccuguggagagccaagagaauggaguacauccugaccgacaucagaaagggccacaugugcaacgccaagcugcugagaaacaugcccgaguucagcggcgugcugcaccagugccacauccuggccagcgagauggugcacuucauccaccagaugcaguacuacaucaccuucgaggugcuggagugcagcugggacgagcuguggaacaaggugcagcaggcccaggaccuggaccacaucaucgccgcccacgagguguuccuggacaccaucaucagcagaugccugcuggacagcgacagcagagcccugcugaaccagcugagagccguguucgaccagaucaucgagcugcagaacgcccaggacgccaucuacagagccgcccuggaggagcugcagagaagacugcaguucgaggagaagaagaagcagagagagaucgagggccaguggggcgugaccgccgccgaggaggaggaggagaacaagagaaucggcgaguucaaggagagcauccccaagaugugcagccagcugagaauccugacccacuucuaccagggcaucgugcagcaguuccuggugcugcugaccaccagcagcgacgagagccugagauuccugagcuucagacuggacuucaacgagcacuacaaggccagagagcccagacugagagugagccugggcaccagaggcagaagaagcagccacaccuaa

SEQ ID NO: 25221 - RNA, 2004 nt, Artificial Sequence
  TUBGCP4__Homo_sapiens__NP_001273343
augauccacgagcugcugcuggcccugagcggcuaccccggcagcaucuucaccuggaacaagagaagcggccugcaggugagccaggacuuccccuuccugcaccccagcgagaccagcgugcugaacagacugugcagacugggcaccgacuacaucagauucaccgaguucaucgagcaguacaccggccacgugcagcagcaggaccaccaccccagccagcagggccagggcggccugcacggcaucuaccugagagccuucugcaccggccuggacagcgugcugcagcccuacagacaggcccugcuggaccuggagcaggaguuccugggcgacccccaccugagcaucagccacgugaacuacuuccuggaccaguuccagcugcuguuccccagcgugaugguggugguggagcagaucaagagccagaagauccacggcugccagauccuggagaccguguacaagcacagcugcggcggccugccccccgugagaagcgcccuggagaagauccuggccgugugccacggcgugauguacaagcagcugagcgccuggaugcugcacggccugcugcuggaccagcacgaggaguucuucaucaagcagggccccagcagcggcaacgugagcgcccagcccgaggaggacgaggaggaccugggcaucggcggccugaccggcaagcagcugagagagcugcaggaccugagacugaucgaggaggagaacaugcuggcccccagccugaagcaguucagccugagaguggagauccugcccagcuacauccccgugagaguggccgagaagauccuguucgugggcgagagcgugcagauguucgagaaccagaacgugaaccugaccagaaagggcagcauccugaagaaccaggaggacaccuucgccgccgagcugcacagacugaagcagcagccccuguucagccugguggacuucgagcaggugguggacagaaucagaagcaccguggccgagcaccuguggaagcugaugguggaggagagcgaccugcugggccagcugaagaucaucaaggacuucuaccugcugggcagaggcgagcuguuccaggccuucaucgacaccgcccagcacaugcugaagaccccccccaccgccgugaccgagcacgacgugaacguggccuuccagcagagcgcccacaaggugcugcuggacgacgacaaccugcugccccugcugcaccugaccaucgaguaccacggcaaggagcacaaggccgacgccacccaggccagagagggccccagcagagagaccagccccagagaggcccccgccagcggcugggccgcccugggccugagcuacaaggugcaguggccccugcacauccuguucacccccgccgugcuggagaaguacaacgugguguucaaguaccugcugagcgugagaagagugcaggccgagcugcagcacugcugggcccugcagaugcagagaaagcaccugaagagcaaccagaccgacgccaucaaguggagacugagaaaccacauggccuuccugguggacaaccugcaguacuaccugcagguggacgugcuggagagccaguucagccagcugcugcaccagaucaacagcaccagagacuucgagagcaucagacuggcccacgaccacuuccugagcaaccugcuggcccagagcuucauccugcugaagcccguguuccacugccugaacgagauccuggaccugugccacagcuucugcagccuggugagccagaaccugggcccccuggacgagagaggcgccgcccagcugagcauccuggugaagggcuucagcagacagagcagccugcuguucaagauccugagcagcgugagaaaccaccagaucaacagcgaccuggcccagcugcugcugagacuggacuacaacaaguacuacacccaggccggcggcacccugggcagcuucggcauguaa

SEQ ID NO: 25222 - RNA, 3075 nt, Artificial Sequence
  TUBGCP5__Homo_sapiens__NP_001096080
auggccagacacggcccccccuggagcagacuggacgcccagcaggagagagacgugagagagcuggugagaggcguggccggccugcaggacgaggccgaccccaacuuccagcuggcccugaacuucgccuggagcaacuucagauuccacagauuccuggacgugaacagccacaagaucgagaagaccaucgagggcaucuacgagaaguucgugauccacagcgaccugagcaaggccgccagcuggaagagacugaccgaggaguuccugaacgccccccugcccagcaucaaggagaucaagaccgacgcccacuacagcauccugagccugcugcugugccugagcgacagccccagcaacagcagcuacguggagacccccagaaacaaggagguggagaagaaggacgacuucgacuggggcaaguaccugauggaggacgaggagauggacaucggccccuacauggacacccccaacuggagcgaggagagcgaggaggagaacgaccagcagccccugagcagagaggacagcggcauccagguggacagaaccccccuggaggagcaggaccagaacagaaagcuggaccccugcaucagcuggaaggacgagcccgacgacagaagcuggcuggagcaccacguggugcaccaguacuggaccgccagacccagccaguucccccacagccugcaccugcacagcaaccuggccgccgugugggaccagcaccuguacagcagcgacccccuguacgugcccgacgacagagugcuggugaccgagacccaggugaucagagagacccuguggcugcugagcggcgugaagaagcuguucaucuuccagcugaucgacggcaaggugaccgugagaaacaacaucaucgugacccaccugacccacagcugccugagaagcgugcuggagcagaucgccgccuacggccaggugguguucagacugcaggaguucaucgacgaggugaugggccacagcagcgagagcaugcugcccggcagcggcagcgugcccaagaagagcaccgaggcccccuucagaaccuaccaggccuucaugugggcccuguacaaguacuucaucagcuucaaggaggagcuggccgagaucgagaagugcaucaucaacaacgacaccaccaucacccuggccaucgugguggacaagcuggcccccagacugagccagcugaaggugcugcacaagguguucagcaccggcguggccgaggugccccccgacaccagaaacguggugagagccagccaccugcugaacacccuguacaaggccauccuggaguacgacaacgugggcgaggccagcgagcagaccgugagccugcuguucagccuguggguggagaccgugagacccuaccugcagaccguggacgaguggaucgugcacggccaccugugggacggcgccagagaguucaucauccagagaaacaagaacgugcccgugaaccacagagacuucugguacgccaccuacacccuguacagcgugagcgagaagaccgagaacgaggagaagaugagcgacaacgccagcgccagcagcggcagcgaccagggccccagcagcagacagcacaccauggugagcuuccugaagcccgugcugaagcagaucaucauggccggcaagagcaugcagcugcugaagaaccugcagugcgccgagagcaccaccugccaggccggcgccagagacgccgagagaaagagccuguacacccuguuccuggagagcgugcagagcagacugagacacggcgaggacagcaccccccaggugcugaccgagcagcaggccaccaaggagaaccugaugaagaugcagagcaucgccgagagccaccuggagcuggacgacgugcacgacccccugcuggccaucaacuucgccagaauguaccuggagcagagcgacuuccacgagaaguucgccggcggcgacgugugcguggacagaagcagcgagagcgugaccugccagaccuucgagcugacccugagaagcugccuguacccccacaucgacaagcaguaccuggacugcugcggcaaccugaugcagacccugaagaaggacuacagacugguggaguaccugcaggccaugagaaacuucuuccugauggagggcggcgacaccauguacgacuucuacaccagcaucuucgacaagaucagagagaaggagaccuggcagaacgugagcuuccugaacgugcagcugcaggaggccgugggccagagauaccccgaggacagcagcagacugagcaucagcuucgagaacguggacaccgccaagaagaagcugcccgugcacauccuggacggccugacccugagcuacaaggugcccuggcccguggacaucgugaucagccuggagugccagaagaucuacaaccagguguuccugcugcugcugcagaucaagugggccaaguacagccuggacgugcugcuguucggcgagcuggugagcaccgccgagaagcccagacugaaggagggccugauccacgagcaggacaccguggcccaguucggcccccagaaggagcccgugagacagcagauccacagaauguuccugcugagagugaagcugaugcacuucgugaacagccugcacaacuacaucaugaccagaauccugcacagcaccggccuggaguuccagcaccagguggaggaggccaaggaccuggaccagcugaucaagauccacuacagauaccugagcaccauccacgacagaugccugcugagagagaaggugagcuucgugaaggaggccaucaugaaggugcugaaccuggcccugauguucgccgacggcuggcaggccggccugggcaccuggagaauggagagcaucgagaagauggagagcgacuucaagaacugccacauguuccuggugaccauccugaacaaggccgugugcagaggcagcuucccccacugcgaguacaucaugcugaaguacuucuaccugugcaucagccuguaa

SEQ ID NO: 25223 - RNA, 5460 nt, Artificial Sequence
  TUBGCP6__Homo_sapiens__NP_065194
auggccagcaucacccagcuguucgacgaccugugcgaggcccugcugcccgccgccaagacccaccugggccagagaagcgugaacagaaagagagccaagagaagccugaagaagguggccuacaacgcccuguucaccaaccuguuccaggacgagacccagcagcugcagcccgacaugagcaagcugcccgccagaaacaagauccugaugcugagcuucgaccugagagugggcggccugggccccaaggccgacagacuggaggagcugguggaggagcuggaggccgcccccugcugcccccugcuggaggugggcagcgugcuggaccugcuggugcagcuggccggcagcggccccccccaggugcugcccagaaagagagacuacuuccugaacaacaagcacgugggcagaaacgugcccuacagcggcuacgacugcgacgaccugagcguguucgagauggacgugcagagccugaucagcagagaggagugccugugccacagcaugauccaggagacccugcaggugauggaggccgcccccggcaccggccugcccaccgugggccuguucagcuucggcgaccccugcggcgacagauucgagagagacaccagagugagccuguucggcgcccuggugcacagcagaaccuacgacauggacgugagacugggccugccccccgugcccgacaacgccgaccugagcggccuggccaucaaggugccccccagcguggaccagugggaggacgagggcuuccagagcgccagcaaccugacccccgacagccagagcgagcccagcgugacccccgacguggaccugugggaggccgcccugaccuacgaggccagcaagagaagaugcugggagagagugggcugcccccccggccacagagaggagcccuaccugaccgaggccggcagagacgccuucgacaaguucugcagacugcaccagggcgagcugcagcugcuggccggcggcgugcugcaggccccccagcccgugcuggugaaggagugcgagcuggugaaggacgugcugaacgugcugaucggcguggugagcgccaccuucagccugugccagcccgcccaggccuucguggugaagagaggcgugcacgugagcggcgccagccccgagagcaucagcagccugcugagcgagguggccgaguacggcaccugcuacaccagacugagccacuucagccugcagcccgugcuggacagccuguacagcaagggccugguguuccaggccuucaccagcggccugagaagauaccugcaguacuacagagccugcgugcugagcaccccccccacccugagccugcugaccaucggcuuccuguucaagaagcugggcagacagcugagauaccuggccgagcugugcggcgugggcgccgugcugcccggcaccugcggcggcggccccagagccgccuuccccaccggcgugaagcugcugagcuaccuguaccaggaggcccugcacaacugcagcaacgagcacuaccccgugcugcugagccugcugaagaccagcugcgagcccuacaccagauucauccacgacuggguguacagcggcguguucagagacgccuacggcgaguucaugauccaggugaaccacgaguaccugagcuucagagacaagcuguacuggacccacggcuacgugcugaucagcaaggagguggaggacugcgugcccguguuccugaagcacaucgcccacgacaucuacgugugcggcaagaccaucaaccugcugaagcugugcugccccagacacuaccugugcuggagcgacgugcccgugcccagaaucagcgugaucuucagccuggaggagcugaaggagaucgagaaggacugcgccguguacgugggcagaauggagagaguggccagacacagcagcgugagcaaggaggagaaggagcugagaauggagaucgccaagcaggagcugaucgcccacgccagagaggccgccagcagagugcugagcgcccugagcgacagacagaugagcgagagaauggcccuggacgccagaaagagagagcaguuccagagacugaaggagcaguucgugaaggaccaggagagaagacaggccgccagacaggaggagcuggacgacgacuucagcuacgccagagagcugagagacagagagagaagacugaagagccuggaggaggagcuggagagaaaggccagacaggcccugguggaccacuacagcaagcugagcgccgaggccgccagaagagagcagaaggcccuguggagaauccagagacacagacuggagagcgccagacugagauuccugcuggaggacgagaagcacauccaggagaugcugaaggccgugagcgaggcccaccagccccaggagccccccgacgugcugcugagcgugcacccccaggugaccagccccggccccgagcaccccgagggcggccagggcugcgacagcggcagcgccgagcagcacagccccgccugggacggcuggaacagacccggccugcugaccccccagccccugaagccccuggccgugggcgccggcggcagaggccugcagcaggccgagggcgccagacccuucagcgacagccugagcaucggcgacuuccugcccgugggccccggcgccgagcccagcgugcagaccggcauggugccccugcuggagguggcccugcagaccaucaaccuggaccugccccccagcgcccccggcgaggcccccgccgccgccagcacccagcccagcagaccccaggaguacgacuucagcaccgugcugagacccgccguggccaccagccccgcccccggcccccugcaggccgccgagugcagccugggcagcagcggccugcagcugugggaggacagcugcggcaagauggacgccugcggcagcgccagcagagagacccugcugcccagccacccccccagaagagccgcccuggaggagggcagcagccagcccaccgagagacuguucggccaggugagcggcggcggccugcccaccggcgacuacgccagcgagaucgcccccaccagacccagauggaacacccacggccacgugagcgacgccagcaucagagugggcgagaacgugagcgacguggcccccacccagcccagauggaacacccacggccacgugagcaacgccagcaucagccugggcgagagcgugagcgacguggcccccaccagacccagauggaacauccacggccacgugagcaacgccagcaucagagugggcgagaacgugagcgacguggcccccaccagacccagauggaacacccacggccacgugagcaacgccagcaucagagugggcgagaacgugagcgacguggcccccaccagacccagauggaacacccacggccacgugagcgacgccagcaucagccugggcgagagcgugagcgacauggcccccgccagacccagauggaacacccacggccacgugagcgacgccagcaucagccugggcgagagcgugagcgacauggcccccaccagacccagauggaacacccacggccacgugagcgacaccagcaucagagugggcgagaacgugagcgacguggcccccaucagaagcagaugcaacacccacggccacgugagcgacgccagcaucagccugggcgagcccgugagcgacguggugagcaccagacccagauggaacacccacgugcccaucccccccccccacauggugcugggcgcccugagccccgaggccgagcccaacacccccagaccccagcagagcccccccggccacaccagccagagcgcccugagccugggcgcccagagcaccgugcuggacugcggccccagacugcccguggaggugggccccagccugagcagccccagcagcggcugcggcgagggcagcaucagcgugggcgagaacgugagcgacguggcccccacccagcccugguggcccaacacccccggcgacagcgugagcgaggagcugggccccggcagaagcggcgacaccgaggaccugagccccaacuggccccugaacagccaggaggacaccgccgcccagagcagccccggcagaggcgaggaggccgaggccagcgccgccgaggcccagggcggcgagcaggccuaccuggccggccuggccggccaguaccaccuggagagauaccccgacagcuacgagagcaugagcgagccccccaucgcccaccugcugagacccgugcugcccagagccuucgccuuccccguggacccccaggugcagagcgccgccgacgagaccgccgugcagcugagcgagcugcugacccugcccgugcugaugaagagaagcaucaccgccccccuggccgcccacaucagccuggugaacaaggccgccguggacuacuucuucguggagcugcaccuggaggcccacuacgaggcccugagacacuuccugcugauggaggacggcgaguucgcccagagccugagcgaccugcuguucgagaagcugggcgccggccagacccccggcgagcugcugaacccccuggugcugaacagcgugcugagcaaggcccugcagugcagccugcacggcgacaccccccacgccagcaaccugagccuggcccugaaguaccugcccgagguguucgcccccaacgcccccgacgugcugagcugccuggagcugagauacaagguggacuggccccugaacaucgugaucaccgagggcugccugagcaaguacagcggcguguucagcuuccugcugcagcugaagcugaugaugugggcccugaaggacgugugcuuccaccugaagagaaccgcccugcugagccacauggccggcagcgugcaguucagacagcugcagcuguucaagcacgagaugcagcacuucgugaaggugauccagggcuacaucgccaaccagauccugcacgugaccuggugcgaguucagagccagacuggccaccgugggcgaccuggaggagauccagagagcccacgccgaguaccugcacaaggccguguucagaggccugcugaccgagaaggccgcccccgugaugaacgugauccacagcaucuucagccuggugcugaaguucagaagccagcugaucagccaggccuggggcccccccggcggccccagaggcgccgagcaccccaacuucgcccugaugcagcagagcuacaacaccuucaaguacuacagccacuuccuguucaagguggugaccaagcuggugaacagaggcuaccagccccaccuggaggacuuccugcugagaaucaacuucaacaacuacuaccaggacgccuaa

SEQ ID NO: 25224 - RNA, 1686 nt, Artificial Sequence
  TUB__Homo_sapiens__NP_003311
augggcgccagaaccccccugcccagcuucugggugagcuucuucgccgagaccggcauccuguuccccggcggcacccccuggcccaugggcagccagcacagcaagcagcacagaaagcccggcccccugaagagaggccacagaagagacagaagaaccaccagaagaaaguacuggaaggagggcagagagaucgccagagugcuggacgacgagggcagaaaccugagacagcagaagcuggacagacagagagcccugcuggagcagaagcagaagaagaagagacaggagccccugauggugcaggccaacgccgacggcagacccagaagcagaagagccagacagagcgaggagcaggccccccugguggagagcuaccugagcagcagcggcagcaccagcuaccaggugcaggaggccgacagccuggccagcgugcagcugggcgccaccagacccaccgcccccgccagcgccaagagaaccaaggccgccgccaccgccggcggccagggcggcgccgccagaaaggagaagaagggcaagcacaagggcaccagcggccccgccgcccuggccgaggacaagagcgaggcccagggccccgugcagauccugaccgugggccagagcgaccacgcccaggacgccggcgagaccgccgccggcggcggcgagagacccagcggccaggaccugagagccaccaugcagagaaagggcaucagcagcagcaugagcuucgacgaggacgaggaggacgaggaggagaacagcagcagcagcagccagcugaacagcaacaccagacccagcagcgccaccagcagaaagagcgugagagaggccgccagcgcccccagccccaccgcccccgagcagcccguggacguggaggugcaggaccuggaggaguucgcccugagacccgccccccagggcaucaccaucaagugcagaaucaccagagacaagaagggcauggacagaggcauguaccccaccuacuuccugcaccuggacagagaggacggcaagaagguguuccugcuggccggcagaaagagaaagaagagcaagaccagcaacuaccugaucagcguggaccccaccgaccugagcagaggcggcgacagcuacaucggcaagcugagaagcaaccugaugggcaccaaguucaccguguacgacaacggcgugaacccccagaaggccagcagcagcacccuggagagcggcacccugagacaggagcuggccgccgugugcuacgagaccaacgugcugggcuucaagggccccagaaagaugagcgugaucgugcccggcaugaacauggugcacgagagagugagcaucagacccagaaacgagcacgagacccugcuggccagauggcagaacaagaacaccgagagcaucaucgagcugcagaacaagacccccguguggaacgacgacacccagagcuacgugcugaacuuccacggcagagugacccaggccagcgugaagaacuuccagaucauccacggcaacgaccccgacuacaucgugaugcaguucggcagaguggccgaggacguguucaccauggacuacaacuacccccugugcgcccugcaggccuucgccaucgcccugagcagcuucgacagcaagcuggccugcgaguaa

SEQ ID NO: 25225 - RNA, 1368 nt, Artificial Sequence
  TUFM__Homo_sapiens__NP_003312
augaccaccauggccgccgccacccugcugagagccaccccccacuucagcggccuggccgccggcagaaccuuccugcugcagggccugcugagacugcugaaggcccccgcccugccccugcugugcagaggccuggccguggaggccaagaagaccuacgugagagacaagccccacgugaacgugggcaccaucggccacguggaccacggcaagaccacccugaccgccgccaucaccaagauccuggccgagggcggcggcgccaaguucaagaaguacgaggagaucgacaacgcccccgaggagagagccagaggcaucaccaucaacgccgcccacguggaguacagcaccgccgccagacacuacgcccacaccgacugccccggccacgccgacuacgugaagaacaugaucaccggcaccgccccccuggacggcugcauccuggugguggccgccaacgacggccccaugccccagaccagagagcaccugcugcuggccagacagaucggcguggagcacguggugguguacgugaacaaggccgacgccgugcaggacagcgagaugguggagcugguggagcuggagaucagagagcugcugaccgaguucggcuacaagggcgaggagacccccgugaucgugggcagcgcccugugcgcccuggagggcagagaccccgagcugggccugaagagcgugcagaagcugcuggacgccguggacaccuacauccccgugcccgccagagaccuggagaagcccuuccugcugcccguggaggccguguacagcgugcccggcagaggcaccguggugaccggcacccuggagagaggcauccugaagaagggcgacgagugcgagcugcugggccacagcaagaacaucagaaccguggugaccggcaucgagauguuccacaagagccuggagagagccgaggccggcgacaaccugggcgcccuggugagaggccugaagagagaggaccugagaagaggccuggugauggugaagcccggcagcaucaagccccaccagaagguggaggcccagguguacauccugagcaaggaggagggcggcagacacaagcccuucgugagccacuucaugcccgugauguucagccugaccugggacauggccugcagaaucauccugccccccgagaaggagcuggccaugcccggcgaggaccugaaguucaaccugauccugagacagcccaugauccuggagaagggccagagauucacccugagagacggcaacagaaccaucggcaccggccuggugaccaacacccuggccaugaccgaggaggagaagaacaucaaguggggcuaa

SEQ ID NO: 25226 - RNA, 1098 nt, Artificial Sequence
  TUFT1__Homo_sapiens__NP_001119809
augaacggcaccagaaacuggugcacccugguggacgugcaccccgaggaccaggccgccgccggcagaaagaccuacgccauggugagcagccacagcgccggccacagccuggccagcgagcugguggagagccacgacggccacgaggagaucaucaagguguaccugaagggcagaagcggcgacaagaugauccacgagaagaacaucaaccagcugaagagcgaggugcaguacauccaggaggccagaaacugccugcagaagcugagagaggacaucagcagcaagcuggacagaaaccugggcgacagccugcacagacaggagauccagguggugcuggagaagcccaacggcuucagccagagccccaccgcccuguacagcagcccccccgagguggacaccugcaucaacgaggacguggagagccugagaaagaccgugcaggaccugcuggccaagcugcaggaggccaagagacagcaccagagcgacugcguggccuucgaggugacccugagcagauaccagagagaggccgagcagagcaacguggcccugcagagagaggaggacagaguggagcagaaggaggccgaggugggcgagcugcagagaagacugcugggcauggagaccgagcaccaggcccugcuggccaaggugagagagggcgagguggcccuggaggagcugagaagcaacaacgccgacugccaggccgagagagagaaggccgccacccuggagaaggagguggccggccugagagagaagauccaccaccuggacgacaugcugaagagccagcagagaaaggugagacagaugaucgagcagcugcagaacagcaaggccgugauccagagcaaggacgccaccauccaggagcugaaggagaagaucgccuaccuggaggccgagaaccuggagaugcacgacagaauggagcaccugaucgagaagcagaucagccacggcaacuucagcacccaggccagagccaagaccgagaaccccggcagcaucagaaucagcaagccccccagccccaagcccaugcccgugaucagagugguggagaccuaa

SEQ ID NO: 25227 - RNA, 1470 nt, Artificial Sequence
  TULP1__Homo_sapiens__NP_001276324
augccccugagagacgagacccugagagaggugugggccagcgacagcggccacgaggaggagagccugagccccgaggcccccagaagacccaagcagagacccgcccccgcccagagacugagaaagaagagaaccgaggcccccgagagccccugccccaccggcagcaagcccagaaagcccggcgaggaggaggaggaggaggaggacgaggaggacgaggaggaggaggccgaggagaagaaggagaagauccugcugccccccaagaagccccugagagagaagagcagcgccgaccugaaggagagaagagccaaggcccagggccccagaggcgaccugggcagccccgaccccccccccaagccccugagagugagaaacaaggaggcccccgccggcgagggcaccaagaugagaaagaccaagaagaagggcagcggcgaggccgacaaggaccccagcggcagccccgccagcgccagaaagagccccgccgccauguuccuggugggcgagggcagccccgacaagaaggcccugaagaagaagggcacccccaagggcgccagaaaggaggaggaggaggaggaggaggccgccaccgugaucaagaagagcaaccagaagggcaaggccaagggcaagggcaagaagaaggccaaggaggagagagcccccagcccccccguggagguggacgagcccagagaguucgugcugagacccgccccccagggcagaaccgugagaugcagacugaccagagacaagaagggcauggacagaggcauguaccccagcuacuuccugcaccuggacaccgagaagaagguguuccugcuggccggcagaaagagaaagagaagcaagaccgccaacuaccugaucagcaucgaccccaccaaccugagcagaggcggcgagaacuucaucggcaagcugagaagcaaccugcugggcaacagauucaccguguucgacaacggccagaacccccagagaggcuacagcaccaacguggccagccugagacaggagcuggccgccgugaucuacgagaccaacgugcugggcuucagaggccccagaagaaugaccgugaucauccccggcaugagcgccgagaacgagagagugcccaucagacccagaaacgccagcgacggccugcuggugagauggcagaacaagacccuggagagccugaucgagcugcacaacaagccccccguguggaacgacgacagcggcagcuacacccugaacuuccagggcagagugacccaggccagcgugaagaacuuccagaucgugcacgccgacgaccccgacuacaucgugcugcaguucggcagaguggccgaggacgccuucacccuggacuacagauacccccugugcgcccugcaggccuucgccaucgcccugagcagcuucgacggcaagcuggccugcgaguaa

SEQ ID NO: 25228 - RNA, 1563 nt, Artificial Sequence
  TULP2__Homo_sapiens__NP_003314
augagccaggacaacgacacccugaugagagacauccugggccacgagcuggccgccaugagacugcagaagcuggagcagcagagaagacuguucgagaagaagcagagacagaagagacaggagcugcugauggugcaggccaaccccgacgccagccccuggcuguggagaagcugccugagagaggagagacugcugggcgacagaggccugggcaaccccuuccugagaaagaaggugagcgaggcccaccugcccagcggcauccacagcgcccugggcaccgugagcugcggcggcgacggcagaggcgagagaggccugcccacccccagaaccgaggccguguucagaaaccugggccugcagagccccuuccugagcuggcugcccgacaacagcgacgccgagcuggaggaggugagcguggagaacggcagcgugagccccccccccuucaagcagagccccagaaucagaagaaagggcuggcaggcccaccagagacccggcaccagagccgagggcgagagcgacagccaggacaugggcgacgcccacaagagccccaacaugggccccaaccccggcauggacggcgacugcguguacgagaaccuggccuuccagaaggaggaggaccuggagaagaagagagaggccagcgagagcaccggcaccaacagcagcgccgcccacaacgaggagcugagcaaggcccugaagggcgagggcggcaccgacagcgaccacaugagacacgaggccagccuggccaucagaagccccugccccggccuggaggaggacauggaggccuacgugcugagacccgcccugcccggcaccaugaugcagugcuaccugaccagagacaagcacggcguggacaagggccuguucccccuguacuaccuguaccuggagaccagcgacagccugcagagauuccugcuggccggcagaaagagaagaagaagcaagaccagcaacuaccugaucagccuggaccccacccaccugagcagagacggcgacaacuucgugggcaaggugagaagcaacguguucagcaccaaguucaccaucuucgacaacggcgugaaccccgacagagagcaccugaccagaaacaccgccagaaucagacaggagcugggcgccgugugcuacgagcccaacgugcugggcuaccugggccccagaaagaugaccgugauccugcccggcaccaacagccagaaccagagaaucaacgugcagccccugaacgagcaggagagccugcugagcagauaccagagaggcgacaagcagggccugcugcugcugcacaacaagacccccagcugggacaaggagaacggcguguacacccugaacuuccacggcagagugaccagagccagcgugaagaacuuccagaucguggaccccaagcaccaggagcaccuggugcugcaguucggcagagugggccccgacaccuucaccauggacuucugcuuccccuucagcccccugcaggccuucagcaucugccugagcagcuucaacuaa

SEQ ID NO: 25229 - RNA, 1506 nt, Artificial Sequence
  TULP3__Homo_sapiens__NP_001153880
auggaggccagcagaugcagacugagccccagcggcgacagcguguuccacgaggagaugaugaagaugagacaggccaagcuggacuaccagagacugcugcuggagaagagacagagaaagaagagacuggagcccuucauggugcagcccaaccccgaggccagacugagaagagccaagcccagagccagcgacgagcagaccccccuggugaacugccacaccccccacagcaacgugauccugcacggcaucgacggccccgccgccgugcugaagcccgacgaggugcacgcccccagcgugagcagcagcgugguggaggaggacgccgagaacaccguggacaccgccagcaagcccggccugcaggagagacugcagaagcacgacaucagcgagagcgugaacuucgacgaggagaccgacggcaucagccagagcgccugccuggagagacccaacagcgccagcagccagaacagcaccgacaccggcaccagcggcagcgccaccgccgcccagcccgccgacaaccugcugggcgacaucgacgaccuggaggacuucguguacagccccgccccccagggcgugaccgugagaugcagaaucaucagagacaagagaggcauggacagaggccuguuccccaccuacuacauguaccuggagaaggaggagaaccagaagaucuuccugcuggccgccagaaagagaaagaagagcaagaccgccaacuaccugaucagcaucgaccccguggaccugagcagagagggcgagagcuacgugggcaagcugagaagcaaccugaugggcaccaaguucaccguguacgacagaggcaucugccccaugaagggcagaggccuggugggcgccgcccacaccagacaggagcuggccgccaucagcuacgagaccaacgugcugggcuucaagggccccagaaagaugagcgugaucauccccggcaugacccugaaccacaagcagauccccuaccagccccagaacaaccacgacagccugcugagcagauggcagaacagaaccauggagaaccugguggagcugcacaacaaggcccccguguggaacagcgacacccagagcuacgugcugaacuucagaggcagagugacccaggccagcgugaagaacuuccagaucgugcacaagaacgaccccgacuacaucgugaugcaguucggcagaguggccgacgacguguucacccuggacuacaacuacccccugugcgccgugcaggccuucggcaucggccugagcagcuucgacaagugcauccagacccugagaaugcaggagcugugcgagcugcacagacagcaccacagcgccgccagccuggugcacagaaccgugugccagagaugggugggccaccccuggagacugcugccccagaccagccugcuguggaccgaccugagccccccccccguggugcccgccccccaccagaucagcauguaa

SEQ ID NO: 25230 - RNA, 2037 nt, Artificial Sequence
  TULP4__Homo_sapiens__NP_001007467
auguacgccgccguggagcacggccccgugcugugcagcgacagcaacauccugugccugagcuggaagggcagagugcccaagagcgagaaggagaagcccgugugcagaagaagauacuacgaggagggcuggcuggccaccggcaacggcagaggcguggugggcgugaccuucaccagcagccacugcagaagagacagaagcaccccccagagaaucaacuucaaccugagaggccacaacagcgagguggugcuggugagauggaacgagcccuaccagaagcuggccaccugcgacgccgacggcggcaucuucguguggauccaguacgagggcagauggagcguggagcuggugaacgacagaggcgcccaggugagcgacuucaccuggagccacgacggcacccaggcccugaucagcuacagagacggcuucgugcuggugggcagcgugagcggccagagacacuggagcagcgagaucaaccuggagagccagaucaccugcggcaucuggacccccgacgaccagcaggugcuguucggcaccgccgacggccaggugaucgugauggacugccacggcagaaugcuggcccacgugcugcugcacgagagcgacggcgugcugggcaugagcuggaacuaccccaucuuccugguggaggacagcagcgagagcgacaccgacagcgacgacuacgcccccccccaggacggccccgccgccuaccccauccccgugcagaacaucaagccccugcugaccgugagcuucaccagcggcgacaucagccugaugaacaacuacgacgaccugagccccaccgugaucagaagcggccugaaggaggugguggcccaguggugcacccagggcgaccugcuggccguggccggcauggagagacagacccagcugggcgagcugcccaacggcccccugcugaagagcgccauggugaaguucuacaacgugagaggcgagcacaucuucacccuggacacccuggugcagagacccaucaucagcaucugcuggggccacagagacagcagacugcugauggccagcggccccgcccuguacguggugagaguggagcacagagugagcagccugcagcugcugugccagcaggccaucgccagcacccugagagaggacaaggacgugagcaagcugacccugccccccagacugugcagcuaccugagcaccgccuucauccccaccaucaagccccccauccccgaccccaacaacaugagagacuucgugagcuaccccagcgccggcaacgagagacugcacugcaccaugaagagaaccgaggacgaccccgaggugggcggccccugcuacacccuguaccuggaguaccugggcggccuggugcccauccugaagggcagaagaaucagcaagcugagacccgaguucgugaucauggaccccagaaccgacagcaagcccgacgagaucuacggcaacagccugaucagcaccgugaucgacagcugcaacugcagcgacagcagcgacaucgagcugagcgacgacugggccgccaagaagagccccaagaucagcagagccagcaagagccccaagcugcccagaaucagcaucgaggccagaaagagccccaagcugcccagagccgcccaggagcugagcagaagccccagacugccccugagaaagcccagcgugggcagccccagccugaccagaagagaguuccccuucgaggacaucacccagcacaacuaccuggcccaggugaccagcaacaucuggggcaccaaguucaagaucgugggccuggccgccuuccugcccaccaaccugggcgccgugaucuacaagaccagccugcugcaccugcagcccagacagaugaccaucuaccugcccgaggugagaaagaucagcauggacuacaucaaccugcccguguucaaccccaacguguucagcgaggacgaggacgaccugcccggcgacgccguguggaccgacuaa

SEQ ID NO: 25231 - RNA, 639 nt, Artificial Sequence
  TUSC1__Homo_sapiens__NP_001004125
augggccccauguggagaaugagaggcggcgccaccagaagaggcagcugcugcggcggcgacggcgccgccgacggcagaggccccggcagaagcggcagagccagaggcggcggcagccccagcggcggcggcggcggcgugggcuggagaggcagagccgacggcgccagacagcagcuggaggagagauucgccgaccuggccgccagccaccuggaggccaucagagccagagacgagugggacagacagaacgccagacugagacaggagaacgccagacugagacuggagaacagaagacugaagagagagaacagaagccuguucagacaggcccugagacugcccggcgagggcggcaacggcacccccgccgaggccagaagagugcccgaggaggccagcaccaacagaagagccagagacagcggcagagaggacgagcccggcagccccagagcccugagagccagacuggagaagcuggaggccauguacagaagagcccugcugcagcugcaccuggagcagagaggccccagacccagcggcgacaaggaggagcagccccugcaggagcccgacagcggccugagaagcagagacagcgagcccagcggccccuggcuguaa

SEQ ID NO: 25232 - RNA, 333 nt, Artificial Sequence
  TUSC2__Homo_sapiens__NP_009206
augggcgccagcggcagcaaggccagaggccuguggcccuucgccagcgccgccggcggcggcggcagcgaggccgccggcgccgagcaggcccuggugagacccagaggcagagccgugccccccuucguguucaccagaagaggcagcauguucuacgacgaggacggcgaccuggcccacgaguucuacgaggagaccaucgugaccaagaacggccagaagagagccaagcugagaagagugcacaagaaccugaucccccagggcaucgugaagcuggaccaccccagaauccacguggacuuccccgugauccuguacgagguguaa

SEQ ID NO: 25233 - RNA, 1047 nt, Artificial Sequence
  TUSC3__Homo_sapiens__NP_006756
augggcgccagaggcgcccccagcagaagaagacaggccggcagaagacugagauaccugcccaccggcagcuuccccuuccugcugcugcugcugcugcugugcauccagcugggcggcggccagaagaagaaggagaaccugcuggccgagaagguggagcagcugauggaguggagcagcagaagaagcaucuucagaaugaacggcgacaaguucagaaaguucaucaaggccccccccagaaacuacagcaugaucgugauguucaccgcccugcagccccagagacagugcagcgugugcagacaggccaacgaggaguaccagauccuggccaacagcuggagauacagcagcgccuucugcaacaagcuguucuucagcaugguggacuacgacgagggcaccgacguguuccagcagcugaacaugaacagcgcccccaccuucaugcacuucccccccaagggcagacccaagagagccgacaccuucgaccugcagagaaucggcuucgccgccgagcagcuggccaaguggaucgccgacagaaccgacgugcacaucagaguguucagaccccccaacuacagcggcaccaucgcccuggcccugcuggugagccuggugggcggccugcuguaccugagaagaaacaaccuggaguucaucuacaacaagaccggcugggccauggugagccugugcaucguguucgccaugaccagcggccagauguggaaccacaucagaggcccccccuacgcccacaagaacccccacaacggccaggugagcuacauccacggcagcagccaggcccaguucguggccgagagccacaucauccuggugcugaacgccgccaucaccaugggcauggugcugcugaacgaggccgccaccagcaagggcgacgugggcaagagaagaaucaucugccuggugggccugggccuggugguguucuucuucagcuuccugcugagcaucuucagaagcaaguaccacggcuaccccuacagcgaccuggacuucgaguaa

SEQ ID NO: 25234 - RNA, 534 nt, Artificial Sequence
  TUSC5__Homo_sapiens__NP_758955
auggcccaccccgugcagagcgaguuccccagcgcccaggagcccggcagcgccgccuuccuggaccugcccgagauggagauccugcugaccaaggccgagaacaaggacgacaagacccugaaccugagcaagacccugagcggcccccuggaccuggagcagaacagccagggccugcccuucaaggccaucagcgagggccaccuggaggccccccugcccagaagccccagcagagccagcagcagaagagccagcagcaucgccaccaccagcuacgcccaggaccaggaggcccccagagacuaccugauccuggccgugguggccugcuucugccccguguggccccugaaccugaucccccugaucaucagcaucaugagcagaagcagcaugcagcagggcaacguggacggcgccagaagacugggcagacuggccagacugcugagcaucacccugaucaucaugggcaucgugaucaucaugguggccgugaccgugaacuucaccgugcagaagaaguaa

SEQ ID NO: 25235 - RNA, 2739 nt, Artificial Sequence
  TUT1__Homo_sapiens__NP_073741
augagccugcccaucggcagcgccgagguggccagcgagagaguggagcuguggagaagcggcuucagaugguggcagagaugccugugcuucugcagauacagaagaguggccauggccgccguggacagcgacguggagagccugcccagaggcggcuucagaugcugccugugccacgugaccaccgccaacagacccagccuggacgcccaccugggcggcagaaagcacagacaccugguggagcugagagccgccagaaaggcccagggccugagaagcguguucgugagcggcuuccccagagacguggacagcgcccagcugagcgaguacuuccuggccuucggccccguggccagcguggugauggacaaggacaagggcguguucgccaucguggagaugggcgacgugggcgccagagaggccgugcugagccagagccagcacagccugggcggccacagacugagagugagacccagagagcagaaggaguuccagagccccgccagcaagagccccaagggcgccgcccccgacagccaccagcuggccaaggcccuggccgaggccgccgacgugggcgcccagaugaucaagcuggugggccugagagagcugagcgaggccgagagacagcugagaagccuggugguggcccugaugcaggagguguucaccgaguucuuccccggcugcguggugcaccccuucggcagcagcaucaacagcuucgacgugcacggcugcgaccuggaccuguuccuggaccugggcgaccuggaggagccccagcccgugcccaaggcccccgagagccccagccuggacagcgcccuggccagcccccuggacccccaggcccuggccugcacccccgccagcccccccgacagccagccccccgccagcccccaggacagcgaggcccuggacuucgagacccccagcagcagccuggccccccagacccccgacagcgcccuggccagcgagacccuggccagcccccagagccugccccccgccagcccccugcuggaggacagagaggagggcgaccugggcaaggccagcgagcuggccgagacccccaaggaggagaaggccgagggcgccgccaugcuggagcuggugggcagcauccugagaggcugcgugcccggcguguacagagugcagaccgugcccagcgccagaagacccguggugaaguucugccacagacccagcggccugcacggcgacgugagccugagcaacagacuggcccugcacaacagcagauuccugagccugugcagcgagcuggacggcagagugagaccccugguguacacccugagaugcugggcccagggcagaggccugagcggcagcggcccccugcugagcaacuacgcccugacccugcuggugaucuacuuccugcagaccagagacccccccgugcugcccaccgugagccagcugacccagaaggccggcgagggcgagcagguggagguggacggcugggacugcagcuuccccagagacgccagcagacuggagcccagcaucaacguggagccccugagcagccugcuggcccaguucuucagcugcgugagcugcugggaccugagaggcagccugcugagccugagagagggccaggcccugcccguggccggcggccugcccagcaaccugugggagggccugagacugggcccccugaaccugcaggaccccuucgaccugagccacaacguggccgccaacgugaccagcagaguggccggcagacugcagaacugcugcagagccgccgccaacuacugcagaagccugcaguaccagagaagaagcagcagaggcagagacuggggccugcugccccugcugcagcccagcagccccagcagccugcugagcgccacccccaucccccugccccuggcccccuucacccagcugaccgccgcccuggugcagguguucagagaggcccugggcugccacaucgagcaggccaccaagagaaccagaagcgagggcggcggcaccggcgagagcagccagggcggcaccagcaagagacugaagguggacggccagaagaacugcugcgaggagggcaaggaggagcagcagggcugcgccggcgacggcggcgaggacagaguggaggagauggugaucgaggugggcgagauggugcaggacugggccaugcagagccccggccagcccggcgaccugccccugaccaccggcaagcacggcgcccccggcgaggagggccagcccagccacgccgcccuggccgagagaggccccaagggccacgaggccgcccaggaguggagccagggcgaggccggcaagggcgccagccugcccagcagcgccagcuggagaugcgcccuguggcacagaguguggcagggcagaagaagagccagaagaagacugcagcagcagaccaaggagggcgccggcggcggcgccggcaccagagccggcuggcuggccaccgaggcccaggugacccaggagcugaagggccugagcggcggcgaggagagacccgagaccgagccccugcugagcuucguggccagcgugagccccgccgacagaaugcugaccgugaccccccugcaggacccccagggccuguuccccgaccugcaccacuuccugcagguguuccugccccaggccaucagacaccugaaguaa

SEQ ID NO: 25236 - RNA, 618 nt, Artificial Sequence
  TVP23B__Homo_sapiens__NP_057162
augcugcagcaggacagcaacgacgacaccgaggacgugagccuguucgacgccgaggaggagaccaccaacagacccagaaaggccaagaucagacaccccguggccagcuucuuccaccuguucuucagagugagcgccaucaucguguaccugcugugcggccugcugagcagcagcuucaucaccugcauggugaccaucauccugcugcugagcugcgacuucugggccgugaagaacgugaccggcagacugauggugggccugagaugguggaaccacaucgacgaggacggcaagagccacuggguguucgagagcagaaaggagagcagccaggagaacaagaccgugagcgaggccgagagcagaaucuucuggcugggccugaucgccugccccgugcugugggugaucuucgccuucagcgcccuguucagcuucagagugaaguggcuggccguggugaucaugggcguggugcugcagggcgccaaccuguacggcuacaucagaugcaaggugagaagcagaaagcaccugaccagcauggccaccagcuacuucggcaagcaguuccugagacagaacaccggcgacgaccagaccagcuaa

SEQ ID NO: 25237 - RNA, 1074 nt, Artificial Sequence
  TWF1__Homo_sapiens__NP_001229326
augagccaccagaccggcauccaggccagcgaggacgugaaggagaucuucgccagagccagaaacggcaaguacagacugcugaagaucagcaucgagaacgagcagcuggugaucggcagcuacagccagcccagcgacagcugggacaaggacuacgacagcuucgugcugccccugcuggaggacaagcagcccugcuacauccuguucagacuggacagccagaacgcccagggcuacgaguggaucuucaucgccuggagccccgaccacagccacgugagacagaagaugcuguacgccgccaccagagccacccugaagaaggaguucggcggcggccacaucaaggacgagguguucggcaccgugaaggaggacgugagccugcacggcuacaagaaguaccugcugagccagagcagccccgccccccugaccgccgccgaggaggagcugagacagaucaagaucaacgagagccccgaggaccacaucggcgugcagaccgacgugggcguggacaccaagcaccagacccugcagggcguggccuuccccaucagcagagaggccuuccaggcccuggagaagcugaacaacagacagcugaacuacgugcagcuggagaucgacaucaagaacgagaucaucauccuggccaacaccaccaacaccgagcugaaggaccugcccaagagaauccccaaggacagcgccagauaccacuucuuccuguacaagcacagccacgagggcgacuaccuggagagcaucguguucaucuacagcaugcccggcuacaccugcagcaucagagagagaaugcuguacagcagcugcaagagcagacugcuggagaucguggagagacagcugcagauggacgugaucagaaagaucgagaucgacaacggcgacgagcugaccgccgacuuccuguacgaggaggugcaccccaagcagcacgcccacaagcagagcuucgccaagcccaagggccccgccggcaagagaggcaucagaagacugaucagaggccccgccgagaccgaggccaccaccgacuaa

SEQ ID NO: 25238 - RNA, 609 nt, Artificial Sequence
  TWIST1__Homo_sapiens__XP_011513798
augaugcaggacgugagcagcagccccgugagccccgccgacgacagccugagcaacagcgaggaggagcccgacagacagcagccccccagcggcaagagaggcggcagaaagagaagaagcagcagaagaagcgccggcggcggcgccggccccggcggcgccgccggcggcggcgugggcggcggcgacgagcccggcagccccgcccagggcaagagaggcaagaagagcgccggcugcggcggcggcggcggcgccggcggcggcggcggcagcagcagcggcggcggcagcccccagagcuacgaggagcugcagacccagagagugauggccaacgugagagagagacagagaacccagagccugaacgaggccuucgccgcccugagaaagaucauccccacccugcccagcgacaagcugagcaagauccagacccugaagcuggccgccagauacaucgacuuccuguaccaggugcugcagagcgacgagcuggacagcaagauggccagcugcagcuacguggcccacgagagacugagcuacgccuucagcguguggagaauggagggcgccuggagcaugagcgccagccacuaa

SEQ ID NO: 25239 - RNA, 483 nt, Artificial Sequence
  TWIST2__Homo_sapiens__NP_001258822
auggaggagggcagcagcagccccgugagccccguggacagccugggcaccagcgaggaggagcuggagagacagcccaagagauucggcagaaagagaagauacagcaagaagagcagcgaggacggcagccccacccccggcaagagaggcaagaagggcagccccagcgcccagagcuucgaggagcugcagagccagagaauccuggccaacgugagagagagacagagaacccagagccugaacgaggccuucgccgcccugagaaagaucauccccacccugcccagcgacaagcugagcaagauccagacccugaagcuggccgccagauacaucgacuuccuguaccaggugcugcagagcgacgagauggacaacaagaugaccagcugcagcuacguggcccacgagagacugagcuacgccuucagcguguggagaauggagggcgccuggagcaugagcgccagccacuaa

SEQ ID NO: 25240 - RNA, 672 nt, Artificial Sequence
  TWSG1__Homo_sapiens__NP_065699
augaagcugcacuacguggccgugcugacccuggccauccugauguuccugaccuggcugcccgagagccugagcugcaacaaggcccugugcgccagcgacgugagcaagugccugauccaggagcugugccagugcagacccggcgagggcaacugcagcugcugcaaggagugcaugcugugccugggcgcccugugggacgagugcugcgacugcgugggcaugugcaaccccagaaacuacagcgacaccccccccaccagcaagagcaccguggaggagcugcacgagcccauccccagccuguucagagcccugaccgagggcgacacccagcugaacuggaacaucgugagcuuccccguggccgaggagcugagccaccacgagaaccuggugagcuuccuggagaccgugaaccagccccaccaccagaacgugagcgugcccagcaacaacgugcacgcccccuacagcagcgacaaggagcacaugugcaccgugguguacuucgacgacugcaugagcauccaccagugcaagaucagcugcgagagcaugggcgccagcaaguacagaugguuccacaacgccugcugcgagugcaucggccccgagugcaucgacuacggcagcaagaccgugaagugcaugaacugcauguucuaa

SEQ ID NO: 25241 - RNA, 1584 nt, Artificial Sequence
  TXK__Homo_sapiens__NP_003319
augauccugagcagcuacaacaccauccagagcguguucugcugcugcugcugcugcagcgugcagaagagacagaugagaacccagaucagccugagcaccgacgaggagcugcccgagaaguacacccagagaagaagacccuggcugagccagcugagcaacaagaagcagagcaacaccggcagagugcagcccagcaagagaaagccccugcccccccugccccccagcgagguggccgaggagaagauccaggugaaggcccuguacgacuuccugcccagagagcccugcaaccuggcccugagaagagccgaggaguaccugauccuggagaaguacaacccccacugguggaaggccagagacagacugggcaacgagggccugauccccagcaacuacgugaccgagaacaagaucaccaaccuggagaucuacgagugguaccacagaaacaucaccagaaaccaggccgagcaccugcugagacaggagagcaaggagggcgccuucaucgugagagacagcagacaccugggcagcuacaccaucagcguguucaugggcgccagaagaagcaccgaggccgccaucaagcacuaccagaucaagaagaacgacagcggccagugguacguggccgagagacacgccuuccagagcauccccgagcugaucugguaccaccagcacaacgccgccggccugaugaccagacugagauaccccgugggccugaugggcagcugccugcccgccaccgccggcuucagcuacgagaagugggagaucgaccccagcgagcuggccuucaucaaggagaucggcagcggccaguucggcguggugcaccugggcgaguggagaagccacauccagguggccaucaaggccaucaacgagggcagcaugagcgaggaggacuucaucgaggaggccaaggugaugaugaagcugagccacagcaagcuggugcagcuguacggcgugugcauccagagaaagccccuguacaucgugaccgaguucauggagaacggcugccugcugaacuaccugagagagaacaagggcaagcugagaaaggagaugcugcugagcgugugccaggacaucugcgagggcauggaguaccuggagagaaacggcuacauccacagagaccuggccgccagaaacugccuggugagcagcaccugcaucgugaagaucagcgacuucggcaugaccagauacgugcuggacgacgaguacgugagcagcuucggcgccaaguuccccaucaaguggagcccccccgagguguuccuguucaacaaguacagcagcaagagcgacguguggagcuucggcgugcugaugugggagguguucaccgagggcaagaugcccuucgagaacaagagcaaccugcaggugguggaggccaucagcgagggcuucagacuguacagaccccaccuggcccccaugagcaucuacgaggugauguacagcugcuggcacgagaagcccgagggcagacccaccuucgccgagcugcugagagccgugaccgagaucgccgagaccugguaa

SEQ ID NO: 25242 - RNA, 1191 nt, Artificial Sequence
  TXLNG__Homo_sapiens__NP_001162154
auggccaccagaguggaggaggccgccagaggcagaggcggcggcgccgaggaggccaccgaggccggcagaggcggcagaagaagaagccccagacagaagcuggaggagagcagaagcgugcagaagcagaugaagauccugcagaagaagcaggcccagaucgugaaggagaaggugcaccugcagagcgagcacagcaaggccauccuggccagaagcaagcuggagagccugugcagagagcugcagagacacaacaagacccugaaggaggagaacaugcagcaggccagagaggaggaggagagaagaaaggaggccaccgcccacuuccagaucacccugaacgagauccaggcccagcuggagcagcacgacauccacaacgccaagcugagacaggagaacaucgagcugggcgagaagcugaagaagcugaucgagcaguacgcccugagagaggagcacaucgacaagguguucaagcacaaggagcugcagcagcagcugguggacgccaagcugcagcagaccacccagcugaucaaggaggccgacgagaagcaccagagagagagagaguuccugcugaaggaggccaccgagagcagacacaaguacgagcagaugaagcagcaggaggugcagcugaagcagcagcugagccuguacauggacaaguucgaggaguuccagaccaccauggccaagagcaacgagcuguucaccaccuucagacaggagauggagaagaugaccaagaagaucaagaagcuggagaaggagaccaucaucuggagaaccaagugggagaacaacaacaaggcccugcugcagauggccgaggagaagaccgugagagacaaggaguacaaggcccugcagaucaagcuggagagacuggagaagcugugcagagcccugcagaccgagagaaacgagcugaacgagaagguggaggugcugaaggagcaggugagcaucaaggccgccaucaaggccgccaacagagaccuggccacccccgugaugcagcccugcaccgcccuggacagccacaaggagcugaacaccagcagcaagagagcccugggcgcccaccuggaggccgagcccaagagccagagaagcgccgugcagaagccccccagcaccggcagcgcccccgccaucgagagcguggacuaa

SEQ ID NO: 25243 - RNA, 594 nt, Artificial Sequence
  TXN2__Homo_sapiens__XP_005261565
auguacgugccccccagaggcagcgacgacagaagagcccuggacagacagggcggccugggcugcgccagccugagaagccacugcagagagauggcccagagacugcugcugagaagauuccuggccagcgugaucagcagaaagcccagccagggccaguggcccccccugaccagcagagcccugcagaccccccagugcagccccggcggccugaccgugacccccaaccccgccagaaccaucuacaccaccagaaucagccugaccaccuucaacauccaggacggccccgacuuccaggacagaguggugaacagcgagacccccguggugguggacuuccacgcccaguggugcggccccugcaagauccugggccccagacuggagaagaugguggccaagcagcacggcaagguggugauggccaagguggacaucgacgaccacaccgaccuggccaucgaguacgaggugagcgccgugcccaccgugcuggccaugaagaacggcgacgugguggacaaguucgugggcaucaaggacgaggaccagcuggaggccuuccugaagaagcugaucggcuaa

SEQ ID NO: 25244 - RNA, 1083 nt, Artificial Sequence
  TXNDC15__Homo_sapiens__NP_078991
auggugcccgccgccggcagaagaccccccagagugaugagacugcugggcugguggcaggugcugcugugggugcugggccugcccgugagaggcguggagguggccgaggagagcggcagacuguggagcgaggagcagcccgcccacccccugcaggugggcgccguguaccugggcgaggaggagcugcugcacgaccccaugggccaggacagagccgccgaggaggccaacgccgugcugggccuggacacccagggcgaccacauggugaugcugagcgugauccccggcgaggccgaggacaaggugagcagcgagcccagcggcgugaccugcggcgccggcggcgccgaggacagcagaugcaacgugagagagagccuguucagccuggacggcgccggcgcccacuuccccgacagagaggaggaguacuacaccgagcccgagguggccgagagcgacgccgcccccaccgaggacagcaacaacaccgagagccugaagagccccaaggugaacugcgaggagagaaacaucaccggccuggagaacuucacccugaagauccugaacaugagccaggaccugauggacuuccugaaccccaacggcagcgacugcacccuggugcuguucuacacccccuggugcagauucagcgccagccuggccccccacuucaacagccugcccagagccuuccccgcccugcacuuccuggcccuggacgccagccagcacagcagccugagcaccagauucggcaccguggccgugcccaacauccugcuguuccagggcgccaagcccauggccagauucaaccacaccgacagaacccuggagacccugaagaucuucaucuucaaccagaccggcaucgaggccaagaagaacgugguggugacccaggccgaccagaucggcccccugcccagcacccugaucaagagcguggacuggcugcugguguucagccuguucuuccugaucagcuucaucauguacgccaccaucagaaccgagagcaucagauggcugauccccggccaggagcaggagcacguggaguaa

SEQ ID NO: 25245 - RNA, 2478 nt, Artificial Sequence
  TXNDC16__Homo_sapiens__NP_065835
auguucagcggcuucaacguguucagagugggcaucagcuucgugaucaugugcaucuucuacaugcccaccgugaacagccugcccgagcugagcccccagaaguacuucagcacccugcagcccggcaaggccagccuggccuacuucugccaggccgacagccccagaaccagcguguuccuggaggagcugaacgaggccgugagaccccugcaggacuacggcaucagcguggccaaggugaacugcgugaaggaggagaucagcagauacugcggcaaggagaaggaccugaugaaggccuaccuguucaagggcaacauccugcugagagaguuccccaccgacacccuguucgacgugaacgccaucguggcccacgugcuguucgcccugcuguucagcgaggugaaguacaucaccaaccuggaggaccugcagaacaucgagaacgcccugaagggcaaggccaacaucaucuucagcuacgugagagccaucggcauccccgagcacagagccgugauggaggccgccuucguguacggcaccaccuaccaguucgugcugaccaccgagaucgcccugcuggagagcaucggcagcgaggacguggaguacgcccaccuguacuucuuccacugcaagcuggugcuggaccugacccagcagugcagaagaacccugauggagcagccccugaccacccugaacauccaccuguucaucaagaccaugaaggccccccugcugaccgagguggccgaggacccccagcaggugagcaccgugcaccugcagcugggccugccccugguguucaucgugagccagcaggccaccuacgaggccgacagaagaaccgccgaguggguggccuggagacugcugggcaaggccggcgugcugcugcugcugagagacagccuggaggugaacaucccccaggacgccaacgugguguucaagagagccgaggagggcgugcccguggaguuccuggugcugcacgacguggaccugaucaucagccacguggagaacaacaugcacaucgaggagauccaggaggacgaggacaacgacauggagggccccgacaucgacgugcaggacgacgagguggccgagaccguguucagagacagaaagagaaagcugccccuggagcugaccguggagcugaccgaggagaccuucaacgccaccgugauggccagcgacagcaucgugcuguucuacgccggcuggcaggccgugagcauggccuuccugcagagcuacaucgacguggccgugaagcugaagggcaccagcaccaugcugcugaccagaaucaacugcgccgacuggagcgacgugugcaccaagcagaacgugaccgaguuccccaucaucaagauguacaagaagggcgagaaccccgugagcuacgccggcaugcugggcaccgaggaccugcugaaguucauccagcugaacagaaucagcuaccccgugaacaucaccagcauccaggaggccgaggaguaccugagcggcgagcuguacaaggaccugauccuguacagcagcgugagcgugcugggccuguucagccccaccaugaagaccgccaaggaggacuucagcgaggccggcaacuaccugaagggcuacgugaucaccggcaucuacagcgaggaggacgugcugcugcugagcaccaaguacgccgccagccugcccgcccugcugcuggccagacacaccgagggcaagaucgagagcaucccccuggccagcacccacgcccaggacaucgugcagaucaucaccgacgcccugcuggagauguuccccgagaucaccguggagaaccugcccagcuacuucagacugcagaagccccugcugauccuguucagcgacggcaccgugaacccccaguacaagaaggccauccugacccuggugaagcagaaguaccuggacagcuucacccccugcuggcugaaccugaagaacacccccgugggcagaggcauccugagagccuacuucgacccccugcccccccugccccugcuggugcuggugaaccugcacagcggcggccagguguucgccuuccccagcgaccaggccaucaucgaggagaaccuggugcuguggcugaagaagcuggaggccggccuggagaaccacaucaccauccugcccgcccaggaguggaagcccccccugcccgccuacgacuuccugagcaugaucgacgccgccaccagccagagaggcaccagaaaggugcccaagugcaugaaggagaccgacgugcaggagaacgacaaggagcagcacgaggacaagagcgccgugagaaaggagcccaucgagacccugagaaucaagcacuggaacagaagcaacugguucaaggaggccgagaagagcuucagaagagacaaggagcugggcugcagcaaggugaacuaa

SEQ ID NO: 25246 - RNA, 372 nt, Artificial Sequence
  TXNDC17__Homo_sapiens__NP_116120
auggccagauacgaggaggugagcgugagcggcuucgaggaguuccacagagccguggagcagcacaacggcaagaccaucuucgccuacuucaccggcagcaaggacgccggcggcaagagcuggugccccgacugcgugcaggccgagcccguggugagagagggccugaagcacaucagcgagggcugcguguucaucuacugccaggugggcgagaagcccuacuggaaggaccccaacaacgacuucagaaagaaccugaaggugaccgccgugcccacccugcugaaguacggcaccccccagaagcugguggagagcgagugccugcaggccaaccugguggagaugcuguucagcgaggacuaa

SEQ ID NO: 25247 - RNA, 975 nt, Artificial Sequence
  TXNDC5__Homo_sapiens__NP_001139021
auggaggacgccaagguguacguggccaagguggacugcaccgcccacagcgacgugugcagcgcccagggcgugagaggcuaccccacccugaagcuguucaagcccggccaggaggccgugaaguaccagggccccagagacuuccagacccuggagaacuggaugcugcagacccugaacgaggagcccgugacccccgagcccgagguggagccccccagcgcccccgagcugaagcagggccuguacgagcugagcgccagcaacuucgagcugcacguggcccagggcgaccacuucaucaaguucuucgcccccuggugcggccacugcaaggcccuggcccccaccugggagcagcuggcccugggccuggagcacagcgagaccgugaagaucggcaagguggacugcacccagcacuacgagcugugcagcggcaaccaggugagaggcuaccccacccugcugugguucagagacggcaagaagguggaccaguacaagggcaagagagaccuggagagccugagagaguacguggagagccagcugcagagaaccgagaccggcgccaccgagaccgugacccccagcgaggcccccgugcuggccgccgagcccgaggccgacaagggcaccgugcuggcccugaccgagaacaacuucgacgacaccaucgccgagggcaucaccuucaucaaguucuacgcccccuggugcggccacugcaagacccuggcccccaccugggaggagcugagcaagaaggaguuccccggccuggccggcgugaagaucgccgagguggacugcaccgccgagagaaacaucugcagcaaguacagcgugagaggcuaccccacccugcugcuguucagaggcggcaagaaggugagcgagcacagcggcggcagagaccuggacagccugcacagauucgugcugagccaggccaaggacgagcuguaa

SEQ ID NO: 25248 - RNA, 258 nt, Artificial Sequence
  TXN__Homo_sapiens__NP_001231867
auggugaagcagaucgagagcaagaccgccuuccaggaggcccuggacgccgccggcgacaagcugguggugguggacuucagcgccaccuggugcggccccugcaagaugaucaagcccuucuuccacgacguggccagcgagugcgaggugaagugcaugcccaccuuccaguucuucaagaagggccagaaggugggcgaguucagcggcgccaacaaggagaagcuggaggccaccaucaacgagcugguguaa

SEQ ID NO: 25249 - RNA, 870 nt, Artificial Sequence
  TXNL1__Homo_sapiens__NP_004777
auggugggcgugaagcccgugggcagcgaccccgacuuccagcccgagcugagcggcgccggcagcagacuggccguggugaaguucaccaugagaggcugcggccccugccugagaaucgcccccgccuucagcagcaugagcaacaaguacccccaggccguguuccuggagguggacgugcaccagugccagggcaccgccgccaccaacaacaucagcgccacccccaccuuccuguucuucagaaacaaggugagaaucgaccaguaccagggcgccgacgccgugggccuggaggagaagaucaagcagcaccuggagaacgaccccggcagcaacgaggacaccgacauccccaagggcuacauggaccugaugcccuucaucaacaaggccggcugcgagugccugaacgagagcgacgagcacggcuucgacaacugccugagaaaggacaccaccuuccuggagagcgacugcgacgagcagcugcugaucaccguggccuucaaccagcccgugaagcuguacagcaugaaguuccagggccccgacaacggccagggccccaaguacgugaagaucuucaucaaccugcccagaagcauggacuucgaggaggccgagagaagcgagcccacccaggcccuggagcugaccgaggacgacaucaaggaggacggcaucgugccccugagauacgugaaguuccagaacgugaacagcgugaccaucuucgugcagagcaaccagggcgaggaggagaccaccagaaucagcuacuucaccuucaucggcacccccgugcaggccaccaacaugaacgacuucaagagaguggugggcaagaagggcgagagccacuaa

SEQ ID NO: 25250 - RNA, 1017 nt, Artificial Sequence
  TXNRD2__Homo_sapiens__NP_001269441
auggccgccauggccguggcccugagaggccugggcggcagauucagauggagaacccaggccguggccggcggcgugagaggcgccgccagaggcgccgccgccggccagagagacuacgaccugcugguggugggcggcggcagcggcggccuggccugcgccaaggaggccgcccagcugggcagaaagguggccgugguggacuacguggagcccagcccccagggcaccagauggggccugggcggcaccugcgugaacgugggcugcauccccaagaagcugaugcaccaggccgcccugcugggcggccugauccaggacgcccccaacuacggcugggagguggcccagcccgugccccacgacuggagaaagauggccgaggccgugcagaaccacgugaagagccugaacuggggccacagagugcagcugcaggacagaaaggugaaguacuucaacaucaaggccagcuucguggacgagcacaccgugugcggcguggccaagggcggcaaggagauccugcugagcgccgaccacaucaucaucgccaccggcggcagacccagauaccccacccacaucgagggcgcccuggaguacggcaucaccagcgacgacaucuucuggcugaaggagagccccggcaagacccugguggugggcgccagcuacguggcccuggagugcgccggcuuccugaccggcaucggccuggacaccaccaucaugaugagaagcaucccccugagaggcuucgaccagcagaugagcagcauggugaucgagcacauggccagccacggcaccagauuccugagaggcugcgcccccagcagagugagaagacugcccgacggccagcugcaggugaccugggaggacagcaccaccggcaaggaggacaccggcaccuucgacaccgugcugugggccaucgcccccugcaucagcgccugccugcccaccaccgugggccacgccggcaagaaccagagaagagacuaa

SEQ ID NO: 25251 - RNA, 402 nt, Artificial Sequence
  TXNRD3NB__Homo_sapiens__NP_001034872
augagagaccugagcgagagaagacugggccagcccgagcugaaggccgagcagcagaugccccuggagcccgugagagccagacugagcgugggccuggccugcugcugcagccacaccaccgccgaggccagcagccuggagcacggcgacaagguguucggccagggcuuccccagcccccuggaggagaucaagagacugcugaagaucagcagagcccugcaggccagaagcgugcccagcacccaggagaaggccaagugccugagcggcgagcccggccagcccgagggcaagggccaggagaccuaccccggccccggcaagguggagggcaaggccgagcccgccaugagaaaggacgacgugugccccggcaugaagugcaucagcggcuaa

SEQ ID NO: 25252 - RNA, 3564 nt, Artificial Sequence
  TYK2__Homo_sapiens__XP_011526547
augccccugagacacuggggcauggccagaggcagcaagcccgugggcgacggcgcccagcccauggccgccaugggcggccugaaggugcugcugcacugggccggccccggcggcggcgagcccugggugaccuucagcgagagcagccugaccgccgaggaggugugcauccacaucgcccacaaggugggcaucaccccccccugcuucaaccuguucgcccuguucgacgcccaggcccagguguggcugccccccaaccacauccuggagauccccagagacgccagccugaugcuguacuucagaaucagauucuacuucagaaacuggcacggcaugaaccccagagagcccgccguguacagaugcggcccccccggcaccgaggccagcagcgaccagaccgcccagggcaugcagcugcuggaccccgccagcuucgaguaccuguucgagcagggcaagcacgaguucgugaacgacguggccagccugugggagcugagcaccgaggaggagauccaccacuucaagaacgagagccugggcauggccuuccugcaccugugccaccuggcccugagacacggcaucccccuggaggagguggccaagaagaccagcuucaaggacugcauccccagaagcuucagaagacacaucagacagcacagcgcccugaccagacugagacugagaaacguguucagaagauuccugagagacuuccagcccggcagacugagccagcagauggugauggugaaguaccuggccacccuggagagacuggcccccagauucggcaccgagagagugcccgugugccaccugagacugcuggcccaggccgagggcgagcccugcuacaucagagacagcggcguggcccccaccgaccccggccccgagagcgccgccggcccccccacccacgaggugcuggugaccggcaccggcggcauccagugguggcccguggaggaggaggugaacaaggaggagggcagcagcggcagcagcggcagaaacccccaggccagccuguucggcaagaaggccaaggcccacaaggccgugggccagcccgccgacagacccagagagccccugugggccuacuucugcgacuucagagacaucacccacguggugcugaaggagcacugcgugagcauccacagacaggacaacaagugccuggagcugagccugcccagcagagccgccgcccugagcuucgugagccugguggacggcuacuucagacugaccgccgacagcagccacuaccugugccacgagguggccccccccagacuggugaugagcaucagagacggcauccacggcccccugcuggagcccuucgugcaggccaagcugagacccgaggacggccuguaccugauccacuggagcaccagccaccccuacagacugauccugaccguggcccagagaagccaggcccccgacggcaugcagagccugagacugagaaaguuccccaucgagcagcaggacggcgccuucgugcuggagggcuggggcagaagcuuccccagcgugagagagcugggcgccgcccugcagggcugccugcugagagccggcgacgacugcuucagccugagaagaugcugccugccccagcccggcgagaccagcaaccugaucaucaugagaggcgccagagccagccccagaacccugaaccugagccagcugagcuuccacagaguggaccagaaggagaucacccagcugagccaccugggccagggcaccagaaccaacguguacgagggcagacugagaguggagggcagcggcgaccccgaggagggcaagauggacgacgaggacccccuggugcccggcagagacagaggccaggagcugagaguggugcugaaggugcuggaccccagccaccacgacaucgcccuggccuucuacgagaccgccagccugaugagccaggugagccacacccaccuggccuucgugcacggcgugugcgugagaggccccgagaacaucauggugaccgaguacguggagcacggcccccuggacguguggcugagaagagagagaggccacgugcccauggccuggaagauggugguggcccagcagcuggccagcgcccugagcuaccuggagaacaagaaccuggugcacggcaacgugugcggcagaaacauccugcuggccagacugggccuggccgagggcaccagccccuucaucaagcugagcgaccccggcgugggccugggcgcccugagcagagaggagagaguggagagaauccccuggcuggcccccgagugccugcccggcggcgccaacagccugagcaccgccauggacaaguggggcuucggcgccacccugcuggagaucugcuucgacggcgaggccccccugcagagcagaagccccagcgagaaggagcacuucuaccagagacagcacagacugcccgagcccagcugcccccagcuggccacccugaccagccagugccugaccuacgagcccacccagagacccagcuucagaaccauccugagagaccugaccagacugcagccccacaaccuggccgacgugcugaccgugaaccccgacagccccgccagcgaccccaccguguuccacaagagauaccugaagaagaucagagaccugggcgagggccacuucggcaaggugagccuguacugcuacgaccccaccaacgacggcaccggcgagaugguggccgugaaggcccugaaggccgacugcggcccccagcacagaagcggcuggaagcaggagaucgacauccugagaacccuguaccacgagcacaucaucaaguacaagggcugcugcgaggaccagggcgagaagagccugcagcuggugauggaguacgugccccugggcagccugagagacuaccugcccagacacagcaucggccuggcccagcugcugcuguucgcccagcagaucugcgagggcauggccuaccugcacgcccagcacuacauccacagagaccuggccgccagaaacgugcugcuggacaacgacagacuggugaagaucggcgacuucggccuggccaaggccgugcccgagggccacgaguacuacagagugagagaggacggcgacagccccguguucugguacgcccccgagugccugaaggaguacaaguucuacuacgccagcgacguguggagcuucggcgugacccuguacgagcugcugacccacugcgacagcagccagagcccccccaccaaguuccuggagcugaucggcaucgcccagggccagaugaccgugcugagacugaccgagcugcuggagagaggcgagagacugcccagacccgacaagugccccugcgagguguaccaccugaugaagaacugcugggagaccgaggccagcuucagacccaccuucgagaaccugauccccauccugaagaccgugcacgagaaguaccagggccaggcccccagcguguucagcgugugcuaa

SEQ ID NO: 25253 - RNA, 1449 nt, Artificial Sequence
  TYMP__Homo_sapiens__NP_001107227
auggccgcccugaugacccccggcaccggcgccccccccgcccccggcgacuucagcggcgagggcagccagggccugcccgaccccagccccgagcccaagcagcugcccgagcugaucagaaugaagagagacggcggcagacugagcgaggccgacaucagaggcuucguggccgccguggugaacggcagcgcccagggcgcccagaucggcgccaugcugauggccaucagacugagaggcauggaccuggaggagaccagcgugcugacccaggcccuggcccagagcggccagcagcuggaguggcccgaggccuggagacagcagcugguggacaagcacagcaccggcggcgugggcgacaaggugagccuggugcuggcccccgcccuggccgccugcggcugcaaggugcccaugaucagcggcagaggccugggccacaccggcggcacccuggacaagcuggagagcauccccggcuucaacgugauccagagccccgagcagaugcaggugcugcuggaccaggccggcugcugcaucgugggccagagcgagcagcuggugcccgccgacggcauccuguacgccgccagagacgugaccgccaccguggacagccugccccugaucaccgccagcauccugagcaagaagcugguggagggccugagcgcccuggugguggacgugaaguucggcggcgccgccguguuccccaaccaggagcaggccagagagcuggccaagacccuggugggcgugggcgccagccugggccugagaguggccgccgcccugaccgccauggacaagccccugggcagaugcgugggccacgcccuggagguggaggaggcccugcugugcauggacggcgccggcccccccgaccugagagaccuggugaccacccugggcggcgcccugcuguggcugagcggccacgccggcacccaggcccagggcgccgccagaguggccgccgcccuggacgacggcagcgcccugggcagauucgagagaaugcuggccgcccagggcguggaccccggccuggccagagcccugugcagcggcagccccgccgagagaagacagcugcugcccagagccagagagcaggaggagcugcuggcccccgccgacggcaccguggagcuggugagagcccugccccuggcccuggugcugcacgagcugggcgccggcagaagcagagccggcgagccccugagacugggcgugggcgccgagcugcugguggacgugggccagagacugagaagaggcacccccuggcugagagugcacagagacggccccgcccugagcggcccccagagcagagcccugcaggaggcccuggugcugagcgacagagcccccuucgccgcccccagccccuucgccgagcuggugcugcccccccagcaguaa

SEQ ID NO: 25254 - RNA, 942 nt, Artificial Sequence
  TYMS__Homo_sapiens__NP_001062
augcccguggccggcagcgagcugcccagaagaccccugccccccgccgcccaggagagagacgccgagcccagacccccccacggcgagcugcaguaccugggccagauccagcacauccugagaugcggcgugagaaaggacgacagaaccggcaccggcacccugagcguguucggcaugcaggccagauacagccugagagacgaguucccccugcugaccaccaagagaguguucuggaagggcgugcuggaggagcugcugugguucaucaagggcagcaccaacgccaaggagcugagcagcaagggcgugaagaucugggacgccaacggcagcagagacuuccuggacagccugggcuucagcaccagagaggagggcgaccugggccccguguacggcuuccaguggagacacuucggcgccgaguacagagacauggagagcgacuacagcggccagggcguggaccagcugcagagagugaucgacaccaucaagaccaaccccgacgacagaagaaucaucaugugcgccuggaaccccagagaccugccccugauggcccugccccccugccacgcccugugccaguucuacguggugaacagcgagcugagcugccagcuguaccagagaagcggcgacaugggccugggcgugcccuucaacaucgccagcuacgcccugcugaccuacaugaucgcccacaucaccggccugaagcccggcgacuucauccacacccugggcgacgcccacaucuaccugaaccacaucgagccccugaagauccagcugcagagagagcccagacccuuccccaagcugagaauccugagaaagguggagaagaucgacgacuucaaggccgaggacuuccagaucgagggcuacaacccccaccccaccaucaagauggagauggccguguaa

SEQ ID NO: 25255 - RNA, 1590 nt, Artificial Sequence
  TYR__Homo_sapiens__NP_000363
augcugcuggccgugcuguacugccugcuguggagcuuccagaccagcgccggccacuuccccagagccugcgugagcagcaagaaccugauggagaaggagugcugcccccccuggagcggcgacagaagccccugcggccagcugagcggcagaggcagcugccagaacauccugcugagcaacgccccccugggcccccaguuccccuucaccggcguggacgacagagagagcuggcccagcguguucuacaacagaaccugccagugcagcggcaacuucaugggcuucaacugcggcaacugcaaguucggcuucuggggccccaacugcaccgagagaagacugcuggugagaagaaacaucuucgaccugagcgcccccgagaaggacaaguucuucgccuaccugacccuggccaagcacaccaucagcagcgacuacgugauccccaucggcaccuacggccagaugaagaacggcagcacccccauguucaacgacaucaacaucuacgaccuguucguguggaugcacuacuacgugagcauggacgcccugcugggcggcagcgagaucuggagagacaucgacuucgcccacgaggcccccgccuuccugcccuggcacagacuguuccugcugagaugggagcaggagauccagaagcugaccggcgacgagaacuucaccauccccuacugggacuggagagacgccgagaagugcgacaucugcaccgacgaguacaugggcggccagcaccccaccaaccccaaccugcugagccccgccagcuucuucagcagcuggcagaucgugugcagcagacuggaggaguacaacagccaccagagccugugcaacggcacccccgagggcccccugagaagaaaccccggcaaccacgacaagagcagaacccccagacugcccagcagcgccgacguggaguucugccugagccugacccaguacgagagcggcagcauggacaaggccgccaacuucagcuucagaaacacccuggagggcuucgccagcccccugaccggcaucgccgacgccagccagagcagcaugcacaacgcccugcacaucuacaugaacggcaccaugagccaggugcagggcagcgccaacgaccccaucuuccugcugcaccacgccuucguggacagcaucuucgagcaguggcugagaagacacagaccccugcaggagguguaccccgaggccaacgcccccaucggccacaacagagagagcuacauggugcccuucaucccccuguacagaaacggcgacuucuucaucagcagcaaggaccugggcuacgacuacagcuaccugcaggacagcgaccccgacagcuuccaggacuacaucaagagcuaccuggagcaggccagcagaaucuggagcuggcugcugggcgccgccauggugggcgccgugcugaccgcccugcuggccggccuggugagccugcugugcagacacaagagaaagcagcugcccgaggagaagcagccccugcugauggagaaggaggacuaccacagccuguaccagagccaccuguaa

SEQ ID NO: 25256 - RNA, 2673 nt, Artificial Sequence
  TYRO3__Homo_sapiens__NP_006284
auggcccugagaagaagcaugggcagacccggccugcccccccugccccugccccccccccccagacugggccugcugcuggccgcccuggccagccugcugcugcccgagagcgccgccgccggccugaagcugaugggcgcccccgugaagcugaccgugagccagggccagcccgugaagcugaacugcagcguggagggcauggaggagcccgacauccagugggugaaggacggcgccguggugcagaaccuggaccagcuguacauccccgugagcgagcagcacuggaucggcuuccugagccugaagagcguggagagaagcgacgccggcagauacuggugccagguggaggacggcggcgagaccgagaucagccagcccguguggcugaccguggagggcgugcccuucuucaccguggagcccaaggaccuggccgugccccccaacgcccccuuccagcugagcugcgaggccgugggcccccccgagcccgugaccaucgugugguggagaggcaccaccaagaucggcggccccgcccccagccccagcgugcugaacgugaccggcgugacccagagcaccauguucagcugcgaggcccacaaccugaagggccuggccagcagcagaaccgccaccgugcaccugcaggcccugcccgccgcccccuucaacaucaccgugaccaagcugagcagcagcaacgccagcguggccuggaugcccggcgccgacggcagagcccugcugcagagcugcaccgugcaggugacccaggcccccggcggcugggaggugcuggccgugguggugcccgugccccccuucaccugccugcugagagaccuggugcccgccaccaacuacagccugagagugagaugcgccaacgcccugggccccagccccuacgccgacugggugcccuuccagaccaagggccuggcccccgccagcgccccccagaaccugcacgccaucagaaccgacagcggccugauccuggagugggaggaggugauccccgaggccccccuggagggcccccugggccccuacaagcugagcugggugcaggacaacggcacccaggacgagcugaccguggagggcaccagagccaaccugaccggcugggacccccagaaggaccugaucgugagagugugcgugagcaacgccgugggcugcggccccuggagccagccccugguggugagcagccacgacagagccggccagcagggccccccccacagcagaaccagcugggugcccguggugcugggcgugcugaccgcccuggugaccgccgccgcccuggcccugauccugcugagaaagagaagaaaggagaccagauucggccaggccuucgacagcgugauggccagaggcgagcccgccgugcacuucagagccgccagaagcuucaacagagagagacccgagagaaucgaggccacccuggacagccugggcaucagcgacgagcugaaggagaagcuggaggacgugcugauccccgagcagcaguucacccugggcagaaugcugggcaagggcgaguucggcagcgugagagaggcccagcugaagcaggaggacggcagcuucgugaagguggccgugaagaugcugaaggccgacaucaucgccagcagcgacaucgaggaguuccugagagaggccgccugcaugaaggaguucgaccacccccacguggccaagcuggugggcgugagccugagaagcagagccaagggcagacugcccauccccauggugauccugcccuucaugaagcacggcgaccugcacgccuuccugcuggccagcagaaucggcgagaaccccuucaaccugccccugcagacccugaucagauucaugguggacaucgccugcggcauggaguaccugagcagcagaaacuucauccacagagaccuggccgccagaaacugcaugcuggccgaggacaugaccgugugcguggccgacuucggccugagcagaaagaucuacagcggcgacuacuacagacagggcugcgccagcaagcugcccgugaaguggcuggcccuggagagccuggccgacaaccuguacaccgugcagagcgacgugugggccuucggcgugaccaugugggagaucaugaccagaggccagacccccuacgccggcaucgagaacgccgagaucuacaacuaccugaucggcggcaacagacugaagcagccccccgagugcauggaggacguguacgaccugauguaccagugcuggagcgccgaccccaagcagagacccagcuucaccugccugagaauggagcuggagaacauccugggccagcugagcgugcugagcgccagccaggacccccuguacaucaacaucgagagagccgaggagcccaccgccggcggcagccuggagcugcccggcagagaccagcccuacagcggcgccggcgacggcagcggcaugggcgccgugggcggcacccccagcgacugcagauacauccugacccccggcggccuggccgagcagcccggccaggccgagcaccagcccgagagcccccugaacgagacccagagacugcugcugcugcagcagggccugcugccccacagcagcugcuaa

SEQ ID NO: 25257 - RNA, 309 nt, Artificial Sequence
  TYROBP__Homo_sapiens__NP_001166985
augggcggccuggagcccugcagcagacugcugcugcugccccugcugcuggccgugagcgacugcagcugcagcaccgugagccccggcgugcuggccggcaucgugaugggcgaccuggugcugaccgugcugaucgcccuggccguguacuuccugggcagacuggugcccagaggcagaggcgccgccgaggccgccaccagaaagcagagaaucaccgagaccgagagccccuaccaggagcugcagggccagagaagcgacguguacagcgaccugaacacccagagacccuacuacaaguaa

SEQ ID NO: 25258 - RNA, 1614 nt, Artificial Sequence
  TYRP1__Homo_sapiens__NP_000541
augagcgcccccaagcugcugagccugggcugcaucuucuucccccugcugcuguuccagcaggccagagcccaguuccccagacagugcgccaccguggaggcccugagaagcggcaugugcugccccgaccugagccccgugagcggccccggcaccgacagaugcggcagcagcagcggcagaggcagaugcgaggccgugaccgccgacagcagaccccacagcccccaguacccccacgacggcagagacgacagagagguguggccccugagauucuucaacagaaccugccacugcaacggcaacuucagcggccacaacugcggcaccugcagacccggcuggagaggcgccgccugcgaccagagagugcugaucgugagaagaaaccugcuggaccugagcaaggaggagaagaaccacuucgugagagcccuggacauggccaagagaaccacccacccccuguucgugaucgccaccagaagaagcgaggagauccugggccccgacggcaacaccccccaguucgagaacaucagcaucuacaacuacuucguguggacccacuacuacagcgugaagaagaccuuccugggcgugggccaggagagcuucggcgagguggacuucagccacgagggccccgccuuccugaccuggcacagauaccaccugcugagacuggagaaggacaugcaggagaugcugcaggagcccagcuucagccugcccuacuggaacuucgccaccggcaagaacgugugcgacaucugcaccgacgaccugaugggcagcagaagcaacuucgacagcacccugaucagccccaacagcguguucagccaguggagaguggugugcgacagccuggaggacuacgacacccugggcacccugugcaacagcaccgaggacggccccaucagaagaaaccccgccggcaacguggccagacccauggugcagagacugcccgagccccaggacguggcccagugccuggaggugggccuguucgacaccccccccuucuacagcaacagcaccaacagcuucagaaacaccguggagggcuacagcgaccccaccggcaaguacgaccccgccgugagaagccugcacaaccuggcccaccuguuccugaacggcaccggcggccagacccaccugagccccaacgaccccaucuucgugcugcugcacaccuucaccgacgccguguucgacgaguggcugagaagauacaacgccgacaucagcaccuucccccuggagaacgcccccaucggccacaacagacaguacaacauggugcccuucuggccccccgugaccaacaccgagauguucgugaccgcccccgacaaccugggcuacaccuacgagauccaguggcccagcagagaguucagcgugcccgagaucaucgccaucgccguggugggcgcccugcugcugguggcccugaucuucggcaccgccagcuaccugaucagagccagaagaagcauggacgaggccaaccagccccugcugaccgaccaguaccagugcuacgccgaggaguacgagaagcugcagaaccccaaccagagcgugguguaa

SEQ ID NO: 25259 - RNA, 1197 nt, Artificial Sequence
  TYSND1__Homo_sapiens__NP_001035363
augagaagacaguggggcagcgccaugagagccgccgagcaggccggcugcauggugagcgccagcagagccggccagcccgaggccggccccuggagcugcagcggcgugauccugagcagaagccccggccuggugcugugccacggcggcaucuucgugcccuuccugagagccggcagcgaggugcugaccgccgccggcgccguguuccugcccggcgacagcugcagagacgaccugagacugcacgugcagugggcccccaccgccgccggccccggcggcggcgccgagagaggcagacccggccugugcaccccccagugcgccagccuggagcccggcccccccgcccccagcagaggcagaccccugcagcccagacugcccgccgagcugcugcugcugcugagcugccccgccuucugggcccacuucgccagacuguucggcgacgaggccgccgagcaguggagauucagcagcgccgccagagacgacgaggugagcgaggacgaggaggccgaccagcugagagcccugggcugguucgcccugcugggcgugagacugggccaggaggagguggaggaggagagaggccccgccauggccgugagcccccugggcgccgugcccaagggcgccccccugcuggugugcggcagccccuucggcgccuucugccccgacaucuuccugaacacccugagcugcggcgugcugagcaacguggccggcccccugcugcugaccgacgccagaugccugcccggcaccgagggcggcggcguguucaccgccagacccgccggcgcccugguggcccuggugguggccccccugugcuggaaggccggcgagugggugggcuucacccugcugugcgccgccgccccccuguucagagccgccagagacgcccugcacagacugccccacagcaccgccgcccuggccgcccugcugccccccgaggugggcgugcccuggggccugccccugagagacagcggcccccugugggccgccgccgccgugcugguggagugcggcaccguguggggcagcggcguggccguggcccccagacugguggugaccugcagacacgugagccccagagaggccgccagagugcuggugagaagcaccacccccaagcacaaccaccagcagcaccccggccaguaa

SEQ ID NO: 25260 - RNA, 1833 nt, Artificial Sequence
  TYW1B__Homo_sapiens__XP_011514532
auggaccccagcgccgacaccugggaccugagcagcccccugaucagccuguggaucaacagauucuacaucuaccugggcuucgccgugagcaucagccuguggaucugcgugcagaucgugaucgagaugcagggcuucgccaccgugcuggccgaggccgugaccagccuggaccugcccguggccaucaucaaccugaaggaguacgaccccgacgaccaccugaucgaggaggugaccagcaagaacgugugcguguuccugguggccaccuacaccgacggccugcccaccgagagcgccgagugguucugcaaguggcuggaggaggccagcaucgacuucagauucggcaagaccuaccugaagggcaugagagacgccguguucggccugggcaacagcgccuacgccagccacuucaacaaggugggcaagaacguggacaaguggcuguggaugcugggcgugcacagagugaugagcagaggcgagggcgacugcgacguggugaagagcaagcacggcagcaucgaggccaacuucagagccuggaagaccaaguucaucagccagcugcaggcccugcagaagggcgagagaaagaagagcugcggcggccacugcaagaagggcaagugcgagagccaccagcacggcagcgaggagagagaggagggcagccaggagcaggacgagcugcaccacagagacaccaaggaggaggagcccuucgagagcagcagcgaggaggaguucggcggcgaggaccaccagagccugaacagcaucguggacguggaggaccugggcaagaucauggaccacgugaagaaggagaagagagagaaggagcagcaggaggagaagagcggccuguucagaaacaugggcagaaacgaggacggcgagagaagagccaugaucacccccgcccugagagaggcccugaccaagcagguggacgcccccagagagagaagccugcugcagacccacauccuguggaacgagagccacagaugcauggagaccacccccagccuggccugcgccaacaagugcguguucugcugguggcaccacaacaaccccgugggcaccgaguggcuguggaagauggaccagcccgagaugauccugaaggaggccaucgagaaccaccagaacaugaucaagcaguucaagggcgugcccggcgugaaggccgagagauucgaggagggcaugaccgugaagcacugcgcccugagccuggugggcgagcccaucauguaccccgagaucaacagauuccugaagcugcugcaccagugcaagaucagcagcuuccuggugaccaacgcccaguuccccgccgagaucagaaaccuggagcccgugacccagcuguacgugagcguggacgccagcaccaaggacagccugaagaagaucgacagaccccuguucaaggacuucuggcagcaguuccuggacagccugaaggcccuggccgugaagcagcagagaaccguguacagacugaugcuggugaaggccuggaacguggacgagcugcaggccuacgcccagcuggugagccugggcaaccccgacuucaucgaggugaagggcgugaccuacugcagagagagcagcgccagcagccugaccauggcccacgugcccuggcacgaggagguggugcaguucgugagagagcugguggaccugauccccgaguacgagaucgccugcgagcacgagcacagcaacugccugcugaucgcccacagaaaggaccugggcagacugcccagagccgaggacgagggccacgugagcuaa

SEQ ID NO: 25261 - RNA, 504 nt, Artificial Sequence
  U2AF1__Homo_sapiens__NP_001020375
augcaggagcacuacgacgaguucuucgaggagguguucaccgagauggaggagaaguacggcgagguggaggagaugaacgugugcgacaaccugggcgaccaccuggugggcaacguguacgugaaguucagaagagaggaggacgccgagaaggccgugaucgaccugaacaacagaugguucaacggccagcccauccacgccgagcugagccccgugaccgacuucagagaggccugcugcagacaguacgagaugggcgagugcaccagaggcggcuucugcaacuucaugcaccugaagcccaucagcagagagcugagaagagagcuguacggcagaagaagaaagaagcacagaagcagaagcagaagcagagagagaagaagcagaagcagagacagaggcagaggcggcggcggcggcggcggcggcggcggcggcggcagagagagagacagaagaagaagcagagacagagagagaagcggcagauucuaa

SEQ ID NO: 25262 - RNA, 1416 nt, Artificial Sequence
  U2AF2__Homo_sapiens__NP_001012496
augagcgacuucgacgaguucgagagacagcugaacgagaacaagcaggagagagacaaggagaacagacacagaaagagaagccacagcagaagcagaagcagagacagaaagagaagaagcagaagcagagacagaagaaacagagaccagagaagcgccagcagagacagaagaagaagaagcaagccccugaccagaggcgccaaggaggagcacggcggccugaucagaagccccagacacgagaagaagaagaaggugagaaaguacugggacgugcccccccccggcuucgagcacaucacccccaugcaguacaaggccaugcaggccgccggccagauccccgccaccgcccugcugcccaccaugacccccgacggccuggccgugacccccacccccgugcccguggugggcagccagaugaccagacaggccagaagacuguacgugggcaacauccccuucggcaucaccgaggaggccaugauggacuucuucaacgcccagaugagacugggcggccugacccaggcccccggcaaccccgugcuggccgugcagaucaaccaggacaagaacuucgccuuccuggaguucagaagcguggacgagaccacccaggccauggccuucgacggcaucaucuuccagggccagagccugaagaucagaagaccccacgacuaccagccccugcccggcaugagcgagaaccccagcguguacgugcccggcguggugagcaccguggugcccgacagcgcccacaagcuguucaucggcggccugcccaacuaccugaacgacgaccaggugaaggagcugcugaccagcuucggcccccugaaggccuucaaccuggugaaggacagcgccaccggccugagcaagggcuacgccuucugcgaguacguggacaucaacgugaccgaccaggccaucgccggccugaacggcaugcagcugggcgacaagaagcugcuggugcagagagccagcgugggcgccaagaacgccacccugagcaccaucaaccagacccccgugacccugcaggugcccggccugaugagcagccaggugcagaugggcggccaccccaccgaggugcugugccugaugaacauggugcugcccgaggagcugcuggacgacgaggaguacgaggagaucguggaggacgugagagacgagugcagcaaguacggccuggugaagagcaucgagauccccagacccguggacggcguggaggugcccggcugcggcaagaucuucguggaguucaccagcguguucgacugccagaaggccaugcagggccugaccggcagaaaguucgccaacagagugguggugaccaaguacugcgaccccgacagcuaccacagaagagacuucugguaa

SEQ ID NO: 25263 - RNA, 4212 nt, Artificial Sequence
  UACA__Homo_sapiens__NP_001008225
augaugaacugcugguucagcugcacccccaagaacagacacgccgccgacuggaacaaguacgacgacagacugaugaaggccgccgagagaggcgacguggagaaggugaccagcauccuggccaagaagggcgugaaccccggcaagcuggacguggagggcagaagcguguuccacguggugaccagcaagggcaaccuggagugccugaacgccauccugauccacggcguggacaucaccaccagcgacaccgccggcagaaacgcccugcaccuggccgccaaguacggccacgcccugugccugcagaagcugcugcaguacaacugccccaccgagcacgccgaccugcagggcagaaccgcccugcacgacgccgccauggccgacugccccagcagcauccagcugcugugcgaccacggcgccagcgugaacgccaaggacguggacggcagaaccccccuggugcuggccacccagaugagcagacccaccaucugccagcugcugaucgacagaggcgccgacgugaacagcagagacaagcagaacagaaccgcccugaugcugggcugcgaguacggcugcagagacgccguggaggugcugaucaagaacggcgccgacaucagccugcuggacgcccugggccacgacagcagcuacuacgccagaaucggcgacaaccuggacauccugacccugcugaagaccgccagcgagaacaccaacaagggcagagagcuguggaagaagggccccagccugcagcagagaaaccugacccacaugcaggacgaggugaacgugaagagccaccagagagagcaccagaacauccaggaccuggagaucgagaacgaggaccugaaggagagacugagaaagauccagcaggagcagagaauccugcuggacaaggugaacggccugcagcugcagcugaacgaggaggugaugguggccgacgaccuggagagcgagagagagaagcugaagagccugcuggccgccaaggagaagcagcacgaggagagccugagaaccaucgaggcccugaagaacagauucaaguacuucgagagcgaccaccugggcagcggcagccacuucagcaacagaaaggaggacaugcugcugaagcagggccagauguacauggccgacagccagugcaccagccccggcauccccgcccacaugcagagcagaagcaugcugagaccccuggagcugagccugcccagccagaccagcuacagcgagaacgagauccugaagaaggagcuggaggccaugagaaccuucugcgagagcgccaagcaggacagacugaagcugcagaacgagcuggcccacaagguggccgagugcaaggcccuggcccuggagugcgagagagugaaggaggacagcgacgagcagaucaagcagcuggaggacgcccugaaggacgugcagaagagaauguacgagagcgagggcaaggugaagcagaugcagacccacuuccuggcccugaaggagcaccugaccagcgaggccgccagcggcaaccacagacugaccgaggagcugaaggaccagcugaaggaccugaaggugaaguacgagggcgccagcgccgaggugggcaagcugagaaaccagaucaagcagaacgagaugaucguggaggaguucaagagagacgagggcaagcugaucgaggagaacaagagacugcagaaggagcugagcaugugcgagauggagagagagaagaagggcagaaaggugaccgagauggagggccaggccaaggagcugagcgccaagcuggcccugagcauccccgccgagaaguucgagaacaugaagagcagccugagcaacgaggugaacgagaaggccaagaagcugguggagauggagagagagcacgagaagagccugagcgagaucagacagcugaagagagagcuggagaacgugaaggccaagcuggcccagcacgugaagcccgaggagcacgagcaggugaagagcagacuggagcagaagagcggcgagcugggcaagaagaucaccgagcugacccugaagaaccagacccugcagaaggagaucgagaagguguaccuggacaacaagcugcugaaggagcaggcccacaaccugaccaucgagaugaagaaccacuacgugccccugaaggugagcgaggacaugaagaagagccacgacgccaucaucgacgaccugaacagaaagcugcuggacgugacccagaaguacaccgagaagaagcuggagauggagaagcugcugcuggagaacgacagccugagcaaggacgugagcagacuggagaccguguucgugccccccgagaagcacgagaaggagaucaucgcccugaagagcaacaucguggagcugaagaagcagcugagcgagcugaagaagaagugcggcgaggaccaggagaagauccacgcccugaccagcgagaacaccaaccugaagaagaugaugagcaaccaguacgugcccgugaagacccacgaggaggugaagaugacccugaacgacacccuggccaagaccaacagagagcugcuggacgugaagaagaaguucgaggacaucaaccaggaguucgugaagaucaaggacaagaacgagauccugaagagaaaccuggagaacacccagaaccagaucaaggccgaguacaucagccuggccgagcacgaggccaagaugagcagccugagccagagcaugagaaaggugcaggacagcaacgccgagauccuggccaacuacagaaagggccaggaggagaucgugacccugcacgccgagaucaaggcccagaagaaggagcuggacaccauccaggagugcaucaaggugaaguacgcccccaucgugagcuucgaggagugcgagagaaaguucaaggccaccgagaaggagcugaaggaccagcugagcgagcagacccagaaguacagcgugagcgaggaggaggugaagaagaacaagcaggagaacgacaagcugaagaaggagaucuucacccugcagaaggaccugagagacaagaccgugcugaucgagaagagccacgagauggagagagcccugagcagaaagaccgacgagcugaacaagcagcugaaggaccugagccagaaguacaccgaggugaagaacgugaaggagaagcugguggaggagaacgccaagcagaccagcgagauccuggccgugcagaaccugcugcagaagcagcacgugccccuggagcagguggaggcccugaagaagagccugaacggcaccaucgagaaccugaaggaggagcugaagagcaugcagagaugcuacgagaaggagcagcagaccgugaccaagcugcaccagcugcuggagaaccagaagaacagcagcgugccccuggccgagcaccugcagaucaaggaggccuucgagaaggaggugggcaucaucaaggccagccugagagagaaggaggaggagagccagaacaagauggaggaggugagcaagcugcagagcgaggugcagaacaccaagcaggcccugaagaagcuggagaccagagaggugguggaccugagcaaguacaaggccaccaagagcgaccuggagacccagaucagcagccugaacgagaagcuggccaaccugaacagaaaguacgaggaggugugcgaggaggugcugcacgccaagaagaaggagaucagcgccaaggacgagaaggagcugcugcacuucagcaucgagcaggagaucaaggaccagaaggagagaugcgacaagagccugaccaccaucaccgagcugcagagaagaauccaggagagcgccaagcagaucgaggccaaggacaacaagaucaccgagcugcugaacgacguggagagacugaagcaggcccugaacggccugagccagcugaccuacaccagcggcaaccccaccaagagacagagccagcugaucgacacccugcagcaccaggugaagagccuggagcagcagcuggccgacgccgacagacagcaccaggaggugaucgccaucuacagaacccaccugcugagcgccgcccagggccacauggacgaggacgugcaggaggcccugcugcagaucauccagaugagacagggccuggugugcuaa

SEQ ID NO: 25264 - RNA, 1518 nt, Artificial Sequence
  UAP1__Homo_sapiens__NP_003106
augaacaucaacgaccugaagcugacccugagcaaggccggccaggagcaccugcugagauucuggaacgagcuggaggaggcccagcagguggagcuguacgccgagcugcaggccaugaacuucgaggagcugaacuucuucuuccagaaggccaucgagggcuucaaccagagcagccaccagaagaacguggacgccagaauggagcccgugcccagagaggugcugggcagcgccaccagagaccaggaccagcugcaggccugggagagcgagggccuguuccagaucagccagaacaagguggccgugcugcugcuggccggcggccagggcaccagacugggcguggccuaccccaagggcauguacgacgugggccugcccagcagaaagacccuguuccagauccaggccgagagaauccugaagcugcagcagguggccgagaaguacuacggcaacaagugcaucauccccugguacaucaugaccagcggcagaaccauggagagcaccaaggaguucuucaccaagcacaaguacuucggccugaagaaggagaacgugaucuucuuccagcagggcaugcugcccgccaugagcuucgacggcaagaucauccuggaggagaagaacaaggugagcauggcccccgacggcaacggcggccuguacagagcccuggccgcccagaacaucguggaggacauggagcagagaggcaucuggagcauccacguguacugcguggacaacauccuggugaagguggccgaccccagauucaucggcuucugcauccagaagggcgccgacugcggcgccaaggugguggagaagaccaaccccaccgagcccgugggcguggugugcagaguggacggcguguaccaggugguggaguacagcgagaucagccuggccaccgcccagaagagaagcagcgacggcagacugcuguucaacgccggcaacaucgccaaccacuucuucaccgugcccuuccugagagacguggugaacguguacgagccccagcugcagcaccacguggcccagaagaagauccccuacguggacacccagggccagcugaucaagcccgacaagcccaacggcaucaagauggagaaguucguguucgacaucuuccaguucgccaagaaguucgugguguacgaggugcugagagaggacgaguucagcccccugaagaacgccgacagccagaacggcaaggacaaccccaccaccgccagacacgcccugaugagccugcaccacugcugggugcugaacgccggcggccacuucaucgacgagaacggcagcagacugcccgccauccccagacugaaggacgccaacgacgugcccauccagugcgagaucagcccccugaucagcuacgccggcgagggccuggagagcuacguggccgacaaggaguuccacgccccccugaucaucgacgagaacggcgugcacgagcuggugaagaacggcaucuaa

SEQ ID NO: 25265 - RNA, 3261 nt, Artificial Sequence
  UBA1__Homo_sapiens__XP_011542255
augcugacccuggagaaccugcaguucggcgacagcggcagcaugcugugcgugaucuaccaccuggacaaccccgugggcaagaugagcagcagcccccugagcaagaagagaagagugagcggccccgaccccaagcccggcagcaacugcagccccgcccagagcgugcugagcgaggugcccagcgugcccaccaacggcauggccaagaacggcagcgaggccgacaucgacgagggccuguacagcagacagcuguacgugcugggccacgaggccaugaagagacugcagaccagcagcgugcuggugagcggccugagaggccugggcguggagaucgccaagaacaucauccugggcggcgugaaggccgugacccugcacgaccagggcaccgcccagugggccgaccugagcagccaguucuaccugagagaggaggacaucggcaagaacagagccgaggugagccagcccagacuggccgagcugaacagcuacgugcccgugaccgccuacaccggcccccugguggaggacuuccugagcggcuuccaggugguggugcugaccaacaccccccuggaggaccagcugagagugggcgaguucugccacaacagaggcaucaagcuggugguggccgacaccagaggccuguucggccagcuguucugcgacuucggcgaggagaugauccugaccgacagcaacggcgagcagccccugagcgccauggugagcauggugaccaaggacaaccccggcguggugaccugccuggacgaggccagacacggcuucgagagcggcgacuucgugagcuucagcgaggugcagggcaugguggagcugaacggcaaccagcccauggagaucaaggugcugggccccuacaccuucagcaucugcgacaccagcaacuucagcgacuacaucagaggcggcaucgugagccaggugaaggugcccaagaagaucagcuucaagagccugguggccagccuggccgagcccgacuucguggugaccgacuucgccaaguucagcagacccgcccagcugcacaucggcuuccaggcccugcaccaguucugcgcccagcacggcagaccccccagacccagaaacgaggaggacgccgccgagcugguggcccuggcccaggccgugaacgccagagcccugcccgccgugcagcagaacaaccuggacgaggaccugaucagaaagcuggccuacguggccgccggcgaccuggcccccaucaacgccuucaucggcggccuggccgcccaggaggugaugaaggccugcagcggcaaguucaugcccaucaugcaguggcuguacuucgacgcccuggagugccugcccgaggacaaggaggugcugaccgaggacaagugccugcagagacagaacagauacgacggccagguggccguguucggcagcgaccugcaggagaagcugggcaagcagaaguacuuccuggugggcgccggcgccaucggcugcgagcugcugaagaacuucgccaugaucggccugggcugcggcgagggcggcgagaucaucgugaccgacauggacaccaucgagaagagcaaccugaacagacaguuccuguucagacccugggacgugaccaagcugaagagcgacaccgccgccgccgccgugagacagaugaacccccacaucagagugaccagccaccagaacagagugggccccgacaccgagagaaucuacgacgacgacuucuuccagaaccuggacggcguggccaacgcccuggacaacguggacgccagaauguacauggacagaagaugcguguacuacagaaagccccugcuggagagcggcacccugggcaccaagggcaacgugcagguggugauccccuuccugaccgagagcuacagcagcagccaggacccccccgagaagagcauccccaucugcacccugaagaacuuccccaacgccaucgagcacacccugcagugggccagagacgaguucgagggccuguucaagcagcccgccgagaacgugaaccaguaccugaccgaccccaaguucguggagagaacccugagacuggccggcacccagccccuggaggugcuggaggccgugcagagaagccuggugcugcagagaccccagaccugggccgacugcgugaccugggccugccaccacuggcacacccaguacagcaacaacaucagacagcugcugcacaacuucccccccgaccagcugaccagcagcggcgcccccuucuggagcggccccaagagaugcccccacccccugaccuucgacgugaacaacccccugcaccuggacuacgugauggccgccgccaaccuguucgcccagaccuacggccugaccggcagccaggacagagccgccguggccaccuuccugcagagcgugcaggugcccgaguucacccccaagagcggcgugaagauccacgugagcgaccaggagcugcagagcgccaacgccagcguggacgacagcagacuggaggagcugaaggccacccugcccagccccgacaagcugcccggcuucaagauguaccccaucgacuucgagaaggacgacgacagcaacuuccacauggacuucaucguggccgccagcaaccugagagccgagaacuacgacauccccagcgccgacagacacaagagcaagcugaucgccggcaagaucauccccgccaucgccaccaccaccgccgccguggugggccuggugugccuggagcuguacaagguggugcagggccacagacagcuggacagcuacaagaacggcuuccugaaccuggcccugcccuucuucggcuucagcgagccccuggccgcccccagacaccaguacuacaaccaggaguggacccugugggacagauucgaggugcagggccugcagcccaacggcgaggagaugacccugaagcaguuccuggacuacuucaagaccgagcacaagcuggagaucaccaugcugagccagggcgugagcaugcuguacagcuucuucaugcccgccgccaagcugaaggagagacuggaccagcccaugaccgagaucgugagcagagugagcaagagaaagcugggcagacacgugagagcccuggugcuggagcugugcugcaacgacgagagcggcgaggacguggaggugcccuacgugagauacaccaucagauaa

SEQ ID NO: 25266 - RNA, 1923 nt, Artificial Sequence
  UBA2__Homo_sapiens__NP_005490
auggcccugagcagaggccugcccagagagcuggccgaggccguggccggcggcagagugcugguggugggcgccggcggcaucggcugcgagcugcugaagaaccuggugcugaccggcuucagccacaucgaccugaucgaccuggacaccaucgacgugagcaaccugaacagacaguuccuguuccagaagaagcacgugggcagaagcaaggcccagguggccaaggagagcgugcugcaguucuaccccaaggccaacaucguggccuaccacgacagcaucaugaaccccgacuacaacguggaguucuucagacaguucauccuggugaugaacgcccuggacaacagagccgccagaaaccacgugaacagaaugugccuggccgccgacgugccccugaucgagagcggcaccgccggcuaccugggccaggugaccaccaucaagaagggcgugaccgagugcuacgagugccaccccaagcccacccagagaaccuuccccggcugcaccaucagaaacacccccagcgagcccauccacugcaucgugugggccaaguaccuguucaaccagcuguucggcgaggaggacgccgaccaggaggugagccccgacagagccgaccccgaggccgccugggagcccaccgaggccgaggccagagccagagccagcaacgaggacggcgacaucaagagaaucagcaccaaggagugggccaagagcaccggcuacgaccccgugaagcuguucaccaagcuguucaaggacgacaucagauaccugcugaccauggacaagcuguggagaaagagaaagccccccgugccccuggacugggccgaggugcagagccagggcgaggagaccaacgccagcgaccagcagaacgagccccagcugggccugaaggaccagcaggugcuggacgugaagagcuacgccagacuguucagcaagagcaucgagacccugagagugcaccuggccgagaagggcgacggcgccgagcugaucugggacaaggacgaccccagcgccauggacuucgugaccagcgccgccaaccugagaaugcacaucuucagcaugaacaugaagagcagauucgacaucaagagcauggccggcaacaucauccccgccaucgccaccaccaacgccgugaucgccggccugaucgugcuggagggccugaagauccugagcggcaagaucgaccagugcagaaccaucuuccugaacaagcagcccaaccccagaaagaagcugcuggugcccugcgcccuggacccccccaaccccaacugcuacgugugcgccagcaagcccgaggugaccgugagacugaacgugcacaaggugaccgugcugacccugcaggacaagaucgugaaggagaaguucgccaugguggcccccgacgugcagaucgaggacggcaagggcaccauccugaucagcagcgaggagggcgagaccgaggccaacaaccacaagaagcugagcgaguucggcaucagaaacggcagcagacugcaggccgacgacuuccugcaggacuacacccugcugaucaacauccugcacagcgaggaccugggcaaggacguggaguucgagguggugggcgacgcccccgagaaggugggccccaagcaggccgaggacgccgccaagagcaucaccaacggcagcgacgacggcgcccagcccagcaccagcaccgcccaggagcaggacgacgugcugaucguggacagcgacgaggaggacagcagcaacaacgccgacgugagcgaggaggagagaagcagaaagagaaagcuggacgagaaggagaaccugagcgccaagagaagcagaaucgagcagaaggaggagcuggacgacgugaucgcccuggacuaa

SEQ ID NO: 25267 - RNA, 1392 nt, Artificial Sequence
  UBA3__Homo_sapiens__NP_003959
auggccgacggcgaggagcccgagaagaagagaagaagaaucgaggagcugcuggccgagaagauggccguggacggcggcugcggcgacaccggcgacugggagggcagauggaaccacgugaagaaguuccuggagagaagcggccccuucacccaccccgacuucgagcccagcaccgagagccugcaguuccugcuggacaccugcaaggugcuggugaucggcgccggcggccugggcugcgagcugcugaagaaccuggcccugagcggcuucagacagauccacgugaucgacauggacaccaucgacgugagcaaccugaacagacaguuccuguucagacccaaggacaucggcagacccaaggccgagguggccgccgaguuccugaacgacagagugcccaacugcaacguggugccccacuucaacaagauccaggacuucaacgacaccuucuacagacaguuccacaucaucgugugcggccuggacagcaucaucgccagaagauggaucaacggcaugcugaucagccugcugaacuacgaggacggcgugcuggaccccagcagcaucgugccccugaucgacggcggcaccgagggcuucaagggcaacgccagagugauccugcccggcaugaccgccugcaucgagugcacccuggagcuguaccccccccaggugaacuuccccaugugcaccaucgccagcaugcccagacugcccgagcacugcaucgaguacgugagaaugcugcaguggcccaaggagcagcccuucggcgagggcgugccccuggacggcgacgaccccgagcacauccaguggaucuuccagaagagccuggagagagccagccaguacaacaucagaggcgugaccuacagacugacccagggcguggugaagagaaucauccccgccguggccagcaccaacgccgugaucgccgccgugugcgccaccgagguguucaagaucgccaccagcgccuacaucccccugaacaacuaccugguguucaacgacguggacggccuguacaccuacaccuucgaggccgagagaaaggagaacugccccgccugcagccagcugccccagaacauccaguucagccccagcgccaagcugcaggaggugcuggacuaccugaccaacagcgccagccugcagaugaagagccccgccaucaccgccacccuggagggcaagaacagaacccuguaccugcagagcgugaccagcaucgaggagagaaccagacccaaccugagcaagacccugaaggagcugggccugguggacggccaggagcuggccguggccgacgugaccaccccccagaccgugcuguucaagcugcacuucaccagcuaa

SEQ ID NO: 25268 - RNA, 3039 nt, Artificial Sequence
  UBA7__Homo_sapiens__NP_003326
auggacgcccuggacgccagcaagcugcuggacgaggagcuguacagcagacagcuguacgugcugggcagccccgccaugcagagaauccagggcgccagagugcuggugagcggccugcagggccugggcgccgagguggccaagaaccuggugcugaugggcgugggcagccugacccugcacgacccccaccccaccugcuggagcgaccuggccgcccaguuccugcugagcgagcaggaccuggagagaagcagagccgaggccagccaggagcugcuggcccagcugaacagagccgugcaggugguggugcacaccggcgacaucaccgaggaccugcugcuggacuuccaggugguggugcugaccgccgccaagcuggaggagcagcugaaggugggcacccugugccacaagcacggcgugugcuuccuggccgccgacaccagaggccuggugggccagcuguucugcgacuucggcgaggacuucaccgugcaggaccccaccgaggccgagccccugaccgccgccauccagcacaucagccagggcagccccggcauccugacccugagaaagggcgccaacacccacuacuucagagacggcgaccuggugaccuucagcggcaucgagggcaugguggagcugaacgacugcgaccccagaagcauccacgugagagaggacggcagccuggagaucggcgacaccaccaccuucagcagauaccugagaggcggcgccaucaccgaggugaagagacccaagaccgugagacacaagagccuggacaccgcccugcugcagccccacgugguggcccagagcagccaggaggugcaccacgcccacugccugcaccaggccuucugcgcccugcacaaguuccagcaccugcacggcagacccccccagcccugggaccccguggacgccgagaccguggugggccuggccagagaccuggagccccugaagagaaccgaggaggagccccuggaggagccccuggacgaggcccuggugagaaccguggcccugagcagcgccggcgugcugagccccaugguggccaugcugggcgccguggccgcccaggaggugcugaaggccaucagcagaaaguucaugccccuggaccaguggcuguacuucgacgcccuggacugccugcccgaggacggcgagcugcugcccagccccgaggacugcgcccugagaggcagcagauacgacggccagaucgccguguucggcgccggcuuccaggagaagcugagaagacagcacuaccugcuggugggcgccggcgccaucggcugcgagcugcugaagguguucgcccuggugggccugggcgccggcaacagcggcggccugaccgugguggacauggaccacaucgagagaagcaaccugagcagacaguuccuguucagaagccaggacgugggcagacccaaggccgagguggccgccgccgccgccagaggccugaaccccgaccugcaggugaucccccugaccuacccccuggaccccaccaccgagcacaucuacggcgacaacuucuucagcagaguggacggcguggccgccgcccuggacagcuuccaggccagaagauacguggccgccagaugcacccacuaccugaagccccugcuggaggccggcaccagcggcaccuggggcagcgccaccguguucaugccccacgugaccgaggccuacagagcccccgccagcgccgccgccagcgaggacgcccccuaccccgugugcaccgugagauacuuccccagcaccgccgagcacacccugcagugggccagacacgaguucgaggagcuguucagacugagcgccgagaccaucaaccaccaccagcaggcccacaccagccuggccgacauggacgagccccagacccugacccugcugaagcccgugcugggcgugcugagagugagaccccagaacuggcaggacugcguggccugggcccugggccacuggaagcugugcuuccacuacggcaucaagcagcugcugagacacuucccccccaacaaggugcuggaggacggcacccccuucuggagcggccccaagcagugcccccagccccuggaguucgacaccaaccaggacacccaccugcuguacgugcuggccgccgccaaccuguacgcccagaugcacggccugcccggcagccaggacuggaccgcccugagagagcugcugaagcugcugccccagcccgacccccagcagauggcccccaucuucgccagcaaccuggagcuggccagcgccagcgccgaguucggccccgagcagcagaaggagcugaacaaggcccuggagguguggagcgugggccccccccugaagccccugauguucgagaaggacgacgacagcaacuuccacguggacuucgugguggccgccgccagccugagaugccagaacuacggcaucccccccgugaacagagcccagagcaagagaaucgugggccagaucauccccgccaucgccaccaccaccgccgccguggccggccugcugggccuggagcuguacaagguggugagcggccccagacccagaagcgccuucagacacagcuaccugcaccuggccgagaacuaccugaucagauacaugcccuucgcccccgccauccagaccuuccaccaccugaaguggaccagcugggacagacugaaggugcccgccggccagcccgagagaacccuggagagccugcuggcccaccugcaggagcagcacggccugagagugagaauccugcugcacggcagcgcccugcuguacgccgccggcuggagccccgagaagcaggcccagcaccugccccugagagugaccgagcuggugcagcagcugaccggccaggcccccgcccccggccagagagugcuggugcuggagcugagcugcgagggcgacgacgaggacaccgccuuccccccccugcacuacgagcuguaa

SEQ ID NO: 25269 - RNA, 1218 nt, Artificial Sequence
  UBAC1__Homo_sapiens__NP_057256
auguucgugcaggaggagaagaucuucgccggcaaggugcugagacugcacaucugcgccagcgacggcgccgaguggcuggaggaggccaccgaggacaccagcguggagaagcugaaggagagaugccugaagcacugcgcccacggcagccuggaggaccccaagagcaucacccaccacaagcugauccacgccgccagcgagagagugcugagcgacgccagaaccauccuggaggagaacauccaggaccaggacgugcugcugcugaucaagaagagagcccccagcccccugcccaagauggccgacgugagcgccgaggagaagaagaagcaggaccagaaggcccccgacaaggaggccauccugagagccaccgccaaccugcccagcuacaacauggacagagccgccgugcagaccaacaugagagacuuccagaccgagcugagaaagauccuggugagccugaucgagguggcccagaagcugcuggcccugaaccccgacgccguggagcuguucaagaaggccaacgccaugcuggacgaggacgaggacgagagaguggacgaggccgcccugagacagcugaccgagaugggcuuccccgagaacagagccaccaaggcccugcagcugaaccacaugagcgugccccaggccauggaguggcugaucgagcacgccgaggaccccaccaucgacaccccccugcccggccaggccccccccgaggccgagggcgccaccgccgccgccagcgaggccgccgccggcgccagcgccaccgacgaggaggccagagacgagcugaccgagaucuucaagaagaucagaagaaagagagaguucagagccgacgccagagccgugaucagccugauggagaugggcuucgacgagaaggaggugaucgacgcccugagagugaacaacaaccagcagaacgccgccugcgaguggcugcugggcgacagaaagcccagccccgaggagcuggacaagggcaucgaccccgacagcccccuguuccaggccauccuggacaaccccguggugcagcugggccugaccaaccccaagacccugcuggccuucgaggacaugcuggagaacccccugaacagcacccaguggaugaacgaccccgagaccggccccgugaugcugcagaucagcagaaucuuccagacccugaacagaaccuaa

SEQ ID NO: 25270 - RNA, 1035 nt, Artificial Sequence
  UBAC2__Homo_sapiens__NP_001137544
auguucaccagcaccggcagcagcggccuguacaaggccccccugagcaagagccugcugcuggugcccagcgcccugagccugcugcuggcccugcugcugccccacugccagaagcuguucguguacgaccugcacgccgugaagaacgacuuccagaucuggagacugaucugcggcagaaucaucugccuggaccugaaggacaccuucugcagcagccugcugaucuacaacuucagaaucuucgagagaagauacggcagcagaaaguucgccagcuuccugcugggcagcugggugcugagcgcccuguucgacuuccugcugaucgaggccaugcaguacuucuucggcaucaccgccgccagcaaccugcccagcggcuuccuggcccccguguucgcccuguucgugcccuucuacugcagcauccccagagugcagguggcccagauccugggcccccugagcaucaccaacaagacccugaucuacauccugggccugcagcuguucaccagcggcagcuacaucuggaucguggccaucagcggccugaugagcggccugugcuacgacagcaagauguuccaggugcaccaggugcugugcauccccagcuggauggccaaguucuucagcuggacccuggagcccaucuucagcagcagcgagcccaccagcgaggccagaaucggcaugggcgccacccuggacauccagagacagcagagaauggagcugcuggacagacagcugauguucagccaguucgcccagggcagaagacagagacagcagcagggcggcaugaucaacuggaacagacuguuccccccccugagacagagacagaacgugaacuaccagggcggcagacagagcgagcccgccgcccccccccuggaggugagcgaggagcagguggccagacugauggagaugggcuucagcagaggcgacgcccuggaggcccugagagccagcaacaacgaccugaacguggccaccaacuuccugcugcagcacuaa

SEQ ID NO: 25271 - RNA, 1701 nt, Artificial Sequence
  UBAP1__Homo_sapiens__NP_001164672
augagcggcgccgugagaggcagaagaagagaggugggccugcagcacggcggcugcggcaccggcggcggcuacggcgacggccuggccagaagcggccagagcuggagaugguggagaagccugagccugggcgccgugggcagcagcgccggcaccgagcccggcagacccgccggcgccagcaccuucagacugcugagaagaagacagcagagacacagcggcaccuucagcuaccuggacgacgugcccuucaagaccggcgacaaguucaagacccccgccaaggugggccugcccaucggcuucagccugcccgacugccugcagguggugagagaggugcaguacgacuucagccuggagaagaagaccaucgagugggccgaggagaucaagaagaucgaggaggccgagagagaggccgagugcaagaucgccgaggccgaggccaaggugaacagcaagagcggccccgagggcgacagcaagaugagcuucagcaagacccacagcaccgccaccaugcccccccccaucaaccccauccuggccagccugcagcacaacagcauccugacccccaccagagugagcagcagcgccaccaagcagaaggugcugagccccccccacaucaaggccgacuucaaccuggccgacuucgagugcgaggaggaccccuucgacaaccuggagcugaagaccaucgacgagaaggaggagcugagaaacauccuggugggcaccaccggccccaucauggcccagcugcuggacaacaaccugcccagaggcggcagcggcagcgugcugcaggacgaggaggugcuggccagccuggagagagccacccuggacuucaagccccugcacaagcccaacggcuucaucacccugccccagcugggcaacugcgagaagaugagccugagcagcaaggugagccugccccccauccccgccgugagcaacaucaagagccugagcuuccccaagcuggacagcgacgacagcaaccagaagaccgccaagcuggccagcaccuuccacagcaccagcugccugagaaacggcaccuuccagaacagccugaagcccagcacccagagcagcgccagcgagcugaacggccaccacacccugggccugagcgcccugaaccuggacagcggcaccgagaugcccgcccugaccagcagccagaugcccagccugagcgugcugagcgugugcaccgaggagagcagcccccccaacaccggccccaccgugaccccccccaacuucagcgugagccaggugcccaacaugcccagcugcccccaggccuacagcgagcugcagaugcugagccccagcgagagacagugcguggagaccguggugaacaugggcuacagcuacgagugcgugcugagagccaugaagaagaagggcgagaacaucgagcagauccuggacuaccuguucgcccacggccagcugugcgagaagggcuucgacccccugcugguggaggaggcccuggagaugcaccagugcagcgaggagaagaugauggaguuccugcagcugaugagcaaguucaaggagaugggcuucgagcugaaggacaucaaggaggugcugcugcugcacaacaacgaccaggacaacgcccuggaggaccugauggccagagccggcgccagcuaa

SEQ ID NO: 25272 - RNA, 2559 nt, Artificial Sequence
  UBAP2__Homo_sapiens__NP_001269458
auggacagcaagggccugggcagaauccuguggaagagcggccagcagaagaccggccugaagaucaucgaccugguggcccugcugcagaagcccgugccccacagccaggccagcgaggccaacagcuucgagaccagccagcagcagggcuucggccaggcccugguguucaccaacagccagcacaacaaccagauggcccccggcaccggcagcagcaccgccgugaacagcugcagcccccagagccugagcagcgugcugggcagcggcuucggcgagcuggccccccccaagauggccaacaucaccagcagccagauccuggaccagcugaaggcccccagccugggccaguucaccaccacccccagcacccagcagaacagcaccagccaccccaccaccaccaccagcugggaccugaagccccccaccagccagagcagcgugcugagccaccuggacuucaagagccagcccgagcccagccccgugcugagccagcugagccagagacagcagcaccagagccaggccgugaccgugcccccccccggccuggagagcuuccccagccaggccaagcugagagagagcacccccggcgacagccccagcaccgugaacaagcugcugcagcugcccagcaccaccaucgagaacaucagcgugagcgugcaccagccccagcccaagcacaucaagcuggccaagagaagaaucccccccgccagcaagauccccgccagcgccguggagaugcccggcagcgccgacgugaccggccugaacgugcaguucggcgcccuggaguucggcagcgagcccagccugagcgaguucggcagcgcccccagcagcgagaacagcaaccagauccccaucagccuguacagcaagagccugagcgagccccugaacaccagccugagcaugaccagcgccgugcagaacagcaccuacaccaccagcgugaucaccagcugcagccugaccagcagcagccugaacagcgccagccccguggccaugagcagcagcuacgaccagagcagcgugcacaacagaauccccuaccagagccccgugagcagcagcgagagcgcccccggcaccaucaugaacggccacggcggcggcagaagccagcagacccuggacacccccaagaccaccggcccccccagcgcccugcccagcgugagcagccugcccagcaccaccagcugcaccgcccugcugcccagcaccagccagcacaccggcgaccugaccagcagcccccugagccagcugagcagcagccugagcagccaccagagcagccugagcgcccacgccgcccugagcagcagcaccagccacacccacgccagcguggagagcgccagcagccaccagagcagcgccaccuucagcaccgccgccaccagcgugagcagcagcgccagcagcggcgugagccugagcagcagcaugaacaccgccaacagccugugccugggcggcacccccgccagcgccagcagcagcagcagcagagccgccccccuggugaccagcggcaaggccccccccaaccugccccagggcgugcccccccugcugcacaaccaguaccuggugggccccggcggccugcugcccgccuaccccaucuacggcuacgacgagcugcagaugcugcagagcagacugcccguggacuacuacggcauccccuucgccgcccccaccgcccuggccagcagagacggcagccuggccaacaaccccuaccccggcgacgugaccaaguucggcagaggcgacagcgccagccccgcccccgccaccacccccgcccagccccagcagagccagagccagacccaccacaccgcccagcagcccuucgugaaccccgcccugccccccggcuacagcuacaccggccugcccuacuacaccggcaugcccagcgccuuccaguacggccccaccauguucgugccccccgccagcgccaagcagcacggcgugaaccugagcacccccaccccccccuuccagcaggccagcggcuacggccagcacggcuacagcaccggcuacgacgaccugacccagggcaccgccgccggcgacuacagcaagggcggcuacgccggcagcagccaggcccccaacaagagcgccggcagcggccccggcaagggcgugagcgugagcagcagcaccaccggccugcccgacaugaccggcagcguguacaacaagacccagaccuucgacaagcagggcuuccacgccggcacccccccccccuucagccugcccagcgugcugggcagcaccggcccccuggccagcggcgccgcccccggcuacgcccccccccccuuccugcacauccugcccgcccaccagcagccccacagccagcugcugcaccaccaccugccccaggacgcccagagcggcagcggccagagaagccagcccagcagccugcagcccaagagccaggccagcaagcccgccuacggcaacagccccuacuggaccaacuaa

SEQ ID NO: 25273 - RNA, 1872 nt, Artificial Sequence
  UBASH3A__Homo_sapiens__NP_001001895
auggccgccggcgagacccagcuguacgccaaggugagcaacaagcugaagagcagaagcagccccagccugcuggagccccugcuggccaugggcuuccccgugcacaccgcccugaaggcccuggccgccaccggcagaaagaccgccgaggaggcccuggccuggcugcacgaccacugcaacgaccccagccuggacgaccccaucccccaggaguacgcccuguuccugugccccaccggcccccugcuggagaagcugcaggaguucuggagagagagcaagagacagugcgccaagaacagagcccacgagguguucccccacgugacccugugcgacuucuucaccugcgaggaccagaagguggagugccuguacgaggcccugaagagagccggcgacagacugcugggcagcuuccccaccgccgugccccuggcccugcacagcagcaucagcuaccugggcuucuucgugagcggcagccccgccgacgugaucagagaguucgccaugaccuucgccaccgaggccagccugcuggccgacugcagcgugaagcccugcaccaagcagcugcaccugacccuggcccacaaguucuacccccaccaccagagaacccuggagcagcuggccagagccaucccccugggccacagcugccaguggaccgccgcccuguacagcagagacaugagauucgugcacuaccagacccugagagcccuguuccaguacaagccccagaacguggacgagcugacccugagccccggcgacuacaucuucguggaccccacccagcaggacgaggccagcgagggcugggugaucggcaucagccagagaaccggcugcagaggcuuccugcccgagaacuacaccgacagagccagcgagagcgacaccugggugaagcacagaauguacaccuucagccuggccaccgaccugaacagcagaaaggacggcgaggccagcagcagaugcagcggcgaguuccugccccagaccgccagaagccugagcagccugcaggcccugcaggccaccguggccagaaagagcgugcugguggugagacacggcgagagaguggaccagaucuucggcaaggccuggcugcagcagugcagcacccccgacggcaaguacuacagacccgaccugaacuuccccugcagccugcccagaagaagcagaggcaucaaggacuucgagaacgaccccccccugagcagcugcggcaucuuccagagcagaaucgccggcgacgcccugcuggacagcggcaucagaaucagcagcguguucgccagccccgcccugagaugcgugcagaccgccaagcugauccuggaggagcugaagcuggagaagaagaucaagaucagaguggagcccggcaucuucgaguggaccaagugggaggccggcaagaccacccccacccugaugagccuggaggagcugaaggaggccaacuucaacaucgacaccgacuacagacccgccuucccccugagcgcccugaugcccgccgagagcuaccaggaguacauggacagaugcaccgccagcauggugcagaucgugaacaccugcccccaggacaccggcgugauccugaucgugagccacggcagcacccuggacagcugcaccagaccccugcugggccugccccccagagagugcggcgacuucgcccagcuggugagaaagauccccagccugggcaugugcuucugcgaggagaacaaggaggagggcaagugggagcuggugaacccccccgugaagacccugacccacggcgccaacgccgccuucaacuggagaaacuggaucagcggcaacuaa

SEQ ID NO: 25274 - RNA, 1950 nt, Artificial Sequence
  UBASH3B__Homo_sapiens__NP_116262
auggcccaguacggccaccccagcccccugggcauggccgccagagaggagcuguacagcaaggugacccccagaagaaacagacagcagagacccggcaccaucaagcacggcagcgcccuggacgugcugcugagcaugggcuuccccagagccagagcccagaaggcccuggccagcaccggcggcagaagcgugcaggccgccugcgacuggcuguucagccacgugggcgaccccuuccuggacgacccccugcccagagaguacgugcuguaccugagacccaccggcccccuggcccagaagcugagcgacuucuggcagcagagcaagcagaucugcggcaagaacaaggcccacaacaucuucccccacaucacccugugccaguucuucaugugcgaggacagcaagguggacgcccugggcgaggcccugcagaccaccgugagcagauggaagugcaaguucagcgccccccugccccuggagcuguacaccagcagcaacuucaucggccuguucgugaaggaggacagcgccgaggugcugaagaaguucgccgccgacuucgccgccgaggccgccagcaagaccgaggugcacguggagccccacaagaagcagcugcacgugacccuggccuaccacuuccaggccagccaccugcccacccuggagaagcuggcccagaacaucgacgugaagcugggcugcgacuggguggccaccaucuucagcagagacaucagauucgccaaccacgagacccugcaggugaucuaccccuacaccccccagaacgacgacgagcuggagcuggugcccggcgacuucaucuucaugagccccauggagcagaccagcaccagcgagggcuggaucuacggcaccagccugaccaccggcugcagcggccugcugcccgagaacuacaucaccaaggccgacgagugcagcaccuggaucuuccacggcagcuacagcauccugaacaccagcagcagcaacagccugaccuucggcgacggcgugcuggagagaagacccuacgaggaccagggccugggcgagaccaccccccugaccaucaucugccagcccaugcagccccugagagugaacagccagcccggcccccagaagagaugccuguucgugugcagacacggcgagagaauggacgugguguucggcaaguacuggcugagccagugcuucgacgccaagggcagauacaucagaaccaaccugaacaugccccacagccugccccagagaagcggcggcuucagagacuacgagaaggacgcccccaucaccguguucggcugcaugcaggccagacuggugggcgaggcccugcuggagagcaacaccaucaucgaccacguguacugcagccccagccugagaugcgugcagaccgcccacaacauccugaagggccugcagcaggagaaccaccugaagaucagaguggagcccggccuguucgaguggaccaaguggguggccggcagcacccugcccgccuggaucccccccagcgagcuggccgccgccaaccugagcguggacaccaccuacagaccccacauccccaucagcaagcugguggugagcgagagcuacgacaccuacaucagcagaagcuuccaggugaccaaggagaucaucagcgagugcaagagcaagggcaacaacauccugaucguggcccacgccagcagccuggaggccugcaccugccagcugcagggccugagcccccagaacagcaaggacuucgugcagauggugagaaagauccccuaccugggcuucugcagcugcgaggagcugggcgagaccggcaucuggcagcugaccgacccccccauccugccccugacccacggccccaccggcggcuucaacuggagagagacccugcugcaggaguaa

SEQ ID NO: 25275 - RNA, 690 nt, Artificial Sequence
  UBB__Homo_sapiens__NP_001268647
augcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcaugcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcaugcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcugcuaa

SEQ ID NO: 25276 - RNA, 2058 nt, Artificial Sequence
  UBC__Homo_sapiens__NP_066289
augcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcaugcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcaugcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcaugcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcaugcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcaugcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcaugcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcaugcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcaugcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcguguaa

SEQ ID NO: 25277 - RNA, 498 nt, Artificial Sequence
  UBD__Homo_sapiens__NP_006389
auggcccccaacgccagcugccugugcgugcacgugagaagcgaggagugggaccugaugaccuucgacgccaaccccuacgacagcgugaagaagaucaaggagcacgugagaagcaagaccaaggugcccgugcaggaccaggugcugcugcugggcagcaagauccugaagcccagaagaagccugagcagcuacggcaucgacaaggagaagaccauccaccugacccugaagguggugaagcccagcgacgaggagcugccccuguuccugguggagagcggcgacgaggccaagagacaccugcugcaggugagaagaagcagcagcguggcccaggugaaggccaugaucgagaccaagaccggcaucauccccgagacccagaucgugaccugcaacggcaagagacuggaggacggcaagaugauggccgacuacggcaucagaaagggcaaccugcuguuccuggccugcuacugcaucggcggcuaa

SEQ ID NO: 25278 - RNA, 360 nt, Artificial Sequence
  UBE2A__Homo_sapiens__NP_001269090
augguguggaacgccgugaucuucggccccgagggcacccccuucgaggacggcaccuucaagcugaccaucgaguucaccgaggaguaccccaacaagccccccaccgugagauucgugagcaagauguuccaccccaacguguacgccgacggcagcaucugccuggacauccugcagaacagauggagccccaccuacgacgugagcagcauccugaccagcauccagagccugcuggacgagcccaaccccaacagccccgccaacagccaggccgcccagcuguaccaggagaacaagagagaguacgagaagagagugagcgccaucguggagcagagcuggagagacugcuaa

SEQ ID NO: 25279 - RNA, 459 nt, Artificial Sequence
  UBE2B__Homo_sapiens__NP_003328
augagcacccccgccagaagaagacugaugagagacuucaagagacugcaggaggacccccccgugggcgugagcggcgcccccagcgagaacaacaucaugcaguggaacgccgugaucuucggccccgagggcacccccuucgaggacggcaccuucaagcuggugaucgaguucagcgaggaguaccccaacaagccccccaccgugagauuccugagcaagauguuccaccccaacguguacgccgacggcagcaucugccuggacauccugcagaacagauggagccccaccuacgacgugagcagcauccugaccagcauccagagccugcuggacgagcccaaccccaacagccccgccaacagccaggccgcccagcuguaccaggagaacaagagagaguacgagaagagagugagcgccaucguggagcagagcuggaacgacagcuaa

SEQ ID NO: 25280 - RNA, 240 nt, Artificial Sequence
  UBE2C__Homo_sapiens__NP_001268671
auggccagccagaacagagaccccgccgccaccagcguggccgccgccagaaagggcgccgagcccagcggcggcgccgccagaggccccgugggcaagagacugcagcaggagcugaugacccugaugaugagcggcgacaagggcaucagcgccuuccccgagagcgacaaccuguucaagugggugggcaccauccacggcgccgccggcaccaaccccacccugaucgugcccuaa

SEQ ID NO: 25281 - RNA, 444 nt, Artificial Sequence
  UBE2D1__Homo_sapiens__NP_003329
auggcccugaagagaauccagaaggagcugagcgaccugcagagagacccccccgcccacugcagcgccggccccgugggcgacgaccuguuccacuggcaggccaccaucaugggcccccccgacagcgccuaccagggcggcguguucuuccugaccgugcacuuccccaccgacuaccccuucaagccccccaagaucgccuucaccaccaagaucuaccaccccaacaucaacagcaacggcagcaucugccuggacauccugagaagccaguggagccccgcccugaccgugagcaaggugcugcugagcaucugcagccugcugugcgaccccaaccccgacgacccccuggugcccgacaucgcccagaucuacaagagcgacaaggagaaguacaacagacacgccagagaguggacccagaaguacgccauguaa

SEQ ID NO: 25282 - RNA, 444 nt, Artificial Sequence
  UBE2D2__Homo_sapiens__NP_003330
auggcccugaagagaauccacaaggagcugaacgaccuggccagagacccccccgcccagugcagcgccggccccgugggcgacgacauguuccacuggcaggccaccaucaugggccccaacgacagccccuaccagggcggcguguucuuccugaccauccacuuccccaccgacuaccccuucaagccccccaagguggccuucaccaccagaaucuaccaccccaacaucaacagcaacggcagcaucugccuggacauccugagaagccaguggagccccgcccugaccaucagcaaggugcugcugagcaucugcagccugcugugcgaccccaaccccgacgacccccuggugcccgagaucgccagaaucuacaagaccgacagagagaaguacaacagaaucgccagagaguggacccagaaguacgccauguaa

SEQ ID NO: 25283 - RNA, 444 nt, Artificial Sequence
  UBE2D3__Homo_sapiens__NP_003331
auggcccugaagagaaucaacaaggagcugagcgaccuggccagagacccccccgcccagugcagcgccggccccgugggcgacgacauguuccacuggcaggccaccaucaugggccccaacgacagccccuaccagggcggcguguucuuccugaccauccacuuccccaccgacuaccccuucaagccccccaagguggccuucaccaccagaaucuaccaccccaacaucaacagcaacggcagcaucugccuggacauccugagaagccaguggagccccgcccugaccaucagcaaggugcugcugagcaucugcagccugcugugcgaccccaaccccgacgacccccuggugcccgagaucgccagaaucuacaagaccgacagagacaaguacaacagaaucagcagagaguggacccagaaguacgccauguaa

SEQ ID NO: 25284 - RNA, 483 nt, Artificial Sequence
  UBE2E1__Homo_sapiens__NP_001189405
augaaggaggugggcagacccagagaggugagaggcagacccggcaagagcagaauccagaaggagcuggccgacaucacccuggaccccccccccaacugcagcgccggccccaagggcgacaacaucuacgaguggagaagcaccauccugggcccccccggcagcguguacgagggcggcguguucuuccuggacaucaccuucacccccgaguaccccuucaagccccccaaggugaccuucagaaccagaaucuaccacugcaacaucaacagccagggcgugaucugccuggacauccugaaggacaacuggagccccgcccugaccaucagcaaggugcugcugagcaucugcagccugcugaccgacugcaaccccgccgacccccuggugggcagcaucgccacccaguacaugaccaacagagccgagcacgacagaauggccagacaguggaccaagagauacgccaccuaa

SEQ ID NO: 25285 - RNA, 606 nt, Artificial Sequence
  UBE2E2__Homo_sapiens__NP_689866
augagcaccgaggcccagagaguggacgacagccccagcaccagcggcggcagcagcgacggcgaccagagagagagcgugcagcaggagcccgagagagagcaggugcagcccaagaagaaggagggcaagaucagcagcaagaccgccgccaagcugagcaccagcgccaagagaauccagaaggagcuggccgagaucacccuggaccccccccccaacugcagcgccggccccaagggcgacaacaucuacgaguggagaagcaccauccugggcccccccggcagcguguacgagggcggcguguucuuccuggacaucaccuucagccccgacuaccccuucaagccccccaaggugaccuucagaaccagaaucuaccacugcaacaucaacagccagggcgugaucugccuggacauccugaaggacaacuggagccccgcccugaccaucagcaaggugcugcugagcaucugcagccugcugaccgacugcaaccccgccgacccccuggugggcagcaucgccacccaguacaugaccaacagagccgagcacgacagaauggccagacaguggaccaagagauacgccaccuaa

SEQ ID NO: 25286 - RNA, 624 nt, Artificial Sequence
  UBE2E3__Homo_sapiens__NP_006348
augagcagcgacagacagagaagcgacgacgagagccccagcaccagcagcggcagcagcgacgccgaccagagagaccccgccgcccccgagcccgaggagcaggaggagagaaagcccagcgccacccagcagaagaagaacaccaagcugagcagcaagaccaccgccaagcugagcaccagcgccaagagaauccagaaggagcuggccgagaucacccuggaccccccccccaacugcagcgccggccccaagggcgacaacaucuacgaguggagaagcaccauccugggcccccccggcagcguguacgagggcggcguguucuuccuggacaucaccuucagcagcgacuaccccuucaagccccccaaggugaccuucagaaccagaaucuaccacugcaacaucaacagccagggcgugaucugccuggacauccugaaggacaacuggagccccgcccugaccaucagcaaggugcugcugagcaucugcagccugcugaccgacugcaaccccgccgacccccuggugggcagcaucgccacccaguaccugaccaacagagccgagcacgacagaaucgccagacaguggaccaagagauacgccaccuaa

SEQ ID NO: 25287 - RNA, 513 nt, Artificial Sequence
  UBE2G1__Homo_sapiens__NP_003333
augaccgagcugcagagcgcccugcugcugagaagacagcuggccgagcugaacaagaaccccguggagggcuucagcgccggccugaucgacgacaacgaccuguacagaugggaggugcugaucaucggcccccccgacacccuguacgagggcggcguguucaaggcccaccugaccuuccccaaggacuacccccugagaccccccaagaugaaguucaucaccgagaucuggcaccccaacguggacaagaacggcgacgugugcaucagcauccugcacgagcccggcgaggacaaguacggcuacgagaagcccgaggagagauggcugcccauccacaccguggagaccaucaugaucagcgugaucagcaugcuggccgaccccaacggcgacagccccgccaacguggacgccgccaaggaguggagagaggacagaaacggcgaguucaagagaaagguggccagaugcgugagaaagagccaggagaccgccuucgaguaa

SEQ ID NO: 25288 - RNA, 498 nt, Artificial Sequence
  UBE2G2__Homo_sapiens__NP_003334
auggccggcaccgcccugaagagacugauggccgaguacaagcagcugacccugaacccccccgagggcaucguggccggccccaugaacgaggagaacuucuucgagugggaggcccugaucaugggccccgaggacaccugcuucgaguucggcguguuccccgccauccugagcuucccccuggacuacccccugagcccccccaagaugagauucaccugcgagauguuccaccccaacaucuaccccgacggcagagugugcaucagcauccugcacgcccccggcgacgaccccaugggcuacgagagcagcgccgagagauggagccccgugcagagcguggagaagauccugcugagcguggugagcaugcuggccgagcccaacgacgagagcggcgccaacguggacgccagcaagauguggagagacgacagagagcaguucuacaagaucgccaagcagaucgugcagaagagccugggccuguaa

SEQ ID NO: 25289 - RNA, 552 nt, Artificial Sequence
  UBE2H__Homo_sapiens__NP_003335
augagcagccccagccccggcaagagaagaauggacaccgacguggugaagcugaucgagagcaagcacgaggugaccauccugggcggccugaacgaguucguggugaaguucuacggcccccagggcacccccuacgagggcggcguguggaaggugagaguggaccugcccgacaaguaccccuucaagagccccagcaucggcuucaugaacaagaucuuccaccccaacaucgacgaggccagcggcaccgugugccuggacgugaucaaccagaccuggaccgcccuguacgaccugaccaacaucuucgagagcuuccugccccagcugcuggccuaccccaaccccaucgacccccugaacggcgacgccgccgccauguaccugcacagacccgaggaguacaagcagaagaucaaggaguacauccagaaguacgccaccgaggaggcccugaaggagcaggaggagggcaccggcgacagcagcagcgagagcagcaugagcgacuucagcgaggacgaggcccaggacauggagcuguaa

SEQ ID NO: 25290 - RNA, 477 nt, Artificial Sequence
  UBE2I__Homo_sapiens__NP_003336
augagcggcaucgcccugagcagacuggcccaggagagaaaggccuggagaaaggaccaccccuucggcuucguggccgugcccaccaagaaccccgacggcaccaugaaccugaugaacugggagugcgccauccccggcaagaagggcacccccugggagggcggccuguucaagcugagaaugcuguucaaggacgacuaccccagcagcccccccaagugcaaguucgagcccccccuguuccaccccaacguguaccccagcggcaccgugugccugagcauccuggaggaggacaaggacuggagacccgccaucaccaucaagcagauccugcugggcauccaggagcugcugaacgagcccaacauccaggaccccgcccaggccgaggccuacaccaucuacugccagaacagaguggaguacgagaagagagugagagcccaggccaagaaguucgcccccagcuaa

SEQ ID NO: 25291 - RNA, 957 nt, Artificial Sequence
  UBE2J1__Homo_sapiens__NP_057105
auggagaccagauacaaccugaagagccccgccgugaagagacugaugaaggaggccgccgagcugaaggaccccaccgaccacuaccacgcccagccccuggaggacaaccuguucgaguggcacuucaccgugagaggcccccccgacagcgacuucgacggcggcguguaccacggcagaaucgugcugccccccgaguaccccaugaagccccccagcaucauccugcugaccgccaacggcagauucgaggugggcaagaagaucugccugagcaucagcggccaccaccccgagaccuggcagcccagcuggagcaucagaaccgcccugcuggccaucaucggcuucaugcccaccaagggcgagggcgccaucggcagccuggacuacacccccgaggagagaagagcccuggccaagaagagccaggacuucugcugcgagggcugcggcagcgccaugaaggacgugcugcugccccugaagagcggcagcgacagcagccaggccgaccaggaggccaaggagcuggccagacagaucagcuucaaggccgaggugaacagcagcggcaagaccaucagcgagagcgaccugaaccacagcuucagccugaccgaccugcaggacgacauccccaccaccuuccagggcgccaccgccagcaccagcuacggccugcagaacagcagcgccgccagcuuccaccagcccacccagcccguggccaagaacaccagcaugagccccagacagagaagagcccagcagcagagccagagaagacugagcaccagccccgacgugauccagggccaccagcccagagacaaccacaccgaccacggcggcagcgccgugcugaucgugauccugacccuggcccuggccgcccugaucuucagaagaaucuaccuggccaacgaguacaucuucgacuucgagcuguaa

SEQ ID NO: 25292 - RNA, 474 nt, Artificial Sequence
  UBE2K__Homo_sapiens__NP_001104582
auggccaacaucgccgugcagagaaucaagagagaguucaaggaggugcugaagagcgaggagaccagcaagaaccagaucaagguggaccugguggacgagaacuucaccgagcugagaggcgagaucgccggcccccccgacacccccuacgagggcggcagauaccagcuggagaucaagauccccgagaccuaccccuucaacccccccaaggugagauucaucaccaagaucuggcaccccaacaucagcagcgugaccggcgccaucugccuggacauccugaaggaccagugggccgccgccaugacccugagaaccgugcugcugagccugcaggcccugcuggccgccgccgagcccgacgacccccaggacgccgugguggccaaccagaacgccgugaucguggcccugagcagcaagagcugggacguggagaccgccaccgagcugcugcugagcaacuaa

SEQ ID NO: 25293 - RNA, 639 nt, Artificial Sequence
  UBE2L3__Homo_sapiens__NP_001243284
augcagguggccgccggcaccagaggcgacaccagacugcaggagguggcccugcugccccagcuguucgaccugcuggugcugggccagagaagagccagacugcugagacaggugcccagcgcccuggccggcaaggaccuggcccagcugcaggccggcgccacccuggccggcuacagaagagcccacggccccgaggagcuggaggagaucagaaagugcggcaugaagaacuucagaaacauccagguggacgaggccaaccugcugaccuggcagggccugaucgugcccgacaacccccccuacgacaagggcgccuucagaaucgagaucaacuuccccgccgaguaccccuucaagccccccaagaucaccuucaagaccaagaucuaccaccccaacaucgacgagaagggccaggugugccugcccgugaucagcgccgagaacuggaagcccgccaccaagaccgaccaggugauccagagccugaucgcccuggugaacgacccccagcccgagcacccccugagagccgaccuggccgaggaguacagcaaggacagaaagaaguucugcaagaacgccgaggaguucaccaagaaguacggcgagaagagacccguggacuaa

SEQ ID NO: 25294 - RNA, 462 nt, Artificial Sequence
  UBE2L6__Homo_sapiens__NP_004214
augauggccagcaugagaguggugaaggagcuggaggaccugcagaagaagcccccccccuaccugagaaaccugagcagcgacgacgccaacgugcugguguggcacgcccugcugcugcccgaccagccccccuaccaccugaaggccuucaaccugagaaucagcuucccccccgaguaccccuucaagccccccaugaucaaguucaccaccaagaucuaccaccccaacguggacgagaacggccagaucugccugcccaucaucagcagcgagaacuggaagcccugcaccaagaccugccaggugcuggaggcccugaacgugcuggugaacagacccaacaucagagagccccugagaauggaccuggccgaccugcugacccagaaccccgagcuguucagaaagaacgccgaggaguucacccugagauucggcguggacagacccagcuaa

SEQ ID NO: 25295 - RNA, 552 nt, Artificial Sequence
  UBE2M__Homo_sapiens__NP_003960
augaucaagcuguucagccugaagcagcagaagaaggaggaggagagcgccggcggcaccaagggcagcagcaagaaggccagcgccgcccagcugagaauccagaaggacaucaacgagcugaaccugcccaagaccugcgacaucagcuucagcgaccccgacgaccugcugaacuucaagcuggugaucugccccgacgagggcuucuacaagagcggcaaguucguguucagcuucaaggugggccagggcuacccccacgacccccccaaggugaagugcgagaccaugguguaccaccccaacaucgaccuggagggcaacgugugccugaacauccugagagaggacuggaagcccgugcugaccaucaacagcaucaucuacggccugcaguaccuguuccuggagcccaaccccgaggacccccugaacaaggaggccgccgaggugcugcagaacaacagaagacuguucgagcagaacgugcagagaagcaugagaggcggcuacaucggcagcaccuacuucgagagaugccugaaguaa

SEQ ID NO: 25296 - RNA, 459 nt, Artificial Sequence
  UBE2N__Homo_sapiens__NP_003339
auggccggccugcccagaagaaucaucaaggagacccagagacugcuggccgagcccgugcccggcaucaaggccgagcccgacgagagcaacgccagauacuuccacguggugaucgccggcccccaggacagccccuucgagggcggcaccuucaagcuggagcuguuccugcccgaggaguaccccauggccgcccccaaggugagauucaugaccaagaucuaccaccccaacguggacaagcugggcagaaucugccuggacauccugaaggacaaguggagccccgcccugcagaucagaaccgugcugcugagcauccaggcccugcugagcgcccccaaccccgacgacccccuggccaacgacguggccgagcaguggaagaccaacgaggcccaggccaucgagaccgccagagccuggaccagacuguacgccaugaacaacaucuaa

SEQ ID NO: 25297 - RNA, 1080 nt, Artificial Sequence
  UBE2Q2__Homo_sapiens__NP_001138807
augagaauggacagccugaccgaggagaagcuggagugcagacuguggugcugccugagcgaccccagcccccccggccuggccgccagaugcugcgugcuggagagaagcaucgugcccagccugagacaggagagcuaccccagcagcagccccaucugguucguggacagcgaggaccccaaccugaccagcgugcuggagagacuggaggacaccaagaacaacaaccugcugagacagcagcugaaguggcugaucugcgagcugugcagccuguacaaccugcccaagcaccuggacguggagaugcuggaccagccccugcccaccggccagaacggcaccaccgaggaggugaccagcgaggaggaggaggaggaggaggagauggccgaggacaucgaggaccuggaccacuacgagaugaaggaggaggagcccaucagcggcaagaagagcgaggacgagggcaucgagaaggagaaccuggccauccuggagaagaucagaaagacccagagacaggaccaccugaacggcgccgugagcggcagcgugcaggccagcgacagacugaugaaggagcugagagacaucuacagaagccagagcuacaagaccggcaucuacagcguggagcugaucaacgacagccuguacgacuggcacgugaagcugcagaagguggaccccgacagcccccugcacagcgaccugcagauccugaaggagaaggagggcaucgaguacauccugcugaacuucagcuucaaggacaacuuccccuucgacccccccuucgugagaguggugcugcccgugcugagcggcggcuacgugcugggcggcggcgcccugugcauggagcugcugaccaagcagggcuggagcagcgccuacagcaucgagagcgugaucaugcagaucaacgccacccuggugaagggcaaggccagagugcaguucggcgccaacaagaaccaguacaaccuggccagagcccagcagagcuacaacagcaucgugcagauccacgagaagaacggcugguacaccccccccaaggaggacggcuaa

SEQ ID NO: 25298 - RNA, 486 nt, Artificial Sequence
  UBE2QL1__Homo_sapiens__NP_001138633
augaaggagcugcaggacaucgccagacugagcgacagauucaucagcguggagcugguggacgagagccuguucgacuggaacgugaagcugcaccagguggacaaggacagcgugcuguggcaggacaugaaggagaccaacaccgaguucauccugcugaaccugaccuuccccgacaacuuccccuucagcccccccuucaugagagugcugagccccagacuggagaacggcuacgugcuggacggcggcgccaucugcauggagcugcugacccccagaggcuggagcagcgccuacaccguggaggccgugaugagacaguucgccgccagccuggugaagggccagggcagaaucugcagaaaggccggcaagagcaagaagagcuucagcagaaaggaggccgaggccaccuucaagagccuggugaagacccacgagaaguacggcugggugaccccccccgugagcgacggcuaa

SEQ ID NO: 25299 - RNA, 717 nt, Artificial Sequence
  UBE2R2__Homo_sapiens__NP_060281
auggcccagcagcagaugaccagcagccagaaggcccugaugcuggagcugaagagccugcaggaggagcccguggagggcuucagaaucacccugguggacgagagcgaccuguacaacugggagguggccaucuucggcccccccaacacccuguacgagggcggcuacuucaaggcccacaucaaguuccccaucgacuaccccuacagcccccccaccuucagauuccugaccaagauguggcaccccaacaucuacgagaacggcgacgugugcaucagcauccugcacccccccguggacgacccccagagcggcgagcugcccagcgagagauggaaccccacccagaacgugagaaccauccugcugagcgugaucagccugcugaacgagcccaacaccuucagccccgccaacguggacgccagcgugauguucagaaaguggagagacagcaagggcaaggacaaggaguacgccgagaucaucagaaagcaggugagcgccaccaaggccgaggccgagaaggacggcgugaaggugcccaccacccuggccgaguacugcaucaagaccaaggugcccagcaacgacaacagcagcgaccugcuguacgacgaccuguacgacgacgacaucgacgacgaggacgaggaggaggaggacgccgacugcuacgacgacgacgacagcggcaacgaggagagcuaa

SEQ ID NO: 25300 - RNA, 669 nt, Artificial Sequence
  UBE2S__Homo_sapiens__NP_055316
augaacagcaacguggagaaccugcccccccacaucaucagacugguguacaaggaggugaccacccugaccgccgacccccccgacggcaucaagguguuccccaacgaggaggaccugaccgaccugcaggugaccaucgagggccccgagggcacccccuacgccggcggccuguucagaaugaagcugcugcugggcaaggacuuccccgccagcccccccaagggcuacuuccugaccaagaucuuccaccccaacgugggcgccaacggcgagaucugcgugaacgugcugaagagagacuggaccgccgagcugggcaucagacacgugcugcugaccaucaagugccugcugauccaccccaaccccgagagcgcccugaacgaggaggccggcagacugcugcuggagaacuacgaggaguacgccgccagagccagacugcugaccgagauccacggcggcgccggcggccccagcggcagagccgaggccggcagagcccuggccagcggcaccgaggccagcagcaccgaccccggcgcccccggcggccccggcggcgccgagggccccauggccaagaagcacgccggcgagagagacaagaagcuggccgccaagaagaagaccgacaagaagagagcccugagaagacuguaa

SEQ ID NO: 25301 - RNA, 594 nt, Artificial Sequence
  UBE2T__Homo_sapiens__NP_054895
augcagagagccagcagacugaagagagagcugcacaugcuggccaccgagcccccccccggcaucaccugcuggcaggacaaggaccagauggacgaccugagagcccagauccugggcggcgccaacacccccuacgagaagggcguguucaagcuggaggugaucauccccgagagauaccccuucgagcccccccagaucagauuccugacccccaucuaccaccccaacaucgacagcgccggcagaaucugccuggacgugcugaagcugccccccaagggcgccuggagacccagccugaacaucgccaccgugcugaccagcauccagcugcugaugagcgagcccaaccccgacgacccccugauggccgacaucagcagcgaguucaaguacaacaagcccgccuuccugaagaacgccagacaguggaccgagaagcacgccagacagaagcagaaggccgacgaggaggagaugcuggacaaccugcccgaggccggcgacagcagagugcacaacagcacccagaagagaaaggccagccagcuggugggcaucgagaagaaguuccaccccgacguguaa

SEQ ID NO: 25302 - RNA, 954 nt, Artificial Sequence
  UBE2U__Homo_sapiens__XP_011539067
augcacggcagagccuaccugcugcugcacagagacuucugcgaccugaaggagaacaacuacaagggcaucaccgccaagcccgugagcgaggacaugauggagugggagguggagaucgagggccugcagaacagcguguggcagggccugguguuccagcugaccauccacuucaccagcgaguacaacuacgccccccccguggugaaguucaucaccauccccuuccaccccaacguggacccccacaccggccagcccugcaucgacuuccuggacaaccccgagaaguggaacaccaacuacacccugagcagcauccugcuggcccugcaggugaugcugagcaaccccgugcuggagaaccccgugaaccuggaggccgccagaauccuggugaaggacgagagccuguacagaaccauccugagacuguucaacagaccccugcagaugaaggacgacagccaggagcugcccaaggaccccagaaagugcaucagacccaucaagaccaccagcuucagcgacuacuaccagaccuggagcagaaucgccaccagcaaggccaccgaguacuacagaaccccccugcugaaggugcccaacuucaucggccaguacuacaaguggaagaagauggaccugcagcaccagaaggaguggaaccugaaguacagcgugaucaagugcuggcuggccagaaagagaaugccccacgaggugacccacagcauggaggagaucaagcugugccccacccugaacgagaucuuccuggagagccccaccgccaucaacagcaucaccgacaucuacgagaccgaggaggagggcuggaagagcgacaccagccuguacgagaacgacaccgacgagcccagagaggaggagguggaggaccugaucagcuggaccaacacccugaacaccaacaccagcgaggacuaa

SEQ ID NO: 25303 - RNA, 444 nt, Artificial Sequence
  UBE2V1__Homo_sapiens__NP_001027459
auggccgccaccaccggcagcggcgugaaggugcccagaaacuucagacugcuggaggagcuggaggagggccagaagggcgugggcgacggcaccgugagcuggggccuggaggacgacgaggacaugacccugaccagauggaccggcaugaucaucggcccccccagaaccaucuacgagaacagaaucuacagccugaagaucgagugcggccccaaguaccccgaggccccccccuucgugagauucgugaccaagaucaacaugaacggcgugaacagcagcaacggcgugguggaccccagagccaucagcgugcuggccaaguggcagaacagcuacagcaucaagguggugcugcaggagcugagaagacugaugaugagcaaggagaacaugaagcugccccagccccccgagggccagugcuacagcaacuaa

SEQ ID NO: 25304 - RNA, 438 nt, Artificial Sequence
  UBE2V2__Homo_sapiens__NP_003341
auggccgugagcaccggcgugaaggugcccagaaacuucagacugcuggaggagcuggaggagggccagaagggcgugggcgacggcaccgugagcuggggccuggaggacgacgaggacaugacccugaccagauggaccggcaugaucaucggcccccccagaaccaacuacgagaacagaaucuacagccugaagguggagugcggccccaaguaccccgaggccccccccagcgugagauucgugaccaagaucaacaugaacggcaucaacaacagcagcggcaugguggacgccagaagcauccccgugcuggccaaguggcagaacagcuacagcaucaagguggugcugcaggagcugagaagacugaugaugagcaaggagaacaugaagcugccccagccccccgagggccagaccuacaacaacuaa

SEQ ID NO: 25305 - RNA, 1065 nt, Artificial Sequence
  UBE2Z__Homo_sapiens__NP_075567
auggccgagagccccaccgaggaggccgccaccgccggcgccggcgccgccggccccggcgccagcagcguggccggcguggugggcgugagcggcagcggcggcggcuucggcccccccuuccugcccgacgugugggccgccgccgccgccgccggcggcgccggcggccccggcagcggccuggccccccugcccggccugccccccagcgccgccgcccacggcgccgcccugcugagccacugggaccccacccugagcagcgacugggacggcgagagaaccgccccccagugccugcugagaaucaagagagacaucaugagcaucuacaaggagcccccccccggcauguucguggugcccgacaccguggacaugaccaagauccacgcccugaucaccggccccuucgacacccccuacgagggcggcuucuuccuguucguguucagaugcccccccgacuaccccauccacccccccagagugaagcugaugaccaccggcaacaacaccgugagauucaaccccaacuucuacagaaacggcaaggugugccugagcauccugggcaccuggaccggccccgccuggagccccgcccagagcaucagcagcgugcugaucagcauccagagccugaugaccgagaaccccuaccacaacgagcccggcuucgagcaggagagacaccccggcgacagcaagaacuacaacgagugcaucagacacgagaccaucagaguggccgugugcgacaugauggagggcaagugccccugccccgagccccugagaggcgugauggagaagagcuuccuggaguacuacgacuucuacgagguggccugcaaggacagacugcaccugcagggccagaccaugcaggaccccuucggcgagaagagaggccacuucgacuaccagagccugcugaugagacugggccugaucagacagaaggugcuggagagacugcacaacgagaacgccgagauggacagcgacagcagcagcagcggcaccgagaccgaccugcacggcagccugagaguguaa

SEQ ID NO: 25306 - RNA, 2559 nt, Artificial Sequence
  UBE3A__Homo_sapiens__XP_005268328
augaagagagccgccgccaagcaccugaucgagagauacuaccaccagcugaccgagggcugcggcaacgaggccugcaccaacgaguucugcgccagcugccccaccuuccugagaauggacaacaacgccgccgccaucaaggcccuggagcuguacaagaucaacgccaagcugugcgacccccaccccagcaagaagggcgccagcagcgccuaccuggagaacagcaagggcgcccccaacaacagcugcagcgagaucaagaugaacaagaagggcgccagaaucgacuucaaggacgugaccuaccugaccgaggagaagguguacgagauccuggagcugugcagagagagagaggacuacagcccccugaucagagugaucggcagaguguucagcagcgccgaggcccuggugcagagcuucagaaaggugaagcagcacaccaaggaggagcugaagagccugcaggccaaggacgaggacaaggacgaggacgagaaggagaaggccgccugcagcgccgccgccauggaggaggacagcgaggccagcagcagcagaaucggcgacagcagccagggcgacaacaaccugcagaagcugggccccgacgacgugagcguggacaucgacgccaucagaagaguguacaccagacugcugagcaacgagaagaucgagaccgccuuccugaacgcccugguguaccugagccccaacguggagugcgaccugaccuaccacaacguguacagcagagaccccaacuaccugaaccuguucaucaucgugauggagaacagaaaccugcacagccccgaguaccuggagauggcccugccccuguucugcaaggccaugagcaagcugccccuggccgcccagggcaagcugaucagacuguggagcaaguacaacgccgaccagaucagaagaaugauggagaccuuccagcagcugaucaccuacaaggugaucagcaacgaguucaacagcagaaaccuggugaacgacgacgacgccaucguggccgccagcaagugccugaagaugguguacuacgccaacguggugggcggcgagguggacaccaaccacaacgaggaggacgacgaggagcccauccccgagagcagcgagcugacccugcaggagcugcugggcgaggagagaagaaacaagaagggccccagaguggacccccuggagaccgagcugggcgugaagacccuggacugcagaaagccccugauccccuucgaggaguucaucaacgagccccugaacgaggugcuggagauggacaaggacuacaccuucuucaagguggagaccgagaacaaguucagcuucaugaccugccccuucauccugaacgccgugaccaagaaccugggccuguacuacgacaacagaaucagaauguacagcgagagaagaaucaccgugcuguacagccuggugcagggccagcagcugaaccccuaccugagacugaaggugagaagagaccacaucaucgacgacgcccuggugagacuggagaugaucgccauggagaaccccgccgaccugaagaagcagcuguacguggaguucgagggcgagcagggcguggacgagggcggcgugagcaaggaguucuuccagcuggugguggaggagaucuucaaccccgacaucggcauguucaccuacgacgagagcaccaagcuguucugguucaaccccagcagcuucgagaccgagggccaguucacccugaucggcaucgugcugggccuggccaucuacaacaacugcauccuggacgugcacuuccccauggugguguacagaaagcugaugggcaagaagggcaccuucagagaccugggcgacagccaccccgugcuguaccagagccugaaggaccugcuggaguacgagggcaacguggaggacgacaugaugaucaccuuccagaucagccagaccgaccuguucggcaaccccaugauguacgaccugaaggagaacggcgacaagauccccaucaccaacgagaacagaaaggaguucgugaaccuguacagcgacuacauccugaacaagagcguggagaagcaguucaaggccuucagaagaggcuuccacauggugaccaacgagagcccccugaaguaccuguucagacccgaggagaucgagcugcugaucugcggcagcagaaaccuggacuuccaggcccuggaggagaccaccgaguacgacggcggcuacaccagagacagcgugcugaucagagaguucugggagaucgugcacagcuucaccgacgagcagaagagacuguuccugcaguucaccaccggcaccgacagagcccccgugggcggccugggcaagcugaagaugaucaucgccaagaacggccccgacaccgagagacugcccaccagccacaccugcuucaacgugcugcugcugcccgaguacagcagcaaggagaagcugaaggagagacugcugaaggccaucaccuacgccaagggcuucggcaugcuguaa

SEQ ID NO: 25307 - RNA, 735 nt, Artificial Sequence
  UBE3B__Homo_sapiens__NP_001257380
auguucacccugagccagaccagcagagccugguucaucgacagagccagacaggccagagaggagagacuggugcagaaggagagagagagagccgccguggugauccaggcccacgugagaagcuuccugugcagaagcagacugcagagagacaucagaagagagaucgacgacuucuucaaggccgacgaccccgagagcaccaagagaagcgcccugugcaucuucaagaucgccagaaagcugcuguuccuguucagaaucaaggaggacaacgagagauucgagaagcugugcagaagcauccugagcagcauggacgccgagaacgagcccaaggugugguacgugagccuggccugcagcaaggaccugacccugcuguggauccagcagaucaagaacauccugugguacugcugcgacuuccugaagcagcugaagcccgagauccugcaggacagcagacugaucacccuguaccugaccaugcuggugaccuucaccgacaccagcaccuggaagauccugagaggcaagggcgagagccugagacccgccaugaaccacaucugcgccaacaucaugggccaccugaaccagcacggcuucuacagcgugcugcagugcugcgacggccuguuccccgaccuggugagcuacgccccccacaacaaccccgugagauggagcgugggcagaagcugguacgacuggcagcugagcagauaa

SEQ ID NO: 25308 - RNA, 3252 nt, Artificial Sequence
  UBE3C__Homo_sapiens__NP_055486
auguucagcuucgagggcgacuucaagaccagacccaaggugagccugggcggcgccagcagaaaggaggagaaggccagccugcugcacagaacccaggaggagagaagaaagagagaggaggagagaagaagacugaagaacgccaucaucauccagagcuucaucagaggcuacagagacagaaagcagcaguacagcauccagagaagcgccuucgacagaugcgccacccugagccagagcggcggcgccuuccccaucgccaacggccccaaccugacccugcuggugagacagcugcuguucuucuacaagcagaacgaggacagcaagagacugaucuggcuguaccagaaccugaucaagcacagcagccuguucgugaagcagcuggacggcagcgagagacugaccugccuguuccagaucaagagacugaugagccugugcugcagacugcugcagaacugcaacgacgacagccugaacguggcccugcccaugagaaugcuggagguguucagcagcgagaacaccuaccugcccgugcugcaggacgccagcuacguggugagcgugaucgagcagauccugcacuacaugauccacaacggcuacuacagaagccuguaccugcugaucaacagcaagcugcccagcagcaucgaguacagcgaccugagcagagugcccaucgccaagauccugcuggagaacgugcugaagccccugcacuucaccuacaacagcugccccgagggcgccagacagcagguguucaccgccuucaccgaggaguuccuggccgcccccuucaccgaccagaucuuccacuucaucauccccgcccuggccgacgcccagaccguguuccccuacgagcccuuccugaacgcccugcugcugaucgagagcagaugcagcagaaagagcggcggcgcccccuggcuguucuacuucgugcugaccgugggcgagaacuaccugggcgcccugagcgaggagggccugcugguguaccugagagugcugcagaccuuccugagccagcugcccgugagccccgccagcgccagcugccacgacagcgccagcgacagcgaggaggagagcgaggaggccgacaagcccagcagccccgaggacggcagacugagcgugagcuacaucaccgaggagugccugaagaagcuggacaccaagcagcagaccaacacccugcugaaccugguguggagagacagcgccagcgaggagguguucaccaccauggccagcgugugccacacccugauggugcagcacagaaugauggugcccaaggugagacugcuguacagccuggccuucaacgccagauuccugagacaccugugguuccugaucagcagcaugagcaccagaaugaucaccggcagcauggugccccugcugcaggugaucagcagaggcagccccaugagcuucgaggacagcagcagaaucaucccccuguucuaccuguucagcagccuguucagccacagccugaucagcauccacgacaacgaguucuucggcgaccccaucgagguggugggccagagacagagcagcaugaugcccuucacccuggaggagcugaucaugcugagcagaugccugagagacgccugccugggcaucaucaagcuggccuaccccgagaccaagcccgaggugagagaggaguacaucaccgccuuccagagcaucggcgugaccaccagcagcgagaugcagcagugcauccagauggagcagaagagauggauccagcuguucaaggugaucaccaaccuggugaagaugcugaagagcagagacaccagaagaaacuucugcccccccaaccacuggcugagcgagcaggaggacaucaaggccgacaaggugacccagcuguacgugcccgccagcagacacguguggagauucagaagaaugggcagaaucggcccccugcagagcacccuggacgugggccuggagagccccccccugagcgugagcgaggagagacagcuggccgugcugaccgagcugcccuucguggugcccuucgaggagagagugaagaucuuccagagacugaucuacgccgacaagcaggaggugcagggcgacggccccuuccuggacggcaucaacgugaccaucagaagaaacuacaucuacgaggacgccuacgacaagcugagccccgagaacgagcccgaccugaagaagagaaucagagugcaccugcugaacgcccacggccuggacgaggccggcaucgacggcggcggcaucuucagagaguuccugaacgagcugcugaagagcggcuucaaccccaaccagggcuucuucaagaccaccaacgagggccugcuguaccccaaccccgccgcccagaugcuggugggcgacagcuucgccagacacuacuacuuccugggcagaaugcugggcaaggcccuguacgagaacaugcugguggagcugcccuucgccggcuucuuccugagcaagcugcugggcaccagcgccgacguggacauccaccaccuggccagccuggaccccgagguguacaagaaccugcuguuccugaagagcuacgaggacgacguggaggagcugggccugaacuucaccguggugaacaacgaccugggcgaggcccaggugguggagcugaaguucggcggcaaggacauccccgugaccagcgccaacagaaucgccuacauccaccugguggccgacuacagacugaacagacagaucagacagcacugccuggccuucagacagggccuggccaacguggugagccuggaguggcugagaauguucgaccagcaggagauccaggugcugaucagcggcgcccaggugcccaucagccuggaggaccugaagagcuucaccaacuacagcggcggcuacagcgccgaccaccccgugaucaagguguucuggagagugguggagggcuucaccgacgaggagaagagaaagcugcugaaguucgugaccagcugcagcagacccccccugcugggcuucaaggagcuguaccccgccuucugcauccacaacggcggcagcgaccuggagagacugcccaccgccagcaccugcaugaaccugcugaagcugcccgaguucuacgacgagacccugcugagaagcaagcugcuguacgccaucgagugcgccgccggcuucgagcugagcuaa

SEQ ID NO: 25309 - RNA, 3201 nt, Artificial Sequence
  UBE4A__Homo_sapiens__NP_001191006
augaccgaccaggagaacaacaacaacaucagcagcaaccccuucgccgcccuguucggcagccuggccgacgccaagcaguucgccgccauccagaaggagcagcugaagcagcagagcgacgagcugcccgccagccccgacgacagcgacaacagcgugagcgagagccuggacgaguucgacuacagcguggccgagaucagcagaagcuucagaagccagcaggagaucugcgagcagcugaacaucaaccacaugauccagagaaucuuccugaucacccuggacaacagcgaccccagccugaagagcggcaacggcauccccagcagaugcguguaccuggaggagauggccguggagcuggaggaccaggacuggcuggacaugagcaacguggagcaggcccuguucgccagacugcugcugcaggaccccggcaaccaccugaucaacaugaccagcagcaccacccugaaccugagcgccgacagagacgccggcgagagacacaucuucugcuaccuguacagcugcuuccagagagccaaggaggagaucaccaaggugcccgagaaccugcugcccuucgccgugcagugcagaaaccugaccgugagcaacaccagaaccgugcugcugacccccgagaucuacguggaccagaacauccacgagcagcugguggaccugaugcuggaggccauccagggcgcccacuucgaggacgugaccgaguuccuggaggaggugaucgaggcccugauccuggacgaggaggugagaaccuuccccgaggugaugauccccguguucgacauccugcugggcagaaucaaggaccuggagcugugccagauccugcuguacgccuaccuggacauccugcuguacuucaccagacagaaggacauggccaagguguucguggaguacauccagcccaaggaccccaccaacggccagauguaccagaagacccugcugggcgugauccugagcaucagcugccugcugaagacccccggcgugguggagaaccacggcuacuuccugaaccccagcagaagcagcccccaggagaucaaggugcaggaggccaacauccaccaguucauggcccaguuccacgagaagaucuaccagaugcugaagaaccugcugcagcugagccccgagaccaagcacugcauccugagcuggcugggcaacugccugcacgccaacgccggcagaaccaagaucugggccaaccagaugcccgagaucuucuuccagauguacgccagcgacgccuucuuccugaaccugggcgccgcccugcugaagcugugccagcccuucugcaagcccagaagcagcagacugcugaccuucaaccccaccuacugcgcccugaaggagcugaacgacgaggagagaaagaucaagaacgugcacaugagaggccuggacaaggagaccugccugauccccgccgugcaggagcccaaguucccccagaacuacaaccuggugaccgagaaccuggcccugaccgaguacacccuguaccugggcuuccacagacugcacgaccagauggugaagaucaaccagaaccugcacagacugcagguggccuggagagacgcccagcagagcagcagccccgccgccgacaaccugagagagcaguucgagagacugaugaccaucuaccugagcaccaagaccgccaugaccgagccccagaugcugcagaacugccugaaccugcaggugagcauggccgugcugcuggugcagcuggccaucggcaacgagggcagccagcccaucgagcugaccuucccccugcccgacggcuacagcagccuggccuacgugcccgaguucuucgccgacaaccugggcgacuuccugaucuuccugagaagauucgccgacgacauccuggagaccagcgccgacagccuggagcacgugcugcacuucaucaccaucuucaccggcagcaucgagagaaugaagaacccccaccugagagccaagcuggccgaggugcuggaggccgugaugccccaccuggaccagacccccaacccccuggugagcagcguguuccacagaaagagaguguucugcaacuuccaguacgccccccagcuggccgaggcccugaucaagguguucguggacaucgaguucaccggcgacccccaccaguucgagcagaaguucaacuacagaagacccauguaccccauccugagauacauguggggcaccgacaccuacagagagagcaucaaggaccuggccgacuacgccagcaagaaccuggaggccaugaaccccccccuguuccugagauuccugaaccugcugaugaacgacgccaucuuccugcuggacgaggccauccaguaccugagcaagaucaagauccagcagaucgagaaggacagaggcgagugggacagccugacccccgaggccagaagagagaaggaggccggccugcagauguucggccagcuggccagauuccacaacaucaugagcaacgagaccaucggcacccuggccuuccugaccagcgagaucaagagccuguucgugcaccccuuccuggccgagagaaucaucagcaugcugaacuacuuccugcagcaccuggugggccccaagaugggcgcccugaaggugaaggacuucagcgaguucgacuucaagccccagcagcuggugagcgacaucugcaccaucuaccugaaccugggcgacgaggagaacuucugcgccaccgugcccaaggacggcagaagcuacagccccacccuguucgcccagaccgugagagugcugaagaagaucaacaagcccggcaacaugaucauggccuucagcaaccuggccgagagaaucaagagccuggccgaccugcagcagcaggaggaggagaccuacgccgacgccugcgacgaguuccuggaccccaucaugagcacccugaugugcgaccccguggugcugcccagcagcagagugaccguggacagaagcaccaucgccagacaccugcugagcgaccagaccgaccccuucaacagaagcccccugaccauggaccagaucagacccaacaccgagcugaaggagaagauccagagauggcuggccgagagaaagcagcagaaggagcagcuggaguaa

SEQ ID NO: 25310 - RNA, 3519 nt, Artificial Sequence
  UBE4B__Homo_sapiens__XP_011538792
auggaggagcugagcgccgacgagaucagaagaagaagacuggccagacuggccggcggccagaccagccagcccaccaccccccugaccagcccccagagagagaacccccccggcccccccaucgccgccagcgcccccggccccagccagagccugggccugaacgugcacaacaugacccccgccaccagccccaucggcgccagcggcguggcccacagaagccagagcagcgagggcgugagcagccugagcagcagccccagcaacagccuggagacccagagccagagccugagcagaagccagagcauggacaucgacggcgugagcugcgagaagagcaugagccagguggacguggacagcggcaucgagaacauggagguggacgagaacgacagaagagagaagagaagccugagcgacaaggagcccagcagcggccccgaggugagcgaggagcaggcccugcagcuggugugcaagaucuucagagugagcuggaaggacagagacagagacgugaucuuccugagcagccugagcgcccaguucaagcagaaccccaaggagguguucagcgacuucaaggaccugaucggccagauccugauggaggugcugaugaugagcacccagaccagagacgagaaccccuucgccagccugaccgccaccagccagcccaucgccgccgccgccagaagccccgacagaaaccugcugcugaacaccggcagcaaccccggcaccagccccauguucugcagcguggccagcuucggcgccagcagccugagcagccuguacgagagcagccccgcccccacccccagcuucuggagcagcgugcccgugaugggccccagccuggccagccccagcagagccgccagccagcuggccgugcccagcaccccccugagcccccacagcgccgccagcggcaccgccgccggcagccagcccagcagccccagauacagacccuacaccgugacccaccccugggccagcagcggcgugagcauccugagcagcagccccagcccccccgcccuggccagcagcccccaggccgugcccgccagcagcagcagacagagacccagcagcaccggccccccccugccccccgccagccccagcgccaccagcagaagacccagcagccugagaaucagccccagcauguacgacaaccccuucagcuuccuguuccuggcccugagcggcgacagcagcgacgaggaggacgaggaggaggacgacgacgacggcgacggcgacgacgagggcggcggcggcggcgacgacuucagcugcgugcaguucggcagcagccugggcgccagcggcggcgccagcaacugggacagcuacagcgaccacuucaccaucgagaccugcaaggagaccgacaugcugaacuaccugaucgagugcuucgacagagugggcaucgaggagaagaaggcccccaagaugugcagccagcccgccgugagccagcugcugagcaacaucagaagccagugcaucagccacaccgcccuggugcugcagggcagccugacccagcccagaagccugcagcagcccagcuuccuggugcccuacaugcugugcagaaaccugcccuacggcuucauccaggagcuggugagaaccacccaccaggacgaggagguguucaagcagaucuucauccccauccugcagggccuggcccuggccgccaaggagugcagccuggacagcgacuacuucaaguacccccugauggcccugggcgagcugugcgagaccaaguucggcaagacccaccccgugugcaaccugguggccagccugagacuguggcugcccaagagccugagccccggcugcggcagagagcugcagagacugagcuaccugggcgccuucuucagcuucagcguguucgccgaggacgacgugaaggugguggagaaguacuucagcggccccgccaucacccuggagaacaccagaguggugagccagagccugcagcacuaccuggagcugggcagacaggagcuguucaagauccugcacagcauccugcugaacggcgagaccagagaggccgcccugagcuacauggccgccguggugaacgccaacaugaagaaggcccagaugcagaccgacgacagacuggugagcaccgacggcuucaugcugaacuuccugugggugcugcagcagcugagcaccaagaucaagcuggagaccguggaccccaccuacaucuuccaccccagaugcagaaucacccugcccaacgacgagaccagagugaacgccaccauggaggacgugaacgacuggcugaccgagcuguacggcgaccagccccccuucagcgagcccaaguuccccaccgagugcuucuuccugacccugcacgcccaccaccugagcauccugcccagcugcagaagauacaucagaagacugagagccaucagagagcugaacagaaccguggaggaccugaagaacaacgagagccaguggaaggacagcccccuggccaccagacacagagagaugcugaagagaugcaagacccagcugaagaagcuggugagaugcaaggccugcgccgacgccggccugcuggacgagagcuuccugagaagaugccugaacuucuacggccugcugauccagcugcugcugagaauccuggaccccgccuaccccgacaucacccugccccugaacagcgacgugcccaagguguucgccgcccugcccgaguucuacguggaggacguggccgaguuccuguucuucaucgugcaguacagcccccaggcccuguacgagcccugcacccaggacaucgugauguuccugguggugaugcugugcaaccagaacuacaucagaaaccccuaccugguggccaagcugguggaggugauguucaugaccaaccccgccgugcagcccagaacccagaaguucuucgagaugaucgagaaccacccccugagcaccaagcugcuggugcccagccugaugaaguucuacaccgacguggagcacaccggcgccaccagcgaguucuacgacaaguucaccaucagauaccacaucagcaccaucuucaagagccuguggcagaacaucgcccaccacggcaccuucauggaggaguucaacagcggcaagcaguucgugagauacaucaacaugcugaucaacgacaccaccuuccugcuggacgagagccuggagagccugaagagaauccacgaggugcaggaggagaugaagaacaaggagcagugggaccagcugcccagagaccagcagcaggccagacagagccagcuggcccaggacgagagagugagcagaagcuaccuggcccuggccaccgagaccguggacauguuccacauccugaccaagcaggugcagaagcccuuccugagaccccacgagcugagcuacuaccccgugaucagcuaa

SEQ ID NO: 25311 - RNA, 540 nt, Artificial Sequence
  UBIAD1__Homo_sapiens__XP_011539606
auggccgccagccaggugcugggcgagaagaucaacauccugagcggcgagaccgugaaggccggcgacagagacccccugggcaacgacugccccgagcaggacagacugccccagagaagcuggagacagaagugcgccagcuacgugcuggcccugagacccuggagcuucagcgccagccugacccccguggcccugggcagcgcccuggccuacagaagccacggcgugcuggaccccagacugcuggugggcugcgccguggccgugcuggccgugcacggcgccggcaaccuggugaacaccuacuacgacuucagcaagggcaucgaccacaagaagagcgacgacagaacccugguggacagaauccuggagccccaggacguggugagauucggcguguuccuguacacccugggcugcgugugcgccgccugccuguacuaccugagcccccugaagcuggagcaccuggcccugaucuacuucggcggccugagcggcagcuuccuguacaccggcgugcugaucuaa

SEQ ID NO: 25312 - RNA, 354 nt, Artificial Sequence
  UBL3__Homo_sapiens__NP_009037
augagcagcaacgugcccgccgacaugaucaaccugagacugauccuggugagcggcaagaccaaggaguuccuguucagccccaacgacagcgccagcgacaucgccaagcacguguacgacaacuggcccauggacugggaggaggagcaggugagcagccccaacauccugagacugaucuaccagggcagauuccugcacggcaacgugacccugggcgcccugaagcugcccuucggcaagaccaccgugaugcaccugguggccagagagacccugcccgagcccaacagccagggccagagaaacagagagaagaccggcgagagcaacugcugcgugauccuguaa

SEQ ID NO: 25313 - RNA, 474 nt, Artificial Sequence
  UBL4A__Homo_sapiens__NP_055050
augcagcugaccgugaaggcccugcagggcagagagugcagccugcaggugcccgaggacgagcuggugagcacccugaagcagcuggugagcgagaagcugaacgugcccgugagacagcagagacugcuguucaagggcaaggcccuggccgacggcaagagacugagcgacuacagcaucggccccaacagcaagcugaaccugguggugaagccccuggagaaggugcugcuggaggagggcgaggcccagagacuggccgacagcccccccccccagguguggcagcugaucagcaaggugcuggccagacacuucagcgccgccgacgccagcagagugcuggagcagcugcagagagacuacgagagaagccugagcagacugacccuggacgacaucgagagacuggccagcagauuccugcaccccgaggugaccgagaccauggagaagggcuucagcaaguaa

SEQ ID NO: 25314 - RNA, 222 nt, Artificial Sequence
  UBL5__Homo_sapiens__NP_001041706
augaucgagguggugugcaacgacagacugggcaagaaggugagagugaagugcaacaccgacgacaccaucggcgaccugaagaagcugaucgccgcccagaccggcaccagauggaacaagaucgugcugaagaagugguacaccaucuucaaggaccacgugagccugggcgacuacgagauccacgacggcaugaaccuggagcuguacuaccaguaa

SEQ ID NO: 25315 - RNA, 1143 nt, Artificial Sequence
  UBL7__Homo_sapiens__NP_001273669
augagccugagcgacuggcaccuggccgugaagcuggccgaccagccccugacccccaagagcauccugagacugcccgagaccgagcugggcgaguacagccugggcggcuacagcaucagcuuccugaagcagcugaucgccggcaagcugcaggagagcgugcccgaccccgagcugaucgaccugaucuacugcggcagaaagcugaaggacgaccagacccuggacuucuacggcauccagcccggcagcaccgugcacgugcugagaaagagcuggcccgagcccgaccagaagcccgagcccguggacaagguggccgccaugagagaguucagagugcugcacaccgcccugcacagcagcagcagcuacagagaggccguguucaagaugcugagcaacaaggagagccuggaccagaucaucguggccacccccggccugagcagcgaccccaucgcccugggcgugcugcaggacaaggaccuguucagcguguucgccgaccccaacaugcuggacacccuggugcccgcccaccccgcccuggugaacgccaucgugcuggugcugcacagcguggccggcagcgcccccaugcccggcaccgacagcagcagcagaagcaugcccagcagcagcuacagagacaugcccggcggcuuccuguucgagggccugagcgacgacgaggacgacuuccaccccaacaccagaagcacccccagcagcagcacccccagcagcagacccgccagccugggcuacagcggcgccgccggccccagacccaucacccagagcgagcuggccaccgcccuggcccuggccagcacccccgagagcagcagccacacccccacccccggcacccagggccacagcagcggcaccagccccaugagcagcggcgugcagagcggcacccccaucaccaacgaccuguucagccaggcccugcagcacgcccugcaggccagcggccagcccagccugcagagccaguggcagccccagcugcagcagcugagagacaugggcauccaggacgacgagcugagccugagagcccugcaggccaccggcggcgacauccaggccgcccuggagcugaucuucgccggcggcgcccccuaa

SEQ ID NO: 25316 - RNA, 957 nt, Artificial Sequence
  UBLCP1__Homo_sapiens__NP_659486
auggcccugcccaucaucgugaaguggggcggccaggaguacagcgugaccacccugagcgaggacgacaccgugcuggaccugaagcaguuccugaagacccugaccggcgugcugcccgagagacagaagcugcugggccugaaggugaagggcaagcccgccgagaacgacgugaagcugggcgcccugaagcugaagcccaacaccaagaucaugaugaugggcaccagagaggagagccuggaggacgugcugggccccccccccgacaacgacgacguggugaacgacuucgacaucgaggacgaggugguggagguggagaacagagaggagaaccugcugaagaucagcagaagagugaaggaguacaagguggagauccugaacccccccagagagggcaagaagcugcuggugcuggacguggacuacacccuguucgaccacagaagcugcgccgagaccggcguggagcugaugagacccuaccugcacgaguuccugaccagcgccuacgaggacuacgacaucgugaucuggagcgccaccaacaugaaguggaucgaggccaagaugaaggagcugggcgugagcaccaacgccaacuacaagaucaccuucaugcuggacagcgccgccaugaucaccgugcacacccccagaagaggccugaucgacgugaagccccugggcgugaucuggggcaaguucagcgaguucuacagcaagaagaacaccaucauguucgacgacaucggcagaaacuuccugaugaacccccagaacggccugaagaucagacccuucaugaaggcccaccugaacagagacaaggacaaggagcugcugaagcugacccaguaccugaaggagaucgccaagcuggacgacuuccuggaccugaaccacaaguacugggagagauaccugagcaagaagcagggccaguaa

SEQ ID NO: 25317 - RNA, 3405 nt, Artificial Sequence
  UBN1__Homo_sapiens__NP_001072982
augagcgagccccacagagugcaguucaccagccugcccggcagccugaaccccgccuuccugaagaagagcagaaaggaggaggccggcgccggcgagcagcaccaggacugcgagcccgccgccgccgccgugagaaucacccugacccuguucgagcccgaccacaagagaugccccgaguucuucuaccccgagcuggugaagaacaucagaggcaaggugaagggccugcagcccggcgacaagaagaaggaccugagcgaccccuucaacgacgaggagaaggagagacacaagguggaggcccuggccagaaaguucgaggagaaguacggcggcaagaagagaagaaaggacagaauccaggaccugaucgacaugggcuacggcuacgacgagagcgacagcuucaucgacaacagcgaggccuacgacgagcuggugcccgccagccugaccaccaaguacggcggcuucuacaucaacagcggcacccugcaguucagacaggccagcgagagcgaggacgacuucaucaaggagaagaagaagaagagccccaagaagagaaagcugaaggagggcggcgagaagaucaagaagaagaagaaggacgacaccuacgacaaggagaagaagagcaagaagagcaaguucagcaaggccggcuucaccgcccugaacgccagcaaggagaagaagaagaagaaguacagcggcgcccugagcgugaaggagaugcugaagaaguuccagaaggagaaggaggcccagaagaagagagaggaggagcacaagcccguggccgugcccagcgccgaggcccagggccugagagagcuggagggcgccagcgacccccugcugagccuguucggcagcaccagcgacaacgaccugcugcaggccgccaccgccauggacagccugaccgaccuggaccuggagcaccugcugagcgagagccccgagggcagccccuucagagacauggacgacggcagcgacagccugggcgugggccuggaccaggaguucagacagcccagcagccugcccgagggccugcccgccccccuggagaagagagugaaggagcuggcccaggccgccagagccgccgagggcgagagcagacagaaguucuucacccaggacaucaacggcauccugcuggacaucgaggcccagaccagagagcugagcagccaggugagaagcggcguguacgccuaccuggccagcuuccugcccugcagcaaggacgcccugcugaagagagccagaaagcugcaccuguacgagcagggcggcagacugaaggagccccugcagaagcugaaggaggccaucggcagagccaugcccgagcagauggccaaguaccaggacgagugccaggcccacacccaggccaagguggccaagaugcuggaggaggagaaggacaaggagcagagagacagaaucugcagcgacgaggaggaggacgaggagaagggcggcagaagaaucaugggccccagaaagaaguuccaguggaacgacgagaucagagagcugcugugccagguggugaagaucaagcuggagagccaggaccuggagagaaacaacaaggcccaggccugggaggacugcgugaagggcuuccuggacgccgaggugaagccccuguggcccaagggcuggaugcaggccagaacccuguucaaggagagcagaagaggccacggccaccugaccagcauccuggccaagaagaaggugauggcccccagcaagaucaaggugaaggagagcagcaccaagcccgacaagaaggugagcgugcccagcggccagaucggcggccccaucgcccugcccagcgaccaccagaccggcggccugagcaucggcgccagcagcagagagcugcccagccaggccagcggcggccuggccaaccccccccccgugaaccuggaggacagccuggacgaggaccugaucagaaaccccgccagcagcguggaggccgugagcaaggagcuggccgcccugaacagcagagccgccggcaacagcgaguucacccugcccgcccccagcaaggcccccgccgagaaggugggcggcgugcugugcaccgaggagaagagaaacuucgccaagcccagccccagcgcccccccccccgccagcagccugcagagcccccugaacuuccuggccgagcaggcccuggcccugggccagagcagccaggagaagaagcccgagagcagcggcuacaaggagcugagcugccaggccccccugaacaagggccugcccgaggugcaccagagcaaggccaagcaccacagccugcccagaaccagccacggcccccagguggccgugcccgugcccggcccccaggugaagguguuccacgccggcacccagcagcagaagaacuucaccccccccagccccuucgccaacaagcugcagggccccaaggccagccccacccagugccacagaagccugcugcagcuggugaagaccgccgccaagggccagggcuuccaccccagcgcccccgccaccagcggcggccugagcgccagcagcagcagcagccacaagacccccgccagcagcagcagcgcccugagccaccccgccaagccccacagcgugagcagcgccggcagcagcuacaagaacaaccccuucgccagcagcaucagcaagcacggcgugagcagcggcagcagcagcagcggcggcacccccgugcagagcagcgugagcggcagccuggugcccggcauccagccccccagcgugggccaggccaccagcagacccgugcccagcagcgccggcaagaagaugcccgugagccagaagcugacccugguggccccccccggcggccccaacggcgacagcagcggcggcacccagggcguggccaagcugcugaccagccccagccugaagcccagcgccgugagcagcgugaccagcagcaccagccugagcaagggcgccagcggcaccgugcugcuggccggcagcagccugauggccagccccuacaagagcagcagccccaagcugagcggcgccaugagcagcaacagccugggcaucaucacccccgugcccauccccgugcacgugcugagcuucagcgccgacagcagcgccaaggccggcgugagcaaggacgccaucgugaccggccccgcccccggcagcuuccaccacggccugggccacagccugcuggccggccugcacagcagccccccccacgccgccccccugccccacgccgccgugcccacccacaucccccagagccugcccggcgccagccagcugcacggcaagggccccgccgugcccagaaagcuguaa

SEQ ID NO: 25318 - RNA, 1539 nt, Artificial Sequence
  UBOX5__Homo_sapiens__NP_001254513
auggugaucaaccugugccugccccaguucagacccagaauccacugcaacaagaucagcgccgacggcuacgagguggagaaccugaucagcgaggaccugaccaagagaagccacggcuucagaaccgaguacuucaucaagccccccguguacgugaccgugagcuuccccuucaacguggagaucugcagaaucaacaucgaccugaccgccggcggcggccagaacgugaccggccuggagauguacaccagcgccagcagcagcagagugagcuggaacaccccccagugcagaacccugggccccgccgagcccagcgugcccgacaaggaggccuucacccuggugggcaaggugcugcugaagaaccagagccaggugguguucagccacagaggcuucaaggccagaccccccuucggcgccauggaggccacccugcccagccccgccgugguggcccaggagcuguggaacaagggcgcccugagccugagccacguggcccaccugagaaucugcaucacccacgugaccggcggcggcauccccugcaucaagagacuggagguguggggccagcccgccaagaccugcagccaggaggugaucgacagcauccugcuggugaccagcgagaaccugccccaggacguggcccugcaggcccccgcccugcccauggagagcgacugcgaccccggcgaccagcccgagagccagcaggcccccagcagccugcagaagcuggccgagaucauccaggacgugcccgaggaguuccuggaccccaucacccuggagaucaugcccugccccaugcugcugcccagcggcaaggugaucgaccagagcacccuggagaagugcaacagaagcgaggccaccuggggcagagugcccagcgaccccuucaccggcguggccuucaccccccacagccagccccugccccaccccagccugaaggccagaaucgaccacuuccugcugcagcacagcauccccggcugccaccugcugggcagagcccagaccgcccuggccgugauccccagcagcaucgugcugcccagccagaagagaaagaucgagcaggccgagcacgugcccgacagcaacuucggcgugaacgccagcugcuucagcgccaccagcccccuggugcugcccaccaccagcgagcacaccgccaagaagaugaaggccaccaacgagcccagccugacccacauggacugcagcaccggcccccugagccacgagcagaagcugagccagagccuggagaucgcccuggccagcacccugggcagcaugcccagcuucaccgccagacugaccagaggccagcugcagcaccugggcaccagaggcagcaacaccagcuggagacccggcaccggcagcgccugggagcaccccggccccagaaugugccugcugcagaagagcaucuucagccugcugcagaagggcgccggcgugcccgccgcccugagacccccccccgugcccacccugcccggcuaa

SEQ ID NO: 25319 - RNA, 1515 nt, Artificial Sequence
  UBP1__Homo_sapiens__NP_001121632
auggccugggugcugaagauggacgaggugaucgagagcggccuggugcacgacuucgacgccagccugagcggcaucggccaggagcugggcgccggcgccuacagcaugagcgacgugcuggcccugcccaucuucaagcaggaggacagcagccugccccuggacggcgagaccgagcacccccccuuccaguacgugaugugcgccgccaccagccccgccgugaagcugcacgacgagacccugaccuaccugaaccagggccagagcuacgagaucagaaugcuggacaacagaaagaugggcgacaugcccgagaucaacggcaagcuggugaagagcaucaucagagugguguuccacgacagaagacugcaguacaccgagcaccagcagcuggagggcuggaaguggaacagacccggcgacagacugcuggaccuggacauccccaugagcgugggcaucaucgacaccagaaccaaccccagccagcugaacgccguggaguuccugugggaccccgccaagagaaccagcgccuucauccaggugcacugcaucagcaccgaguucacccccagaaagcacggcggcgagaagggcgugcccuucagaauccagguggacaccuucaagcagaacgagaacggcgaguacaccgaccaccugcacagcgccagcugccagaucaagguguucaagcccaagggcgccgacagaaagcagaagaccgacagagagaagauggagaagagaaccgcccacgagaaggagaaguaccagcccagcuacgacaccaccauccugaccgagugcagccccuggcccgacgcccccaccgccuacgugaacaacagccccagccccgcccccaccuucaccagcccccagcagagcaccugcagcgugcccgacagcaacagcagcagccccaaccaccagggcgacggcgccagccagaccagcggcgagcagauccagcccagcgccaccauccaggagacccagcaguggcugcugaagaacagauucagcagcuacaccagacuguucagcaacuucagcggcgccgaccugcugaagcugaccaaggaggaccuggugcagaucugcggcgccgccgacggcaucagacuguacaacagccugaagagcagaagcgugagacccagacugaccaucuacgugugcagagagcagcccagcagcaccgugcugcagggccagcagcaggccgccagcagcgccagcgagaacggcagcggcgcccccuacguguaccacgccaucuaccuggaggagaugaucgccagcgagguggccagaaagcuggcccugguguucaacaucccccugcaccagaucaaccagguguacagacagggccccaccggcauccacauccuggugagcgaccagauggugcagaacuuccaggacgagagcugcuuccuguucagcaccgugaaggccgagagcagcgacggcauccacaucauccugaaguaa

SEQ ID NO: 25320 - RNA, 1770 nt, Artificial Sequence
  UBQLN1__Homo_sapiens__NP_038466
auggccgagagcggcgagagcggcggcccccccggcagccaggacagcgccgccggcgccgagggcgccggcgcccccgccgccgccgccagcgccgagcccaagaucaugaaggugaccgugaagacccccaaggagaaggaggaguucgccgugcccgagaacagcagcgugcagcaguucaaggaggagaucagcaagagauucaagagccacaccgaccagcuggugcugaucuucgccggcaagauccugaaggaccaggacacccugagccagcacggcauccacgacggccugaccgugcaccuggugaucaagacccagaacagaccccaggaccacagcgcccagcagaccaacaccgccggcagcaacgugaccaccagcagcacccccaacagcaacagcaccagcggcagcgccaccagcaaccccuucggccugggcggccugggcggccuggccggccugagcagccugggccugaacaccaccaacuucagcgagcugcagagccagaugcagagacagcugcugagcaaccccgagaugauggugcagaucauggagaaccccuucgugcagagcaugcugagcaaccccgaccugaugagacagcugaucauggccaacccccagaugcagcagcugauccagagaaaccccgagaucagccacaugcugaacaaccccgacaucaugagacagacccuggagcuggccagaaaccccgccaugaugcaggagaugaugagaaaccaggacagagcccugagcaaccuggagagcauccccggcggcuacaacgcccugagaagaauguacaccgacauccaggagcccaugcugagcgccgcccaggagcaguucggcggcaaccccuucgccagccuggugagcaacaccagcagcggcgagggcagccagcccagcagaaccgagaacagagacccccugcccaaccccugggccccccagaccagccagagcagcagcgccagcagcggcaccgccagcaccgugggcggcaccaccggcagcaccgccagcggcaccagcggccagagcaccaccgcccccaaccuggugcccggcgugggcgccagcauguucaacacccccggcaugcagagccugcugcagcagaucaccgagaacccccagcugaugcagaacaugcugagcgcccccuacaugagaagcaugaugcagagccugagccagaaccccgaccuggccgcccagaugaugcugaacaacccccuguucgccggcaacccccagcugcaggagcagaugagacagcagcugcccaccuuccugcagcagaugcagaaccccgacacccugagcgccaugagcaaccccagagccaugcaggcccugcugcagauccagcagggccugcagacccuggccaccgaggcccccggccugauccccggcuucacccccggccugggcgcccugggcagcaccggcggcagcagcggcaccaacggcagcaacgccacccccagcgagaacaccagccccaccgccggcaccaccgagcccggccaccagcaguucauccagcagaugcugcaggcccuggccggcgugaacccccagcugcagaaccccgaggugagauuccagcagcagcuggagcagcugagcgccaugggcuuccugaacagagaggccaaccugcaggcccugaucgccaccggcggcgacaucaacgccgccaucgagagacugcugggcagccagcccagcuaa

SEQ ID NO: 25321 - RNA, 1875 nt, Artificial Sequence
  UBQLN2__Homo_sapiens__NP_038472
auggccgagaacggcgagagcagcggcccccccagacccagcagaggccccgccgccgcccagggcagcgccgccgcccccgccgagcccaagaucaucaaggugaccgugaagacccccaaggagaaggaggaguucgccgugcccgagaacagcagcgugcagcaguucaaggaggccaucagcaagagauucaagagccagaccgaccagcuggugcugaucuucgccggcaagauccugaaggaccaggacacccugauccagcacggcauccacgacggccugaccgugcaccuggugaucaagagccagaacagaccccagggccagagcacccagcccagcaacgccgccggcaccaacaccaccagcgccagcacccccagaagcaacagcacccccaucagcaccaacagcaaccccuucggccugggcagccugggcggccuggccggccugagcagccugggccugagcagcaccaacuucagcgagcugcagagccagaugcagcagcagcugauggccagccccgagaugaugauccagaucauggagaaccccuucgugcagagcaugcugagcaaccccgaccugaugagacagcugaucauggccaacccccagaugcagcagcugauccagagaaaccccgagaucagccaccugcugaacaaccccgacaucaugagacagacccuggagaucgccagaaaccccgccaugaugcaggagaugaugagaaaccaggaccuggcccugagcaaccuggagagcauccccggcggcuacaacgcccugagaagaauguacaccgacauccaggagcccaugcugaacgccgcccaggagcaguucggcggcaaccccuucgccagcgugggcagcagcagcagcagcggcgagggcacccagcccagcagaaccgagaacagagacccccugcccaaccccugggcccccccccccgccacccagagcagcgccaccaccagcaccaccaccagcaccggcagcggcagcggcaacagcagcagcaacgccaccggcaacaccguggccgccgccaacuacguggccagcaucuucagcacccccggcaugcagagccugcugcagcagaucaccgagaacccccagcugauccagaacaugcugagcgcccccuacaugagaagcaugaugcagagccugagccagaaccccgaccuggccgcccagaugaugcugaacagcccccuguucaccgccaacccccagcugcaggagcagaugagaccccagcugcccgccuuccugcagcagaugcagaaccccgacacccugagcgccaugagcaaccccagagccaugcaggcccugaugcagauccagcagggccugcagacccuggccaccgaggcccccggccugauccccagcuucacccccggcgugggcgugggcgugcugggcaccgccaucggccccgugggccccgugacccccaucggccccaucggccccaucgugcccuucacccccaucggccccaucggccccaucggccccaccggccccgccgccccccccggcagcaccggcagcggcggccccaccggccccaccgugagcagcgccgcccccagcgagaccaccagccccaccagcgagagcggccccaaccagcaguucauccagcagauggugcaggcccuggccggcgccaacgccccccagcugcccaaccccgaggugagauuccagcagcagcuggagcagcugaacgccaugggcuuccugaacagagaggccaaccugcaggcccugaucgccaccggcggcgacaucaacgccgccaucgagagacugcugggcagccagcccagcuaa

SEQ ID NO: 25322 - RNA, 1428 nt, Artificial Sequence
  UBQLNL__Homo_sapiens__NP_659490
auguggcacgccaucagcagaaccagcagaaugagccagagcggcugccccagcggccugcuggccgacaagaacaucagcagcagcgccaccagagugaucgugaagaccgccggcaaccagaaggacuucaugguggccgacgacaucagcgugagacaguucaaggagaugcugcuggcccacuuccagugccagauggaccagcuggugcugguguucaugggcugccugcugaaggaccacgacacccugagccagagaggcaucauggacggccacaccaucuaccuggugaucaagagcaagcagggcagcagaagccuggcccacagcuucagagaccugcccaccaacgaccccugccacagagacagaaacaccaagggcaacagcagcagagugcaccagcccaccggcaugaaccaggcccccguggagcuggcccacuucgugggcagcgacgcccccaaggugcacacccagaaccuggaggugagccaccccgagugcaaggcccagaugcuggagaaccccagcauccagagacugcugagcaacauggaguucauguggcaguucaucagcgagcaccuggacacccagcagcugaugcagcagaaccccgaggugagcagacugcugcuggacaacagcgagauccugcugcagacccuggagcuggccagaaaccuggccaugauccaggagaucaugcagauccagcagcccagccagaaccuggaguacccccugaacccccagcccuaccugggccuggagaccaugcccggcggcaacaacgcccugggccagaacuacgccgacaucaacgaccagaugcugaacagcaugcaggaccccuucggcggcaaccccuucaccgcccugcuggccggccaggugcuggagcaggugcagagcagcccccccccccccccccccagccaggagcagcaggaccagcugacccagcaccccgccaccagagugaucuacaacagcagcggcggcuucagcagcaacaccagcgccaacgacacccugaacaaggugaaccacaccagcaaggccaacaccgccaugaucagcaccaagggccagagccacaucugcgccaccagacagcccgccuggauccccgcccugcccagcaucgagcugacccagcagcugcaggaggaguacaaggacgccaccgugagccugagcagcagcagacagacccugaagggcgaccugcagcugagcgacgagcagagcagcagccagaucaccggcggcaugaugcagcugcugaugaacaaccccuaccuggccgcccagaucaugcuguucaccagcaugccccagcugagcgagcaguggagacagcagcugcccaccuuccugcagcagacccagaucagcgaccugcugagcgccuaa

SEQ ID NO: 25323 - RNA, 5250 nt, Artificial Sequence
  UBR1__Homo_sapiens__NP_777576
auggccgacgaggaggccggcggcaccgagagaauggagaucagcgccgagcugccccagaccccccagagacuggccagcuggugggaccagcagguggacuucuacaccgccuuccugcaccaccuggcccagcuggugcccgagaucuacuucgccgagauggaccccgaccuggagaagcaggaggagagcgugcagaugagcaucuucaccccccuggagugguaccuguucggcgaggaccccgacaucugccuggagaagcugaagcacagcggcgccuuccagcugugcggcagaguguucaagagcggcgagaccaccuacagcugcagagacugcgccaucgaccccaccugcgugcugugcauggacugcuuccaggacagcgugcacaagaaccacagauacaagaugcacaccagcaccggcggcggcuucugcgacugcggcgacaccgaggccuggaagaccggccccuucugcgugaaccacgagcccggcagagccggcaccaucaaggagaacagcagaugcccccugaacgaggaggugaucgugcaggccagaaagaucuuccccagcgugaucaaguacgugguggagaugaccaucugggaggaggagaaggagcugccccccgagcugcagaucagagagaagaacgagagauacuacugcgugcuguucaacgacgagcaccacagcuacgaccacgugaucuacagccugcagagagcccuggacugcgagcuggccgaggcccagcugcacaccaccgccaucgacaaggagggcagaagagccgugaaggccggcgccuacgccgccugccaggaggccaaggaggacaucaagagccacagcgagaacgugagccagcacccccugcacguggaggugcugcacagcgagaucauggcccaccagaaguucgcccugagacugggcagcuggaugaacaagaucaugagcuacagcagcgacuucagacagaucuucugccaggccugccugagagaggagcccgacagcgagaaccccugccugaucagcagacugaugcugugggacgccaagcuguacaagggcgccagaaagauccugcacgagcugaucuucagcagcuucuucauggagauggaguacaagaagcuguucgccauggaguucgugaaguacuacaagcagcugcagaaggaguacaucagcgacgaccacgacagaagcaucagcaucaccgcccugagcgugcagauguucaccgugcccacccuggccagacaccugaucgaggagcagaacgugaucagcgugaucaccgagacccugcuggaggugcugcccgaguaccuggacagaaacaacaaguucaacuuccagggcuacagccaggacaagcugggcagaguguacgccgugaucugcgaccugaaguacauccugaucagcaagcccaccaucuggaccgagagacugagaaugcaguuccuggagggcuucagaagcuuccugaagauccugaccugcaugcagggcauggaggagaucagaagacaggugggccagcacaucgagguggaccccgacugggaggccgccaucgccauccagaugcagcugaagaacauccugcugauguuccaggaguggugcgccugcgacgaggagcugcugcugguggccuacaaggagugccacaaggccgugaugagaugcagcaccagcuucaucagcagcagcaagaccguggugcagagcugcggccacagccuggagaccaagagcuacagagugagcgaggaccuggugagcauccaccugccccugagcagaacccuggccggccugcacgugagacugagcagacugggcgccgugagcagacugcacgaguucgugagcuucgaggacuuccagguggaggugcugguggaguacccccugagaugccuggugcugguggcccaggugguggccgagauguggagaagaaacggccugagccugaucagccagguguucuacuaccaggacgugaagugcagagaggagauguacgacaaggacaucaucaugcugcagaucggcgccagccugauggaccccaacaaguuccugcugcuggugcugcagagauacgagcuggccgaggccuucaacaagaccaucagcaccaaggaccaggaccugaucaagcaguacaacacccugaucgaggagaugcugcaggugcugaucuacaucgugggcgagagauacgugcccggcgugggcaacgugaccaaggaggaggugaccaugagagagaucauccaccugcugugcaucgagcccaugccccacagcgccaucgccaagaaccugcccgagaacgagaacaacgagaccggccuggagaacgugaucaacaagguggccaccuucaagaagcccggcgugagcggccacggcguguacgagcugaaggacgagagccugaaggacuucaacauguacuucuaccacuacagcaagacccagcacagcaaggccgagcacaugcagaagaagagaagaaagcaggagaacaaggacgaggcccugccccccccccccccccccgaguucugccccgccuucagcaaggugaucaaccugcugaacugcgacaucaugauguacauccugagaaccguguucgagagagccaucgacaccgacagcaaccuguggaccgagggcaugcugcagauggccuuccacauccuggcccugggccugcuggaggagaagcagcagcugcagaaggcccccgaggaggaggugaccuucgacuucuaccacaaggccagcagacugggcagcagcgccaugaacauccagaugcugcuggagaagcugaagggcaucccccagcuggagggccagaaggacaugaucaccuggauccugcagauguucgacaccgugaagagacugagagagaagagcugccugaucguggccaccaccagcggcagcgagagcaucaagaacgacgagaucacccacgacaaggagaaggccgagagaaagagaaaggccgaggccgccagacugcacagacagaagaucauggcccagaugagcgcccugcagaagaacuucaucgagacccacaagcugauguacgacaacaccagcgagaugcccggcaaggaggacagcaucauggaggaggagagcacccccgccgugagcgacuacagcagaaucgcccugggccccaagagaggccccagcgugaccgagaaggaggugcugaccugcauccugugccaggaggagcaggaggugaagaucgagaacaacgccauggugcugagcgccugcgugcagaagagcaccgcccugacccagcacagaggcaagcccaucgagcugagcggcgaggcccuggacccccuguucauggaccccgaccuggccuacggcaccuacaccggcagcugcggccacgugaugcacgccgugugcuggcagaaguacuucgaggccgugcagcugagcagccagcagagaauccacguggaccuguucgaccuggagagcggcgaguaccugugcccccugugcaagagccugugcaacaccgugauccccaucaucccccugcagccccagaagaucaacagcgagaacgccgacgcccuggcccagcugcugacccuggccagauggauccagaccgugcuggccagaaucagcggcuacaacaucagacacgccaagggcgagaaccccauccccaucuucuucaaccagggcaugggcgacagcacccuggaguuccacagcauccugagcuucggcguggagagcagcaucaaguacagcaacagcaucaaggagauggugauccuguucgccaccaccaucuacagaaucggccugaaggugccccccgacgagagagaccccagagugcccaugcugaccuggagcaccugcgccuucaccauccaggccaucgagaaccugcugggcgacgagggcaagccccuguucggcgcccugcagaacagacagcacaacggccugaaggcccugaugcaguucgccguggcccagagaaucaccugcccccaggugcugauccagaagcaccuggugagacugcugagcguggugcugcccaacaucaagagcgaggacacccccugccugcugagcaucgaccuguuccacgugcuggugggcgccgugcuggccuuccccagccuguacugggacgaccccguggaccugcagcccagcagcgugagcagcagcuacaaccaccuguaccuguuccaccugaucaccauggcccacaugcugcagauccugcugaccguggacaccggccugccccuggcccaggugcaggaggacagcgaggaggcccacagcgccagcagcuucuucgccgagaucagccaguacaccagcggcagcaucggcugcgacauccccggcugguaccugugggugagccugaagaacggcaucacccccuaccugagaugcgccgcccuguucuuccacuaccugcugggcgugaccccccccgaggagcugcacaccaacagcgccgagggcgaguacagcgcccugugcagcuaccugagccugcccaccaaccuguuccugcuguuccaggaguacugggacaccgugagaccccugcugcagagauggugcgccgaccccgcccugcugaacugccugaagcagaagaacaccguggugagauaccccagaaagagaaacagccugaucgagcugcccgacgacuacagcugccugcugaaccaggccagccacuucagaugccccagaagcgccgacgacgagagaaagcaccccgugcugugccuguucugcggcgccauccugugcagccagaacaucugcugccaggagaucgugaacggcgaggaggugggcgccugcaucuuccacgcccugcacugcggcgccggcgugugcaucuuccugaagaucagagagugcagaguggugcugguggagggcaaggccagaggcugcgccuaccccgcccccuaccuggacgaguacggcgagaccgaccccggccugaagagaggcaacccccugcaccugagcagagagagauacagaaagcugcaccugguguggcagcagcacugcaucaucgaggagaucgccagaagccaggagaccaaccagaugcuguucggcuucaacuggcagcugcuguaa

SEQ ID NO: 25324 - RNA, 5667 nt, Artificial Sequence
  UBR3__Homo_sapiens__NP_742067
auggccgccgccgccgccgccgccgugggcggccagcagcccagccagcccgagcugcccgcccccggccuggcccuggacaaggccgccaccgccgcccaccugaaggccgcccugagcagacccgacaacagagccggcgccgaggagcugcaggcccugcuggagagagugcugagcgccgagagaccccuggccgccgccgccggcggcgaggacgccgccgccgccggcggcggcggcggccccggcgccgccgaggaggaggcccuggaguggugcaagugccugcuggccggcggcggcggcuacgacgaguucugcgccgccgugagagccuacgaccccgccgcccugugcggccugguguggaccgccaacuucguggccuacagaugcagaaccugcggcaucagccccugcaugagccugugcgccgagugcuuccaccagggcgaccacaccggccacgacuucaacauguucagaagccaggccggcggcgccugcgacugcggcgacagcaacgugaugagagagagcggcuucugcaagagacaccagaucaagagcagcagcaacauccccugcgugcccaaggaccugcugaugaugagcgaguucgugcugcccagauucaucuucugccugauccaguaccugagagagggcuacaacgagcccgccgccgacggccccagcgagaaggaccugaacaaggugcugcagcugcuggagccccagaucagcuuccuggaggaccugaccaagaugggcggcgccaugagaagcgugcugacccaggugcugaccaaccagcagaacuacaaggaccugaccagcggccugggcgagaacgccugcgugaagaagagccacgagaaguaccugaucgcccugaagagcagcggccugaccuaccccgaggacaagcugguguacggcgugcaggagcccagcgccggcaccagcagccuggccgugcagggcuucaucggcgccaccggcacccugggccagguggacagcagcgacgaggacgaccaggacggcagccagggccugggcaagagaaagagagugaagcugagcagcggcaccaaggaccagagcaucauggacgugcugaagcacaagagcuuccuggaggagcugcuguucuggaccaucaaguacgaguucccccagaagauggugaccuuccugcugaacaugcugcccgaccaggaguacaagguggccuucaccaagaccuucgugcagcacuacgccuucaucaugaagacccugaagaagagccacgagagcgacaccaugagcaacagaaucgugcacaucagcgugcagcuguucagcaacgaggagcuggccagacaggugaccgaggagugccagcugcuggacaucauggugaccgugcugcuguacaugauggagagcugccugaucaagagcgagcugcaggacgaggagaacagccugcacgugguggugaacugcggcgaggcccugcugaagaacaacaccuacuggccccuggugagcgacuucaucaacauccugagccaccagagcguggccaagagauuccuggaggaccacggccugcuggugaccuggaugaacuucgugagcuucuuccagggcaugaaccugaacaagagagagcugaacgagcacguggaguucgagagccagaccuacuacgccgccuucgccgccgagcuggaggccugcgcccagcccauguggggccugcugagccacugcaaggugagagagacccaggaguacaccagaaacguggugagauacugccuggaggcccugcaggacugguucgacgccaucaacuucguggacgagcccgcccccaaccaggugaccuuccaccugccccugcacagauacuacgccauguuccugagcaaggccgugaagugccaggagcuggaccuggacagcgugcugcccgaccaggagaugcugaugaagcugaugauccacccccugcagauccaggccagccuggccgagauccacagcaacaugugggugagaaacggccugcagaucaagggccaggccaugaccuacgugcagagccacuucugcaacagcaugaucgaccccgacaucuaccugcugcaggugugcgccagcagacuggaccccgacuacuucaucagcagcguguucgagagauucaaggugguggaccugcugaccauggccagccagcaccagaacaccgugcuggacgccgagcacgagagaagcaugcuggagggcgcccugaccuuccuggugauccugcugagccugagacugcaccugggcaugagcgacgacgagauccugagagccgagaugguggcccagcugugcaugaacgacagaacccacagcagccugcuggaccugauccccgagaaccccaaccccaagagcggcaucauccccggcagcuacagcuucgagagcgugcugagcgccguggccgacuucaaggcccccguguucgagcccggcggcagcaugcagcagggcauguacacccccaaggccgaggugugggaccaggaguucgaccccgugauggugauccugagaaccguguacagaagagacgugcagagcgccauggacagauacaccgccuuccugaagcagagcggcaaguuccccggcaaccccuggccccccuacaagaagagaaccagccugcaccccagcuacaagggccugaugagacugcugcacugcaagacccugcacaucgugcuguucacccugcuguacaagauccugauggaccaccagaaccugagcgagcacgugcugugcauggugcuguaccugaucgagcugggccuggagaacagcgccgaggaggagagcgacgaggaggccagcgugggcggccccgagagaugccacgacagcugguuccccggcagcaaccuggugagcaacaugagacacuucaucaacuacgugagagugagagugcccgagaccgcccccgaggugaagagagacagccccgccagcaccagcagcgacaaccugggcagccugcagaacagcggcaccgcccagguguucagccugguggccgagagaagaaagaaguuccaggagaucaucaacagaagcagcagcgaggccaaccagguggugagacccaagaccagcagcaaguggagcgcccccggcagcgccccccagcugaccaccgccauccuggagaucaaggagagcauccugagccugcugaucaagcugcaccacaagcugagcggcaagcagaacagcuacuacccccccuggcuggacgacaucgagauccugauccagcccgagauccccaaguacagccacggcgacggcaucaccgccguggagagaauccugcugaaggccgccagccagagcagaaugaacaagagaaucaucgaggagaucugcagaaaggugaccccccccgugccccccaagaaggugaccgccgccgagaagaagacccuggacaaggaggagagaagacagaaggccagagagagacagcagaagcugcuggccgaguucgccagcagacagaagagcuucauggagaccgccauggacguggacagccccgagaacgacauccccauggagaucaccaccgccgagccccaggugagcgaggccguguacgacugcgugaucugcggccagagcggccccagcagcgaggacagacccaccggccugguggugcugcugcaggccagcagcgugcugggccagugcagagacaacguggagcccaagaagcugcccaucagcgaggaggagcagaucuaccccugggacaccugcgccgccgugcacgacgugagacugagccugcugcagagauacuucaaggacagcagcugccugcuggccgugagcaucggcugggagggcggcguguacgugcagaccugcggccacacccugcacaucgacugccacaagagcuacauggagagccugagaaacgaccaggugcugcagggcuucagcguggacaagggcgaguucaccugcccccugugcagacaguucgccaacagcgugcugcccugcuaccccggcagcaacguggagaacaaccccuggcagagacccagcaacaagagcauccaggaccugaucaaggagguggaggagcugcagggcagacccggcgccuuccccagcgagaccaaccugagcaaggagauggagagcgugaugaaggacaucaagaacaccacccagaagaaguacagagacuacagcaagacccccggcagccccgacaacgacuuccuguucauguacagcguggccagaaccaaccuggagcuggagcugauccacagaggcggcaaccugugcagcggcggcgccagcaccgccggcaagagaagcugccugaaccagcuguuccacgugcuggcccugcacaugagacuguacagcaucgacagcgaguacaaccccuggagaaagcugacccagcuggaggagaugaacccccagcugggcuacgaggagcagcagcccgaggugcccauccuguaccacgacgugaccagccugcugcugauccagauccugaugaugccccagccccugagaaaggaccacuucaccugcaucgugaaggugcuguucacccugcuguacacccaggcccuggccgcccugagcgugaagugcagcgaggaggacagaagcgccuggaagcacgccggcgcccugaagaagagcaccugcgacgccgagaagagcuacgaggugcugcugagcuucgugaucagcgagcuguucaagggcaagcuguaccacgaggagggcacccaggagugcgccauggugaaccccaucgccuggagccccgagagcauggagaagugccugcaggacuucugccugcccuuccugagaaucaccagccugcugcagcaccaccuguucggcgaggaccugcccagcugccaggaggaggaggaguucagcgugcuggccagcugccugggccugcugcccaccuucuaccagaccgagcaccccuucaucagcgccagcugccuggacuggcccgugcccgccuucgacaucaucacccaguggugcuucgagaucaagagcuucaccgagagacacgccgagcagggcaaggcccugcugauccaggagagcaaguggaagcugccccaccugcugcagcugcccgagaacuacaacaccaucuuccaguacuaccacagaaagaccugcagcgugugcaccaaggugcccaaggaccccgccgugugccuggugugcggcaccuucgugugccugaagggccugugcugcaagcagcagagcuacugcgagugcgugcugcacagccagaacugcggcgccggcaccggcaucuuccugcugaucaacgccagcgugaucaucaucaucagaggccacagauucugccuguggggcagcguguaccuggacgcccacggcgaggaggacagagaccugagaagaggcaagccccuguacaucugcaaggagagauacaaggugcuggagcagcaguggaucagccacaccuucgaccacaucaacaagagauggggcccccacuacaacggccuguaa

SEQ ID NO: 25325 - RNA, 15705 nt, Artificial Sequence
  UBR4__Homo_sapiens__XP_011539410
auggccaccagcggcggcgaggaggccgccgccgccgcccccgcccccggcacccccgccaccggcgccgacaccacccccggcugggagguggccgugagaccccugcugagcgccagcuacagcgccuucgagaugaaggagcugccccagcugguggccagcgugaucgagagcgagagcgagauccugcaccacgagaagcaguacgagcccuucuacagcagcuucguggcccugagcacccacuacaucaccaccgugugcagccugauccccagaaaccagcugcagagcguggccgccgccugcaaggugcugaucgaguucagccugcugagacuggagaaccccgacgaggccugcgccgugagccagaagcaccugauccugcugaucaagggccugugcaccggcugcagcagacuggacagaaccgagaucaucaccuucaccgccaugaugaagagcgccaagcugccccagaccgugaagacccugagcgacguggaggaccagaaggagcuggccagccccgugagccccgagcugagacagaaggaggugcagaugaacuuccugaaccagcugaccagcguguucaaccccagaaccguggccagccagcccaucagcacccagacccugguggagggcgagaacgacgagcagagcagcaccgaccaggccagcgccaucaagaccaagaacguguucaucgcccagaacguggccagccugcaggagcugggcggcagcgagaagcugcugagagugugccugaaccugcccuacuuccugagauacaucaacagauuccaggacgccgugcuggccaacagcuucuucaucaugcccgccaccguggccgacgccaccgccgugagaaacggcuuccacagccuggugaucgacgugaccauggcccuggacacccugagccugcccgugcuggagccccugaaccccagcagacugcaggacgugaccgugcugagccugagcugccuguacgccggcgugagcguggccaccugcauggccauccugcacgugggcagcgcccagcaggugagaaccggcagcaccagcagcaaggaggacgacuacgagagcgacgccgccaccaucgugcagaagugccuggagaucuacgacaugaucggccaggccaucagcagcagcagaagagccggcggcgagcacuaccagaacuuccagcugcugggcgccuggugccugcugaacagccuguuccugauccugaaccugagccccaccgcccuggccgacaagggcaaggagaaggacccccuggccgcccugagagugagagacauccugagcagaaccaaggagggcgugggcagccccaagcugggccccggcaagggccaccagggcuucggcgugcugagcgugauccuggccaaccacgccaucaagcugcugaccagccuguuccaggaccugcagguggaggcccugcacaagggcugggagaccgacggcccccccgccgcccugagcaucauggcccagagcaccagcauccagagaauccagagacugaucgacagcgugccccugaugaaccugcugcugacccugcugagcaccagcuacagaaaggccugcgugcugcagagacagagaaagggcagcaugagcagcgacgccagcgccagcaccgacagcaacaccuacuacgaggacgacuucagcagcaccgaggaggacagcagccaggacgacgacagcgagcccauccugggccagugguucgaggagaccaucagccccagcaaggagaaggccgccccccccccccccccccccccccccccccuggagagcagccccagagugaagagccccagcaagcaggcccccggcgagaagggcaacauccuggccagcagaaaggaccccgagcuguuccugggccuggccagcaacauccugaacuucaucaccagcagcaugcugaacagcagaaacaacuucaucagaaacuaccugagcgugagccugagcgagcaccacauggccacccuggccagcaucaucaaggagguggacaaggacggccugaagggcagcagcgacgaggaguucgccgccgcccuguaccacuucaaccacagccuggugaccagcgaccugcagagccccaaccugcagaacacccugcugcagcagcugggcguggcccccuucagcgagggccccuggccccuguacauccacccccagagccugagcgugcugagcagacugcugcugaucuggcagcacaaggccagcgcccagggcgaccccgacgugcccgagugccugaaggugugggacagauuccugagcaccaugaagcagaacgcccugcagggcguggugcccagcgagaccgaggaccugaacguggagcaccugcagaugcugcugcugaucuuccacaacuucaccgagaccggcagaagagccauccugagccuguucgugcagaucauccaggagcugagcgugaacauggacgcccagaugagauucgugccccugauccuggccagacugcugcugaucuucgacuaccugcugcaccaguacagcaaggcccccguguaccuguucgagcaggugcagcacaaccugcugagcccccccuucggcugggccagcggcagccaggacagcaacagcagaagagccaccaccccccuguaccacggcuucaaggagguggaggagaacuggagcaagcacuucagcagcgacgccgugccccaccccagauucuacugcgugcugagccccgaggccagcgaggacgaccugaacagacuggacagcguggccugcgacgugcuguucagcaagcuggugaaguacgacgagcuguacgccgcccugaccgcccugcuggccgccggcagccagcuggacaccgugagaagaaaggagaacaagaacgugaccgcccuggaggccugcgcccugcaguacuacuuccugauccuguggagaauccugggcauccugccccccagcaagaccuacaucaaccagcugagcaugaacagccccgagaugagcgagugcgacauccugcacacccugagauggagcagcagacugagaaucagcagcuacgugaacuggaucaaggaccaccugaucaagcagggcaugaaggccgagcacgccagcagccugcuggagcuggccagcaccaccaagugcagcagcgugaaguacgacguggagaucguggaggaguacuucgccagacagaucagcagcuucugcagcaucgacugcaccaccauccugcagcugcacgagauccccagccugcagagcaucuacacccuggacgccgccaucagcaaggugcaggugagccuggacgagcacuucagcaagauggccgccgagaccgacccccacaagagcagcgagaucaccaagaaccugcugcccgccacccugcagcugaucgacaccuacgccagcuucaccagagccuaccugcugcagaacuucaacgaggagggcaccaccgagaagcccagcaaggagaagcugcagggcuucgccgccgugcuggccaucggcagcagcagaugcaaggccaacacccugggccccacccuggugcagaaccugcccagcagcgugcagaccgugugcgagagcuggaacaacaucaacaccaacgaguuccccaacaucggcagcuggagaaacgccuucgccaacgacaccauccccagcgagagcuacaucagcgccgugcaggccgcccaccugggcacccugugcagccagagccugccccuggccgccagccugaagcacacccugcugagccuggugagacugaccggcgaccugaucguguggagcgacgagaugaaccccccccaggugaucagaacccugcugccccugcugcuggagagcagcaccgagagcguggccgagaucagcagcaacagccuggagagaauccugggccccgccgagagcgacgaguuccuggccagaguguacgagaagcugaucaccggcugcuacaacauccuggccaaccacgccgaccccaacagcggccuggacgagagcauccuggaggagugccugcaguaccuggagaagcagcuggagagcagccaggccagaaaggccauggaggaguucuucagcgacagcggcgagcuggugcagaucaugauggccaccgccaacgagaaccugagcgccaaguucugcaacagagugcugaaguucuucaccaagcuguuccagcugaccgagaagagccccaaccccagccugcugcaccugugcggcagccuggcccagcuggccugcguggagcccgugagacugcaggccuggcugaccagaaugaccaccagcccccccaaggacagcgaccagcuggacgugauccaggagaacagacagcugcugcagcugcugaccaccuacaucgugagagagaacagccaggugggcgagggcgugugcgccgugcugcugggcacccugacccccauggccaccgagaugcuggccaacggcgacggcaccggcuuccccgagcugaugguggugauggccacccuggccagcgccggccagggcgccggccaccugcagcugcacaacgccgccguggacuggcugagcagaugcaagaaguaccugagccagaagaacgugguggagaagcugaacgccaacgugaugcacggcaagcacgugaugauccuggagugcaccugccacaucaugagcuaccuggccgacgugaccaacgcccugagccagagcaacggccagggccccagccaccugagcguggacggcgaggagagagccaucgagguggacagcgacuggguggaggagcuggccguggaggaggaggacagccaggccgaggacagcgacgaggacagccugugcaacaagcugugcaccuucaccaucacccagaaggaguucaugaaccagcacugguaccacugccacaccugcaagaugguggacggcgugggcgugugcaccgugugcgccaaggugugccacaaggaccacgagaucagcuacgccaaguacggcagcuucuucugcgacugcggcgccaaggaggacggcagcugccuggcccuggugaagagaacccccagcagcggcaugagcagcaccaugaaggagagcgccuuccagagcgagcccagaaucagcgagagccuggugagacacgccagcaccagcagccccgccgacaaggccaaggugaccaucagcgacggcaagguggccgacgaggagaagcccaagaagagcagccugugcagaaccguggagggcugcagagaggagcugcagaaccaggccaacuucagcuucgccccccuggugcuggacaugcugaacuuccugauggacgccauccagaccaacuuccagcaggccagcgccgugggcagcagcagcagagcccagcaggcccugagcgagcugcacaccguggagaaggccguggagaugaccgaccagcugauggugcccacccugggcagccaggagggcgccuucgagaacgugagaaugaacuacagcggcgaccagggccagaccaucagacagcugaucagcgcccacgugcugagaagaguggccaugugcgugcugagcagcccccacggcagaagacagcaccuggccgugagccacgagaagggcaagaucaccgugcugcagcugagcgcccugcugaagcaggccgacagcagcaagagaaagcugacccugaccagacuggccagcgcccccgugcccuucaccgugcugagccugaccggcaaccccugcaaggaggacuaccuggccgugugcggccugaaggacugccacgugcugaccuucagcagcagcggcagcgugagcgaccaccuggugcugcacccccagcuggccaccggcaacuucaucaucaaggccguguggcugcccggcagccagaccgagcuggccaucgugaccgccgacuucgugaagaucuacgaccugugcguggacgcccugagccccaccuucuacuuccugcugcccagcagcaagaucagagacgugaccuuccuguucaacgaggagggcaagaacaucaucgugaucaugagcagcgccggcuacaucuacacccagcugauggaggaggccagcagcgcccagcagggccccuucuacgugaccaacgugcuggagaucaaccacgaggaccugaagcaggacagcaacagccagguggccggcggcggcgugagcguguacuacagccacgugcugcagaugcuguucuucagcuacugccagggcaagagcuucgccgccaccaucagcagaaccacccuggaggugcugcagcuguuccccaucaacaucaagagcuucguggugugcagcagcaacggcggcagcaagaccagccccgcccugugccaguggagcgaggugaugaaccaccccggccuggugugcugcgugcagcagaccaccggcgugccccugguggugauggugaagcccgacaccuuccugauccaggagaucaagacccugcccgccaaggccaagauccaggacaugguggccaucagacacaccgccugcaacgagcagcagagaaccaccaugauccugcugugcgaggacggcagccugagaaucuacauggccaacguggagaacaccagcuacuggcugcagcccagccugcagcccagcagcgugaucagcaucaugaagcccgugagaaagagaaagaccgccaccaucaccaccagaaccagcagccaggugaccuuccccaucgacuucuucgagcacaaccagcagcugaccgacguggaguucggcggcaacgaccugcugcagguguacaacgcccagcagaucaagcacagacugaacagcaccggcauguacguggccaacaccaagcccggcggcuucaccaucgagaucagcaacaacaacagcaccauggugaugaccggcaugagaauccagaucggcacccaggccaucgagagagcccccagcuacaucgagaucuucggcagaaccaugcagcugaaccugagcagaagcagaugguucgacuuccccuucaccagagaggaggcccugcaggccgacaagaagcugaaccuguucaucggcgccagcguggaccccgccggcgugaccaugaucgacgccgugaagaucuacggcaagaccaaggagcaguucggcuggcccgacgagccccccgaggaguuccccagcgccagcgugagcaacaucugccccagcaaccugaaccagagcaacggcaccggcgacagcgacagcgccgcccccaccaccaccagcggcaccgugcuggagagcagcgagaccgagagccugaccaagcuggacagacugguggugagcagccuggaggcccuggagagcugcuucgccgugggccccaucaucgagaaggagagaaacaagaacgccgcccaggagcuggccacccugcugcugagccugcccgcccccgccagcgugcagcagcagagcaagagccugcuggccagccugcacaccagcagaagcgccuaccacagccacaaggaccaggcccugcugagcaaggccgugcagugccugaacaccagcagcaaggagggcaaggaccuggaccccgagguguuccagagacuggugaucaccgccagaagcaucgccaucaugagacccaacaaccuggugcacuucaccgagagcaagcugccccagauggagaccgacugcuucuuccccagaugcgccugcuggagccugggcaucgugggcauccugaucggcgccccccuggagacccccagccccgagggcauggacgagggcaaggagccccagaagcagcuggagggcgacugcugcagcuucaucacccagcuggugaaccacuucuggaagcugcacgccagcaagcccaagaacgccuuccuggcccccgccugccugcccggccugacccacaucgaggccaccgugaacgcccugguggacaucauccacggcuacugcaccugcgagcuggacugcaucaacaccgccagcaagaucuacaugcagaugcugcugugccccgaccccgccgugagcuucagcugcaagcaggcccugaucagagugcugagacccagaaacaagagaagacacgugacccugcccagcagccccagaagcaacacccccaugggcgacaaggacgacgacgacgacgacgacgccgacgagaagaugcagagcagcggcauccccaacggcggccacaucagacaggagagccaggagcagagcgagguggaccacggcgacuucgagauggugagcgagagcauggugcuggagaccgccgagaacgugaacaacggcaaccccagcccccuggaggcccugcuggccggcgccgagggcuucccccccaugcuggacaucccccccgacgccgacgacgagaccaugguggagcuggccaucgcccugagccugcagcaggaccagcagggcagcagcagcagcgcccugggccugcagagccugggccugagcggccaggcccccagcagcagcagccuggacgccggcacccugagcgacaccaccgccagcgcccuggugacccugagcgcccccgccagcgacgacgagggcagcaccgccgccaccgacggcagcacccugagaaccagccccgccgaccacggcggcagcgugggcagcgagagcggcggcagcgccguggacagcguggccggcgagcacagcgugagcggcagaagcagcgccuacggcgacgccaccgccgagggccaccccgccggccccggcagcgugagcagcagcaccggcgccaucagcaccaccaccggccaccaggagggcgacggcagcgagggcgagggcgagggcgagaccgagggcgacgugcacaccagcaacagacugcacauggugagacugaugcugcuggagagacugcugcagacccugccccagcugagaaacgugggcggcgugagagccauccccuacaugcaggugauccugaugcugaccaccgaccuggacggcgaggacgagaaggacaagggcgcccuggacaaccugcugagccagcugaucgccgagcugggcauggacaagaaggacgugagcaagaagaacgagagaagcgcccugaacgaggugcaccugguggugaugagacugcugagcguguucaugagcagaaccaagagcggcagcaagagcagcaucugcgagagcagcagccugaucagcagcgccaccgccgccgcccugcugagcagcggcgccguggacuacugccugcacgugcugaagagccugcuggaguacuggaagagccagcagaacgacgaggagcccguggccaccagccagcugcugaagccccacaccaccagcagcccccccgacaugagccccuucuuccugagacaguacgugaagggccacgccgccgacguguucgaggccuacacccagcugcugaccgagauggugcugagacugcccuaccagaucaagaagaucaccgacaccaacagcagaauccccccccccguguucgaccacagcugguucuacuuccugagcgaguaccugaugauccagcagacccccuucgugagaagacaggugagaaagcugcugcuguucaucugcggcagcaaggagaaguacagacagcugagagaccugcacacccuggacagccacgugagaggcaucaagaagcugcuggaggagcagggcaucuuccugagagccagcguggugaccgccagcagcggcagcgcccugcaguacgacacccugaucagccugauggagcaccugaaggccugcgccgagaucgccgcccagagaaccaucaacuggcagaaguucugcaucaaggacgacagcgugcuguacuuccugcugcaggugagcuuccugguggacgagggcgugagccccgugcugcugcagcugcugagcugcgcccugugcggcagcaaggugcuggccgcccuggccgccagcagcggcagcagcagcgccagcagcagcagcgcccccguggccgccagcagcggccaggccaccacccagagcaagagcagcaccaagaagagcaagaaggaggagaaggagaaggagaaggacggcgagaccagcggcagccaggaggaccagcugugcaccgcccuggugaaccagcugaacaaguucgccgacaaggagacccugauccaguuccugagaugcuuccugcuggagagcaacagcagcagcgugagauggcaggcccacugccugacccugcacaucuacagaaacagcagcaagagccagcaggagcugcugcuggaccugauguggagcaucuggcccgagcugcccgccuacggcagaaaggccgcccaguucguggaccugcugggcuacuucagccugaagaccccccagaccgagaagaagcugaaggaguacagccagaaggccguggagauccugagaacccagaaccacauccugaccaaccaccccaacagcaacaucuacaacacccugagcggccugguggaguucgacggcuacuaccuggagagcgaccccugccuggugugcaacaaccccgaggugcccuucugcuacaucaagcugagcagcaucaagguggacaccagauacaccaccacccagcagguggugaagcugaucggcagccacaccaucagcaaggugaccgugaagaucggcgaccugaagagaaccaagauggugagaaccaucaaccuguacuacaacaacagaaccgugcaggccaucguggagcugaagaacaagcccgccagauggcacaaggccaagaaggugcagcugacccccggccagaccgaggugaagaucgaccugccccugcccaucguggccagcaaccugaugaucgaguucgccgacuucuacgagaacuaccaggccagcaccgagacccugcagugccccagaugcagcgccagcgugcccgccaaccccggcgugugcggcaacugcggcgagaacguguaccagugccacaagugcagaagcaucaacuacgacgagaaggaccccuuccugugcaacgccugcggcuucugcaaguacgccagauucgacuucaugcuguacgccaagcccugcugcgccguggaccccaucgagaacgaggaggacagaaagaaggccgugagcaacaucaacacccugcuggacaaggccgacagaguguaccaccagcugaugggccacagaccccagcuggagaaccugcugugcaaggugaacgaggccgcccccgagaagccccaggacgacagcggcaccgccggcggcaucagcagcaccagcgccagcgugaacagauacauccugcagcuggcccaggaguacugcggcgacugcaagaacagcuucgacgagcugagcaagaucauccagaagguguucgccagcagaaaggagcugcuggaguacgaccugcagcagagagaggccgccaccaagagcagcagaaccagcgugcagcccaccuucaccgccagccaguacagagcccugagcgugcugggcugcggccacaccagcagcaccaagugcuacggcugcgccagcgccgugaccgagcacugcaucacccugcugagagcccuggccaccaaccccgcccugagacacauccuggugagccagggccugaucagagagcuguucgacuacaaccugagaagaggcgccgccgccaugagagaggaggugagacagcugaugugccugcugaccagagacaaccccgaggccacccagcagaugaacgaccugaucaucggcaaggugagcaccgcccugaagggccacugggccaaccccgaccuggccagcagccugcaguacgagaugcugcugcugaccgacagcaucagcaaggaggacagcugcugggagcugagacugagaugcgcccugagccuguuccugauggccgugaacaucaagacccccguggugguggagaacaucacccugaugugccugagaauccugcagaagcugaucaagccccccgcccccaccagcaagaagaacaaggacgugcccguggaggcccugaccaccgugaagcccuacugcaacgagauccacgcccaggcccagcuguggcugaagagagaccccaaggccagcuacgacgccuggaagaagugccugcccaucagaggcaucgacggcaacggcaaggcccccagcaagagcgagcugagacaccuguaccugaccgagaaguacguguggagauggaagcaguuccugagcagaagaggcaagagaaccagcccccuggaccugaagcugggccacaacaacuggcugagacaggugcuguucacccccgccacccaggccgccagacaggccgccugcaccaucguggaggcccuggccaccauccccagcagaaagcagcaggugcuggaccugcugaccagcuaccuggacgagcugagcaucgccggcgagugcgccgccgaguaccuggcccuguaccagaagcugaucaccagcgcccacuggaagguguaccuggccgccagaggcgugcugcccuacgugggcaaccugaucaccaaggagaucgccagacugcuggcccuggaggaggccacccugagcaccgaccugcagcagggcuacgcccugaagagccugaccggccugcugagcagcuucguggagguggagagcaucaagagacacuucaagagcagacuggugggcaccgugcugaacggcuaccugugccugagaaagcugguggugcagagaaccaagcugaucgacgagacccaggacaugcugcuggagaugcuggaggacaugaccaccggcaccgagagcgagaccaaggccuucauggccgugugcaucgagaccgccaagagauacaaccuggacgacuacagaacccccguguucaucuucgagagacugugcagcaucaucuaccccgaggagaacgaggugaccgaguucuucgugacccuggagaaggacccccagcaggaggacuuccugcagggcagaaugcccggcaaccccuacagcagcaacgagcccggcaucggcccccugaugagagacaucaagaacaagaucugccaggacugcgaccugguggcccugcuggaggacgacagcggcauggagcugcuggugaacaacaagaucaucagccuggaccugcccguggccgagguguacaagaagguguggugcaccaccaacgagggcgagcccaugagaaucguguacagaaugagaggccugcugggcgacgccaccgaggaguucaucgagagccuggacagcaccaccgacgaggaggaggacgaggaggagguguacaagauggccggcgugauggcccagugcggcggccuggagugcaugcugaacagacuggccggcaucagagacuucaagcagggcagacaccugcugaccgugcugcugaagcuguucagcuacugcgugaaggugaaggugaacagacagcagcuggugaagcuggagaugaacacccugaacgugaugcugggcacccugaaccuggcccugguggccgagcaggagagcaaggacagcggcggcgccgccguggccgagcaggugcugagcaucauggagaucauccuggacgagagcaacgccgagccccugagcgaggacaagggcaaccugcugcugaccggcgacaaggaccagcuggugaugcugcuggaccagaucaacagcaccuucgugagaagcaaccccagcgugcugcagggccugcugagaaucauccccuaccugagcuucggcgagguggagaagaugcagauccugguggagagauucaagcccuacugcaacuucgacaaguacgacgaggaccacagcggcgacgacaagguguuccuggacugcuucugcaagaucgccgccggcaucaagaacaacagcaacggccaccagcugaaggaccugauccugcagaagggcaucacccagaacgcccuggacuacaugaagaagcacauccccagcgccaagaaccuggacgccgacaucuggaagaaguuccugagcagacccgcccugcccuucauccugagacugcugagaggccuggccauccagcaccccggcacccaggugcugaucggcaccgacagcauccccaaccugcacaagcuggagcaggugagcagcgacgagggcaucggcacccuggccgagaaccugcuggaggcccugagagagcaccccgacgugaacaagaagaucgacgccgccagaagagagaccagagccgagaagaagagaauggccauggccaugagacagaaggcccugggcacccugggcaugaccaccaacgagaagggccagguggugaccaagaccgcccugcugaagcagauggaggagcugaucgaggagcccggccugaccugcugcaucugcagagagggcuacaaguuccagcccaccaaggugcugggcaucuacaccuucaccaagagaguggcccuggaggagauggagaacaagcccagaaagcagcagggcuacagcaccgugagccacuucaacaucgugcacuacgacugccaccuggccgccgugagacuggccagaggcagagaggagugggagagcgccgcccugcagaacgccaacaccaagugcaacggccugcugcccguguggggcccccacgugcccgagagcgccuucgccaccugccuggccagacacaacaccuaccugcaggagugcaccggccagagagagcccaccuaccagcugaacauccacgacaucaagcugcuguuccugagauucgccauggagcagagcuucagcgccgacaccggcggcggcggcagagagagcaacauccaccugauccccuacaucauccacaccgugcuguacgugcugaacaccaccagagccaccagcagagaggagaagaaccugcagggcuuccuggagcagcccaaggagaaguggguggagagcgccuucgagguggacggccccuacuacuucaccgugcuggcccugcacauccugccccccgagcaguggagagccaccagaguggagauccugagaagacugcuggugaccagccaggccagagccguggcccccggcggcgccaccagacugaccgacaaggccgugaaggacuacagcgccuacagaagcagccugcuguucugggcccugguggaccugaucuacaacauguucaagaaggugcccaccagcaacaccgagggcggcuggagcugcagccuggccgaguacaucagacacaacgacaugcccaucuacgaggccgccgacaaggcccugaagaccuuccaggaggaguucaugcccguggagaccuucagcgaguuccuggacguggccggccugcugagcgagaucaccgaccccgagagcuuccugaaggaccugcugaacagcgugcccuaa

SEQ ID NO: 25326 - RNA, 8397 nt, Artificial Sequence
  UBR5__Homo_sapiens__NP_001269802
augaccagcauccacuucguggugcacccccugcccggcaccgaggaccagcugaacgacagacugagagaggugagcgagaagcugaacaaguacaaccugaacagccaccccccccugaacgugcuggagcaggccaccaucaagcagugcguggugggccccaaccacgccgccuuccugcuggaggacggcagagugugcagaaucggcuucagcgugcagcccgacagacuggagcugggcaagcccgacaacaacgacggcagcaagcugaacagcaacagcggcgccggcagaaccagcagacccggcagaaccagcgacagccccugguuccugagcggcagcgagacccugggcagacuggccggcaacacccugggcagcagauggagcagcggcgugggcggcagcggcggcggcagcagcggcagaagcagcgccggcgccagagacagcagaagacagaccagagugaucagaaccggcagagacagaggcagcggccugcugggcagccagccccagcccgugauccccgccagcgugauccccgaggagcugaucagccaggcccagguggugcugcagggcaagagcagaagcgugaucaucagagagcugcagagaaccaaccuggacgugaaccuggccgugaacaaccugcugagcagagacgacgaggacggcgacgacggcgacgacaccgccagcgagagcuaccugcccggcgaggaccugaugagccugcuggacgccgacauccacagcgcccaccccagcgugaucaucgacgccgacgccauguucagcgaggacaucagcuacuucggcuaccccagcuucagaagaagcagccugagcagacugggcagcagcagagugcugcugcugccccuggagagagacagcgagcugcugagagagagagagagcgugcugagacugagagagagaagauggcuggacggcgccagcuucgacaacgagagaggcagcaccagcaaggagggcgagcccaaccuggacaagaagaacacccccgugcagagccccgugagccugggcgaggaccugcagugguggcccgacaaggacggcaccaaguucaucugcaucggcgcccuguacagcgagcugcuggccgugagcagcaagggcgagcuguaccaguggaaguggagcgagagcgagcccuacagaaacgcccagaaccccagccugcaccaccccagagccaccuuccugggccugaccaacgagaagaucgugcugcugagcgccaacagcaucagagccaccguggccaccgagaacaacaagguggccaccuggguggacgagacccugagcagcguggccagcaagcuggagcacaccgcccagaccuacagcgagcugcagggcgagagaaucgugagccugcacugcugcgcccuguacaccugcgcccagcuggagaacagccuguacugguggggcguggugcccuucagccagagaaagaagaugcuggagaaggccagagccaagaacaagaagcccaagagcagcgccggcaucagcagcaugcccaacaucaccgugggcacccaggugugccugagaaacaacccccuguaccacgccggcgccguggccuucagcaucagcgccggcauccccaaggugggcgugcugauggagagcguguggaacaugaacgacagcugcagauuccagcugagaagccccgagagccugaagaacauggagaaggccagcaagaccaccgaggccaagcccgagagcaagcaggagcccgugaagaccgagaugggccccccccccagccccgccagcaccugcagcgacgccagcagcaucgccagcagcgccagcaugcccuacaagagaagaagaagcacccccgcccccaaggaggaggagaaggugaacgaggagcaguggagccugagagaggugguguucguggaggacgugaagaacgugcccgugggcaaggugcugaagguggacggcgccuacguggccgugaaguuccccggcaccagcagcaacaccaacugccagaacagcagcggccccgacgccgaccccagcagccugcugcaggacugcagacugcugagaaucgacgagcugcagguggugaagaccggcggcacccccaaggugcccgacugcuuccagagaacccccaagaagcugugcauccccgagaagaccgagauccuggccgugaacguggacagcaagggcgugcacgccgugcugaagaccggcaacugggugagauacugcaucuucgaccuggccaccggcaaggccgagcaggagaacaacuuccccaccagcagcaucgccuuccugggccagaacgagagaaacguggccaucuucaccgccggccaggagagccccaucauccugagagacggcaacggcaccaucuaccccauggccaaggacugcaugggcggcaucagagaccccgacuggcuggaccugccccccaucagcagccugggcaugggcgugcacagccugaucaaccugcccgccaacagcaccaucaagaagaaggccgccgugaucaucauggccguggagaagcagacccugaugcagcacauccugagaugcgacuacgaggccugcagacaguaccugaugaaccuggagcaggccguggugcuggagcagaaccugcagaugcugcagaccuucaucagccacagaugcgacggcaacagaaacauccugcacgccugcgugagcgugugcuuccccaccagcaacaaggagaccaaggaggaggaggaggccgagagaagcgagagaaacaccuucgccgagagacugagcgccguggaggccaucgccaacgccaucagcguggugagcagcaacggccccggcaacagagccggcagcagcagcagcagaagccugagacugagagagaugaugagaagaagccugagagccgccggccugggcagacacgaggccggcgccagcagcagcgaccaccaggaccccgugagcccccccaucgccccccccagcugggugcccgacccccccgccauggaccccgacggcgacaucgacuucauccuggcccccgccgugggcagccugaccaccgccgccaccggcaccggccagggccccagcaccagcaccauccccggccccagcaccgagcccagcgugguggagagcaaggacagaaaggccaacgcccacuucauccugaagcugcugugcgacagcguggugcugcagcccuaccugagagagcugcugagcgccaaggacgccagaggcaugacccccuucaugagcgccgugagcggcagagccuaccccgccgccaucaccauccuggagaccgcccagaagaucgccaaggccgagaucagcagcagcgagaaggaggaggacguguucaugggcauggugugccccagcggcaccaaccccgacgacagcccccuguacgugcugugcugcaacgacaccugcagcuucaccuggaccggcgccgagcacaucaaccaggacaucuucgagugcagaaccugcggccugcuggagagccugugcugcugcaccgagugcgccagagugugccacaagggccacgacugcaagcugaagagaaccagccccaccgccuacugcgacugcugggagaagugcaagugcaagacccugaucgccggccagaagagcgccagacuggaccugcuguacagacugcugaccgccaccaaccuggugacccugcccaacagcagaggcgagcaccugcugcuguuccuggugcagaccguggccagacagaccguggagcacugccaguacagaccccccagaaucagagaggacagaaacagaaagaccgccagccccgaggacagcgacaugcccgaccacgaccuggagccccccagauucgcccagcuggcccuggagagagugcugcaggacuggaacgcccugaagagcaugaucauguucggcagccaggagaacaaggacccccugagcgccagcagcagaaucggccaccugcugcccgaggagcagguguaccugaaccagcagagcggcaccaucagacuggacugcuucacccacugccugaucgugaagugcaccgccgacauccugcugcuggacacccugcugggcacccuggugaaggagcugcagaacaaguacacccccggcagaagagaggaggccaucgccgugaccaugagauuccugagaagcguggccagaguguucgugauccugagcguggagauggccagcagcaagaagaagaacaacuucaucccccagcccaucggcaagugcaagagaguguuccaggcccugcugcccuacgccguggaggagcugugcaacguggccgagagccugaucgugcccgugagaaugggcaucgccagacccaccgcccccuucacccuggccagcaccagcaucgacgccaugcagggcagcgaggagcuguucagcguggagccccugccccccagacccagcagcgaccagagcagcagcagcagccagagccagagcagcuacaucaucagaaacccccagcagagaagaaucagccagagccagcccgugagaggcagagacgaggagcaggacgacaucgugagcgccgacguggaggagguggaggugguggagggcguggccggcgaggaggaccaccacgacgagcaggaggagcacggcgaggagaacgccgaggccgagggccagcacgacgagcacgacgaggacggcagcgacauggagcuggaccugcuggccgccgccgagaccgagagcgacagcgagagcaaccacagcaaccaggacaacgccagcggcagaagaagcguggugaccgccgccaccgccggcagcgaggccggcgccagcagcgugcccgccuucuucagcgaggacgacagccagagcaacgacagcagcgacagcgacagcagcagcagccagagcgacgacaucgagcaggagaccuucaugcuggacgagccccuggagagaaccaccaacagcagccacgccaacggcgccgcccaggcccccagaagcaugcagugggccgugagaaacacccagcaccagagagccgccagcaccgcccccagcagcaccagcacccccgccgccagcagcgccggccugaucuacaucgaccccagcaaccugagaagaagcggcaccaucagcaccagcgccgccgccgccgccgccgcccuggaggccagcaacgccagcagcuaccugaccagcgccagcagccuggccagagccuacagcaucgugaucagacagaucagcgaccugaugggccugauccccaaguacaaccaccugguguacagccagauccccgccgccgugaagcugaccuaccaggacgccgugaaccugcagaacuacguggaggagaagcugauccccaccuggaacuggauggugagcaucauggacagcaccgaggcccagcugagauacggcagcgcccuggccagcgccggcgaccccggccaccccaaccacccccugcacgccagccagaacagcgccagaagagagagaaugaccgccagagaggaggccagccugagaacccuggagggcagaagaagagccacccugcugagcgccagacagggcaugaugagcgccagaggcgacuuccugaacuacgcccugagccugaugagaagccacaacgacgagcacagcgacgugcugcccgugcuggacgugugcagccugaagcacguggccuacguguuccaggcccugaucuacuggaucaaggccaugaaccagcagaccacccuggacaccccccagcuggagagaaagagaaccagagagcugcuggagcugggcaucgacaacgaggacagcgagcacgagaacgacgacgacaccaaccagagcgccacccugaacgacaaggacgacgacagccugcccgccgagaccggccagaaccaccccuucuucagaagaagcgacagcaugaccuuccugggcugcaucccccccaaccccuucgaggugccccuggccgaggccaucccccuggccgaccagccccaccugcugcagcccaacgccagaaaggaggaccuguucggcagacccagccagggccuguacagcagcagcgccagcagcggcaagugccugauggaggugaccguggacagaaacugccuggaggugcugcccaccaagaugagcuacgccgccaaccugaagaacgugaugaacaugcagaacagacagaagaaggagggcgaggagcagcccgugcugcccgaggagaccgagagcagcaagcccggccccagcgcccacgaccuggccgcccagcugaagagcagccugcuggccgagaucggccugaccgagagcgagggccccccccugaccagcuucagaccccagugcagcuucaugggcauggugaucagccacgacaugcugcugggcagauggagacugagccuggagcuguucggcagaguguucauggaggacgugggcgccgagcccggcagcauccugaccgagcugggcggcuucgaggugaaggagagcaaguucagaagagagauggagaagcugagaaaccagcagagcagagaccugagccuggagguggacagagacagagaccugcugauccagcagaccaugagacagcugaacaaccacuucggcagaagaugcgccaccacccccauggccgugcacagagugaaggugaccuucaaggacgagcccggcgagggcagcggcguggccagaagcuucuacaccgccaucgcccaggccuuccugagcaacgagaagcugcccaaccuggagugcauccagaacgccaacaagggcacccacaccagccugaugcagagacugagaaacagaggcgagagagacagagagagagagagagagagagagaugagaagaagcagcggccugagagccggcagcagaagagacagagacagagacuucagaagacagcugagcaucgacaccagacccuucagacccgccagcgagggcaaccccagcgacgaccccgagccccugcccgcccacagacaggcccugggcgagagacuguaccccagagugcaggccaugcagcccgccuucgccagcaagaucaccggcaugcugcuggagcugagccccgcccagcugcugcugcugcuggccagcgaggacagccugagagccagaguggacgaggccauggagcugaucaucgcccacggcagagagaacggcgccgacagcauccuggaccugggccugguggacagcagcgagaaggugcaggagaacagaaagagacacggcagcagcagaagcgugguggacauggaccuggacgacaccgacgacggcgacgacaacgccccccuguucuaccagcccggcaagagaggcuucuacacccccagacccggcaagaacaccgaggccagacugaacugcuucagaaacaucggcagaauccugggccugugccugcugcagaacgagcugugccccaucacccugaacagacacgugaucaaggugcugcugggcagaaaggugaacuggcacgacuucgccuucuucgaccccgugauguacgagagccugagacagcugauccuggccagccagagcagcgacgccgacgccguguucagcgccauggaccuggccuucgccaucgaccugugcaaggaggagggcggcggccagguggagcugauccccaacggcgugaacauccccgugaccccccagaacguguacgaguacgugagaaaguacgccgagcacagaaugcuggugguggccgagcagccccugcacgccaugagaaagggccugcuggacgugcugcccaagaacagccuggaggaccugaccgccgaggacuucagacugcuggugaacggcugcggcgaggugaacgugcagaugcugaucagcuucaccagcuucaacgacgagagcggcgagaacgccgagaagcugcugcaguucaagagaugguucuggagcaucguggagaagaugagcaugaccgagagacaggaccugguguacuucuggaccagcagccccagccugcccgccagcgaggagggcuuccagcccaugcccagcaucaccaucagaccccccgacgaccagcaccugcccaccgccaacaccugcaucagcagacuguacgugccccuguacagcagcaagcagauccugaagcagaagcugcugcuggccaucaagaccaagaacuucggcuucguguaa

SEQ ID NO: 25327 - RNA, 1278 nt, Artificial Sequence
  UBR7__Homo_sapiens__NP_786924
auggccggcgccgagggcgccgccggcagacagagcgagcuggagcccguggugagccugguggacgugcuggaggaggacgaggagcuggagaacgaggccugcgccgugcugggcggcagcgacagcgagaagugcagcuacagccagggcagcgugaagagacaggcccuguacgccugcagcaccugcacccccgagggcgaggagcccgccggcaucugccuggccugcagcuacgagugccacggcagccacaagcuguucgagcuguacaccaagagaaacuucagaugcgacugcggcaacagcaaguucaagaaccuggagugcaagcugcugcccgacaaggccaaggugaacagcggcaacaaguacaacgacaacuucuucggccuguacugcaucugcaagagacccuaccccgaccccgaggacgagauccccgacgagaugauccagugcguggugugcgaggacugguuccacggcagacaccugggcgccaucccccccgagagcggcgacuuccaggagauggugugccaggccugcaugaagagaugcagcuuccugugggccuacgccgcccagcuggccgugaccaagaucagcaccgaggacgacggccuggugagaaacaucgacggcaucggcgaccaggaggugaucaagcccgagaacggcgagcaccaggacagcacccugaaggaggacgugcccgagcagggcaaggacgacgugagagaggugaagguggagcagaacagcgagcccugcgccggcagcagcagcgagagcgaccugcagaccguguucaagaacgagagccugaacgccgagagcaagagcggcugcaagcugcaggagcugaaggccaagcagcugaucaagaaggacaccgccaccuacuggccccugaacuggagaagcaagcugugcaccugccaggacugcaugaagauguacggcgaccuggacgugcuguuccugaccgacgaguacgacaccgugcuggccuacgagaacaagggcaagaucgcccaggccaccgacagaagcgacccccugauggacacccugagcagcaugaacagagugcagcagguggagcugaucugcgaguacaacgaccugaagaccgagcugaaggacuaccugaagagauucgccgacgagggcaccguggugaagagagaggacauccagcaguucuucgaggaguuccagagcaagaagagaagaagaguggacggcaugcaguacuacugcagcuaa

SEQ ID NO: 25328 - RNA, 705 nt, Artificial Sequence
  UBTD2__Homo_sapiens__NP_689490
augggcggcugcgugggcgcccagcacgacagcagcggcagccugaacgagaacagcgagggcaccggcguggcccugggcagaaaccagccccugaagaaggagaagcccaaguggaagagcgacuaccccaugaccgacggccagcugagaagcaagagagacgaguucugggacaccgcccccgccuucgagggcagaaaggagaucugggacgcccugaaggccgccgcccacgccuucgagagcaacgaccacgagcuggcccaggccaucaucgacggcgccaacaucacccugccccacggcgcccugaccgagugcuacgacgagcugggcaacagauaccagcugcccguguacugccuggccccccccaucaacaugaucgaggagaagagcgacaucgagacccuggacauccccgagcccccccccaacagcggcuacgagugccagcugagacugagacugagcaccggcaaggaccugaagcugguggugagaagcaccgacaccguguuccacaugaagagaagacugcacgccgccgagggcguggagcccggcagccagagaugguucuucagcggcagaccccugaccgacaagaugaaguucgaggagcugaagauccccaaggacuacguggugcaggugaucgugagccagcccgugcagaaccccacccccguggagaacuaa

SEQ ID NO: 25329 - RNA, 2184 nt, Artificial Sequence
  UBTF__Homo_sapiens__NP_001070151
augaacggcgaggccgacugccccaccgaccuggagauggccgcccccaagggccaggacagauggagccaggaggacaugcugacccugcuggagugcaugaagaacaaccugcccagcaacgacagcagcaaguucaagaccaccgagagccacauggacugggagaagguggccuucaaggacuucagcggcgacaugugcaagcugaaguggguggagaucagcaacgaggugagaaaguucagaacccugaccgagcugauccuggacgcccaggagcacgugaagaaccccuacaagggcaagaagcugaagaagcaccccgacuuccccaagaagccccugacccccuacuucagauucuucauggagaagagagccaaguacgccaagcugcaccccgagaugagcaaccuggaccugaccaagauccugagcaagaaguacaaggagcugcccgagaagaagaagaugaaguacauccaggacuuccagagagagaagcaggaguucgagagaaaccuggccagauucagagaggaccaccccgaccugauccagaacgccaagaagagcgacauccccgagaagcccaagaccccccagcagcugugguacacccacgagaagaagguguaccugaaggugagacccgacgagaucaugagagacuacauccagaagcaccccgagcugaacaucagcgaggagggcaucaccaagagcacccugaccaaggccgagagacagcugaaggacaaguucgacggcagacccaccaagcccccccccaacagcuacagccuguacugcgccgagcugauggccaacaugaaggacgugcccagcaccgagagaauggugcugugcagccagcaguggaagcugcugagccagaaggagaaggacgccuaccacaagaagugcgaccagaagaagaaggacuacgagguggagcugcugagauuccuggagagccugcccgaggaggagcagcagagagugcugggcgaggagaagaugcugaacaucaacaagaagcaggccaccagccccgccagcaagaagcccgcccaggagggcggcaagggcggcagcgagaagcccaagagacccgugagcgccauguucaucuucagcgaggagaagagaagacagcugcaggaggagagacccgagcugagcgagagcgagcugaccagacugcuggccagaauguggaacgaccugagcgagaagaagaaggccaaguacaaggccagagaggccgcccugaaggcccagagcgagagaaagcccggcggcgagagagaggagagaggcaagcugcccgagagccccaagagagccgaggagaucuggcagcagagcgugaucggcgacuaccuggccagauucaagaacgacagagugaaggcccugaaggccauggagaugaccuggaacaacauggagaagaaggagaagcugauguggaucaagaaggccgccgaggaccagaagagauacgagagagagcugagcgagaugagagccccccccgccgccaccaacagcagcaagaagaugaaguuccagggcgagcccaagaagccccccaugaacggcuaccagaaguucagccaggagcugcugagcaacggcgagcugaaccaccugccccugaaggagagaaugguggagaucggcagcagauggcagagaaucagccagagccagaaggagcacuacaagaagcuggccgaggagcagcagaagcaguacaaggugcaccuggaccugugggugaagagccugagcccccaggacagagccgccuacaaggaguacaucagcaacaagagaaagagcaugaccaagcugagaggccccaaccccaagagcagcagaaccacccugcagagcaagagcgagagcgaggaggacgacgaggaggacgaggacgacgaggacgaggacgaggaggaggaggacgacgagaacggcgacagcagcgaggacggcggcgacagcagcgagagcagcagcgaggacgagagcgaggacggcgacgagaacgaggaggacgacgaggacgaggacgacgacgaggacgacgacgaggacgaggacaacgagagcgagggcagcagcagcagcagcagcagcagcggcgacagcagcgacagcgacagcaacuaa

SEQ ID NO: 25330 - RNA, 894 nt, Artificial Sequence
  UBXN1__Homo_sapiens__NP_001273006
auggccgagcugaccgcccuggagagccugaucgagaugggcuuccccagaggcagagccgagaaggcccuggcccugaccggcaaccagggcaucgaggccgccauggacuggcugauggagcacgaggacgaccccgacguggacgagccccuggagaccccccugggccacauccugggcagagagcccaccagcagcgagcagggcggccuggagggcagcggcagcgccgccggcgagggcaagcccgcccugagcgaggaggagagacaggagcagaccaagagaaugcuggagcugguggcccagaagcagagagagagagaggagagagaggagagagaggcccuggagagagagagacagagaagaagacagggccaggagcugagcgccgccagacagagacugcaggaggacgagaugagaagagccgccgaggagagaagaagagagaaggccgaggagcuggccgccagacagagagugagagagaagaucgagagagacaaggccgagagagccaagaaguacggcggcagcgugggcagccagcccccccccguggcccccgagcccggccccgugcccagcagccccagccaggagccccccaccaagagagaguacgaccagugcagaauccaggugagacugcccgacggcaccagccugacccagaccuucagagccagagagcagcuggccgccgugagacuguacguggagcugcacagaggcgaggagcugggcggcggccaggaccccgugcagcugcugagcggcuuccccagaagagccuucagcgaggccgacauggagagaccccugcaggagcugggccuggugcccagcgccgugcugaucguggccaagaagugccccagcuaa

SEQ ID NO: 25331 - RNA, 780 nt, Artificial Sequence
  UBXN2A__Homo_sapiens__NP_859064
augaaggacguggacaaccugaagagcaucaaggaggagugggugugcgagaccggcagcgacaaccagccccugggcaacaaccagcagagcaacugcgaguacuucguggacagccuguucgaggaggcccagaaggugagcagcaagugcgugagccccgccgagcagaagaagcagguggacgugaacaucaagcuguggaagaacggcuucaccgugaacgacgacuucagaagcuacagcgacggcgccagccagcaguuccugaacagcaucaagaagggcgagcugcccagcgagcugcagggcaucuucgacaaggaggagguggacgugaagguggaggacaagaagaacgagaucugccugagcaccaagcccguguuccagcccuucagcggccagggccacagacugggcagcgccacccccaagaucgugagcaaggccaagaacaucgagguggagaacaagaacaaccugagcgccgugccccugaacaaccuggagcccaucaccaacauccagaucuggcuggccaacggcaagagaaucgugcagaaguucaacaucacccacagagugagccacaucaaggacuucaucgagaaguaccagggcagccagagaagcccccccuucagccuggccaccgcccugcccgugcugagacugcuggacgagacccugacccuggaggaggccgaccugcagaacgccgugaucauccagagacugcagaagaccgccagcuucagagagcugagcgagcacuaa

SEQ ID NO: 25332 - RNA, 996 nt, Artificial Sequence
  UBXN2B__Homo_sapiens__NP_001071087
auggccgagggcggcggccccgagcccggcgagcaggagagaagaagcagcggccccagaccccccagcgccagagaccugcagcuggcccuggccgagcuguacgaggacgaggugaagugcaagagcagcaagagcaacagacccaaggccaccguguucaagagccccagaacccccccccagagauucuacagcagcgagcacgaguacagcggccugaacaucgugagacccagcaccggcaagaucgugaacgagcuguucaaggaggccagagagcacggcgccgugccccugaacgaggccaccagagccagcggcgacgacaagagcaagagcuucaccggcggcggcuacagacugggcagcagcuucugcaagagaagcgaguacaucuacggcgagaaccagcugcaggacgugcagauccugcugaagcuguggagcaacggcuucagccuggacgacggcgagcugagacccuacaacgagcccaccaacgcccaguuccuggagagcgugaagagaggcgagaucccccuggagcugcagagacuggugcacggcggccaggugaaccuggacauggaggaccaccaggaccaggaguacaucaagcccagacugagauucaaggccuucagcggcgagggccagaagcugggcagccugacccccgagaucgugagcacccccagcagccccgaggaggaggacaagagcauccugaacgccguggugcugaucgacgacagcgugcccaccaccaagauccagaucagacuggccgacggcagcagacugauccagagauucaacagcacccacagaauccuggacgugagaaacuucaucgugcagagcagacccgaguucgccgcccuggacuucauccuggugaccagcuuccccaacaaggagcugaccgacgagagccugacccugcuggaggccgacauccugaacaccgugcugcugcagcagcugaaguaa

SEQ ID NO: 25333 - RNA, 1527 nt, Artificial Sequence
  UBXN4__Homo_sapiens__NP_055422
augcugugguuccagggcgccauccccgccgccaucgccaccgccaagagaagcggcgccguguucgugguguucguggccggcgacgacgagcagagcacccagauggccgccagcugggaggacgacaaggugaccgaggccagcagcaacagcuucguggccaucaagaucgacaccaagagcgaggccugccugcaguucagccagaucuaccccguggugugcgugcccagcagcuucuucaucggcgacagcggcaucccccuggaggugaucgccggcagcgugagcgccgacgagcuggugaccagaauccacaaggugagacagaugcaccugcugaagagcgagaccagcguggccaacggcagccagagcgagagcagcgugagcacccccagcgccagcuucgagcccaacaacaccugcgagaacagccagagcagaaacgccgagcugugcgagaucccccccaccagcgacaccaagagcgacaccgccaccggcggcgagagcgccggccacgccaccagcagccaggagcccagcggcugcagcgaccagagacccgccgaggaccugaacaucagaguggagagacugaccaagaagcuggaggagagaagagaggagaagagaaaggaggaggagcagagagagaucaagaaggagaucgagagaagaaagaccggcaaggagaugcuggacuacaagagaaagcaggaggaggagcugaccaagagaaugcuggaggagagaaacagagagaaggccgaggacagagccgccagagagagaaucaagcagcagaucgcccuggacagagccgagagagccgccagauucgccaagaccaaggaggagguggaggccgccaaggccgccgcccugcuggccaagcaggccgagauggaggugaagagagagagcuacgccagagagagaagcaccguggccagaauccaguucagacugcccgacggcagcagcuucaccaaccaguuccccagcgacgccccccuggaggaggccagacaguucgccgcccagaccgugggcaacaccuacggcaacuucagccuggccaccauguuccccagaagagaguucaccaaggaggacuacaagaagaagcugcuggaccuggagcuggcccccagcgccagcguggugcugcugcccgccggcagacccaccgccagcaucgugcacagcagcagcggcgacaucuggacccugcugggcaccgugcuguaccccuuccuggccaucuggagacugaucagcaacuuccuguucagcaaccccccccccacccagaccagcgugagagugaccagcagcgagccccccaaccccgccagcagcagcaagagcgagaagagagagcccgugagaaagagagugcuggagaagagaggcgacgacuucaagaaggagggcaagaucuacagacugagaacccaggacgacggcgaggacgagaacaacaccuggaacggcaacagcacccagcagauguaa

SEQ ID NO: 25334 - RNA, 672 nt, Artificial Sequence
  UCHL1__Homo_sapiens__NP_004172
augcagcugaagcccauggagaucaaccccgagaugcugaacaaggugcugagcagacugggcguggccggccaguggagauucguggacgugcugggccuggaggaggagagccugggcagcgugcccgcccccgccugcgcccugcugcugcuguucccccugaccgcccagcacgagaacuucagaaagaagcagaucgaggagcugaagggccaggaggugagccccaagguguacuucaugaagcagaccaucggcaacagcugcggcaccaucggccugauccacgccguggccaacaaccaggacaagcugggcuucgaggacggcagcgugcugaagcaguuccugagcgagaccgagaagaugagccccgaggacagagccaagugcuucgagaagaacgaggccauccaggccgcccacgacgccguggcccaggagggccagugcagaguggacgacaaggugaacuuccacuucauccuguucaacaacguggacggccaccuguacgagcuggacggcagaaugcccuuccccgugaaccacggcgccagcagcgaggacacccugcugaaggacgccgccaaggugugcagagaguucaccgagagagagcagggcgaggugagauucagcgccguggcccugugcaaggccgccuaa

SEQ ID NO: 25335 - RNA, 693 nt, Artificial Sequence
  UCHL3__Homo_sapiens__NP_005993
auggagggccagagauggcugccccuggaggccaaccccgaggugaccaaccaguuccugaagcagcugggccugcaccccaacuggcaguucguggacguguacggcauggaccccgagcugcugagcauggugcccagacccgugugcgccgugcugcugcuguuccccaucaccgagaaguacgagguguucagaaccgaggaggaggagaagaucaagagccagggccaggacgugaccagcagcguguacuucaugaagcagaccaucagcaacgccugcggcaccaucggccugauccacgccaucgccaacaacaaggacaagaugcacuucgagagcggcagcacccugaagaaguuccuggaggagagcgugagcaugagccccgaggagagagccagauaccuggagaacuacgacgccaucagagugacccacgagaccagcgcccacgagggccagaccgaggcccccagcaucgacgagaagguggaccugcacuucaucgcccuggugcacguggacggccaccuguacgagcuggacggcagaaagcccuuccccaucaaccacggcgagaccagcgacgagacccugcuggaggacgccaucgaggugugcaagaaguucauggagagagaccccgacgagcugagauucaacgccaucgcccugagcgccgccuaa

SEQ ID NO: 25336 - RNA, 987 nt, Artificial Sequence
  UCHL5__Homo_sapiens__NP_001186190
augaccggcaacgccggcgaguggugccugauggagagcgaccccggcguguucaccgagcugaucaagggcuucggcugcagaggcgcccagguggaggagaucuggagccuggagcccgagaacuucgagaagcugaagcccgugcacggccugaucuuccuguucaaguggcagcccggcgaggagcccgccggcagcguggugcaggacagcagacuggacaccaucuucuucgccaagcaggugaucaacaacgccugcgccacccaggccaucgugagcgugcugcugaacugcacccaccaggacgugcaccugggcgagacccugagcgaguucaaggaguucagccagagcuucgacgccgccaugaagggccuggcccugagcaacagcgacgugaucagacaggugcacaacagcuucgccagacagcagauguucgaguucgacaccaagaccagcgccaaggaggaggacgccuuccacuucgugagcuacgugcccgugaacggcagacuguacgagcuggacggccugagagagggccccaucgaccugggcgccugcaaccaggacgacuggaucagcgccgugagacccgugaucgagaagagaauccagaaguacagcgagggcgagaucagauucaaccugauggccaucgugagcgacagaaagaugaucuacgagcagaagaucgccgagcugcagagacagcuggccgaggagcccauggacaccgaccagggcaacagcaugcugagcgccauccagagcgagguggccaagaaccagaugcugaucgaggaggaggugcagaagcugaagagauacaagaucgagaacaucagaagaaagcacaacuaccugcccuucaucauggagcugcugaagacccuggccgagcaccagcagcugaucccccugguggagaaggccaaggagaagcagaacgccaagaaggcccaggagaccaaguaa

SEQ ID NO: 25337 - RNA, 606 nt, Artificial Sequence
  UCK1__Homo_sapiens__NP_001129426
auggccagcgccggcggcgaggacugcgagagccccgcccccgaggccgacagaccccaccagagacccuuccugaucggcgugagcggcggcaccgccagcggcaagagcaccgugugcgagaagaucauggagcugcugggccagaacgagguggagcagagacagagaaagguggugauccugagccaggacagauucuacaaggugcugaccgccgagcagaaggccaaggcccugaagggccaguacaacuucgaccaccccgacgccuucgacaacgaccugaugcacagaacccugaagaacaucguggagggcaagaccguggaggugcccaccuacgacuucgugacccacagcagacugcccgagaccaccgugguguaccccgccgacguggugcuguucgagggcauccugguguucuacagccaggagaucagagacauguuccaccugagacuguucguggacaccgacagcgacgugagacugagcagaagagacaaggaggugugcagaugcgaccaccccgccagaagcggccaguacggcugccaccagcccgacagagccgcccaccccggccacagcgagugguaa

SEQ ID NO: 25338 - RNA, 786 nt, Artificial Sequence
  UCK2__Homo_sapiens__NP_036606
auggccggcgacagcgagcagacccugcagaaccaccagcagcccaacggcggcgagcccuuccugaucggcgugagcggcggcaccgccagcggcaagagcagcgugugcgccaagaucgugcagcugcugggccagaacgagguggacuacagacagaagcagguggugauccugagccaggacagcuucuacagagugcugaccagcgagcagaaggccaaggcccugaagggccaguucaacuucgaccaccccgacgccuucgacaacgagcugauccugaagacccugaaggagaucaccgagggcaagaccgugcagauccccguguacgacuucgugagccacagcagaaaggaggagaccgugaccguguaccccgccgacguggugcuguucgagggcauccuggccuucuacagccaggaggugagagaccuguuccagaugaagcuguucguggacaccgacgccgacaccagacugagcagaagagugcugagagacaucagcgagagaggcagagaccuggagcagauccugagccaguacaucaccuucgugaagcccgccuucgaggaguucugccugcccaccaagaaguacgccgacgugaucauccccagaggcgccgacaaccugguggccaucaaccugaucgugcagcacauccaggacauccugaacggcggccccagcaagagacagaccaacggcugccugaacggcuacacccccagcagaaagagacaggccagcgagagcagcagcagaccccacuaa

SEQ ID NO: 25339 - RNA, 1602 nt, Artificial Sequence
  UCKL1__Homo_sapiens__NP_001180308
augagcagcccccccgccuaccccggcaucagaaucagcggcugcagagcccugggcgccgagggcagcagcaacgccgagagccuggacagacugcugccccccgugggcaccggcagaagccccagaaagagaaccaccagccagugcaagagcgagcccccccugcugagaaccagcaagagaaccaucuacaccgccggcagaccccccugguacaacgagcacggcacccagagcaaggaggccuucgccaucggccugggcggcggcagcgccagcggcaagaccaccguggccagaaugaucaucgaggcccuggacgugcccuggguggugcugcugagcauggacagcuucuacaaggugcugaccgagcagcagcaggagcaggccgcccacaacaacuucaacuucgaccaccccgacgccuucgacuucgaccugaucaucagcacccugaagaagcugaagcagggcaagagcgugaaggugcccaucuacgacuucaccacccacagcagaaagaaggacuggaagacccuguacggcgccaacgugaucaucuucgagggcaucauggccuucgccgacaagacccugcuggagcugcuggacaugaagaucuucguggacaccgacagcgacaucagacuggugagaagacugagaagagacaucagcgagagaggcagagacaucgagggcgugaucaagcaguacaacaaguucgugaagcccagcuucgaccaguacauccagcccaccaugagacuggccgacaucguggugcccagaggcagcggcaacaccguggccaucgaccugaucgugcagcacgugcacagccagcuggaggagagagagcugagcgugagagccgcccuggccagcgcccaccagugccacccccugcccagaacccugagcgugcugaagagcaccccccaggugagaggcaugcacaccaucaucagagacaaggagaccagcagagacgaguucaucuucuacagcaagagacugaugagacugcugaucgagcacgcccugagcuuccugcccuuccaggacugcguggugcagaccccccagggccaggacuacgccggcaagugcuacgccggcaagcagaucaccggcgugagcauccugagagccggcgagaccauggagcccgcccugagagccgugugcaaggacgugagaaucggcaccauccugauccagaccaaccagcugaccggcgagcccgagcugcacuaccugagacugcccaaggacaucagcgacgaccacgugauccugauggacugcaccgugagcaccggcgccgccgccaugauggccgugagagugcugcuggaccacgacgugcccgaggacaagaucuuccugcugagccugcugauggccgagaugggcgugcacagcguggccuacgccuuccccagagugagaaucaucaccaccgccguggacaagagagugaacgaccuguucagaaucauccccggcaucggcaacuucggcgacagauacuucggcaccgacgccgugcccgacggcagcgacgaggaggagguggccuacaccggcuaa

SEQ ID NO: 25340 - RNA, 417 nt, Artificial Sequence
  UCMA__Homo_sapiens__NP_660357
augaccuggagacaggccgugcugcugagcugcuucagcgccguggugcugcugagcaugcugagagagggcaccagcgugagcgugggcaccaugcagauggccggcgaggaggccagcgaggacgccaagcagaagaucuucaugcaggagagcgacgccagcaacuuccugaagagaagaggcaagagaagccccaagagcagagacgaggugaacguggagaacagacagaagcugagaguggacgagcugagaagagaguacuacgaggagcagagaaacgaguucgagaacuucguggaggagcagaacgacgagcaggaggagagaagcagagaggccguggagcaguggagacaguggcacuacgacggccugcaccccagcuaccuguacaacagacaccacaccuaa

SEQ ID NO: 25341 - RNA, 339 nt, Artificial Sequence
  UCN2__Homo_sapiens__NP_149976
augaccagaugcgcccugcugcugcugauggugcugaugcugggcagagugcugguggugcccgugacccccauccccaccuuccagcugagaccccagaacagcccccagaccacccccagacccgccgccagcgagagccccagcgccgcccccaccuggcccugggccgcccagagccacugcagccccaccagacaccccggcagcagaaucgugcugagccuggacgugcccaucggccugcugcagauccugcuggagcaggccagagccagagccgccagagagcaggccaccaccaacgccagaauccuggccagagugggccacugcuaa

SEQ ID NO: 25342 - RNA, 486 nt, Artificial Sequence
  UCN3__Homo_sapiens__NP_444277
augcugaugcccgugcacuuccugcugcugcugcugcugcugcugggcggccccagaaccggccugccccacaaguucuacaaggccaagcccaucuucagcugccugaacaccgcccugagcgaggccgagaagggccagugggaggacgccagccugcugagcaagagaagcuuccacuaccugagaagcagagacgccagcagcggcgaggaggaggagggcaaggagaagaagaccuuccccaucagcggcgccagaggcggcgccagaggcaccagauacagauacgugagccaggcccagcccagaggcaagcccagacaggacaccgccaagagcccccacagaaccaaguucacccugagccuggacgugcccaccaacaucaugaaccugcuguucaacaucgccaaggccaagaaccugagagcccaggccgccgccaacgcccaccugauggcccagaucggcagaaagaaguaa

SEQ ID NO: 25343 - RNA, 375 nt, Artificial Sequence
  UCN__Homo_sapiens__NP_003344
augagacaggccggcagagccgcccugcuggccgcccugcugcugcuggugcagcugugccccggcagcagccagagaagccccgaggccgccggcgugcaggaccccagccugagauggagccccggcgccagaaaccagggcggcggcgccagagcccugcugcugcugcuggccgagagauuccccagaagagccggccccggcagacugggccugggcaccgccggcgagagacccagaagagacaaccccagccugagcaucgaccugaccuuccaccugcugagaacccugcuggagcuggccagaacccagagccagagagagagagccgagcagaacagaaucaucuucgacagcgugggcaaguaa

SEQ ID NO: 25344 - RNA, 924 nt, Artificial Sequence
  UCP1__Homo_sapiens__NP_068605
augggcggccugaccgccagcgacgugcaccccacccugggcgugcagcuguucagcgccggcaucgccgccugccuggccgacgugaucaccuucccccuggacaccgccaaggugagacugcaggugcagggcgagugccccaccagcagcgugaucagauacaagggcgugcugggcaccaucaccgccguggugaagaccgagggcagaaugaagcuguacagcggccugcccgccggccugcagagacagaucagcagcgccagccugagaaucggccuguacgacaccgugcaggaguuccugaccgccggcaaggagaccgcccccagccugggcagcaagauccuggccggccugaccaccggcggcguggccguguucaucggccagcccaccgagguggugaaggugagacugcaggcccagagccaccugcacggcaucaagcccagauacaccggcaccuacaacgccuacagaaucaucgccaccaccgagggccugaccggccuguggaagggcaccacccccaaccugaugagaagcgugaucaucaacugcaccgagcuggugaccuacgaccugaugaaggaggccuucgugaagaacaacauccuggccgacgacgugcccugccaccuggugagcgcccugaucgccggcuucugcgccaccgccaugagcagccccguggacguggugaagaccagauucaucaacagcccccccggccaguacaagagcgugcccaacugcgccaugaagguguucaccaacgagggccccaccgccuucuucaagggccuggugcccagcuuccugagacugggcagcuggaacgugaucauguucgugugcuucgagcagcugaagagagagcugagcaagagcagacagaccauggacugcgccaccuaa

SEQ ID NO: 25345 - RNA, 930 nt, Artificial Sequence
  UCP2__Homo_sapiens__NP_003346
auggugggcuucaaggccaccgacgugccccccaccgccaccgugaaguuccugggcgccggcaccgccgccugcaucgccgaccugaucaccuucccccuggacaccgccaaggugagacugcagauccagggcgagagccagggccccgugagagccaccgccagcgcccaguacagaggcgugaugggcaccauccugaccauggugagaaccgagggccccagaagccuguacaacggccugguggccggccugcagagacagaugagcuucgccagcgugagaaucggccuguacgacagcgugaagcaguucuacaccaagggcagcgagcacgccagcaucggcagcagacugcuggccggcagcaccaccggcgcccuggccguggccguggcccagcccaccgacguggugaaggugagauuccaggcccaggccagagccggcggcggcagaagauaccagagcaccgugaacgccuacaagaccaucgccagagaggagggcuucagaggccuguggaagggcaccagccccaacguggccagaaacgccaucgugaacugcgccgagcuggugaccuacgaccugaucaaggacgcccugcugaaggccaaccugaugaccgacgaccugcccugccacuucaccagcgccuucggcgccggcuucugcaccaccgugaucgccagccccguggacguggugaagaccagauacaugaacagcgcccugggccaguacagcagcgccggccacugcgcccugaccaugcugcagaaggagggccccagagccuucuacaagggcuucaugcccagcuuccugagacugggcagcuggaacguggugauguucgugaccuacgagcagcugaagagagcccugauggccgccugcaccagcagagaggcccccuucuaa

SEQ ID NO: 25346 - RNA, 939 nt, Artificial Sequence
  UCP3__Homo_sapiens__NP_003347
auggugggccugaagcccagcgacgugccccccaccauggccgugaaguuccugggcgccggcaccgccgccugcuucgccgaccuggugaccuucccccuggacaccgccaaggugagacugcagauccagggcgagaaccaggccgugcagaccgccagacuggugcaguacagaggcgugcugggcaccauccugaccauggugagaaccgagggccccugcagccccuacaacggccugguggccggccugcagagacagaugagcuucgccagcaucagaaucggccuguacgacagcgugaagcagguguacacccccaagggcgccgacaacagcagccugaccaccagaauccuggccggcugcaccaccggcgccauggccgugaccugcgcccagcccaccgacguggugaaggugagauuccaggccagcauccaccugggccccagcagaagcgacagaaaguacagcggcaccauggacgccuacagaaccaucgccagagaggagggcgugagaggccuguggaagggcacccugcccaacaucaugagaaacgccaucgugaacugcgccgagguggugaccuacgacauccugaaggagaagcugcuggacuaccaccugcugaccgacaacuuccccugccacuucgugagcgccuucggcgccggcuucugcgccaccgugguggccagccccguggacguggugaagaccagauacaugaacagcccccccggccaguacuucagcccccuggacugcaugaucaagaugguggcccaggagggccccaccgccuucuacaagggcuucacccccagcuuccugagacugggcagcuggaacguggugauguucgugaccuacgagcagcugaagagagcccugaugaaggugcagaugcugagagagagccccuucuaa

SEQ ID NO: 25347 - RNA, 1416 nt, Artificial Sequence
  UEVLD__Homo_sapiens__NP_001035787
auggaguucgacugcgagggccugagaagacugcugggcaaguacaaguucagagaccugaccguggaggagcugagaaacgugaacguguucuucccccacuucaaguacagcauggacaccuacguguucaaggacagcagccagaaggaccugcugaacuucaccggcaccauccccgugauguaccagggcaacaccuacaacauccccaucagauucuggauccuggacagccaccccuucgccccccccaucugcuuccugaagcccaccgccaacaugggcauccuggugggcaagcacguggacgcccagggcagaaucuaccugcccuaccugcagaacuggagccaccccaagagcgugaucgugggccugaucaaggagaugaucgccaaguuccaggaggagcugcccauguacagccugagcagcagcgacgaggccagacagguggaccugcuggccuacaucgccaagaucaccgagggcgugagcgacaccaacagcaagagcugggccaaccacgagaacaagaccgugaacaagaucaccguggugggcggcggcgagcugggcaucgccugcacccuggccaucagcgccaagggcaucgccgacagacuggugcugcuggaccugagcgagggcaccaagggcgccaccauggaccuggagaucuucaaccugcccaacguggagaucagcaaggaccugagcgccagcgcccacagcaagguggugaucuucaccgugaacagccugggcagcagccagagcuaccuggacguggugcagagcaacguggacauguucagagcccuggugcccgcccugggccacuacagccagcacagcgugcugcugguggccagccagcccguggagaucaugaccuacgugaccuggaagcugagcaccuuccccgccaacagagugaucggcaucggcugcaaccuggacagccagagacugcaguacaucaucaccaacgugcugaaggcccagaccagcggcaaggaggugugggugaucggcgagcagggcgaggacaaggugcugaccuggagcggccaggaggagguggugagccacaccagccaggugcagcugagcaacagagccauggagcugcugagagugaagggccagagaagcuggagcgugggccugagcguggccgacaugguggacagcaucgugaacaacaagaagaaggugcacagcgugagcgcccuggccaagggcuacuacgacaucaacagcgagguguuccugagccugcccugcauccugggcaccaacggcgugagcgaggugaucaagaccacccugaaggaggacaccgugaccgagaagcugcagagcagcgccagcagcauccacagccugcagcagcagcugaagcuguaa

SEQ ID NO: 25348 - RNA, 801 nt, Artificial Sequence
  UFD1L__Homo_sapiens__NP_001030324
auguucagcuucaacauguucgaccaccccauccccagaguguuccagaacagauucagcacccaguacagaugcuucagcgugagcaugcuggccggccccaacgacagaagcgacguggagaagggcggcaagaucaucaugccccccagcgcccuggaccagcugagcagacugaacaucaccuaccccaugcuguucaagcugaccaacaagaacagcgacagaaugacccacugcggcgugcuggaguucguggccgacgagggcaucugcuaccugccccacuggaugaugcagaaccugcugcuggaggagggcggccuggugcagguggagagcgugaaccugcagguggccaccuacagcaaguuccagccccagagccccgacuuccuggacaucaccaaccccaaggccgugcuggagaacgcccugagaaacuucgccugccugaccaccggcgacgugaucgccaucaacuacaacgagaagaucuacgagcugagagugauggagaccaagcccgacaaggccgugagcaucaucgagugcgacaugaacguggacuucgacgccccccugggcuacaaggagcccgagagacaggugcagcacgaggagagcaccgagggcgaggccgaccacagcggcuacgccggcgagcugggcuucagagccuucagcggcagcggcaacagacuggacggcaagaagaagggcguggagcccagccccagccccaucaagcccggcgacaucaagagaggcauccccaacuacgaguucaagcugggcuaa

SEQ ID NO: 25349 - RNA, 2385 nt, Artificial Sequence
  UFL1__Homo_sapiens__NP_056138
auggccgacgccugggaggagaucagaagacuggccgccgacuuccagagagcccaguucgccgaggccacccagagacugagcgagagaaacugcaucgagaucgugaacaagcugaucgcccagaagcagcuggagguggugcacacccuggacggcaaggaguacaucacccccgcccagaucagcaaggagaugagagacgagcugcacgugagaggcggcagagugaacaucguggaccugcagcaggugaucaacguggaccugauccacaucgagaacagaaucggcgacaucaucaagagcgagaagcacgugcagcuggugcugggccagcugaucgacgagaacuaccuggacagacuggccgaggaggugaacgacaagcugcaggagagcggccaggugaccaucagcgagcugugcaagaccuacgaccugcccggcaacuuccugacccaggcccugacccagagacugggcagaaucaucagcggccacaucgaccuggacaacagaggcgugaucuucaccgaggccuucguggccagacacaaggccagaaucagaggccuguucagcgccaucaccagacccaccgccgugaacagccugaucagcaaguacggcuuccaggagcagcugcuguacagcgugcuggaggagcuggugaacagcggcagacugagaggcaccguggugggcggcagacaggacaaggccguguucgugcccgacaucuacagcagaacccagagcaccuggguggacagcuucuucagacagaacggcuaccuggaguucgacgcccugagcagacugggcauccccgacgccgugagcuacaucaagaagagauacaagaccacccagcugcuguuccugaaggccgccugcgugggccagggccugguggaccagguggaggccagcguggaggaggccaucagcagcggcaccuggguggacaucgccccccugcugcccaccagccugagcguggaggacgccgccauccugcugcagcaggugaugagagccuucagcaagcaggccagcaccgugguguucagcgacaccgugguggugagcgagaaguucaucaacgacugcaccgagcuguucagagagcugaugcaccagaaggccgagaaggagaugaagaacaaccccgugcaccugaucaccgaggaggaccugaagcagaucagcacccuggagagcgugagcaccagcaagaaggacaagaaggacgagagaagaagaaaggccaccgagggcagcggcagcaugagaggcggcggcggcggcaacgccagagaguacaagaucaagaaggugaagaagaagggcagaaaggacgacgacagcgacgacgagagccagagcagccacaccggcaagaagaagcccgagaucagcuucauguuccaggacgagaucgaggacuuccugagaaagcacauccaggacgcccccgaggaguucaucagcgagcuggccgaguaccugaucaagccccugaacaagaccuaccuggagguggugagaagcguguucaugagcagcaccaccagcgccagcggcaccggcagaaagagaaccaucaaggaccugcaggaggaggugagcaaccuguacaacaacaucagacuguucgagaagggcaugaaguucuucgccgacgacacccaggccgcccugaccaagcaccugcugaagagcgugugcaccgacaucaccaaccugaucuucaacuuccuggccagcgaccugaugauggccguggacgaccccgccgccaucaccagcgagaucagaaagaagauccugagcaagcugagcgaggagaccaagguggcccugaccaagcugcacaacagccugaacgagaagagcaucgaggacuucaucagcugccuggacagcgccgccgaggccugcgacaucauggugaagagaggcgacaagaagagagagagacagauccuguuccagcacagacaggcccuggccgagcagcugaaggugaccgaggaccccgcccugauccugcaccugaccagcgugcugcuguuccaguucagcacccacagcaugcugcacgcccccggcagaugcgugccccagaucaucgccuuccugaacagcaagauccccgaggaccagcacgcccugcuggugaaguaccagggccugguggugaagcagcuggugagccagagcaagaagaccggccagggcgacuacccccugaacaacgagcuggacaaggagcaggaggacguggccagcaccaccagaaaggagcugcaggagcugagcagcagcaucaaggaccuggugcugaagagcagaaagagcagcgugaccgaggaguaa

SEQ ID NO: 25350 - RNA, 312 nt, Artificial Sequence
  UFM1__Homo_sapiens__NP_001273633
augaucagagccuuccccaccaccacccccagaagccugcaccuguucaccagcagcaccuuccuggccagagcccugcccggcgccuuccccaccggcgccugcgaggagagacugagcgugcccgagagcacccccuucaccgccgugcugaaguucgccgccgaggaguucaaggugcccgccgccaccagcgccaucaucaccaacgacggcaucggcaucaaccccgcccagaccgccggcaacguguuccugaagcacggcagcgagcugagaaucauccccagagacagagugggcagcugcuaa

SEQ ID NO: 25351 - RNA, 1185 nt, Artificial Sequence
  UGCG__Homo_sapiens__NP_003349
auggcccugcuggaccuggcccuggagggcauggccguguucggcuucgugcuguuccuggugcuguggcugaugcacuucauggccaucaucuacaccagacugcaccugaacaagaaggccaccgacaagcagcccuacagcaagcugcccggcgugagccugcugaagccccugaagggcguggaccccaaccugaucaacaaccuggagaccuucuucgagcuggacuaccccaaguacgaggugcugcugugcgugcaggaccacgacgaccccgccaucgacgugugcaagaagcugcugggcaaguaccccaacguggacgccagacuguucaucggcggcaagaaggugggcaucaaccccaagaucaacaaccugaugcccggcuacgagguggccaaguacgaccugaucuggaucugcgacagcggcaucagagugauccccgacacccugaccgacauggugaaccagaugaccgagaaggugggccuggugcacggccugcccuacguggccgacagacagggcuucgccgccacccuggagcagguguacuucggcaccagccaccccagauacuacaucagcgccaacgugaccggcuucaagugcgugaccggcaugagcugccugaugagaaaggacgugcuggaccaggccggcggccugaucgccuucgcccaguacaucgccgaggacuacuucauggccaaggccaucgccgacagaggcuggagauucgccaugagcacccagguggccaugcagaacagcggcagcuacagcaucagccaguuccagagcagaaugaucagauggaccaagcugagaaucaacaugcugcccgccaccaucaucugcgagcccaucagcgagugcuucguggccagccugaucaucggcugggccgcccaccacguguucagaugggacaucaugguguucuucaugugccacugccuggccugguucaucuucgacuacauccagcugagaggcgugcagggcggcacccugugcuucagcaagcuggacuacgccguggccugguucaucagagagagcaugaccaucuacaucuuccugagcgcccugugggaccccaccaucagcuggagaaccggcagauacagacugagaugcggcggcaccgccgaggagauccuggacguguaa

SEQ ID NO: 25352 - RNA, 1284 nt, Artificial Sequence
  UGDH__Homo_sapiens__NP_001171629
auguucgagaucaagaagaucugcugcaucggcgccggcuacgugggcggccccaccugcagcgugaucgcccacaugugccccgagaucagagugaccgugguggacgugaacgagagcagaaucaacgccuggaacagccccacccugcccaucuacgagcccggccugaaggaggugguggagagcugcagaggcaagaaccuguucuucagcaccaacaucgacgacgccaucaaggaggccgaccugguguucaucagcgugcugagcaaccccgaguuccuggccgagggcaccgccaucaaggaccugaagaaccccgacagagugcugaucggcggcgacgagacccccgagggccagagagccgugcaggcccugugcgccguguacgagcacugggugcccagagagaagauccugaccaccaacaccuggagcagcgagcugagcaagcuggccgccaacgccuuccuggcccagagaaucagcagcaucaacagcaucagcgcccugugcgaggccaccggcgccgacguggaggagguggccaccgccaucggcauggaccagagaaucggcaacaaguuccugaaggccagcgugggcuucggcggcagcugcuuccagaaggacgugcugaaccugguguaccugugcgaggcccugaaccugcccgagguggccagauacuggcagcaggugaucgacaugaacgacuaccagagaagaagauucgccagcagaaucaucgacagccuguucaacaccgugaccgacaagaagaucgccauccugggcuucgccuucaagaaggacaccggcgacaccagagagagcagcagcaucuacaucagcaaguaccugauggacgagggcgcccaccugcacaucuacgaccccaaggugcccagagagcagaucgugguggaccugagccaccccggcgugagcgaggacgaccaggugagcagacuggugaccaucagcaaggaccccuacgaggccugcgacggcgcccacgccguggugaucugcaccgagugggacauguucaaggagcuggacuacgagagaauccacaagaagaugcugaagcccgccuucaucuucgacggcagaagagugcuggacggccugcacaacgagcugcagaccaucggcuuccagaucgagaccaucggcaagaaggugagcagcaagagaauccccuacgcccccagcggcgagauccccaaguucagccugcaggacccccccaacaagaagcccaagguguaa

SEQ ID NO: 25353 - RNA, 4668 nt, Artificial Sequence
  UGGT1__Homo_sapiens__NP_064505
augggcugcaagggcgacgccagcggcgccugcgccgccggcgcccugcccgugaccggcgugugcuacaagaugggcgugcugguggugcugaccgugcuguggcuguucagcagcgugaaggccgacagcaaggccaucaccaccagccugaccaccaagugguucagcaccccccugcugcuggaggccagcgaguuccuggccgaggacagccaggagaaguucuggaacuucguggaggccagccagaacaucggcagcagcgaccacgacggcaccgacuacagcuacuaccacgccauccuggaggccgccuuccaguuccugagcccccugcagcagaaccuguucaaguucugccugagccugagaagcuacagcgccaccauccaggccuuccagcagaucgccgccgacgagcccccccccgagggcugcaacagcuucuucagcgugcacggcaagaagaccugcgagagcgacacccuggaggcccugcugcugaccgccagcgagagacccaagccccugcuguucaagggcgaccacagauaccccagcagcaaccccgagagccccguggugaucuucuacagcgagaucggcagcgaggaguucagcaacuuccacagacagcugaucagcaagagcaacgccggcaagaucaacuacguguucagacacuacaucuucaaccccagaaaggagcccguguaccugagcggcuacggcguggagcuggccaucaagagcaccgaguacaaggccaaggacgacacccaggugaagggcaccgaggugaacaccaccgugaucggcgagaacgaccccaucgacgaggugcagggcuuccuguucggcaagcugagagaccugcaccccgaccuggagggccagcugaaggagcugagaaagcaccugguggagagcaccaacgagauggccccccugaagguguggcagcugcaggaccugagcuuccagaccgccgccagaauccuggccagccccguggagcuggcccugguggugaugaaggaccugagccagaacuuccccaccaaggccagagccaucaccaagaccgccgugagcagcgagcugagaaccgagguggaggagaaccagaaguacuucaagggcacccugggccugcagcccggcgacagcgcccuguucaucaacggccugcacauggaccuggacacccaggacaucuucagccuguucgacgugcugagaaacgaggccagagugauggagggccugcacagacugggcaucgagggccugagccugcacaacgugcugaagcugaacauccagcccagcgaggccgacuacgccguggacaucagaagccccgccaucagcugggugaacaaccuggagguggacagcagauacaacagcuggcccagcagccugcaggagcugcugagacccaccuuccccggcgugaucagacagaucagaaagaaccugcacaacaugguguucaucguggaccccgcccacgagaccaccgccgagcugaugaacaccgccgagauguuccugagcaaccacaucccccugagaaucggcuucaucuucguggugaacgacagcgaggacguggacggcaugcaggacgccggcguggccgugcugagagccuacaacuacguggcccaggagguggacgacuaccacgccuuccagacccugacccacaucuacaacaaggugagaaccggcgagaaggugaagguggagcacguggugagcgugcuggagaagaaguaccccuacguggaggugaacagcauccugggcaucgacagcgccuacgacagaaacagaaaggaggccagaggcuacuacgagcagaccggcgugggcccccugcccguggugcuguucaacggcaugcccuucgagagagagcagcuggaccccgacgagcuggagaccaucaccaugcacaagauccuggagaccaccaccuucuuccagagagccguguaccugggcgagcugccccacgaccaggacgugguggaguacaucaugaaccagcccaacguggugcccagaaucaacagcagaauccugaccgccgagagagacuaccuggaccugaccgccagcaacaacuucuucguggacgacuacgccagauucaccauccuggacagccagggcaagaccgccgccguggccaacagcaugaacuaccugaccaagaagggcaugagcagcaaggagaucuacgacgacagcuucaucagacccgugaccuucuggaucgugggcgacuucgacagccccagcggcagacagcugcuguacgacgccaucaagcaccagaagagcagcaacaacgugagaaucagcaugaucaacaaccccgccaaggagaucagcuacgagaacacccagaucagcagagccaucugggccgcccugcagacccagaccagcaacgccgccaagaacuucaucaccaagauggccaaggagggcgccgccgaggcccuggccgccggcgccgacaucgccgaguucagcgugggcggcauggacuucagccuguucaaggagguguucgagagcagcaagauggacuucauccugagccacgccguguacugcagagacgugcugaagcugaagaagggccagagagccgugaucagcaacggcagaaucaucggcccccuggaggacagcgagcuguucaaccaggacgacuuccaccugcuggagaacaucauccugaagaccagcggccagaagaucaagagccacauccagcagcugagaguggaggaggacguggccagcgaccuggugaugaagguggacgcccugcugagcgcccagcccaagggcgaccccagaaucgaguaccaguucuucgaggacagacacagcgccaucaagcugagacccaaggagggcgagaccuacuucgacgugguggccgugguggaccccgugaccagagaggcccagagacuggccccccugcugcuggugcuggcccagcugaucaacaugaaccugagaguguucaugaacugccagagcaagcugagcgacaugccccugaagagcuucuacagauacgugcuggagcccgagaucagcuucaccagcgacaacagcuucgccaagggccccaucgccaaguuccuggacaugccccagagcccccuguucacccugaaccugaacacccccgagagcuggaugguggagagcgugagaacccccuacgaccuggacaacaucuaccuggaggagguggacagcgugguggccgccgaguacgagcuggaguaccugcugcuggagggccacugcuacgacaucaccaccggccagccccccagaggccugcaguucacccugggcaccagcgccaaccccgugaucguggacaccaucgugauggccaaccugggcuacuuccagcugaaggccaaccccggcgccuggauccugagacugagaaagggcagaagcgaggacaucuacagaaucuacagccacgacggcaccgacagcccccccgacgccgacgagguggugaucgugcugaacaacuucaagagcaagaucaucaaggugaaggugcagaagaaggccgacauggugaacgaggaccugcugagcgacggcaccagcgagaacgagagcggcuucugggacagcuucaaguggggcuucaccggccagaagaccgaggaggugaagcaggacaaggacgacaucaucaacaucuucagcguggccagcggccaccuguacgagagauuccugagaaucaugaugcugagcgugcugaagaacaccaagacccccgugaaguucugguuccugaagaacuaccugagccccaccuucaaggaguucauccccuacauggccaacgaguacaacuuccaguacgagcuggugcaguacaaguggcccagauggcugcaccagcagaccgagaagcagagaaucaucuggggcuacaagauccuguuccuggacgugcuguucccccuggugguggacaaguuccuguucguggacgccgaccagaucgugagaaccgaccugaaggagcugagagacuucaaccuggacggcgcccccuacggcuacacccccuucugcgacagcagaagagagauggacggcuacagauucuggaagagcggcuacugggccagccaccuggccggcagaaaguaccacaucagcgcccuguacgugguggaccugaagaaguucagaaagaucgccgccggcgacagacugagaggccaguaccagggccugagccaggaccccaacagccugagcaaccuggaccaggaccugcccaacaacaugauccaccaggugcccaucaagagccugccccaggaguggcuguggugcgagaccuggugcgacgacgccagcaagaagagagccaagaccaucgaccugugcaacaaccccaugaccaaggagcccaagcuggaggccgccgugagaaucgugcccgaguggcaggacuacgaccaggagaucaagcagcugcagaucagauuccagaaggagaaggagaccggcgcccuguacaaggagaagaccaaggagcccagcagagagggcccccagaagagagaggagcuguaa

SEQ ID NO: 25354 - RNA, 4551 nt, Artificial Sequence
  UGGT2__Homo_sapiens__NP_064506
auggcccccgccaaggccaccaacguggugagacugcugcugggcagcaccgcccuguggcugagccagcugggcagcggcaccguggccgccagcaagagcgugaccgcccaccuggccgccaaguggcccgagaccccccugcugcuggaggccagcgaguucauggccgaggagagcaacgagaaguucuggcaguuccuggagaccgugcaggagcuggccaucuacaagcagaccgagagcgacuacagcuacuacaaccugauccugaagaaggccggccaguuccuggacaaccugcacaucaaccugcugaaguucgccuucagcaucagagccuacagccccgccauccagauguuccagcagaucgccgccgacgagcccccccccgacggcugcaacgccuucguggugauccacaagaagcacaccugcaagaucaacgagaucaagaagcugcugaagaaggccgccagcagaaccagacccuaccuguucaagggcgaccacaaguuccccaccaacaaggagaaccugcccguggugauccuguacgccgagaugggcaccagaaccuucagcgccuuccacaaggugcugagcgagaaggcccagaacgaggagauccuguacgugcugagacacuacauccagaagcccagcagcagaaagauguaccugagcggcuacggcguggagcuggccaucaagagcaccgaguacaaggcccuggacgacacccaggugaagaccgugaccaacaccaccguggaggacgagaccgagaccaacgaggugcagggcuuccuguucggcaagcugaaggagaucuacagcgaccugagagacaaccugaccgccuuccagaaguaccugaucgagagcaacaagcagaugaugccccugaaggugugggagcugcaggaccugagcuuccaggccgccagccagaucaugagcgcccccguguacgacagcaucaagcugaugaaggacaucagccagaacuuccccaucaaggccagaagccugaccagaaucgccgugaaccagcacaugagagaggagaucaaggagaaccagaaggaccugcaggugagauucaagauccagcccggcgacgccagacuguucaucaacggccugagaguggacauggacguguacgacgccuucagcauccuggacaugcugaagcuggagggcaagaugaugaacggccugagaaaccugggcaucaacggcgaggacaugagcaaguuccugaagcugaacagccacaucugggaguacaccuacgugcuggacaucagacacagcagcaucauguggaucaacgaccuggagaacgacgaccuguacaucaccuggcccaccagcugccagaagcugcugaagcccguguuccccggcagcgugcccagcaucagaagaaacuuccacaaccuggugcuguucaucgaccccgcccaggaguacacccuggacuucaucaagcuggccgacguguucuacagccacgaggugccccugagaaucggcuucguguucauccugaacaccgacgacgagguggacggcgccaacgacgccggcguggcccuguggagagccuucaacuacaucgccgaggaguucgacaucagcgaggccuucaucagcaucgugcacauguaccagaaggugaagaaggaccagaacauccugaccguggacaacgugaagagcgugcugcagaacaccuucccccacgccaacaucugggacauccugggcauccacagcaaguacgacgaggagagaaaggccggcgccagcuucuacaagaugaccggccugggcccccugccccaggcccuguacaacggcgagcccuucaagcacgaggagaugaacaucaaggagcugaagauggccgugcugcagagaaugauggacgccagcguguaccugcagagagagguguuccugggcacccugaacgacagaaccaacgccaucgacuuccugauggacagaaacaacguggugcccagaaucaacacccugauccugagaaccaaccagcaguaccugaaccugaucagcaccagcgugaccgccgacguggaggacuucagcaccuucuucuuccuggacagccaggacaagagcgccgugaucgccaagaacauguacuaccugacccaggacgacgagagcaucaucagcgccgugacccuguggaucaucgccgacuucgacaagcccagcggcagaaagcugcuguucaacgcccugaagcacaugaagaccagcgugcacagcagacugggcaucaucuacaaccccaccagcaagaucaacgaggagaacaccgccaucagcagaggcauccuggccgccuuccugacccagaagaacauguuccugagaagcuuccugggccagcuggccaaggaggagaucgccaccgccaucuacagcggcgacaagaucaagaccuuccugaucgagggcauggacaagaacgccuucgagaagaaguacaacaccgugggcgugaacaucuucagaacccaccagcuguucugccaggacgugcugaagcugagacccggcgagaugggcaucgugagcaacggcagauuccugggcccccuggacgaggacuucuacgccgaggacuucuaccugcuggagaagaucaccuucagcaaccugggcgagaagaucaagggcaucguggagaacaugggcaucaacgccaacaacaugagcgacuucaucaugaagguggacgcccugaugagcagcgugcccaagagagccagcagauacgacgugaccuuccugagagagaaccacagcgugaucaagaccaacccccaggagaacgacauguucuucaacgugaucgccaucguggacccccugaccagagaggcccagaagauggcccagcugcugguggugcugggcaagaucaucaacaugaagaucaagcuguucaugaacugcagaggcagacugagcgaggccccccuggagagcuucuacagauucgugcuggagcccgagcugaugagcggcgccaacgacgugagcagccugggccccguggccaaguuccuggacauccccgagagcccccugcugauccugaacaugaucacccccgagggcuggcugguggagaccgugcacagcaacugcgaccuggacaacauccaccugaaggacaccgagaagaccgugaccgccgaguacgagcuggaguaccugcugcuggagggccagugcuucgacaaggugaccgagcagccccccagaggccugcaguucacccugggcaccaagaacaagcccgccgugguggacaccaucgugauggcccaccacggcuacuuccagcugaaggccaaccccggcgccuggauccugagacugcaccagggcaagagcgaggacaucuaccagaucgugggccacgagggcaccgacagccaggccgaccuggaggacaucaucguggugcugaacagcuucaagagcaagauccugaaggugaaggugaagaaggagaccgacaagaucaaggaggacauccugaccgacgaggacgagaagaccaagggccugugggacagcaucaagagcuucaccgugagccugcacaaggagaacaagaaggagaaggacgugcugaacaucuucagcguggccagcggccaccuguacgagagauuccugagaaucaugaugcugagcgugcugagaaacaccaagacccccgugaaguucuggcugcugaagaacuaccugagccccaccuucaaggaggugaucccccacauggccaaggaguacggcuucagauacgagcuggugcaguacagauggcccagauggcugagacagcagaccgagagacagagaaucaucuggggcuacaagauccuguuccuggacgugcuguucccccuggccguggacaagaucaucuucguggacgccgaccagaucgugagacacgaccugaaggagcugagagacuucgaccuggacggcgcccccuacggcuacacccccuucugcgacagcagaagagagauggacggcuacagauucuggaagaccggcuacugggccagccaccugcugagaagaaaguaccacaucagcgcccuguacgugguggaccugaagaaguucagaagaaucggcgccggcgacagacugagaagccaguaccaggcccugagccaggaccccaacagccugagcaaccuggaccaggaccugcccaacaacaugaucuaccagguggccaucaagagccugccccaggacuggcuguggugcgagaccuggugcgacgacgagagcaagcagagagccaagaccaucgaccugugcaacaaccccaagaccaaggagagcaagcugaaggccgccgccagaaucgugcccgaguggguggaguacgacgccgagaucagacagcugcuggaccaccuggagaacaagaagcaggacaccauccugacccacgacgagcuguaa

SEQ ID NO: 25355 - RNA, 1527 nt, Artificial Sequence
  UGP2__Homo_sapiens__NP_006750
augagcagauucgugcaggaccugagcaaggccaugagccaggacggcgccagccaguuccaggaggugaucagacaggagcuggagcugagcgugaagaaggagcuggagaagauccugaccaccgccagcagccacgaguucgagcacaccaagaaggaccuggacggcuucagaaagcuguuccacagauuccugcaggagaagggccccagcguggacuggggcaagauccagagaccccccgaggacagcauccagcccuacgagaagaucaaggccagaggccugcccgacaacaucagcagcgugcugaacaagcuggugguggugaagcugaacggcggccugggcaccagcaugggcugcaagggccccaagagccugaucggcgugagaaacgagaacaccuuccuggaccugaccgugcagcagaucgagcaccugaacaagaccuacaacaccgacgugccccuggugcugaugaacagcuucaacaccgacgaggacaccaagaagauccugcagaaguacaaccacugcagagugaagaucuacaccuucaaccagagcagauaccccagaaucaacaaggagagccugcugcccguggccaaggacgugagcuacagcggcgagaacaccgaggccugguacccccccggccacggcgacaucuacgccagcuucuacaacagcggccugcuggacaccuucaucggcgagggcaaggaguacaucuucgugagcaacaucgacaaccugggcgccaccguggaccuguacauccugaaccaccugaugaacccccccaacggcaagagaugcgaguucgugauggaggugaccaacaagaccagagccgacgugaagggcggcacccugacccaguacgagggcaagcugagacugguggagaucgcccaggugcccaaggcccacguggacgaguucaagagcgugagcaaguucaagaucuucaacaccaacaaccuguggaucagccuggccgccgugaagagacugcaggagcagaacgccaucgacauggagaucaucgugaacgccaagacccuggacggcggccugaacgugauccagcuggagaccgccgugggcgccgccaucaagagcuucgagaacagccugggcaucaacgugcccagaagcagauuccugcccgugaagaccaccagcgaccugcugcuggugaugagcaaccuguacagccugaacgccggcagccugaccaugagcgagaagagagaguuccccaccgugccccuggugaagcugggcagcagcuucaccaaggugcaggacuaccugagaagauucgagagcauccccgacaugcuggagcuggaccaccugaccgugagcggcgacgugaccuucggcaagaacgugagccugaagggcaccgugaucaucaucgccaaccacggcgacagaaucgacaucccccccggcgccgugcuggagaacaagaucgugagcggcaaccugagaauccuggaccacuaa

SEQ ID NO: 25356 - RNA, 1593 nt, Artificial Sequence
  UGT1A10__Homo_sapiens__NP_061948
auggccagagccggcuggaccagccccgugccccugugcgugugccugcugcugaccugcggcuucgccgaggccggcaagcugcugguggugcccauggacggcagccacugguucaccaugcagagcgugguggagaagcugauccugagaggccacgagguggugguggugaugcccgaggugagcuggcagcuggagagaagccugaacugcaccgugaagaccuacagcaccagcuacacccuggaggaccagaacagagaguucaugguguucgcccacgcccaguggaaggcccaggcccagagcaucuucagccugcugaugagcagcagcagcggcuuccuggaccuguucuucagccacugcagaagccuguucaacgacagaaagcugguggaguaccugaaggagagcagcuucgacgccguguuccuggaccccuucgacaccugcggccugaucguggccaaguacuucagccugcccagcgugguguucaccagaggcaucuucugccaccaccuggaggagggcgcccagugccccgccccccugagcuacgugcccaacgaccugcugggcuucagcgacgccaugaccuucaaggagagaguguggaaccacaucgugcaccuggaggaccaccuguucugccaguaccuguucagaaacgcccuggagaucgccagcgagauccugcagacccccgugaccgccuacgaccuguacagccacaccagcaucuggcugcugagaaccgacuucgugcuggacuaccccaagcccgugaugcccaacaugaucuucaucggcggcaucaacugccaccagggcaagccccugcccauggaguucgaggccuacaucaacgccagcggcgagcacggcaucgugguguucagccugggcagcauggugagcgagauccccgagaagaaggccauggccaucgccgacgcccugggcaagaucccccagaccgugcuguggagauacaccggcaccagacccagcaaccuggccaacaacaccauccuggugaaguggcugccccagaacgaccugcugggccaccccaugaccagagccuucaucacccacgccggcagccacggcguguacgagagcaucugcaacggcgugcccauggugaugaugccccuguucggcgaccagauggacaacgccaagagaauggagaccaagggcgccggcgugacccugaacgugcuggagaugaccagcgaggaccuggagaacgcccugaaggccgugaucaacgacaagagcuacaaggagaacaucaugagacugagcagccugcacaaggacagacccguggagccccuggaccuggccguguucuggguggaguucgugaugagacacaagggcgccccccaccugagacccgccgcccacgaccugaccugguaccaguaccacagccuggacgugaucggcuuccugcuggccguggugcugaccguggccuucaucaccuucaagugcugcgccuacggcuacagaaagugccugggcaagaagggcagagugaagaaggcccacaagagcaagacccacuaa

SEQ ID NO: 25357 - RNA, 1602 nt, Artificial Sequence
  UGT1A1__Homo_sapiens__NP_000454
auggccguggagagccagggcggcagaccccuggugcugggccugcugcugugcgugcugggccccguggugagccacgccggcaagauccugcugauccccguggacggcagccacuggcugagcaugcugggcgccauccagcagcugcagcagagaggccacgagaucguggugcuggcccccgacgccagccuguacaucagagacggcgccuucuacacccugaagaccuaccccgugcccuuccagagagaggacgugaaggagagcuucgugagccugggccacaacguguucgagaacgacagcuuccugcagagagugaucaagaccuacaagaagaucaagaaggacagcgccaugcugcugagcggcugcagccaccugcugcacaacaaggagcugauggccagccuggccgagagcagcuucgacgugaugcugaccgaccccuuccugcccugcagccccaucguggcccaguaccugagccugcccaccguguucuuccugcacgcccugcccugcagccuggaguucgaggccacccagugccccaaccccuucagcuacgugcccagaccccugagcagccacagcgaccacaugaccuuccugcagagagugaagaacaugcugaucgccuucagccagaacuuccugugcgacgugguguacagccccuacgccacccuggccagcgaguuccugcagagagaggugaccgugcaggaccugcugagcagcgccagcguguggcuguucagaagcgacuucgugaaggacuaccccagacccaucaugcccaacaugguguucgugggcggcaucaacugccugcaccagaacccccugagccaggaguucgaggccuacaucaacgccagcggcgagcacggcaucgugguguucagccugggcagcauggugagcgagauccccgagaagaaggccauggccaucgccgacgcccugggcaagaucccccagaccgugcuguggagauacaccggcaccagacccagcaaccuggccaacaacaccauccuggugaaguggcugccccagaacgaccugcugggccaccccaugaccagagccuucaucacccacgccggcagccacggcguguacgagagcaucugcaacggcgugcccauggugaugaugccccuguucggcgaccagauggacaacgccaagagaauggagaccaagggcgccggcgugacccugaacgugcuggagaugaccagcgaggaccuggagaacgcccugaaggccgugaucaacgacaagagcuacaaggagaacaucaugagacugagcagccugcacaaggacagacccguggagccccuggaccuggccguguucuggguggaguucgugaugagacacaagggcgccccccaccugagacccgccgcccacgaccugaccugguaccaguaccacagccuggacgugaucggcuuccugcuggccguggugcugaccguggccuucaucaccuucaagugcugcgccuacggcuacagaaagugccugggcaagaagggcagagugaagaaggcccacaagagcaagacccacuaa

SEQ ID NO: 25358 - RNA, 1605 nt, Artificial Sequence
  UGT1A3__Homo_sapiens__NP_061966
auggccaccggccugcaggugccccugcccuggcuggccaccggccugcugcugcugcugagcgugcagcccugggccgagagcggcaaggugcugguggugcccaucgacggcagccacuggcugagcaugagagaggugcugagagagcugcacgccagaggccaccaggccguggugcugacccccgaggugaacaugcacaucaaggaggagaacuucuucacccugaccaccuacgccaucagcuggacccaggacgaguucgacagacacgugcugggccacacccagcuguacuucgagaccgagcacuuccugaagaaguucuucagaagcauggccaugcugaacaacaugagccugguguaccacagaagcugcguggagcugcugcacaacgaggcccugaucagacaccugaacgccaccagcuucgacguggugcugaccgaccccgugaaccugugcgccgccgugcuggccaaguaccugagcauccccaccguguucuuccugagaaacauccccugcgaccuggacuucaagggcacccagugccccaaccccagcagcuacauccccagacugcugaccaccaacagcgaccacaugaccuucaugcagagagugaagaacaugcuguacccccuggcccugagcuacaucugccacgccuucagcgcccccuacgccagccuggccagcgagcuguuccagagagaggugagcgugguggacauccugagccacgccagcguguggcuguucagaggcgacuucgugauggacuaccccagacccaucaugcccaacaugguguucaucggcggcaucaacugcgccaacagaaagccccugagccaggaguucgaggccuacaucaacgccagcggcgagcacggcaucgugguguucagccugggcagcauggugagcgagauccccgagaagaaggccauggccaucgccgacgcccugggcaagaucccccagaccgugcuguggagauacaccggcaccagacccagcaaccuggccaacaacaccauccuggugaaguggcugccccagaacgaccugcugggccaccccaugaccagagccuucaucacccacgccggcagccacggcguguacgagagcaucugcaacggcgugcccauggugaugaugccccuguucggcgaccagauggacaacgccaagagaauggagaccaagggcgccggcgugacccugaacgugcuggagaugaccagcgaggaccuggagaacgcccugaaggccgugaucaacgacaagagcuacaaggagaacaucaugagacugagcagccugcacaaggacagacccguggagccccuggaccuggccguguucuggguggaguucgugaugagacacaagggcgccccccaccugagacccgccgcccacgaccugaccugguaccaguaccacagccuggacgugaucggcuuccugcuggccguggugcugaccguggccuucaucaccuucaagugcugcgccuacggcuacagaaagugccugggcaagaagggcagagugaagaaggcccacaagagcaagacccacuaa

SEQ ID NO: 25359 - RNA, 1605 nt, Artificial Sequence
  UGT1A4__Homo_sapiens__NP_009051
auggccagaggccugcaggugccccugcccagacuggccaccggccugcugcugcugcugagcgugcagcccugggccgagagcggcaaggugcugguggugcccaccgacggcagccccuggcugagcaugagagaggcccugagagagcugcacgccagaggccaccaggccguggugcugacccccgaggugaacaugcacaucaaggaggagaaguucuucacccugaccgccuacgccgugcccuggacccagaaggaguucgacagagugacccugggcuacacccagggcuucuucgagaccgagcaccugcugaagagauacagcagaagcauggccaucaugaacaacgugagccuggcccugcacagaugcugcguggagcugcugcacaacgaggcccugaucagacaccugaacgccaccagcuucgacguggugcugaccgaccccgugaaccugugcggcgccgugcuggccaaguaccugagcauccccgccguguucuucuggagauacauccccugcgaccuggacuucaagggcacccagugccccaaccccagcagcuacauccccaagcugcugaccaccaacagcgaccacaugaccuuccugcagagagugaagaacaugcuguacccccuggcccugagcuacaucugccacaccuucagcgcccccuacgccagccuggccagcgagcuguuccagagagaggugagcgugguggaccuggugagcuacgccagcguguggcuguucagaggcgacuucgugauggacuaccccagacccaucaugcccaacaugguguucaucggcggcaucaacugcgccaacggcaagccccugagccaggaguucgaggccuacaucaacgccagcggcgagcacggcaucgugguguucagccugggcagcauggugagcgagauccccgagaagaaggccauggccaucgccgacgcccugggcaagaucccccagaccgugcuguggagauacaccggcaccagacccagcaaccuggccaacaacaccauccuggugaaguggcugccccagaacgaccugcugggccaccccaugaccagagccuucaucacccacgccggcagccacggcguguacgagagcaucugcaacggcgugcccauggugaugaugccccuguucggcgaccagauggacaacgccaagagaauggagaccaagggcgccggcgugacccugaacgugcuggagaugaccagcgaggaccuggagaacgcccugaaggccgugaucaacgacaagagcuacaaggagaacaucaugagacugagcagccugcacaaggacagacccguggagccccuggaccuggccguguucuggguggaguucgugaugagacacaagggcgccccccaccugagacccgccgcccacgaccugaccugguaccaguaccacagccuggacgugaucggcuuccugcuggccguggugcugaccguggccuucaucaccuucaagugcugcgccuacggcuacagaaagugccugggcaagaagggcagagugaagaaggcccacaagagcaagacccacuaa

SEQ ID NO: 25360 - RNA, 1605 nt, Artificial Sequence
  UGT1A5__Homo_sapiens__NP_061951
auggccaccggccugcaggugccccugccccagcuggccaccggccugcugcugcugcugagcgugcagcccugggccgagagcggcaaggugcugguggugcccaccgacggcagccacuggcugagcaugagagaggcccugagagaccugcacgccagaggccaccaggugguggugcugacccuggaggugaacauguacaucaaggaggagaacuucuucacccugaccaccuacgccaucagcuggacccaggacgaguucgacagacugcugcugggccacacccagagcuucuucgagaccgagcaccugcugaugaaguucagcagaagaauggccaucaugaacaacaugagccugaucauccacagaagcugcguggagcugcugcacaacgaggcccugaucagacaccugcacgccaccagcuucgacguggugcugaccgaccccuuccaccugugcgccgccgugcuggccaaguaccugagcauccccgccguguucuuccugagaaacauccccugcgaccuggacuucaagggcacccagugccccaaccccagcagcuacauccccagacugcugaccaccaacagcgaccacaugaccuuccugcagagagugaagaacaugcuguacccccuggcccugagcuaccugugccacgccgugagcgcccccuacgccagccuggccagcgagcuguuccagagagaggugagcgugguggaccuggugagccacgccagcguguggcuguucagaggcgacuucgugauggacuaccccagacccaucaugcccaacaugguguucaucggcggcaucaacugcgccaacggcaagccccugagccaggaguucgaggccuacaucaacgccagcggcgagcacggcaucgugguguucagccugggcagcauggugagcgagauccccgagaagaaggccauggccaucgccgacgcccugggcaagaucccccagaccgugcuguggagauacaccggcaccagacccagcaaccuggccaacaacaccauccuggugaaguggcugccccagaacgaccugcugggccaccccaugaccagagccuucaucacccacgccggcagccacggcguguacgagagcaucugcaacggcgugcccauggugaugaugccccuguucggcgaccagauggacaacgccaagagaauggagaccaagggcgccggcgugacccugaacgugcuggagaugaccagcgaggaccuggagaacgcccugaaggccgugaucaacgacaagagcuacaaggagaacaucaugagacugagcagccugcacaaggacagacccguggagccccuggaccuggccguguucuggguggaguucgugaugagacacaagggcgccccccaccugagacccgccgcccacgaccugaccugguaccaguaccacagccuggacgugaucggcuuccugcuggccguggugcugaccguggccuucaucaccuucaagugcugcgccuacggcuacagaaagugccugggcaagaagggcagagugaagaaggcccacaagagcaagacccacuaa

SEQ ID NO: 25361 - RNA, 1599 nt, Artificial Sequence
  UGT1A6__Homo_sapiens__NP_001063
auggccugccugcugagaagcuuccagagaaucagcgccggcguguucuuccuggcccuguggggcaugguggugggcgacaagcugcugguggugccccaggacggcagccacuggcugagcaugaaggacaucguggaggugcugagcgacagaggccacgagaucguggugguggugcccgaggugaaccugcugcugaaggagagcaaguacuacaccagaaagaucuaccccgugcccuacgaccaggaggagcugaagaacagauaccagagcuucggcaacaaccacuucgccgagagaagcuuccugaccgccccccagaccgaguacagaaacaacaugaucgugaucggccuguacuucaucaacugccagagccugcugcaggacagagacacccugaacuucuucaaggagagcaaguucgacgcccuguucaccgaccccgcccugcccugcggcgugauccuggccgaguaccugggccugcccagcguguaccuguucagaggcuuccccugcagccuggagcacaccuucagcagaagccccgaccccgugagcuacauccccagaugcuacaccaaguucagcgaccacaugaccuucagccagagaguggccaacuuccuggugaaccugcuggagcccuaccuguucuacugccuguucagcaaguacgaggagcuggccagcgccgugcugaagagagacguggacaucaucacccuguaccagaaggugagcguguggcugcugagauacgacuucgugcuggaguaccccagacccgugaugcccaacaugguguucaucggcggcaucaacugcaagaagagaaaggaccugagccaggaguucgaggccuacaucaacgccagcggcgagcacggcaucgugguguucagccugggcagcauggugagcgagauccccgagaagaaggccauggccaucgccgacgcccugggcaagaucccccagaccgugcuguggagauacaccggcaccagacccagcaaccuggccaacaacaccauccuggugaaguggcugccccagaacgaccugcugggccaccccaugaccagagccuucaucacccacgccggcagccacggcguguacgagagcaucugcaacggcgugcccauggugaugaugccccuguucggcgaccagauggacaacgccaagagaauggagaccaagggcgccggcgugacccugaacgugcuggagaugaccagcgaggaccuggagaacgcccugaaggccgugaucaacgacaagagcuacaaggagaacaucaugagacugagcagccugcacaaggacagacccguggagccccuggaccuggccguguucuggguggaguucgugaugagacacaagggcgccccccaccugagacccgccgcccacgaccugaccugguaccaguaccacagccuggacgugaucggcuuccugcuggccguggugcugaccguggccuucaucaccuucaagugcugcgccuacggcuacagaaagugccugggcaagaagggcagagugaagaaggcccacaagagcaagacccacuaa

SEQ ID NO: 25362 - RNA, 1593 nt, Artificial Sequence
  UGT1A7__Homo_sapiens__NP_061950
auggccagagccggcuggaccggccugcugccccuguacgugugccugcugcugaccugcggcuucgccaaggccggcaagcugcugguggugcccauggacggcagccacugguucaccaugcagagcgugguggagaagcugauccugagaggccacgagguggugguggugaugcccgaggugagcuggcagcugggcagaagccugaacugcaccgugaagaccuacagcaccagcuacacccuggaggaccaggacagagaguucaugguguucgccgacgccagauggaccgccccccugagaagcgccuucagccugcugaccagcagcagcaacggcaucuucgaccuguucuucagcaacugcagaagccuguucaacgacagaaagcugguggaguaccugaaggagagcugcuucgacgccguguuccuggaccccuucgacgccugcggccugaucguggccaaguacuucagccugcccagcgugguguucgccagaggcaucuucugccacuaccuggaggagggcgcccagugccccgccccccugagcuacgugcccagacugcugcugggcuucagcgacgccaugaccuucaaggagagaguguggaaccacaucaugcaccuggaggagcaccuguucugccccuacuucuucaagaacgugcuggagaucgccagcgagauccugcagacccccgugaccgccuacgaccuguacagccacaccagcaucuggcugcugagaaccgacuucgugcuggaguaccccaagcccgugaugcccaacaugaucuucaucggcggcaucaacugccaccagggcaagcccgugcccauggaguucgaggccuacaucaacgccagcggcgagcacggcaucgugguguucagccugggcagcauggugagcgagauccccgagaagaaggccauggccaucgccgacgcccugggcaagaucccccagaccgugcuguggagauacaccggcaccagacccagcaaccuggccaacaacaccauccuggugaaguggcugccccagaacgaccugcugggccaccccaugaccagagccuucaucacccacgccggcagccacggcguguacgagagcaucugcaacggcgugcccauggugaugaugccccuguucggcgaccagauggacaacgccaagagaauggagaccaagggcgccggcgugacccugaacgugcuggagaugaccagcgaggaccuggagaacgcccugaaggccgugaucaacgacaagagcuacaaggagaacaucaugagacugagcagccugcacaaggacagacccguggagccccuggaccuggccguguucuggguggaguucgugaugagacacaagggcgccccccaccugagacccgccgcccacgaccugaccugguaccaguaccacagccuggacgugaucggcuuccugcuggccguggugcugaccguggccuucaucaccuucaagugcugcgccuacggcuacagaaagugccugggcaagaagggcagagugaagaaggcccacaagagcaagacccacuaa

SEQ ID NO: 25363 - RNA, 1593 nt, Artificial Sequence
  UGT1A8__Homo_sapiens__NP_061949
auggccagaaccggcuggaccagccccaucccccugugcgugagccugcugcugaccugcggcuucgccgaggccggcaagcugcugguggugcccauggacggcagccacugguucaccaugcagagcgugguggagaagcugauccugagaggccacgagguggugguggugaugcccgaggugagcuggcagcugggcaagagccugaacugcaccgugaagaccuacagcaccagcuacacccuggaggaccuggacagagaguucauggacuucgccgacgcccaguggaaggcccaggugagaagccuguucagccuguuccugagcagcagcaacggcuucuucaaccuguucuucagccacugcagaagccuguucaacgacagaaagcugguggaguaccugaaggagagcagcuucgacgccguguuccuggaccccuucgacgccugcggccugaucguggccaaguacuucagccugcccagcgugguguucgccagaggcaucgccugccacuaccuggaggagggcgcccagugccccgccccccugagcuacgugcccagaauccugcugggcuucagcgacgccaugaccuucaaggagagagugagaaaccacaucaugcaccuggaggagcaccuguucugccaguacuucagcaagaacgcccuggagaucgccagcgagauccugcagacccccgugaccgccuacgaccuguacagccacaccagcaucuggcugcugagaaccgacuucgugcuggacuaccccaagcccgugaugcccaacaugaucuucaucggcggcaucaacugccaccagggcaagccccugcccauggaguucgaggccuacaucaacgccagcggcgagcacggcaucgugguguucagccugggcagcauggugagcgagauccccgagaagaaggccauggccaucgccgacgcccugggcaagaucccccagaccgugcuguggagauacaccggcaccagacccagcaaccuggccaacaacaccauccuggugaaguggcugccccagaacgaccugcugggccaccccaugaccagagccuucaucacccacgccggcagccacggcguguacgagagcaucugcaacggcgugcccauggugaugaugccccuguucggcgaccagauggacaacgccaagagaauggagaccaagggcgccggcgugacccugaacgugcuggagaugaccagcgaggaccuggagaacgcccugaaggccgugaucaacgacaagagcuacaaggagaacaucaugagacugagcagccugcacaaggacagacccguggagccccuggaccuggccguguucuggguggaguucgugaugagacacaagggcgccccccaccugagacccgccgcccacgaccugaccugguaccaguaccacagccuggacgugaucggcuuccugcuggccguggugcugaccguggccuucaucaccuucaagugcugcgccuacggcuacagaaagugccugggcaagaagggcagagugaagaaggcccacaagagcaagacccacuaa

SEQ ID NO: 25364 - RNA, 1593 nt, Artificial Sequence
  UGT1A9__Homo_sapiens__NP_066307
auggccugcaccggcuggaccagcccccugccccugugcgugugccugcugcugaccugcggcuucgccgaggccggcaagcugcugguggugcccauggacggcagccacugguucaccaugagaagcgugguggagaagcugauccugagaggccacgagguggugguggugaugcccgaggugagcuggcagcugggcagaagccugaacugcaccgugaagaccuacagcaccagcuacacccuggaggaccuggacagagaguucaaggccuucgcccacgcccaguggaaggcccaggugagaagcaucuacagccugcugaugggcagcuacaacgacaucuucgaccuguucuucagcaacugcagaagccuguucaaggacaagaagcugguggaguaccugaaggagagcagcuucgacgccguguuccuggaccccuucgacaacugcggccugaucguggccaaguacuucagccugcccagcgugguguucgccagaggcauccugugccacuaccuggaggagggcgcccagugccccgccccccugagcuacgugcccagaauccugcugggcuucagcgacgccaugaccuucaaggagagagugagaaaccacaucaugcaccuggaggagcaccugcugugccacagauucuucaagaacgcccuggagaucgccagcgagauccugcagacccccgugaccgaguacgaccuguacagccacaccagcaucuggcugcugagaaccgacuucgugcuggacuaccccaagcccgugaugcccaacaugaucuucaucggcggcaucaacugccaccagggcaagccccugcccauggaguucgaggccuacaucaacgccagcggcgagcacggcaucgugguguucagccugggcagcauggugagcgagauccccgagaagaaggccauggccaucgccgacgcccugggcaagaucccccagaccgugcuguggagauacaccggcaccagacccagcaaccuggccaacaacaccauccuggugaaguggcugccccagaacgaccugcugggccaccccaugaccagagccuucaucacccacgccggcagccacggcguguacgagagcaucugcaacggcgugcccauggugaugaugccccuguucggcgaccagauggacaacgccaagagaauggagaccaagggcgccggcgugacccugaacgugcuggagaugaccagcgaggaccuggagaacgcccugaaggccgugaucaacgacaagagcuacaaggagaacaucaugagacugagcagccugcacaaggacagacccguggagccccuggaccuggccguguucuggguggaguucgugaugagacacaagggcgccccccaccugagacccgccgcccacgaccugaccugguaccaguaccacagccuggacgugaucggcuuccugcuggccguggugcugaccguggccuucaucaccuucaagugcugcgccuacggcuacagaaagugccugggcaagaagggcagagugaagaaggcccacaagagcaagacccacuaa

SEQ ID NO: 25365 - RNA, 2082 nt, Artificial Sequence
  UGT2A1__Homo_sapiens__NP_001239203
augcugaacaaccugcugcuguucagccugcagaucagccugaucggcaccacccugggcggcaacgugcugaucuggcccauggagggcagccacuggcugaacgugaagaucaucaucgacgagcugaucaagaaggagcacaacgugaccgugcugguggccagcggcgcccuguucaucacccccaccagcaaccccagccugaccuucgagaucuacaaggugcccuucggcaaggagagaaucgagggcgugaucaaggacuucgugcugaccuggcuggagaacagacccagccccagcaccaucuggagauucuaccaggagauggccaaggugaucaaggacuuccacauggugagccaggagaucugcgacggcgugcugaagaaccagcagcugauggccaagcugaagaagagcaaguucgaggugcuggugagcgaccccguguuccccugcggcgacaucguggcccugaagcugggcauccccuucauguacagccugagauucagccccgccagcaccguggagaagcacugcggcaaggugcccuacccccccagcuacgugcccgccgugcugagcgagcugaccgaccagaugagcuucaccgacagaaucagaaacuucaucagcuaccaccugcaggacuacauguucgagacccuguggaagagcugggacagcuacuacagcaaggcccuggacggcagccacuggcugaacaucaagaucauccuggaggagcugauccagagaaaccacaacgugaccgugcuggccagcagcgccacccuguucaucaacagcaaccccgacagccccgugaacuucgaggugauccccgugagcuacaagaagagcaacaucgacagccugaucgagcacaugaucaugcuguggaucgaccacagacccaccccccugaccaucugggccuucuacaaggagcugggcaagcugcuggacaccuucuuccagaucaacauccagcugugcgacggcgugcugaagaaccccaagcugauggccagacugcagaagggcggcuucgacgugcugguggccgaccccgugaccaucugcggcgaccugguggcccugaagcugggcauccccuucauguacacccugagauucagccccgccagcaccguggagagacacugcggcaagauccccgcccccgugagcuacgugcccgccgcccugagcgagcugaccgaccagaugaccuucggcgagagaaucaagaacaccaucagcuacagccugcaggacuacaucuuccagagcuacuggggcgaguggaacagcuacuacagcaagauccugggcagacccaccacccugugcgagaccaugggcaaggccgagaucuggcugaucagaaccuacugggacuucgaguuccccagacccuaccugcccaacuucgaguucgugggcggccugcacugcaagcccgccaagccccugcccaaggugcuguggagauacaagggcaagaagcccgccacccugggcaacaacacccagcuguucgacuggaucccccagaacgaccugcugggccaccccaagaccaaggccuucaucacccacggcggcaccaacggcaucuacgaggccaucuaccacggcgugcccauggugggcgugcccauguucgccgaccagcccgacaacaucgcccacaugaaggccaagggcgccgccguggaggugaaccugaacaccaugaccagcguggaccugcugagcgcccugagaaccgugaucaacgagcccagcuacaaggagaacgccaugagacugagcagaauccaccacgaccagcccgugaagccccuggacagagccguguucuggaucgaguucgugaugagacacaagggcgccaagcaccugagaguggccgcccacgaccugaccugguuccaguaccacagccuggacgugaucggcuuccugcuggugugcgugaccaccgccaucuuccuggugauccagugcugccuguucagcugccagaaguucggcaagaucggcaagaagaagaagagagaguaa

SEQ ID NO: 25366 - RNA, 1611 nt, Artificial Sequence
  UGT2A2__Homo_sapiens__NP_001099147
auggugagcaucagagacuucaccaugcccaagaaguucgugcagaugcugguguucaaccugacccugaccgagguggugcugagcggcaacgugcugaucuggcccaccgacggcagccacuggcugaacaucaagaucauccuggaggagcugauccagagaaaccacaacgugaccgugcuggccagcagcgccacccuguucaucaacagcaaccccgacagccccgugaacuucgaggugauccccgugagcuacaagaagagcaacaucgacagccugaucgagcacaugaucaugcuguggaucgaccacagacccaccccccugaccaucugggccuucuacaaggagcugggcaagcugcuggacaccuucuuccagaucaacauccagcugugcgacggcgugcugaagaaccccaagcugauggccagacugcagaagggcggcuucgacgugcugguggccgaccccgugaccaucugcggcgaccugguggcccugaagcugggcauccccuucauguacacccugagauucagccccgccagcaccguggagagacacugcggcaagauccccgcccccgugagcuacgugcccgccgcccugagcgagcugaccgaccagaugaccuucggcgagagaaucaagaacaccaucagcuacagccugcaggacuacaucuuccagagcuacuggggcgaguggaacagcuacuacagcaagauccugggcagacccaccacccugugcgagaccaugggcaaggccgagaucuggcugaucagaaccuacugggacuucgaguuccccagacccuaccugcccaacuucgaguucgugggcggccugcacugcaagcccgccaagccccugcccaaggagauggaggaguucauccagagcagcggcaagaacggcguggugguguucagccugggcagcauggugaagaaccugaccgaggagaaggccaaccugaucgccagcgcccuggcccagaucccccagaaggugcuguggagauacaagggcaagaagcccgccacccugggcaacaacacccagcuguucgacuggaucccccagaacgaccugcugggccaccccaagaccaaggccuucaucacccacggcggcaccaacggcaucuacgaggccaucuaccacggcgugcccauggugggcgugcccauguucgccgaccagcccgacaacaucgcccacaugaaggccaagggcgccgccguggaggugaaccugaacaccaugaccagcguggaccugcugagcgcccugagaaccgugaucaacgagcccagcuacaaggagaacgccaugagacugagcagaauccaccacgaccagcccgugaagccccuggacagagccguguucuggaucgaguucgugaugagacacaagggcgccaagcaccugagaguggccgcccacgaccugaccugguuccaguaccacagccuggacgugaucggcuuccugcuggugugcgugaccaccgccaucuuccuggugauccagugcugccuguucagcugccagaaguucggcaagaucggcaagaagaagaagagagaguaa

SEQ ID NO: 25367 - RNA, 1584 nt, Artificial Sequence
  UGT2A3__Homo_sapiens__NP_079019
augagaagcgacaagagcgcccugguguuccugcugcugcagcuguucugcgugggcugcggcuucugcggcaaggugcugguguggcccugcgacaugagccacuggcugaacgugaaggugauccuggaggagcugaucgugagaggccacgaggugaccgugcugacccacagcaagcccagccugaucgacuacagaaagcccagcgcccugaaguucgagguggugcacaugccccaggacagaaccgaggagaacgagaucuucguggaccuggcccugaacgugcugcccggccugagcaccuggcagagcgugaucaagcugaacgacuucuucguggagaucagaggcacccugaagaugaugugcgagagcuucaucuacaaccagacccugaugaagaagcugcaggagaccaacuacgacgugaugcugaucgaccccgugauccccugcggcgaccugauggccgagcugcuggccgugcccuucgugcugacccugagaaucagcgugggcggcaacauggagagaagcugcggcaagcugcccgccccccugagcuacgugcccgugcccaugaccggccugaccgacagaaugaccuuccuggagagagugaagaacagcaugcugagcgugcuguuccacuucuggauccaggacuacgacuaccacuucugggaggaguucuacagcaaggcccugggcagacccaccacccugugcgagaccgugggcaaggccgagaucuggcugaucagaaccuacugggacuucgaguucccccagcccuaccagcccaacuucgaguucgugggcggccugcacugcaagcccgccaaggcccugcccaaggagauggagaacuucgugcagagcagcggcgaggacggcaucgugguguucagccugggcagccuguuccagaacgugaccgaggagaaggccaacaucaucgccagcgcccuggcccagaucccccagaaggugcuguggagauacaagggcaagaagcccagcacccugggcgccaacaccagacuguacgacuggaucccccagaacgaccugcugggccaccccaagaccaaggccuucaucacccacggcggcaugaacggcaucuacgaggccaucuaccacggcgugcccauggugggcgugcccaucuucggcgaccagcuggacaacaucgcccacaugaaggccaagggcgccgccguggagaucaacuucaagaccaugaccagcgaggaccugcugagagcccugagaaccgugaucaccgacagcagcuacaaggagaacgccaugagacugagcagaauccaccacgaccagcccgugaagccccuggacagagccguguucuggaucgaguucgugaugagacacaagggcgccaagcaccugagaagcgccgcccacgaccugaccugguuccagcacuacagcaucgacgugaucggcuuccugcuggccugcguggccaccgccaucuuccuguucaccaagugcuuccuguucagcugccagaaguucaacaagaccagaaagaucgagaagagagaguaa

SEQ ID NO: 25368 - RNA, 1587 nt, Artificial Sequence
  UGT2B10__Homo_sapiens__NP_001066
auggcccugaaguggaccaccgugcugcugauccagcugagcuucuacuucagcagcggcagcugcggcaaggugcuggugugggccgccgaguacagccuguggaugaacaugaagaccauccugaaggagcuggugcagagaggccacgaggugaccgugcuggccagcagcgccagcauccuguucgaccccaacgacagcagcacccugaagcuggagguguaccccaccagccugaccaagaccgaguucgagaacaucaucaugcagcuggugaagagacugagcgagauccagaaggacaccuucuggcugcccuucagccaggagcaggagauccugugggccaucaacgacaucaucagaaacuucugcaaggacguggugagcaacaagaagcugaugaagaagcugcaggagagcagauucgacaucguguucgccgacgccuaccugcccugcggcgagcugcuggccgagcuguucaacauccccuucguguacagccacagcuucagccccggcuacagcuucgagagacacagcggcggcuucaucuucccccccagcuacgugcccguggugaugagcaagcugagcgaccagaugaccuucauggagagagugaagaacaugcuguacgugcuguacuucgacuucugguuccagaucuucaacaugaagaagugggaccaguucuacagcgaggugcugggcagacccaccacccugagcgagaccaugagaaaggccgacaucuggcugaugagaaacagcuggaacuucaaguucccccaccccuuccugcccaacguggacuucgugggcggccugcacugcaagcccgccaagccccugcccaaggagauggaggaguucgugcagagcagcggcgagaacggcguggugguguucagccugggcagcauggugagcaacaugaccgaggagagagccaacgugaucgccaccgcccuggccaagaucccccagaaggugcuguggagauucgacggcaacaagcccgacgcccugggccugaacaccagacuguacaaguggaucccccagaacgaccugcugggccaccccaagaccagagccuucaucacccacggcggcgccaacggcaucuacgaggccaucuaccacggcauccccauggugggcaucccccuguucuucgaccagcccgacaacaucgcccacaugaaggccaagggcgccgccgugagaguggacuucaacaccaugagcagcaccgaccugcugaacgcccugaagaccgugaucaacgaccccagcuacaaggagaacaucaugaagcugagcagaauccagcacgaccagcccgugaagccccuggacagagccguguucuggaucgaguucgugaugagacacaagggcgccaagcaccugagaguggccgcccacaaccugaccugguuccaguaccacagccuggacgugaucggcuuccugcuggccugcguggccaccgugcuguucaucaucaccaagugcugccuguucugcuucuggaaguucgccagaaagggcaagaagggcaagagagacuaa

SEQ ID NO: 25369 - RNA, 1590 nt, Artificial Sequence
  UGT2B11__Homo_sapiens__NP_001064
augacccugaaguggaccagcgugcugcugcugauccaccugagcugcuacuucagcagcggcagcugcggcaaggugcuggugugggccgccgaguacagccacuggaugaacaugaagaccauccugaaggagcuggugcagagaggccacgaggugaccgugcuggccagcagcgccagcauccuguucgaccccaacgacgccagcacccugaaguucgagguguaccccaccagccugaccaagaccgaguucgagaacaucaucaugcagcaggugaagagauggagcgacaucagaaaggacagcuucuggcuguacuucagccaggagcaggagauccugugggagcuguacgacaucuucagaaacuucugcaaggacguggugagcaacaagaaggugaugaagaagcugcaggagagcagauucgacaucguguucgccgacgccguguuccccugcggcgagcugcuggccgcccugcugaacaucagauucguguacagccugagauucacccccggcuacaccaucgagagacacagcggcggccugaucuucccccccagcuacauccccaucgugaugagcaagcugagcgaccagaugaccuucauggagagagugaagaacaugaucuacgugcuguacuucgacuucugguuccagaugagcgacaugaagaagugggaccaguucuacagcgaggugcugggcagacccaccacccuguucgagaccaugggcaaggccgacaucuggcugaugagaaacagcuggagcuuccaguucccccaccccuuccugcccaacguggacuucgugggcggcuuccacugcaagcccgccaagccccugcccaaggagauggaggaguucgugcagagcagcggcgagaacggcguggugguguucagccugggcagcgugaucagcaacaugaccgccgagagagccaacgugaucgccaccgcccuggccaagaucccccagaaggugcuguggagauucgacggcaacaagcccgacgcccugggccugaacaccagacuguacaaguggaucccccagaacgaccugcugggccaccccaagaccagagccuucaucacccacggcggcgccaacggcaucuacgaggccaucuaccacggcauccccauggugggcaucccccuguucuucgaccagcccgacaacaucgcccacaugaaggccaagggcgccgccgugagacuggacuucaacaccaugagcagcaccgaccugcugaacgcccugaagaccgugaucaacgacccccuguacaaggagaacaucaugaagcugagcagaauccagcacgaccagcccgugaagccccuggacagagccguguucuggaucgaguucgugaugccccacaagggcgccaagcaccugagaguggccgcccacgaccugaccugguuccaguaccacagccuggacgugaucggcuuccugcuggccugcguggccaccgugaucuucaucaucaccaaguucugccuguucugcuucuggaaguucgccagaaagggcaagaagggcaagagagacuaa

SEQ ID NO: 25370 - RNA, 1593 nt, Artificial Sequence
  UGT2B15__Homo_sapiens__NP_001067
augagccugaaguggaccagcguguuccugcugauccagcugagcugcuacuucagcagcggcagcugcggcaaggugcugguguggcccaccgaguacagccacuggaucaacaugaagaccauccuggaggagcuggugcagagaggccacgaggugaccgugcugaccagcagcgccagcacccuggugaacgccagcaagagcagcgccaucaagcuggagguguaccccaccagccugaccaagaacuaccuggaggacagccugcugaagauccuggacagauggaucuacggcgugagcaagaacaccuucuggagcuacuucagccagcugcaggagcugugcugggaguacuacgacuacagcaacaagcugugcaaggacgccgugcugaacaagaagcugaugaugaagcugcaggagagcaaguucgacgugauccuggccgacgcccugaaccccugcggcgagcugcuggccgagcuguucaacauccccuuccuguacagccugagauucagcgugggcuacaccuucgagaagaacggcggcggcuuccuguucccccccagcuacgugcccguggugaugagcgagcugagcgaccagaugaucuucauggagagaaucaagaacaugauccacaugcuguacuucgacuucugguuccagaucuacgaccugaagaagugggaccaguucuacagcgaggugcugggcagacccaccacccuguucgagaccaugggcaaggccgagauguggcugaucagaaccuacugggacuucgaguuccccagacccuuccugcccaacguggacuucgugggcggccugcacugcaagcccgccaagccccugcccaaggagauggaggaguucgugcagagcagcggcgagaacggcaucgugguguucagccugggcagcaugaucagcaacaugagcgaggagagcgccaacaugaucgccagcgcccuggcccagaucccccagaaggugcuguggagauucgacggcaagaagcccaacacccugggcagcaacaccagacuguacaaguggcugccccagaacgaccugcugggccaccccaagaccaaggccuucaucacccacggcggcaccaacggcaucuacgaggccaucuaccacggcauccccauggugggcaucccccuguucgccgaccagcacgacaacaucgcccacaugaaggccaagggcgccgcccugagcguggacaucagaaccaugagcagcagagaccugcugaacgcccugaagagcgugaucaacgaccccguguacaaggagaacgugaugaagcugagcagaauccaccacgaccagcccaugaagccccuggacagagccguguucuggaucgaguucgugaugagacacaagggcgccaagcaccugagaguggccgcccacaaccugaccuggauccaguaccacagccuggacgugaucgccuuccugcuggccugcguggccaccgugaucuucaucaucaccaaguucugccuguucugcuucagaaagcuggccaagaagggcaagaagaagaagagagacuaa

SEQ ID NO: 25371 - RNA, 1008 nt, Artificial Sequence
  UGT2B28__Homo_sapiens__NP_001193933
auggcccugaaguggaccagcgugcugcugcugauccaccugggcugcuacuucagcagcggcagcugcggcaaggugcugguguggaccggcgaguacagccacuggaugaacaugaagaccauccugaaggagcuggugcagagaggccacgaggugaccgugcuggccagcagcgccagcauccuguucgaccccaacgacgccuucacccugaagcuggagguguaccccaccagccugaccaagaccgaguucgagaacaucaucaugcagcaggugaagagauggagcgacauccagaaggacagcuucuggcuguacuucagccaggagcaggagauccugugggaguuccacgacaucuucagaaacuucugcaaggacguggugagcaacaagaaggugaugaagaagcugcaggagagcagauucgacaucaucuucgccgacgccuucuuccccugcggcgagcugcuggccgcccugcugaacauccccuucguguacagccugugcuucacccccggcuacaccaucgagagacacagcggcggccugaucuucccccccagcuacauccccguggugaugagcaagcugagcgaccagaugaccuucauggagagagugaagaacaugaucuacgugcuguacuucgacuucugguuccagaugugcgacaugaagaagugggaccaguucuacagcgaggugcugggcagacccaccacccuguucgagaccaugggcaaggccgacaucuggcugaugagaaacagcuggagcuuccaguucccccaccccuuccugcccaacaucgacuucgugggcggccugcacugcaagcccgccaagccccugcccaaggagauggaggaguucgugcagagcagcggcgagaacggcguggugguguucagccugggcagcgugaucagcaacaugaccgccgagagagccaacgugaucgccaccgcccuggccaagaucccccagaagaucuaa

SEQ ID NO: 25372 - RNA, 1110 nt, Artificial Sequence
  UGT2B4__Homo_sapiens__NP_001284544
augagcaugaaguggaccagcgcccugcugcugauccagcugagcugcuacuucagcagcggcagcugcggcaaggugcugguguggcccaccgaguucagccacuggaugaacaucaagaccauccuggacgagcuggugcagagaggccacgaggugaccgugcuggccagcagcgccagcaucagcuucgaccccaacagccccagcacccugaaguucgagguguaccccgugagccugaccaagaccgaguucgaggacaucaucaagcagcuggugaagagaugggccgagcugcccaaggacaccuucuggagcuacuucagccaggugcaggagaucauguggaccuucaacgacauccugagaaaguucugcaaggacaucgugagcaacaagaagcugaugaagaagcugcaggagagcagauucgacguggugcuggccgacgccguguuccccuucggcgagcugcuggccgagcugcugaagauccccuucguguacagccugagauucagccccggcuacgccaucgagaagcacagcggcggccugcuguucccccccagcuacgugcccguggugaugagcgagcugagcgaccagaugaccuucaucgagagagugaagaacaugaucuacgugcuguacuucgaguucugguuccagaucuucgacaugaagaagugggaccaguucuacagcgaggugcugggcagacccaccacccugagcgagaccauggccaaggccgacaucuggcugaucagaaacuacugggacuuccaguucccccacccccugcugcccaacguggaguucgugggcggccugcacugcaagcccgccaagccccugcccaaggagauggaggaguucgugcagagcagcggcgagaacggcguggugguguucagccugggcagcauggugagcaacaccagcgaggagagagccaacgugaucgccagcgcccuggccaagaucccccagaaggugcuguggagauucgacggcaacaagcccgacacccugggccugaacaccagacuguacaaguggaucccccagaacgaccugcuggacaucaagagaaugcuguaa

SEQ ID NO: 25373 - RNA, 1590 nt, Artificial Sequence
  UGT2B7__Homo_sapiens__NP_001065
augagcgugaaguggaccagcgugauccugcugauccagcugagcuucugcuucagcagcggcaacugcggcaaggugcuggugugggccgccgaguacagccacuggaugaacaucaagaccauccuggacgagcugauccagagaggccacgaggugaccgugcuggccagcagcgccagcauccuguucgaccccaacaacagcagcgcccugaagaucgagaucuaccccaccagccugaccaagaccgagcuggagaacuucaucaugcagcagaucaagagauggagcgaccugcccaaggacaccuucuggcuguacuucagccaggugcaggagaucaugagcaucuucggcgacaucaccagaaaguucugcaaggacguggugagcaacaagaaguucaugaagaaggugcaggagagcagauucgacgugaucuucgccgacgccaucuuccccugcagcgagcugcuggccgagcuguucaacauccccuucguguacagccugagcuucagccccggcuacaccuucgagaagcacagcggcggcuucaucuucccccccagcuacgugcccguggugaugagcgagcugaccgaccagaugaccuucauggagagagugaagaacaugaucuacgugcuguacuucgacuucugguucgagaucuucgacaugaagaagugggaccaguucuacagcgaggugcugggcagacccaccacccugagcgagaccaugggcaaggccgacguguggcugaucagaaacagcuggaacuuccaguuccccuacccccugcugcccaacguggacuucgugggcggccugcacugcaagcccgccaagccccugcccaaggagauggaggacuucgugcagagcagcggcgagaacggcguggugguguucagccugggcagcauggugagcaacaugaccgaggagagagccaacgugaucgccagcgcccuggcccagaucccccagaaggugcuguggagauucgacggcaacaagcccgacacccugggccugaacaccagacuguacaaguggaucccccagaacgaccugcugggccaccccaagaccagagccuucaucacccacggcggcgccaacggcaucuacgaggccaucuaccacggcauccccauggugggcaucccccuguucgccgaccagcccgacaacaucgcccacaugaaggccagaggcgccgccgugagaguggacuucaacaccaugagcagcaccgaccugcugaacgcccugaagagagugaucaacgaccccagcuacaaggagaacgugaugaagcugagcagaauccagcacgaccagcccgugaagccccuggacagagccguguucuggaucgaguucgugaugagacacaagggcgccaagcaccugagaguggccgcccacgaccugaccugguuccaguaccacagccuggacgugaucggcuuccugcuggugugcguggccaccgugaucuucaucgugaccaagugcugccuguucugcuucuggaaguucgccagaaaggccaagaagggcaagaacgacuaa

SEQ ID NO: 25374 - RNA, 1470 nt, Artificial Sequence
  UGT3A2__Homo_sapiens__NP_001161788
auggccggccagagagugcugcugcuggugggcuuccugcugcccggcgugcugcugagcgaggccgccaagauccugaccaucagcaccguggacuucaagaaggaggagaagagcuaccaggugaucagcuggcuggcccccgaggaccaccagagagaguucaagaagagcuucgacuucuuccuggaggagacccugggcggcagaggcaaguucgagaaccugcugaacgugcuggaguaccuggcccugcagugcagccacuuccugaacagaaaggacaucauggacagccugaagaacgagaacuucgacauggugaucguggagaccuucgacuacugccccuuccugaucgccgagaagcugggcaagcccuucguggccauccugagcaccagcuucggcagccuggaguucggccugcccaucccccugagcuacgugcccguguucagaagccugcugaccgaccacauggacuucuggggcagagugaagaacuuccugauguucuucagcuucugcagaagacagcagcacaugcagagcaccuucgacaacaccaucaaggagcacuucaccgagggcagcagacccgugcugagccaccugcugcugaaggccgagcugugguucaucaacagcgacuucgccuucgacuucgccagaccccugcugcccaacaccguguacgugggcggccugauggagaagcccaucaagcccgugccccaggaccuggagaacuucaucgccaaguucggcgacagcggcuucgugcuggugacccugggcagcauggugaacaccugccagaaccccgagaucuucaaggagaugaacaacgccuucgcccaccugccccagggcgugaucuggaagugccagugcagccacuggcccaaggacgugcaccuggccgccaacgugaagaucguggacuggcugccccagagcgaccugcuggcccaccccagcaucagacuguucgugacccacggcggccagaacagcaucauggaggccauccagcacggcgugcccauggugggcaucccccuguucggcgaccagcccgagaacauggugagaguggaggccaagaaguucggcgugagcauccagcugaagaagcugaaggccgagacccuggcccugaagaugaagcagaucauggaggacaagagauacaagagcgccgccguggccgccagcgugauccugagaagccacccccugagccccacccagagacuggugggcuggaucgaccacgugcugcagaccggcggcgccacccaccugaagcccuacguguuccagcagcccuggcacgagcaguaccugcuggacguguucguguuccugcugggccugacccugggcacccuguggcugugcggcaagcugcugggcauggccgugugguggcugagaggcgccagaaaggugaaggagaccuaa

SEQ ID NO: 25375 - RNA, 1626 nt, Artificial Sequence
  UGT8__Homo_sapiens__NP_001121646
augaagagcuacacccccuacuucauccugcuguggagcgccgugggcaucgccaaggccgccaagaucaucaucgugccccccaucauguucgagagccacauguacaucuucaagacccuggccagcgcccugcacgagagaggccaccacaccguguuccugcugagcgagggcagagacaucgcccccagcaaccacuacagccugcagagauaccccggcaucuucaacagcaccaccagcgacgccuuccugcagagcaagaugagaaacaucuucagcggcagacugaccgccaucgagcuguucgacauccuggaccacuacaccaagaacugcgaccugauggugggcaaccacgcccugauccagggccugaagaaggagaaguucgaccugcugcugguggaccccaacgacaugugcggcuucgugaucgcccaccugcugggcgugaaguacgccguguucagcaccggccugugguaccccgccgaggugggcgcccccgccccccuggccuacgugcccgaguucaacagccugcugaccgacagaaugaaccugcugcagagaaugaagaacaccggcguguaccugaucagcagacugggcgugagcuuccuggugcugcccaaguacgagagaaucaugcagaaguacaaccugcugcccgagaagagcauguacgaccuggugcacggcagcagccuguggaugcugugcaccgacguggcccuggaguuccccagacccacccugcccaacgugguguacgugggcggcauccugaccaagcccgccagcccccugcccgaggaccugcagagaugggugaacggcgccaacgagcacggcuucgugcuggugagcuucggcgccggcgugaaguaccugagcgaggacaucgccaacaagcuggccggcgcccugggcagacugccccagaaggugaucuggagauucagcggccccaagcccaagaaccugggcaacaacaccaagcugaucgaguggcugccccagaacgaccugcugggccacagcaagaucaaggccuuccugagccacggcggccugaacagcaucuucgagaccauguaccacggcgugcccguggugggcaucccccuguucggcgaccacuacgacaccaugaccagagugcaggccaagggcaugggcauccugcuggaguggaagaccgugaccgagaaggagcuguacgaggcccuggugaaggugaucaacaaccccagcuacagacagagagcccagaagcugagcgagauccacaaggaccagcccggccaccccgugaacagaaccaucuacuggaucgacuacaucaucagacacaacggcgcccaccaccugagagccgccgugcaccagaucagcuucugccaguacuuccugcuggacaucgccuucgugcugcugcugggcgccgcccugcuguacuuccugcugagcugggugaccaaguucaucuacagaaagaucaagagccuguggagcagaaacaagcacagcaccgugaacggccacuaccacaacggcauccugaacggcaaguacaagagaaacggccacaucaagcacgagaagaaggugaaguaa

SEQ ID NO: 25376 - RNA, 1038 nt, Artificial Sequence
  UHMK1__Homo_sapiens__NP_001171692
auguuccugaccagacccaaggugugcguggaccugaacagaagagugacccuguacggcguguucaccauccacuucagccccaacgugcccagcagaugccugcugcuggagcugcuggacgugagcgugagcgagcugcugcuguacagcagccaccagggcugcagcauguggaugauccagcacugcgccagagacgugcuggaggcccuggccuuccugcaccacgagggcuacgugcacgccgaccugaagcccagaaacauccuguggagcgccgagaacgagugcuucaagcugaucgacuucggccugagcuucaaggagggcaaccaggacgugaaguacauccagaccgacggcuacagagcccccgaggccgagcugcagaacugccuggcccaggccggccugcagagcgacaccgagugcaccagcgccguggaccuguggagccugggcaucauccugcuggagauguucagcggcaugaagcugaagcacaccgugagaagccaggaguggaaggccaacagcagcgccaucaucgaccacaucuucgccagcaaggccguggugaacgccgccauccccgccuaccaccugagagaccugaucaagagcaugcugcacgacgaccccagcagaagaauccccgccgagauggcccugugcagccccuucuucagcauccccuucgccccccacaucgaggaccuggugaugcugcccacccccgugcugagacugcugaacgugcuggacgacgacuaccuggagaacgaggaggaguacgaggacgugguggaggacgugaaggaggagugccagaaguacggccccguggugagccugcuggugcccaaggagaaccccggcagaggccagguguucguggaguacgccaacgccggcgacagcaaggccgcccagaagcugcugaccggcagaauguucgacggcaaguucgugguggccaccuucuacccccugagcgccuacaagagaggcuaccuguaccagacccugcuguaa

SEQ ID NO: 25377 - RNA, 4323 nt, Artificial Sequence
  UHRF1BP1__Homo_sapiens__NP_060224
auggccggcaucaucaagaagcagauccugaagcaccugagcagauucaccaagaaccugagccccgacaagaucaaccugagcacccugaagggcgagggccagcugaccaaccuggagcuggacgaggaggugcugcagaacgugcuggagcugcccaccuggcuggccaucaccagaguguacugcaacagagccagcaucagaauccaguggaccaagcugaagacccaccccaucugccugugccuggacaagguggagguggagaugaagaccugcgaggaccccagaccccccaacggccagagccccaucgcccuggccagcggccagagcgaguacggcuucgccgagaaggugguggagggcauguucaucaucgugaacagcaucaccaucaagauccacagcaaggccuuccacgccagcuucgagcuguggcagcugcagggcuacagcgugaaccccaacuggcagcagagcgaccugagacugaccagaaucaccgaccccugcagaggcgaggugcugaccuucaaggagaucaccuggcagacccugagaaucgaggccgacgccaccgacaacggcgaccaggaccccgugaccaccccccugagacugaucaccaaccagggcagaauccagaucgcccugaagagaagaaccaaggacugcaacgugaucagcagcaagcugauguuccugcuggacgaccugcugugggugcugaccgacagccagcugaaggccaugaugaaguacgccgagagccugagcgaggccauggagaagagcgcccaccagagaaagagccuggcccccgagcccgugcagaucaccccccccgcccccagcgcccagcagagcugggcccaggccuucggcggcagccagggcaacagcaacagcagcagcagcagacugagccaguacuucgagaaguucgacgugaaggagagcagcuaccaccugcugaucagcagacuggaccugcacaucugcgacgacagccagagcagagagcccggcgugagcgccaacagacugaugggcggcgccaugcagcugaccuucagaaagauggccuucgacuacuaccccuuccacugggccggcgacagcugcaagcacugggugagacacugcgaggccauggagaccagaggccagugggcccagaagcuggugauggaguuccagagcaagauggagaaguggcacgaggagaccggccugaagccccccuggcaccugggcguggacagccuguucagaagaaaggccgacagccugagcagccccagaaagaacccccuggagagaagccccagccagggcagacagcccgccuuccagccccccgccuggaacagacugagaagcagcugcaugguggugagaguggacgaccuggacauccaccaggugagcaccgccggccagcccagcaagaagcccagcacccugcugagcugcagcagaaagcugcacaaccugcccacccaggugagcgccauccacaucgaguucaccgaguacuacuuccccgacaaccaggagcugcccgugcccugccccaaccuguacauccagcugaacggccugaccuucaccauggaccccgugagccugcuguggggcaaccuguucugccuggaccuguacagaagccuggagcaguucaaggccaucuacaagcuggaggacagcagccagaaggacgagcaccuggacaucagacuggacgccuucuggcugaaggugagcuucccccuggagaagagagagagagccgagcugcacagaccccaggcccugguguucagcgccagcggcaugaucgccaccaacaccagacacgccccccacugcagcugcagcgaccugcagagccuguucagaggcuucgccgccgccgaguucuuccacagcaacuacgaccacuuccccaaggugcccggcggcuucagccugcugcacaugcuguuccugcaccacgccuuccagauggacagcugccugccccagcccaacacccugcccccccagagacccaaggccagcugggaccuguggagcgugcacuucacccagaucagccuggacuucgagggcaccgagaacuucaagggccacacccugaacuucguggcccccuucccccugagcaucugggccugccugccccugagauggcagcaggcccaggccagaaagcugcugcuggccagcgagggcagacugaagcccagcgccagcuucggcagccccgugcagagcgaggcccuggcccccgacagcaugagccaccccagaagcaagaccgagcacgaccugaagagccugagcggccugaccgaggugauggagauccugaaggagggcagcagcggcauggacaacaagggcccccugaccgagcuggaggacguggccgacgugcacaugcuggugcacagccccgcccacgugagagugagacuggaccacuaccaguaccuggcccugcugagacugaaggaggugcugcagagacugcaggagcagcugaccaaggacaccgagagcaugaccggcagcccccugcagaaccagaccgccugcaucggcgugcuguuccccagcgccgagguggcccugcugaugcaccccgcccccggcgccguggacgccgacagcgccggcagcgacagcaccagccugguggacagcgagcugagccccagcgaggacagagagcugaagagcgacgccagcagcgaccagggccccgccagccccgagaaggugcuggaggagagcagcaucgagaaccaggacgugagccaggagagaccccacagcaacggcgagcugcaggacagcggcccccuggcccagcagcuggccggcaagggccacgaggccguggagagccugcaggccaagaagcugagcagaacccaggccagcagcagccccgccgcccugaagccccccgccggcagagagaccgccgugaacggccagggcgagcugaucccccugaagaacaucgagggcgagcugagcagcgccauccacaugaccaaggacgccaccaaggaggcccugcacgccaccauggaccugaccaaggaggccgugagccugaccaaggacgccuucagccugggcagagacagaaugaccagcaccaugcacaagaugcugagccugccccccgccaaggagcccauggccaagaccgacgagggcguggccgcccccgugagcggcggcgccgccagacugagauucuucagcaugaagagaaccgugagccagcagagcuucgacggcgugagccuggacagcagcggccccgaggacagaaucagcguggacagcgacggcagcgacagcuucgugaugcugcuggagagcgagagcggccccgagagcgugccccccggcagccugagcaacgugagcgacaacgccggcgugcagggcagcccccuggugaacaacuacggccagggcagccccgccgccaacagcagcgugagccccagcggcgaggaccugaucuuccaccccgugagcgugcuggugcugaaggugaacgaggugagcuucggcaucgaggugagaggcgaggaccugaccguggcccugcaggccgaggagcugacccugcagcagcugggcaccgugggccuguggcaguuccugcacggccagugccccggcaccugcuuccaggagagcagcacccugaagaccggccacaucagacccgccgugggccugagauucgaggugggccccggcgccgccgugcacagcccccuggccagccagaacggcuuccugcaccugcugcugcacggcugcgaccuggagcugcugaccagcgugcugagcggccugggccccuuccuggaggacgaggagauccccgugguggugcccaugcagaucgagcugcugaacagcagcaucacccugaaggacgacaucccccccaucuaccccaccagccccggccccauccccaucacccuggccauggagcacguggugcugaagagaagcgacgacggcguguuccacaucggcgccgccgcccaggacaagcccagcgccgaggugcugaagagcgagaagagacagccccccaaggagcagguguuccuggugcccaccggcgagguguucgagcagcaggugaaggagcugcccauccugcagaaggagcugaucgagaccaagcaggcccuggccaacgccaaccaggacaaggagaagcugcugcaggagaucagaaaguacaaccccuucuucgagcuguaa

SEQ ID NO: 25378 - RNA, 2382 nt, Artificial Sequence
  UHRF1__Homo_sapiens__NP_001276980
auguggauccaggugagaaccauggacggcagacagacccacaccguggacagccugagcagacugaccaagguggaggagcugagaagaaagauccaggagcuguuccacguggagcccggccugcagagacuguucuacagaggcaagcagauggaggacggccacacccuguucgacuacgaggugagacugaacgacaccauccagcugcuggugagacagagccuggugcugccccacagcaccaaggagagagacagcgagcugagcgacaccgacagcggcugcugccugggccagagcgagagcgacaagagcagcacccacggcgaggccgccgccgagaccgacagcagacccgccgacgaggacaugugggacgagaccgagcugggccuguacaaggugaacgaguacguggacgccagagacaccaacaugggcgccugguucgaggcccagguggugagagugaccagaaaggcccccagcagagacgagcccugcagcagcaccagcagacccgcccuggaggaggacgugaucuaccacgugaaguacgacgacuaccccgagaacggcguggugcagaugaacagcagagacgugagagccagagccagaaccaucaucaaguggcaggaccuggaggugggccagguggugaugcugaacuacaaccccgacaaccccaaggagagaggcuucugguacgacgccgagaucagcagaaagagagagaccagaaccgccagagagcuguacgccaacguggugcugggcgacgacagccugaacgacugcagaaucaucuucguggacgagguguucaagaucgagagacccggcgagggcagccccaugguggacaaccccaugagaagaaagagcggccccagcugcaagcacugcaaggacgacgugaacagacugugcagagugugcgccugccaccugugcggcggcagacaggaccccgacaagcagcugaugugcgacgagugcgacauggccuuccacaucuacugccuggaccccccccugagcagcgugcccagcgaggacgagugguacugccccgagugcagaaacgacgccagcgagguggugcuggccggcgagagacugagagagagcaagaagaaggccaagauggccagcgccaccagcagcagccagagagacuggggcaagggcauggccugcgugggcagaaccaaggagugcaccaucgugcccagcaaccacuacggccccauccccggcauccccgugggcaccauguggagauucagagugcaggugagcgagagcggcgugcacagaccccacguggccggcauccacggcagaagcaacgacggcgccuacagccuggugcuggccggcggcuacgaggacgacguggaccacggcaacuucuucaccuacaccggcagcggcggcagagaccugagcggcaacaagagaaccgccgagcagagcugcgaccagaagcugaccaacaccaacagagcccuggcccugaacugcuucgcccccaucaacgaccaggagggcgccgaggccaaggacuggagaagcggcaagcccgugagaguggugagaaacgugaagggcggcaagaacagcaaguacgcccccgccgagggcaacagauacgacggcaucuacaagguggugaaguacuggcccgagaagggcaagagcggcuuccugguguggagauaccugcugagaagagacgacgacgagcccggccccuggaccaaggagggcaaggacagaaucaagaagcugggccugaccaugcaguaccccgagggcuaccuggaggcccuggccaacagagagagagagaaggagaacagcaagagagaggaggaggagcagcaggagggcggcuucgccagccccagaaccggcaagggcaaguggaagagaaagagcgccggcggcggccccagcagagccggcagccccagaagaaccagcaagaagaccaagguggagcccuacagccugaccgcccagcagagcagccugaucagagaggacaagagcaacgccaagcuguggaacgaggugcuggccagccugaaggacagacccgccagcggcagccccuuccagcuguuccugagcaagguggaggagaccuuccagugcaucugcugccaggagcugguguucagacccaucaccaccgugugccagcacaacgugugcaaggacugccuggacagaagcuucagagcccagguguucagcugccccgccugcagauacgaccugggcagaagcuacgccaugcaggugaaccagccccugcagaccgugcugaaccagcuguuccccggcuacggcaacggcagauaa

SEQ ID NO: 25379 - RNA, 2409 nt, Artificial Sequence
  UHRF2__Homo_sapiens__NP_690856
auguggauccaggugagaaccaucgacggcagcaagaccugcaccaucgaggacgugagcagaaaggccaccaucgaggagcugagagagagagugugggcccuguucgacgugagacccgagugccagagacuguucuacagaggcaagcagcuggagaacggcuacacccuguucgacuacgacgugggccugaacgacaucauccagcugcuggugagacccgaccccgaccaccugcccggcaccagcacccagaucgaggccaagcccugcagcaacagcccccccaaggugaagaaggcccccagagugggccccagcaaccagcccagcaccagcgccagagccagacugaucgaccccggcuucggcaucuacaaggugaacgagcugguggacgccagagacgugggccugggcgccugguucgaggcccacauccacagcgugaccagagccagcgacggccagagcagaggcaagaccccccugaagaacggcagcagcugcaagagaaccaacggcaacaucaagcacaagagcaaggagaacaccaacaagcuggacagcgugcccagcaccagcaacagcgacugcguggccgccgacgaggacgugaucuaccacauccaguacgacgaguaccccgagagcggcacccuggagaugaacgugaaggaccugagacccagagccagaaccauccugaaguggaacgagcugaacgugggcgacguggugauggugaacuacaacguggagagccccggccagagaggcuucugguucgacgccgagaucaccacccugaagaccaucagcagaaccaagaaggagcugagagugaagaucuuccugggcggcagcgagggcacccugaacgacugcaagaucaucagcguggacgagaucuucaagaucgagagacccggcgcccacccccugagcuucgccgacggcaaguuccugagaagaaacgaccccgagugcgaccugugcggcggcgaccccgagaagaagugccacagcugcagcugcagagugugcggcggcaagcacgagcccaacaugcagcugcugugcgacgagugcaacguggccuaccacaucuacugccugaaccccccccuggacaaggugcccgaggaggaguacugguacugccccagcugcaagaccgacagcagcgagguggugaaggccggcgagagacugaagaugagcaagaagaaggccaagaugcccagcgccagcaccgagagcagaagagacuggggcagaggcauggccugcgugggcagaaccagagagugcaccaucgugcccagcaaccacuacggccccauccccggcauccccgugggcagcaccuggagauucagagugcaggugagcgaggccggcgugcacagaccccacgugggcggcauccacggcagaagcaacgacggcgccuacagccuggugcuggccggcggcuucgccgacgagguggacagaggcgacgaguucaccuacaccggcagcggcggcaagaaccuggccggcaacaagagaaucggcgcccccagcgccgaccagacccugaccaacaugaacagagcccuggcccugaacugcgacgccccccuggacgacaagaucggcgccgagagcagaaacuggagagccggcaagcccgugagagugaucagaagcuucaagggcagaaagaucagcaaguacgcccccgaggagggcaacagauacgacggcaucuacaagguggugaaguacuggcccgagaucagcagcagccacggcuuccugguguggagauaccugcugagaagagacgacguggagcccgcccccuggaccagcgagggcaucgagagaagcagaagacugugccugagacugcaguaccccgccggcuaccccagcgacaaggagggcaagaagcccaagggccagagcaagaagcagcccagcggcaccaccaagagacccaucagcgacgacgacugccccagcgccagcaagguguacaaggccagcgacagcgccgaggccaucgaggccuuccagcugaccccccagcagcagcaccugaucagagaggacugccagaaccagaagcugugggacgaggugcugagccaccugguggagggccccaacuuccugaagaagcuggagcagagcuucaugugcgugugcugccaggagcugguguaccagcccgugaccaccgagugcuuccacaacgugugcaaggacugccugcagagaagcuucaaggcccagguguucagcugccccgccugcagacacgaccugggccagaacuacaucaugauccccaacgagauccugcagacccugcuggaccuguucuuccccggcuacagcaagggcagauaa

SEQ ID NO: 25380 - RNA, 2160 nt, Artificial Sequence
  UIMC1__Homo_sapiens__NP_057374
augcccagaagaaagaagaaggugaaggaggugagcgagagcagaaaccuggagaagaaggacguggagaccaccagcagcgugagcgugaagagaaagagaagacuggaggacgccuucaucgugaucagcgacagcgacggcgaggagcccaaggaggagaacggccugcagaagaccaagaccaagcagagcaacagagccaagugccuggccaagagaaagaucgcccagaugaccgaggaggagcaguucgcccuggcccugaagaugagcgagcaggaggccagagaggugaacagccaggaggaggaggaggaggagcugcugagaaaggccaucgccgagagccugaacagcugcagacccagcgacgccagcgccaccagaagcagaccccuggccaccggccccagcagccagagccaccaggagaagaccaccgacagcggccugaccgagggcaucuggcagcuggugccccccagccuguucaagggcagccacaucagccagggcaacgaggccgaggagagagaggagcccugggaccacaccgagaagaccgaggaggagcccgugagcggcagcagcggcagcugggaccagagcagccagcccguguucgagaacgugaacgugaagagcuucgacagaugcaccggccacagcgccgagcacacccagugcggcaagccccaggagagcaccggcagaggcagcgccuuccugaaggccgugcagggcagcggcgacaccagcagacacugccugcccacccuggccgacgccaagggccugcaggacaccggcggcaccgugaacuacuucuggggcauccccuucugccccgacggcguggaccccaaccaguacaccaaggugauccugugccagcuggagguguaccagaagagccugaagauggcccagagacagcugcugaacaagaagggcuucggcgagcccgugcugcccagaccccccagccugauccagaacgagugcggccagggcgagcaggccagcgagaagaacgagugcaucagcgaggacaugggcgacgaggacaaggaggagagacaggagagcagagccagcgacuggcacagcaagaccaaggacuuccaggagagcagcaucaagagccugaaggagaagcugcugcuggaggaggagcccaccaccagccacggccagagcagccagggcaucguggaggagaccagcgaggagggcaacagcgugcccgccagccagagcguggccgcccugaccagcaagagaagccuggugcugaugcccgagagcagcgccgaggagaucaccgugugccccgagacccagcugagcagcagcgagaccuucgaccuggagagagaggugagccccggcagcagagacauccuggacggcgugagaaucaucauggccgacaaggaggugggcaacaaggaggacgccgagaaggagguggccaucagcaccuucagcagcagcaaccaggugagcugcccccugugcgaccagugcuucccccccaccaagaucgagagacacgccauguacugcaacggccugauggaggaggacaccgugcugaccagaagacagaaggaggccaagaccaagagcgacagcggcaccgccgcccagaccagccuggacaucgacaagaacgagaagugcuaccugugcaagagccuggugcccuucagagaguaccagugccacguggacagcugccugcagcuggccaaggccgaccagggcgacggccccgagggcagcggcagagccugcagcaccguggagggcaaguggcagcagagacugaagaaccccaaggagaagggccacagcgagggcagacugcugagcuuccuggagcagagcgagcacaagaccagcgacgccgacaucaagagcagcgagaccggcgccuucagagugcccagccccggcauggaggaggccggcugcagcagagagaugcagagcagcuucaccagaagagaccugaacgagagccccgugaagagcuucgugagcaucagcgaggccaccgacugccugguggacuucaagaagcaggugaccgugcagcccggcagcagaaccagaaccaaggccggcagaggcagaagaagaaaguucuaa

SEQ ID NO: 25381 - RNA, 735 nt, Artificial Sequence
  ULBP1__Homo_sapiens__NP_079494
auggccgccgccgccagccccgccuuccugcugugccugccccugcugcaccugcugagcggcuggagcagagccggcuggguggacacccacugccugugcuacgacuucaucaucacccccaagagcagacccgagccccaguggugcgaggugcagggccugguggacgagagacccuuccugcacuacgacugcgugaaccacaaggccaaggccuucgccagccugggcaagaaggugaacgugaccaagaccugggaggagcagaccgagacccugagagacgugguggacuuccugaagggccagcugcuggacauccagguggagaaccugauccccaucgagccccugacccugcaggccagaaugagcugcgagcacgaggcccacggccacggcagaggcagcuggcaguuccuguucaacggccagaaguuccugcuguucgacagcaacaacagaaaguggaccgcccugcaccccggcgccaagaagaugaccgagaagugggagaagaacagagacgugaccauguucuuccagaagaucagccugggcgacugcaagauguggcuggaggaguuccugauguacugggagcagaugcuggaccccaccaagccccccagccuggcccccggcaccacccagcccaaggccauggccaccacccugagccccuggagccugcugaucaucuuccugugcuucauccuggccggcagauaa

SEQ ID NO: 25382 - RNA, 741 nt, Artificial Sequence
  ULBP2__Homo_sapiens__NP_079493
auggccgccgccgccgccaccaagauccugcugugccugccccugcugcugcugcugagcggcuggagcagagccggcagagccgacccccacagccugugcuacgacaucaccgugauccccaaguucagacccggccccagauggugcgccgugcagggccagguggacgagaagaccuuccugcacuacgacugcggcaacaagaccgugacccccgugagcccccugggcaagaagcugaacgugaccaccgccuggaaggcccagaaccccgugcugagagaggugguggacauccugaccgagcagcugagagacauccagcuggagaacuacacccccaaggagccccugacccugcaggccagaaugagcugcgagcagaaggccgagggccacagcagcggcagcuggcaguucagcuucgacggccagaucuuccugcuguucgacagcgagaagagaauguggaccaccgugcaccccggcgccagaaagaugaaggagaagugggagaacgacaaggugguggccaugagcuuccacuacuucagcaugggcgacugcaucggcuggcuggaggacuuccugaugggcauggacagcacccuggagcccagcgccggcgccccccuggccaugagcagcggcaccacccagcugagagccaccgccaccacccugauccugugcugccugcugaucauccugcccugcuucauccugcccggcaucuaa

SEQ ID NO: 25383 - RNA, 735 nt, Artificial Sequence
  ULBP3__Homo_sapiens__NP_078794
auggccgccgccgccagccccgccauccugcccagacuggccauccugcccuaccugcuguucgacuggagcggcaccggcagagccgacgcccacagccugugguacaacuucaccaucauccaccugcccagacacggccagcaguggugcgaggugcagagccagguggaccagaagaacuuccugagcuacgacugcggcagcgacaaggugcugagcaugggccaccuggaggagcagcuguacgccaccgacgccuggggcaagcagcuggagaugcugagagaggugggccagagacugagacuggagcuggccgacaccgagcuggaggacuucacccccagcggcccccugacccugcaggugagaaugagcugcgagugcgaggccgacggcuacaucagaggcagcuggcaguucagcuucgacggcagaaaguuccugcuguucgacagcaacaacagaaaguggaccguggugcacgccggcgccagaagaaugaaggagaagugggagaaggacagcggccugaccaccuucuucaagauggugagcaugagagacugcaagagcuggcugagagacuuccugaugcacagaaagaagagacuggagcccaccgccccccccaccauggcccccggccuggcccagcccaaggccaucgccaccacccugagccccuggagcuuccugaucauccugugcuucauccugcccggcaucuaa

SEQ ID NO: 25384 - RNA, 3153 nt, Artificial Sequence
  ULK1__Homo_sapiens__NP_003556
auggagcccggcagaggcggcaccgagaccgugggcaaguucgaguucagcagaaaggaccugaucggccacggcgccuucgccgugguguucaagggcagacacagagagaagcacgaccuggagguggccgugaagugcaucaacaagaagaaccuggccaagagccagacccugcugggcaaggagaucaagauccugaaggagcugaagcacgagaacaucguggcccuguacgacuuccaggagauggccaacagcguguaccuggugauggaguacugcaacggcggcgaccuggccgacuaccugcacgccaugagaacccugagcgaggacaccaucagacuguuccugcagcagaucgccggcgccaugagacugcugcacagcaagggcaucauccacagagaccugaagccccagaacauccugcugagcaaccccgccggcagaagagccaaccccaacagcaucagagugaagaucgccgacuucggcuucgccagauaccugcagagcaacaugauggccgccacccugugcggcagccccauguacauggcccccgaggugaucaugagccagcacuacgacggcaaggccgaccuguggagcaucggcaccaucguguaccagugccugaccggcaaggcccccuuccaggccagcagcccccaggaccugagacuguucuacgagaagaacaagacccuggugcccaccauccccagagagaccagcgccccccugagacagcugcugcuggcccugcugcagagaaaccacaaggacagaauggacuucgacgaguucuuccaccaccccuuccuggacgccagccccagcgugagaaagagcccccccgugcccgugcccagcuaccccagcagcggcagcggcagcagcagcagcagcagcagcaccagccaccuggccagcccccccagccugggcgagaugcagcagcugcagaagacccuggccagccccgccgacaccgccggcuuccugcacagcagcagagacagcggcggcagcaaggacagcagcugcgacaccgacgacuucgugauggugcccgcccaguuccccggcgaccugguggccgaggcccccagcgccaagcccccccccgacagccugaugugcagcggcagcagccugguggccagcgccggccuggagagccacggcagaacccccagccccagcccccccugcagcagcagccccagccccagcggcagagccggccccuucagcagcagcagaugcggcgccagcgugcccauccccgugcccacccaggugcagaacuaccagagaaucgagagaaaccugcagagccccacccaguuccagacccccagaagcagcgccaucagaagaagcggcagcaccagcccccugggcuucgccagagccagccccagcccccccgcccacgccgagcacggcggcgugcuggccagaaagaugagccugggcggcggcagacccuacacccccagcccccaggugggcaccauccccgagagacccggcuggagcggcacccccagcccccagggcgccgagaugagaggcggcagaagccccagacccggcagcagcgcccccgagcacagccccagaaccagcggccugggcugcagacugcacagcgcccccaaccugagcgaccugcacguggugagacccaagcugcccaagccccccaccgacccccugggcgccguguucagccccccccaggccagccccccccagcccagccacggccugcagagcugcagaaaccugagaggcagccccaagcugcccgacuuccugcagagaaacccccugccccccauccugggcagccccaccaaggccgugcccagcuucgacuuccccaagacccccagcagccagaaccugcuggcccugcuggccagacagggcguggugaugaccccccccagaaacagaacccugcccgaccugagcgaggugggccccuuccacggccagccccugggccccggccugagacccggcgaggaccccaagggccccuucggcagaagcuucagcaccagcagacugaccgaccugcugcugaaggccgccuucggcacccaggcccccgaccccggcagcaccgagagccugcaggagaagcccauggagaucgcccccagcgccggcuucggcggcagccugcaccccggcgccagagccggcggcaccagcagccccagccccgugguguucaccgugggcagcccccccagcggcagcacccccccccagggccccagaaccagaauguucagcgccggccccaccggcagcgccagcagcagcgccagacaccuggugcccggccccugcagcgaggcccccgcccccgagcugcccgcccccggccacggcugcagcuucgccgaccccaucgccgccaaccuggagggcgccgugaccuucgaggcccccgaccugcccgaggagacccugauggagcaggagcacaccgagauccugagaggccugagauucacccugcuguucgugcagcacgugcuggagaucgccgcccugaagggcagcgccagcgaggccgccggcggccccgaguaccagcugcaggagagcgugguggccgaccagaucagccugcugagcagagaguggggcuucgccgagcagcuggugcuguaccugaagguggccgagcugcugagcagcggccugcagagcgccaucgaccagaucagagccggcaagcugugccugagcagcaccgugaagcagguggugagaagacugaacgagcuguacaaggccagcguggugagcugccagggccugagccugagacugcagagauucuuccuggacaagcagagacugcuggacagaauccacagcaucaccgccgagagacugaucuucagccacgccgugcagauggugcagagcgccgcccuggacgagauguuccagcacagagagggcugcgugcccagauaccacaaggcccugcugcugcuggagggccugcagcacaugcugagcgaccaggccgacaucgagaacgugaccaagugcaagcugugcaucgagagaagacugagcgcccugcugaccggcaucugcgccuaa

SEQ ID NO: 25385 - RNA, 3111 nt, Artificial Sequence
  ULK2__Homo_sapiens__NP_001136082
auggagguggugggcgacuucgaguacagcaagagagaccuggugggccacggcgccuucgccgugguguucagaggcagacacagacagaagaccgacugggagguggccaucaagagcaucaacaagaagaaccugagcaagagccagauccugcugggcaaggagaucaagauccugaaggagcugcagcacgagaacaucguggcccuguacgacgugcaggagcugcccaacagcguguuccuggugauggaguacugcaacggcggcgaccuggccgacuaccugcaggccaagggcacccugagcgaggacaccaucagaguguuccugcaccagaucgccgccgccaugagaauccugcacagcaagggcaucauccacagagaccugaagccccagaacauccugcugagcuacgccaacagaagaaagagcagcgugagcggcaucagaaucaagaucgccgacuucggcuucgccagauaccugcacagcaacaugauggccgccacccugugcggcagccccauguacauggcccccgaggugaucaugagccagcacuacgacgccaaggccgaccuguggagcaucggcaccgugaucuaccagugccuggugggcaagccccccuuccaggccaacagcccccaggaccugagaauguucuacgagaagaacagaagccugaugcccagcauccccagagagaccagccccuaccuggccaaccugcugcugggccugcugcagagaaaccagaaggacagaauggacuucgaggccuucuucagccaccccuuccuggagcagggccccgugaagaagagcugccccgugcccgugcccauguacagcggcagcgugagcggcagcagcugcggcagcagccccagcugcagauucgccagcccccccagccugcccgacaugcagcacauccaggaggagaaccugagcagccccccccugggcccccccaacuaccugcaggugagcaaggacagcgccagcaccagcagcaagaacagcagcugcgacaccgacgacuucgugcuggugccccacaacaucagcagcgaccacagcugcgacaugcccgugggcaccgccggcagaagagccagcaacgaguuccuggugugcggcggccagugccagcccaccgugagcccccacagcgagaccgcccccauccccgugcccacccagaucagaaacuaccagagaaucgagcagaaccugaccagcaccgccagcagcggcaccaacgugcacggcagccccagaagcgccguggugagaagaagcaacaccagccccaugggcuuccugagacccggcagcugcagccccgugcccgccgacaccgcccagaccgugggcagaagacugagcaccggcagcagcagacccuacagccccagcccccuggugggcaccauccccgagcaguucagccagugcugcugcggccacccccagggccacgacagcagaagcagaaacagcagcggcagccccgugccccaggcccagagcccccagagccugcugagcggcgccagacugcagagcgcccccacccugaccgacaucuaccagaacaagcagaagcugagaaagcagcacagcgaccccgugugccccagccacaccggcgccggcuacagcuacagcccccagcccagcagacccggcagccugggcaccagccccaccaagcaccugggcagcagccccagaagcagcgacugguucuucaagaccccccugcccaccaucaucggcagccccaccaagaccaccgcccccuucaagauccccaagacccaggccagcagcaaccugcuggcccuggugaccagacacggccccgccgaggagcagagcaaggacggcaacgagcccagagagugcgcccacugccugcuggugcagggcagcgagagacagagagccgagcagcagagcaaggccguguucggcagaagcgugagcaccggcaagcugagcgaccagcagggcaagacccccaucugcagacaccagggcagcaccgacagccugaacaccgagagacccauggacaucgcccccgccggcgccugcggcggcgugcuggccccccccgccggcaccgccgccagcagcaaggccgugcuguucaccgugggcagccccccccacagcgccgccgcccccaccugcacccacauguuccugagaaccagaaccaccagcgugggccccagcaacagcggcggcagccugugcgccaugagcggcagagugugcgugggcagcccccccggccccggcuucggcagcagcccccccggcgccgaggccgcccccagccugagauacgugcccuacggcgccagcccccccagccuggagggccugaucaccuucgaggcccccgagcugcccgaggagacccugauggagagagagcacaccgacacccugagacaccugaacgugaugcugauguucaccgagugcgugcuggaccugaccgccaugagaggcggcaaccccgagcugugcaccagcgccgugagccuguaccagauccaggagagcguggugguggaccagaucagccagcugagcaaggacuggggcagaguggagcagcuggugcuguacaugaaggccgcccagcugcuggccgccagccugcaccuggccaaggcccagaucaagagcggcaagcugagccccagcaccgccgugaagcagguggugaagaaccugaacgagagauacaaguucugcaucaccaugugcaagaagcugaccgagaagcugaacagauucuucagcgacaagcagagauucaucgacgagaucaacagcgugaccgccgagaagcugaucuacaacugcgccguggagauggugcagagcgccgcccuggacgagauguuccagcagaccgaggacaucguguacagauaccacaaggccgcccugcugcuggagggccugagcagaauccugcaggaccccgccgacaucgagaacgugcacaaguacaagugcagcaucgagagaagacugagcgcccugugccacagcaccgccaccguguaa

SEQ ID NO: 25386 - RNA, 1419 nt, Artificial Sequence
  ULK3__Homo_sapiens__NP_001092906
auggccggccccggcuggggcccccccagacuggacggcuucauccugaccgagagacugggcagcggcaccuacgccaccguguacaaggccuacgccaagaaggacaccagagaggugguggccaucaagugcguggccaagaagagccugaacaaggccagcguggagaaccugcugaccgagaucgagauccugaagggcaucagacacccccacaucgugcagcugaaggacuuccagugggacagcgacaacaucuaccugaucauggaguucugcgccggcggcgaccugagcagauucauccacaccagaagaauccugcccgagaagguggccagaguguucaugcagcagcuggccagcgcccugcaguuccugcacgagagaaacaucagccaccuggaccugaagccccagaacauccugcugagcagccuggagaagccccaccugaagcuggccgacuucggcuucgcccagcacaugagccccugggacgagaagcacgugcugagaggcagcccccuguacauggcccccgagauggugugccagagacaguacgacgccagaguggaccuguggagcaugggcgugauccuguacgaggcccuguucggccagccccccuucgccagcagaagcuucagcgagcuggaggagaagaucagaagcaacagagugaucgagcugccccugagaccccugcugagcagagacugcagagaccugcugcagagacugcuggagagagaccccagcagaagaaucagcuuccaggacuucuucgcccaccccuggguggaccuggagcacaugcccagcggcgagagccugggcagagccaccgcccugguggugcaggccgugaagaaggaccaggagggcgacagcgccgccgcccugagccuguacugcaaggcccuggacuucuucgugcccgcccugcacuacgagguggacgcccagagaaaggaggccaucaaggccaaggugggccaguacgugagcagagccgaggagcugaaggccaucgugagcagcagcaaccaggcccugcugagacagggcaccagcgccagagaccugcugagagagauggccagagacaagcccagacugcuggccgcccuggagguggccagcgccgccauggccaaggaggaggccgccggcggcgagcaggacgcccuggaccuguaccagcacagccugggcgagcugcugcugcugcuggccgccgagccccccggcagaagaagagagcugcugcacaccgaggugcagaaccugauggccagagccgaguaccugaaggagcaggugaagaugagagagagcagaugggaggccgacacccuggacaaggagggccugagcgagagcgugagaagcagcugcacccugcaguaa

SEQ ID NO: 25387 - RNA, 3828 nt, Artificial Sequence
  ULK4__Homo_sapiens__NP_060356
auggagaacuucauccuguacgaggagaucggcagaggcagcaagaccgugguguacaagggcagaagaaagggcaccaucaacuucguggccauccugugcaccgacaagugcaagagacccgagaucaccaacugggugagacugaccagagagaucaagcacaagaacaucgugaccuuccacgagugguacgagaccagcaaccaccuguggcuggugguggagcugugcaccggcggcagccugaagaccgugaucgcccaggacgagaaccugcccgaggacguggugagagaguucggcaucgaccugaucagcggccugcaccaccugcacaagcugggcauccuguucugcgacaucagccccagaaagauccugcuggagggccccggcacccugaaguucagcaacuucugccuggccaagguggagggcgagaaccuggaggaguucuucgcccugguggccgccgaggagggcggcggcgacaacggcgagaacgugcugaagaagagcaugaagagcagagugaagggcagccccguguacaccgcccccgagguggugagaggcgccgacuucagcaucagcagcgaccuguggagccugggcugccugcuguacgagauguucagcggcaagccccccuucuucagcgagagcaucagcgagcugaccgagaagauccugugcgaggacccccugccccccauccccaaggacagcagcagacccaaggccagcagcgacuucaucaaccugcuggacggccugcugcagagagacccccagaagagacugaccuggaccagacugcugcagcacagcuucuggaagaaggccuucgccggcgccgaccaggagagcagcguggaggaccugagccugagcagaaacaccauggagugcagcggcccccaggacagcaaggagcugcugcagaacagccagagcagacaggccaagggccacaagagcggccagccccugggccacagcuucagacuggagaaccccaccgaguucagacccaagagcacccuggagggccagcugaacgagagcauguuccugcugagcagcagacccacccccagaaccagcaccgccguggaggugagccccggcgaggacaugacccacugcagcccccagaagaccagcccccugaccaagaucaccagcggccaccugagccagcaggaccuggagagccagaugagagagcugaucuacaccgacagcgaccugguggugacccccaucaucgacaaccccaagaucaugaagcagccccccgugaaguucgacgccaagauccugcaccugcccaccuacagcguggacaagcugcuguuccugaaggaccaggacuggaacgacuuccugcagcaggugugcagccagaucgacagcaccgagaagagcaugggcgccagcagagccaagcugaaccugcugugcuaccugugcgugguggccggccaccaggagguggccaccagacugcugcacagcccccuguuccagcugcugauccagcaccugagaaucgcccccaacugggacaucagagccaagguggcccacgugaucggccugcuggccagccacaccgccgagcugcaggagaacacccccgugguggaggccaucgugcugcugaccgagcugaucagagagaacuucagaaacagcaagcugaagcagugccugcugcccacccugggcgagcugaucuaccugguggccacccaggaggagaagaagaagaaccccagagagugcugggccgugccccuggccgccuacaccgugcugaugagaugccugagagagggcgaggagagaguggugaaccacauggccgccaagaucaucgagaacgugugcaccaccuucagcgcccagagccagggcuucaucaccggcgagaucggccccauccugugguaccuguucagacacagcaccgccgacagccugagaaucaccgccgugagcgcccugugcagaaucaccagacacagccccaccgccuuccagaacgugaucgagaaggugggccugaacagcgugaucaacagccuggccagcgccaucugcaaggugcagcaguacaugcugacccuguucgccgccaugcugagcugcggcauccaccugcagagacugauccaggagaagggcuucgugagcaccaucaucagacugcuggacagccccagcaccugcaucagagccaaggccuuccuggugcugcuguacauccugaucuacaacagagagaugcugcugcugagcugccaggccagacuggugauguacaucgagagagacagcagaaagaccacccccggcaaggagcagcagagcggcaacgaguaccugagcaagugccuggaccugcugaucugccacaucgugcaggagcugcccagaauccugggcgacauccugaacagccuggccaacgugagcggcagaaagcaccccagcaccgugcaggugaagcagcugaagcugugccugccccugaugcccguggugcugcaccuggugaccagccagguguucagaccccagguggugaccgaggaguuccuguucagcuacggcaccauccugagccacaucaagagcguggacagcggcgagaccaacaucgacggcgccaucggccugaccgccagcgaggaguucaucaagaucacccugagcgccuucgaggccaucauccaguaccccauccugcugaaggacuacagaagcaccgugguggacuacauccugcccccccuggugagccuggugcagagccagaacguggaguggagacuguucagccugagacugcugagcgagaccaccagccugcuggugaaccaggaguucggcgacggcaaggagaaggccagcguggacagcgacagcaaccugcuggcccugaucagagacgugcugcugccccaguacgagcacauccugcuggagcccgaccccgugcccgccuacgcccugaagcugcugguggccaugaccgagcacaaccccaccuucaccagacugguggaggagagcaagcugaucccccugaucuucgaggugacccuggagcaccaggagagcauccugggcaacaccaugcagagcgugaucgcccugcugagcaaccugguggccugcaaggacagcaacauggagcugcuguacgagcagggccuggugagccacaucugcaaccugcugaccgagaccgccacccugugccuggacguggacaacaagaacaacaacgagauggccgccccccugcuguucagccugcuggacauccugcacagcaugcugaccuacaccagcggcaucgugagacuggcccugcaggcccagaagagcggcagcggcgaggacccccaggccgccgaggaccugcugcugcugaacagaccccugaccgaccugaucagccugcugaucccccugcugcccaacgaggaccccgagaucuucgacgugagcagcaagugccugagcauccuggugcagcuguacggcggcgagaaccccgacagccugagccccgagaacguggagaucuucgcccaccugcugaccagcaaggaggaccccaaggagcagaagcugcugcugagaauccugagaagaaugaucaccagcaacgagaagcaccuggagagccugaagaacgccggcagccugcugagagcccuggagagacuggcccccggcagcggcagcuucgccgacagcgccguggccccccuggcccuggagauccugcaggccgugggccacuaa

SEQ ID NO: 25388 - RNA, 1923 nt, Artificial Sequence
  UMOD__Homo_sapiens__NP_001008390
augggccagcccagccugaccuggaugcugaugguggugguggccagcugguucaucaccaccgccgccaccgacaccagcgaggccagauggugcagcgagugccacagcaacgccaccugcaccgaggacgaggccgugaccaccugcaccugccaggagggcuucaccggcgacggccugaccugcguggaccuggacgagugcgccauccccggcgcccacaacugcagcgccaacagcagcugcgugaacacccccggcagcuucagcugcgugugccccgagggcuucagacugagccccggccugggcugcaccgacguggacgagugcgccgagcccggccugagccacugccacgcccuggccaccugcgugaacguggugggcagcuaccugugcgugugccccgccggcuacagaggcgacggcuggcacugcgagugcagccccggcagcugcggccccggccuggacugcgugcccgagggcgacgcccuggugugcgccgaccccugccaggcccacagaacccuggacgaguacuggagaagcaccgaguacggcgagggcuacgccugcgacaccgaccugagaggcugguacagauucgugggccagggcggcgccagaauggccgagaccugcgugcccgugcugagaugcaacaccgccgcccccauguggcugaacggcacccaccccagcagcgacgagggcaucgugagcagaaaggccugcgcccacuggagcggccacugcugccugugggacgccagcgugcaggugaaggccugcgccggcggcuacuacguguacaaccugaccgccccccccgagugccaccuggccuacugcaccgaccccagcagcguggagggcaccugcgaggagugcagcaucgacgaggacugcaagagcaacaacggcagauggcacugccagugcaagcaggacuucaacaucaccgacaucagccugcuggagcacagacuggagugcggcgccaacgacaugaaggugagccugggcaagugccagcugaagagccugggcuucgacaagguguucauguaccugagcgacagcagaugcagcggcuucaacgacagagacaacagagacugggugagcguggugacccccgccagagacggccccugcggcaccgugcugaccagaaacgagacccacgccaccuacagcaacacccuguaccuggccgacgagaucaucaucagagaccugaacaucaagaucaacuucgccugcagcuacccccuggacaugaaggugagccugaagaccgcccugcagcccauggugagcgcccugaacaucagagugggcggcaccggcauguucaccgugagaauggcccuguuccagacccccagcuacacccagcccuaccagggcagcagcgugacccugagcaccgaggccuuccuguacgugggcaccaugcuggacggcggcgaccugagcagauucgcccugcugaugaccaacugcuacgccacccccagcagcaacgccaccgacccccugaaguacuucaucauccaggacagaugcccccacaccagagacagcaccauccaggugguggagaacggcgagagcagccagggcagauucagcgugcagauguucagauucgccggcaacuacgaccugguguaccugcacugcgagguguaccugugcgacaccaugaacgagaagugcaagcccaccugcagcggcaccagauucagaagcggcagcgugaucgaccagagcagagugcugaaccugggccccaucaccagaaagggcgugcaggccaccgugagcagagccuucagcagccugggccugcugaagguguggcugccccugcugcugagcgccacccugacccugaccuuccaguaa

SEQ ID NO: 25389 - RNA, 3957 nt, Artificial Sequence
  UMODL1__Homo_sapiens__NP_001004416
augcugagaaccagcggccuggcccugcuggcccuggugagcgccgugggccccagccaggccagcggcuucaccgagaagggccugagccugcugggcuaccagcugugcagccacagagugacccacaccgugcagaagguggaggccgugcagaccagcuacaccagcuacgugagcugcggcggcuggauccccuggagaagaugccccaagaugguguacagaacccaguaccuggugguggaggugcccgagagcagaaacgugaccgacugcugcgagggcuacgagcagcugggccuguacugcgugcugccccugaaccagagcggccaguucaccagcagacccggcgccugccccgccgagggccccgagcccagcaccagccccugcagccuggacaucgacugccccggccuggagaagugcugccccuggagcggcggcagauacugcauggcccccgccccccaggcccccgagagagaccccgugggcagcugguacaacgugaccauccuggugaagauggacuucaaggagcugcagcagguggaccccagacugcugaaccacaugagacugcugcacagccuggugaccagcgcccugcagcccauggccagcaccgugcaccaccugcacagcgcccccggcaacgccagcaccaccgugagcagacugcugcugggccugcccagaccccugcccguggccgacgugagcacccugcugggcgacaucgccaagagaguguacgaggugaucagcgugcaggugcaggacgugaacgagugcuucuacgaggagcugaacgccugcagcggcagagagcugugcgccaaccuggagggcagcuacuggugcgugugccaccaggaggcccccgccaccagccccagaaagcugaaccuggagugggaggacugcccccccgugagcgacuacguggugcugaacgugaccagcgacagcuuccaggugagcuggagacugaacagcacccagaaccacaccuuccacgugagaguguacagaggcauggagcugcugagaagcgccagaacccagagccaggcccuggccguggccggccuggaggccggcgugcuguacagagugaagaccagcuaccagggcugcggcgccgacgugagcaccacccugaccaucaagaccaacgcccagguguucgaggugaccaucaagaucgugaaccacaaccugaccgagaagcugcugaacagaagcagcguggaguaccaggacuucagcagacagcugcugcacgagguggagagcagcuucccccccguggugagcgaccuguacagaagcggcaagcugagaaugcagaucgugagccugcaggccggcagcgugguggugagacugaagcugaccgugcaggaccccggcuuccccaugggcaucagcacccuggcccccauccugcagccccugcuggccagcaccguguuccagaucgacagacagggcaccagagugcaggacugggacgagugcguggacagcgccgagcacgacugcagccccgccgccuggugcaucaaccuggagggcagcuacaccugccagugcagaaccaccagagacgccacccccagcagagccggcagagccugcgagggcgaccuggugagccccaccggcggcggccugagcgccgccaccggcgugaccgugcccggccugggcaccggcaccgccgcccugggccuggagaacuucacccugagccccagccccggcuacccccagggcacccccgccgccggccaggccuggacccccgagcccagccccagaagaggcggcagcaacguggugggcuacgacagaaacaacaccggcaagggcguggagcaggagcugcagggcaacagcaucauggagccccccagcuggcccagccccaccgaggaccccaccggccacuuccuguggcacgccaccagaagcaccagagagacccugcugaaccccaccuggcugagaaacgaggacagcggccccagcggcagcguggaccugccccugaccagcacccugaccgcccugaagacccccgccugcgugcccgugagcaucggcagaaucauggugagcaacgugaccagcaccggcuuccaccuggccugggaggccgaccuggccauggacagcaccuuccagcugacccugaccagcauguggagccccgccguggugcuggagaccuggaacaccagcgugacccugagcggccuggagcccggcgugcugcaccugguggagaucauggccaaggccugcggcaaggagggcgccagagcccaccugaaggugagaaccgccgccagaaagcugaucggcaaggugagaaucaagaacgugagauacagcgagagcuucagaaacgccagcagccaggaguacagagacuuccuggagcuguucuucagaauggugagaggcagccugcccgccaccaugugccagcacauggacgccggcggcgugagaauggagguggugagcgugaccaacggcagcaucgugguggaguuccaccugcugaucaucgccgacguggacgugcaggaggugagcgccgccuuccugaccgccuuccagaccgugccccugcuggaggugaucagaggcgacaccuucauccaggacuacgacgagugcgagagaaaggaggacgacugcgugcccggcaccagcugcagaaacacccugggcagcuucaccugcagcugcgagggcggcgcccccgacuuccccguggaguacagcgagagacccugcgagggcgacagccccggcaacgagaccugggccaccagccccgagagaccccugaccaccgccggcaccaaggccgccuucgugcagggcaccagccccaccccccagggccugccccagagacugaaccugaccggcgccgugagagugcugugcgagaucgagaagguggugguggccauccagaagagauuccugcagcaggagagcauccccgagagcagccuguaccugagccaccccagcugcaacgugagccacagcaacggcacccacgugcugcuggaggccggcuggagcgagugcggcacccugaugcagagcaacaugaccaacaccguggugagaaccacccugagaaacgaccugagccaggagggcaucauccaccaccugaagauccugagccccaucuacugcgccuuccagaacgaccugcugaccagcagcggcuucacccuggaguggggcguguacaccaucaucgaggaccugcacggcgccggcaacuucgugaccgagaugcagcuguucaucggcgacagccccaucccccagaacuacagcgugagcgccagcgacgacgugagaaucgaggugggccuguacagacagaagagcaaccugaagguggugcugaccgagugcugggccacccccagcagcaacgccagagaccccaucaccuucagcuucaucaacaacagcugccccgugcccaacaccuacaccaacgugaucgagaacggcaacagcaacaaggcccaguucaagcugagaaucuucagcuucaucaacgacagcaucguguaccugcacugcaagcugagagugugcauggagagccccggcgccaccugcaagaucaacugcaacaacuucagacugcugcagaacagcgagaccagcgccacccaccagaugagcuggggcccccugaucagaagcgagggcgagcccccccacgccgaggccggccugggcgccggcuacguggugcugaucgugguggccaucuucgugcugguggccggcaccgccacccugcugaucgugagauaccagagaaugaacggcagauacaacuucaagauccagagcaacaacuucagcuaccagguguucuacgaguaa

SEQ ID NO: 25390 - RNA, 1443 nt, Artificial Sequence
  UMPS__Homo_sapiens__NP_000364
auggccguggccagagccgcccugggcccccuggugaccggccuguacgacgugcaggccuucaaguucggcgacuucgugcugaagagcggccugagcagccccaucuacaucgaccugagaggcaucgugagcagacccagacugcugagccagguggccgacauccuguuccagaccgcccagaacgccggcaucagcuucgacaccgugugcggcgugcccuacaccgcccugccccuggccaccgugaucugcagcaccaaccagauccccaugcugaucagaagaaaggagaccaaggacuacggcaccaagagacugguggagggcaccaucaaccccggcgagaccugccugaucaucgaggacguggugaccagcggcagcagcgugcuggagaccguggaggugcugcagaaggagggccugaaggugaccgacgccaucgugcugcuggacagagagcagggcggcaaggacaagcugcaggcccacggcaucagacugcacagcgugugcacccugagcaagaugcuggagauccuggagcagcagaagaagguggacgccgagaccgugggcagagugaagagauucauccaggagaacguguucguggccgccaaccacaacggcagcccccugagcaucaaggaggcccccaaggagcugagcuucggcgccagagccgagcugcccagaauccaccccguggccagcaagcugcugagacugaugcagaagaaggagaccaaccugugccugagcgccgacgugagccuggccagagagcugcugcagcuggccgacgcccugggccccagcaucugcaugcugaagacccacguggacauccugaacgacuucacccuggacgugaugaaggagcugaucacccuggccaagugccacgaguuccugaucuucgaggacagaaaguucgccgacaucggcaacaccgugaagaagcaguacgagggcggcaucuucaagaucgccagcugggccgaccuggugaacgcccacguggugcccggcagcggcguggugaagggccugcaggaggugggccugccccugcacagaggcugccugcugaucgccgagaugagcagcaccggcagccuggccaccggcgacuacaccagagccgccgugagaauggccgaggagcacagcgaguucguggugggcuucaucagcggcagcagagugagcaugaagcccgaguuccugcaccugacccccggcgugcagcuggaggccggcggcgacaaccugggccagcaguacaacagcccccaggaggugaucggcaagagaggcagcgacaucaucaucgugggcagaggcaucaucagcgccgccgacagacuggaggccgccgagauguacagaaaggccgccugggaggccuaccugagcagacugggcguguaa

SEQ ID NO: 25391 - RNA, 723 nt, Artificial Sequence
  UNC119__Homo_sapiens__NP_005139
augaaggugaagaagggcggcggcggcgccggcaccgccaccgagagcgcccccggccccagcggccagagcguggcccccaucccccagccccccgccgagagcgagagcggcagcgagagcgagcccgacgccggccccggccccagacccggcccccugcagagaaagcagcccaucggccccgaggacgugcugggccugcagagaaucaccggcgacuaccugugcagccccgaggagaacaucuacaagaucgacuucgugagauucaagaucagagacauggacagcggcaccgugcuguucgagaucaagaagccccccgugagcgagagacugcccaucaacagaagagaccuggaccccaacgccggcagauucgugagauaccaguucacccccgccuuccugagacugagacaggugggcgccaccguggaguucaccgugggcgacaagcccgugaacaacuucagaaugaucgagagacacuacuucagaaaccagcugcugaagagcuucgacuuccacuucggcuucugcauccccagcagcaagaacaccugcgagcacaucuacgacuuccccccccugagcgaggagcugaucagcgagaugaucagacaccccuacgagacccagagcgacagcuucuacuucguggacgacagacuggugaugcacaacaaggccgacuacagcuacagcggcacccccuaa

SEQ ID NO: 25392 - RNA, 5112 nt, Artificial Sequence
  UNC13A__Homo_sapiens__NP_001073890
augagccugcugugcgugggcgugaagaaggccaaguucgacggcgcccaggagaaguucaacaccuacgugacccugaaggugcagaacgugaagagcaccaccaucgccgugagaggcagccagcccagcugggagcaggacuucauguucgagaucaacagacuggaccugggccugaccguggagguguggaacaagggccugaucugggacaccauggugggcaccguguggaucccccugagaaccaucagacagagcaacgaggagggccccggcgaguggcugacccuggacagccaggugaucauggccgacagcgagaucugcggcaccaaggaccccaccuuccacagaauccugcuggacaccagauucgagcugccccuggacauccccgaggaggaggccagauacugggccaagaagcuggagcagcugaacgccaugagagaccaggacgaguacagcuuccaggacgagcaggacaagccccugcccgugcccagcaaccagugcugcaacuggaacuacuucggcuggggcgagcagcacaacgacgaccccgacagcgccguggacgacagagacagcgacuacagaagcgagaccagcaacagcauccccccccccuacuacaccaccagccagcccaacgccagcgugcaccaguacagcgugagaccccccccccugggcagcagagagagcuacagcgacagcaugcacagcuacgaggaguucagcgagccccaggcccugagccccaccggcagcagcagauacgccagcagcggcgagcugagccagggcagcagccagcugagcgaggacuucgaccccgacgagcacagccugcagggcagcgacauggaggacgagagagacagagacagcuaccacagcugccacagcagcgugagcuaccacaaggacagccccagaugggaccaggacgaggaggagcuggaggaggaccuggaggacuuccuggaggaggaggagcugcccgaggacgaggaggagcuggaggaggaggaggaggaggugcccgacgaccugggcagcuacgcccagagagaggacguggccguggccgagcccaaggacuucaagagaaucagccugccccccgccgcccccggcaaggaggacaaggcccccguggcccccaccgaggcccccgacauggccaagguggcccccaagcccgccacccccgacaaggugcccgccgccgagcagauccccgaggccgagccccccaaggacgaggagagcuucagacccagagaggacgaggagggccaggagggccaggacagcaugagcagagccaaggccaacuggcugagagccuucaacaaggugagaaugcagcugcaggaggccagaggcgagggcgagaugagcaagagccugugguucaagggcggccccggcggcggccugaucaucaucgacagcaugcccgacaucagaaagagaaagcccaucccccuggugagcgaccuggccaugagccuggugcagagcagaaaggccggcaucaccagcgcccuggccagcagcacccugaacaacgaggagcugaagaaccacguguacaagaagacccugcaggcccugaucuaccccaucagcugcaccaccccccacaacuucgagguguggaccgccaccacccccaccuacugcuacgagugcgagggccugcuguggggcaucgccagacagggcaugagaugcaccgagugcggcgugaagugccacgagaagugccaggaccugcugaacgccgacugccugcagagagccgccgagaagagcagcaagcacggcgccgaggacagaacccagaacaucaucauggugcugaaggacagaaugaagaucagagagagaaacaagcccgagaucuucgagcugauccaggagaucuucgccgugaccaagaccgcccacacccagcagaugaaggccgugaagcagagcgugcuggacggcaccagcaaguggagcgccaagaucagcaucaccguggugugcgcccagggccugcaggccaaggacaagaccggcagcagcgaccccuacgugaccgugcaggugggcaagaccaagaagagaaccaagaccaucuacggcaaccugaaccccgugugggaggagaacuuccacuucgagugccacaacagcagcgacagaaucaaggugagagugugggacgaggacgacgacaucaagagcagagugaagcagagauucaagagagagagcgacgacuuccugggccagaccaucaucgaggugagaacccugagcggcgagauggacgugugguacaaccuggacaagagaaccgacaagagcgccgugagcggcgccaucagacugcacaucagcguggagaucaagggcgaggagaagguggcccccuaccacgugcaguacaccugccugcacgagaaccuguuccacuucgugaccgacgugcagaacaacggcguggugaagauccccgacgccaagggcgacgacgccuggaagguguacuacgacgagaccgcccaggagaucguggacgaguucgccaugagauacggcguggagagcaucuaccaggccaugacccacuucgccugccugagcagcaaguacaugugccccggcgugcccgccgugaugagcacccugcuggccaacaucaacgccuacuacgcccacaccaccgccagcaccaacgugagcgccagcgacagauucgccgccagcaacuucggcaaggagagauucgugaagcugcuggaccagcugcacaacagccugagaaucgaccugagcauguacagaaacaacuuccccgccagcagccccgagagacugcaggaccugaagagcaccguggaccugcugaccagcaucaccuucuucagaaugaaggugcaggagcugcagagcccccccagagccagccagguggugaaggacugcgugaaggccugccugaacagcaccuacgaguacaucuucaacaacugccacgagcuguacagcagagaguaccagaccgaccccgccaagaagggcgaggugcugcccgaggagcagggccccagcaucaagaaccuggacuucuggagcaagcugaucacccugaucgugagcaucaucgaggaggacaagaacagcuacacccccugccugaaccaguucccccaggagcugaacgugggcaagaucagcgccgaggugauguggaaccuguucgcccaggacaugaaguacgccauggaggagcacgacaagcacagacugugcaagagcgccgacuacaugaaccugcacuucaaggugaaguggcuguacaacgaguacgugaccgagcugcccgccuucaaggacagagugcccgaguaccccgccugguucgagcccuucgugauccaguggcuggacgagaacgaggaggugagcagagacuuccugcacggcgcccuggagagagacaagaaggacggcuuccagcagaccagcgagcacgcccuguucagcugcagcgugguggacguguucagccagcugaaccagagcuucgagaucaucaagaagcuggagugccccgacccccagaucgugggccacuacaugagaagauucgccaagaccaucagcaacgugcugcugcaguacgccgacaucaucagcaaggacuucgccagcuacugcagcaaggagaaggagaaggugcccugcauccugaugaacaacacccagcagcugagagugcagcuggagaagauguucgaggccaugggcggcaaggagcuggacgccgaggccagcgacauccugaaggagcugcaggugaagcugaacaacgugcuggacgagcugagcagaguguucgccaccagcuuccagccccacaucgaggagugcgugaagcagaugggcgacauccugagccaggugaagggcaccggcaacgugcccgccagcgccugcagcagcguggcccaggacgccgacaacgugcugcagcccaucauggaccugcuggacagcaaccugacccuguucgccaagaucugcgagaagaccgugcugaagagagugcugaaggagcuguggaagcuggugaugaacaccauggagaagaccaucgugcugcccccccugaccgaccagaccaugaucggcaaccugcugagaaagcacggcaagggccuggagaagggcagagugaagcugcccagccacagcgacggcacccagaugaucuucaacgccgccaaggagcugggccagcugagcaagcugaaggaccacauggugagagaggaggccaagagccugacccccaagcagugcgccgugguggagcuggcccuggacaccaucaagcaguacuuccacgccggcggcgugggccugaagaagaccuuccuggagaagagccccgaccugcagagccugagauacgcccugagccuguacacccaggccaccgaccugcugaucaagaccuucgugcagacccagagcgcccagggccugggcguggaggaccccgugggcgaggugagcgugcacguggagcuguucacccaccccggcaccggcgagcacaaggugaccgugaaggugguggccgccaacgaccugaaguggcagaccagcggcaucuucagacccuucaucgaggugaacaucaucggcccccagcugagcgacaagaagagaaaguucgccaccaagagcaagaacaacagcugggcccccaaguacaacgagagcuuccaguucacccugagcgccgacgccggccccgagugcuacgagcugcaggugugcgugaaggacuacugcuucgccagagaggacagaaccgugggccuggccgugcugcagcugagagagcuggcccagagaggcagcgccgccugcuggcugccccugggcagaagaauccacauggacgacaccggccugaccgugcugagaauccugagccagagaagcaacgacgagguggccaaggaguucgugaagcugaagagcgacaccagaagcgccgaggagggcggcgccgcccccgcccccuaa

SEQ ID NO: 25393 - RNA, 4776 nt, Artificial Sequence
  UNC13B__Homo_sapiens__NP_006368
augagccugcugugcgugagagugaagagagccaaguuccagggcagccccgacaaguucaacaccuacgugacccugaaggugcagaacgugaagagcaccaccguggccgugagaggcgaccagcccagcugggagcaggacuucauguucgagaucagcagacuggaccugggccugagcguggagguguggaacaagggccugaucugggacaccauggugggcaccguguggaucgcccugaagaccaucagacagagcgacgaggagggccccggcgaguggagcacccuggaggccgagacccugaugaaggacgacgagaucugcggcaccagaaaccccaccccccacaagauccugcuggacaccagauucgagcugcccuucgacauccccgaggaggaggccagauacuggaccuacaagugggagcagaucaacgcccugggcgccgacaacgaguacagcagccaggaggagagccagagaaagccccugcccaccgccgccgcccagugcagcuucgaggaccccgacagcgccguggacgacagagacagcgacuacagaagcgagaccagcaacagcuuccccccccccuaccacaccgccagccagcccaacgccagcgugcaccaguuccccgugcccgugagaagcccccagcagcugcugcugcagggcagcagcagagacagcugcaacgacagcaugcagagcuacgaccuggacuaccccgagagaagagccaucagccccaccagcagcagcagauacggcagcagcugcaacgugagccagggcagcagccagcugagcgagcuggaccaguaccacgagcaggacgacgaccacagagagaccgacagcauccacagcugccacagcagccacagccugagcagagacggccaggccggcuucggcgagcaggagaagccccuggaggugaccggccaggccgagaaggaggccgccugcgagcccaaggagaugaaggaggacgccaccacccaccccccccccgaccuggugcugcagaaggaccacuuccugggcccccaggagagcuuccccgaggagaacgccagcagccccuucacccaggccagagcccacuggaucagagccgugaccaaggugagacugcagcugcaggagauccccgacgacggcgaccccagccugccccaguggcugcccgagggccccgccggcggccuguacggcaucgacagcaugcccgaccugagaagaaagaagccccugccccuggugagcgaccugagccuggugcagagcagaaaggccggcaucaccagcgccauggccaccagaaccagccugaaggacgaggagcugaagagccacguguacaagaagacccugcaggcccugaucuaccccaucagcugcaccaccccccacaacuucgagguguggaccgccaccacccccaccuacugcuacgagugcgagggccugcuguggggcaucgccagacagggcaugagaugcagcgagugcggcgugaagugccacgagaagugccaggaccugcugaacgccgacugccugcagagagccgccgagaagagcugcaagcacggcgccgaggacagaacccagaacaucaucauggccaugaaggacagaaugaagaucagagagagaaacaagcccgagaucuucgaggugaucagagacguguucaccgugaacaaggccgcccacgugcagcagaugaagaccgugaagcagagcgugcuggacggcaccagcaaguggagcgccaagaucaccaucaccguggugugcgcccagggccugcaggccaaggacaagaccggcagcagcgaccccuacgugaccgugcaggugagcaagaccaagaagagaaccaagaccaucuucggcaaccugaaccccgugugggaggagaaguuccacuucgagugccacaacagcagcgacagaaucaaggugagagugugggacgaggacgacgacaucaagagcagagugaagcagagacugaagagagagagcgacgacuuccugggccagaccaucaucgaggugagaacccugagcggcgagauggacgugugguacaaccuggagaagagaaccgacaagagcgccgugagcggcgccaucagacugcagaucagcguggagaucaagggcgaggagaagguggcccccuaccacgugcaguacaccugccugcacgagaaccuguuccacuaccugaccgacauccagggcagcggcggcgugagaauccccgaggccagaggcgacgacgccuggaagguguacuucgacgagaccgcccaggagaucguggacgaguucgccaugagauacggcaucgagagcaucuaccaggccaugacccacuucgccugccugagcagcaaguacaugugccccggcgugcccgccgugaugagcacccugcuggccaacaucaacgccuacuacgcccacaccaccgccagcaccaacgugagcgccagcgacagauucgccgccagcaacuucggcaaggagagauucgugaagcugcuggaccagcugcacaacagccugagaaucgaccugagcaccuacagaaacaacuuccccgccggcagccccgagagacugcaggaccugaagagcaccguggaccugcugaccagcaucaccuucuucagaaugaaggugcaggagcugcagagcccccccagagccagccagguggugaaggacugcgugaaggccugccugaacagcaccuacgaguacaucuucaacaacugccacgaccuguacagcagacaguaccagcugaagcaggagcugccccccgaggagcagggccccagcaucagaaaccuggacuucuggcccaagcugaucacccugaucgugagcaucaucgaggaggacaagaacagcuacacccccgugcugaaccaguucccccaggagcugaacgugggcaaggugagcgccgaggugauguggcaccuguucgcccaggacaugaaguacgcccuggaggagcacgagaaggaccaccugugcaagagcgccgacuacaugaaccugcacuucaaggugaaguggcugcacaacgaguacgugagagaccugcccgugcugcagggccaggugcccgaguaccccgccugguucgagcaguucgugcugcaguggcuggacgagaacgaggacgugagccuggaguuccugagaggcgcccuggagagagacaagaaggacggcuuccagcagaccagcgagcacgcccuguucagcugcagcgugguggacguguucacccagcugaaccagagcuucgagaucaucagaaagcuggagugccccgaccccagcauccuggcccacuacaugagaagauucgccaagaccaucggcaaggugcugaugcaguacgccgacauccugagcaaggacuuccccgccuacugcaccaaggagaagcugcccugcauccugaugaacaacgugcagcagcugagagugcagcuggagaagauguucgaggccaugggcggcaaggagcuggaccuggaggccgccgacagccugaaggagcugcaggugaagcugaacaccgugcuggacgagcugagcaugguguucggcaacagcuuccaggugagaaucgacgagugcgugagacagauggccgacauccugggccaggugagaggcaccggcaacgccagccccgacgccagagccagcgccgcccaggacgccgacagcgugcugagaccccugauggacuuccuggacggcaaccugacccuguucgccaccgugugcgagaagaccgugcugaagagagugcugaaggagcuguggagaguggugaugaacaccauggagagaaugaucgugcugcccccccugaccgaccagaccggcacccagcugaucuucaccgccgccaaggagcugagccaccugagcaagcugaaggaccacauggugagagaggagaccagaaaccugacccccaagcagugcgccgugcuggaccuggcccuggacaccaucaagcaguacuuccacgccggcggcaacggccugaagaagaccuuccuggagaagagccccgaccugcagagccugagauacgcccugagccuguacacccagaccaccgacacccugaucaagaccuucgugagaagccagaccacccagggcagcggcguggacgaccccgugggcgaggugagcauccagguggaccuguucacccaccccggcaccggcgagcacaaggugaccgugaaggugguggccgccaacgaccugaaguggcagaccgccggcauguucagacccuucguggaggugaccauggugggcccccaccagagcgacaagaagagaaaguucaccaccaagagcaagagcaacaacugggcccccaaguacaacgagaccuuccacuuccugcugggcaacgaggagggccccgagagcuacgagcugcagaucugcgugaaggacuacugcuucgccagagaggacagagugcugggccuggccgugaugccccugagagacgugaccgccaagggcagcugcgccugcuggugcccccugggcagaaagauccacauggacgagaccggccugaccauccugagaauccugagccagagaagcaacgacgagguggccagagaguucgugaagcugaagagcgagagcagaagcaccgaggagggcagcuaa

SEQ ID NO: 25394 - RNA, 6645 nt, Artificial Sequence
  UNC13C__Homo_sapiens__NP_001074003
augguggccaacuucuucaagagccugauccugcccuacauccacaagcugugcaagggcauguucaccaagaagcugggcaacaccaacaagaacaaggaguacagacagcagaagaaggaccaggacuuccccaccgccggccagaccaagagccccaaguucagcuacaccuucaagagcaccgugaagaagaucgccaagugcagcagcacccacaaccugagcaccgaggaggacgaggccagcaaggaguucagccugagccccaccuucagcuacagaguggccaucgccaacggccugcagaagaacgccaaggugaccaacagcgacaacgaggaccugcugcaggagcugagcagcaucgagagcagcuacagcgagagccugaacgagcugagaagcagcaccgagaaccaggcccagagcacccacaccaugcccgugagaagaaacagaaagagcagcagcagccuggcccccagcgagggcagcagcgacggcgagagaacccugcacggccugaagcugggcgcccugagaaagcugagaaaguggaagaagagccaggagugcgugagcagcgacagcgagcugagcaccaugaagaagagcuggggcaucagaagcaagagccuggacagaaccgugagaaaccccaagaccaacgcccuggagcccggcuucagcagcagcggcugcaucagccagacccacgacgugauggagaugaucuucaaggagcugcagggcaucagccagaucgagaccgagcugagcgagcugagaggccacgugaacgcccugaagcacagcaucgacgagaucagcagcagcguggagguggugcagagcgagaucgagcagcugagaaccggcuucgugcagagcagaagagagaccagagacauccacgacuacaucaagcaccugggccacaugggcagcaaggccagccugagauuccugaacgugaccgaggagagauucgaguacguggagagcgugguguaccagauccugaucgacaagaugggcuucagcgacgcccccaacgccaucaagaucgaguucgcccagagaaucggccaccagagagacugccccaacgccaagcccagacccauccugguguacuucgagaccccccagcagagagacagcgugcugaagaagagcuacaagcugaagggcaccggcaucggcaucagcaccgacauccugacccacgacaucagagagagaaaggagaagggcauccccagcagccagaccuacgagagcauggccaucaagcugagcacccccgagcccaagaucaagaagaacaacuggcagagccccgacgacagcgacgaggaccuggagagcgaccugaacagaaacagcuacgccgugcugagcaagagcgagcugcugaccaagggcagcaccagcaagcccagcagcaagagccacagcgccagaagcaagaacaagaccgccaacagcagcagaaucagcaacaagagcgacuacgacaagaucagcagccagcugcccgagagcgacauccuggagaagcagaccaccacccacuacgccgacgccaccccccuguggcacagccagagcgacuucuucaccgccaagcugagcagaagcgagagcgacuucagcaagcugugccagagcuacagcgaggacuucagcgagaaccaguucuucaccagaaccaacggcagcagccugcugagcagcagcgacagagagcuguggcagagaaagcaggagggcaccgccacccuguacgacagccccaaggaccagcaccugaacggcggcgugcagggcauccagggccagaccgagaccgagaacaccgagaccguggacagcggcaugagcaacggcauggugugcgccagcggcgacagaagccacuacagcgacagccagcugagccugcacgaggaccugagccccuggaaggaguggaaccagggcgccgaccugggccuggacagcagcacccaggagggcuucgacuacgagaccaacagccuguucgaccagcagcuggacguguacaacaaggaccuggaguaccugggcaagugccacagcgaccugcaggacgacagcgagagcuacgaccugacccaggacgacaacagcagccccugccccggccuggacaacgagccccagggccagugggugggccaguacgacagcuaccagggcgccaacagcaacgagcuguaccagaaccagaaccagcugagcaugauguacagaagccagagcgagcugcagagcgacgacagcgaggacgccccccccaagagcuggcacagcagacugagcaucgaccugagcgacaagaccuucagcuuccccaaguucggcagcacccugcagagagccaagagcgcccuggaggugguguggaacaagagcacccagagccugagcggcuacgaggacagcggcagcagccugaugggcagauucagaacccugagccagagcaccgccaacgagagcagcaccacccuggacagcgacguguacaccgagcccuacuacuacaaggccgaggacgaggaggacuacaccgagcccguggccgacaacgagaccgacuacguggaggugauggagcaggugcuggccaagcuggagaacagaaccagcaucaccgagaccgacgagcagaugcaggccuacgaccaccugagcuacgagacccccuacgagaccccccaggacgagggcuacgacggccccgccgacgacauggugagcgaggagggccuggagccccugaacgagaccagcgccgagauggagaucagagaggacgagaaccagaacauccccgagcagcccguggagaucaccaagcccaagagaaucagacccagcuucaaggaggccgcccugagagccuacaagaagcagauggccgagcuggaggagaagauccuggccggcgacagcagcagcguggacgagaaggccagaaucgugagcggcaacgaccuggacgccagcaaguucagcgcccugcaggugugcggcggcgccggcggcggccuguacggcaucgacagcaugcccgaccugagaagaaagaagacccugcccaucgugagagacguggccaugacccuggccgccagaaagagcggccugagccuggccauggugaucagaaccagccugaacaacgaggagcugaagaugcacguguucaagaagacccugcaggcccugaucuaccccaugagcagcaccaucccccacaacuucgagguguggaccgccaccacccccaccuacugcuacgagugcgagggccugcuguggggcaucgccagacagggcaugaagugccuggagugcggcgugaagugccacgagaagugccaggaccugcugaacgccgacugccugcagagagccgccgagaagagcagcaagcacggcgccgaggacaagacccagaccaucaucaccgccaugaaggagagaaugaagaucagagagaagaacagacccgagguguucgaggugauccaggagauguuccagaucagcaaggaggacuucgugcaguucaccaaggccgccaagcagagcgugcuggacggcaccagcaaguggagcgccaagaucaccaucaccguggugagcgcccagggccugcaggccaaggacaagaccggcagcagcgaccccuacgugaccgugcaggugggcaagaacaagagaagaaccaagaccaucuucggcaaccugaaccccgugugggacgagaaguucuacuucgagugccacaacagcaccgacagaaucaaggugagagugugggacgaggacgacgacaucaagagcagagugaagcagcacuucaagaaggagagcgacgacuuccugggccagaccaucguggaggugagaacccugagcggcgagauggacgugugguacaaccuggagaagagaaccgacaagagcgccgugagcggcgccaucagacugaagaucaacguggagaucaagggcgaggagaagguggcccccuaccacauccaguacaccugccugcacgagaaccuguuccacuaccugaccgaggugaagagcaacggcggcgugaagauccccgaggugaagggcgacgaggccuggaagguguucuucgacgacgccagccaggagaucguggacgaguucgccaugagauacggcaucgagagcaucuaccaggccaugacccacuucagcugccugagcagcaaguacaugugccccggcgugcccgccgugaugagcacccugcuggccaacaucaacgccuucuacgcccacaccaccgugagcaccaacauccaggugagcgccagcgacagauucgccgccaccaacuucggcagagagaaguucaucaagcugcuggaccagcugcacaacagccugagaaucgaccugagcaaguacagagagaacuuccccgccagcaacaccgagagacugcaggaccugaagagcaccguggaccugcugaccagcaucaccuucuucagaaugaaggugcuggagcugcagagcccccccaaggccagcaugguggugaaggacugcgugagagccugccuggacagcaccuacaaguacaucuucgacaacugccacgagcuguacagccagcugaccgaccccagcaagaagcaggacauccccagagaggaccagggccccaccaccaagaaccuggacuucuggccccagcugaucacccugauggugaccaucaucgacgaggacaagaccgccuacacccccgugcugaaccaguucccccaggagcugaacaugggcaagaucagcgccgagaucauguggacccuguucgcccuggacaugaaguacgcccuggaggagcacgagaaccagagacugugcaagagcaccgacuacaugaaccugcacuucaaggugaagugguucuacaacgaguacgugagagagcugcccgccuucaaggacgccgugcccgaguacagccugugguucgagcccuucgugaugcaguggcuggacgagaacgaggacgugagcauggaguuccugcacggcgcccugggcagagacaagaaggacggcuuccagcagaccagcgagcacgcccuguucagcugcagcgugguggacguguucgcccagcugaaccagagcuucgagaucaucaagaagcuggagugccccaaccccgaggcccugagccaccugaugagaagauucgccaagaccaucaacaaggugcugcugcaguacgccgccaucgugagcagcgacuucagcagccacugcgacaaggagaacgugcccugcauccugaugaacaacauccagcagcugagagugcagcuggagaagauguucgagagcaugggcggcaaggagcuggacagcgaggccagcaccauccugaaggagcugcaggugaagcugagcggcgugcuggacgagcugagcgugaccuacggcgagagcuuccaggugaucaucgaggagugcaucaagcagaugagcuucgagcugaaccagaugagagccaacggcaacaccaccagcaacaagaacagcgccgccauggacgccgagaucgugcugagaagccugauggacuuccuggacaagacccugagccugagcgccaagaucugcgagaagaccgugcugaagagagugcugaaggagcuguggaagcuggugcugaacaagaucgagaagcagaucgugcugcccccccugaccgaccagaccggcccccagaugaucuucaucgccgccaaggaccugggccagcugagcaagcugaaggagcacaugaucagagaggacgccagaggccugacccccagacagugcgccaucauggagguggugcuggccaccaucaagcaguacuuccacgccggcggcaacggccugaagaagaacuuccuggagaagagccccgaccugcagagccugagauacgcccugagccuguacacccagaccaccgacgcccugaucaagaaguucaucgacacccagaccagccagagcagaagcagcaaggacgccgugggccagaucagcgugcacguggacaucaccgccacccccggcaccggcgaccacaaggugaccgugaaggugaucgccaucaacgaccugaacuggcagaccaccgccauguucagacccuucguggaggugugcauccugggccccaaccugggcgacaagaagagaaagcagggcaccaagaccaagagcaacaccuggagccccaaguacaacgagaccuuccaguucauccugggcaaggagaacagacccggcgccuacgagcugcaccugagcgugaaggacuacugcuucgccagagaggacagaaucaucggcaugaccgugauccagcugcagaacaucgccgagaagggcagcuacggcgccugguacccccugcugaagaacaucagcauggacgagaccggccugaccauccugagaauccugagccagagaaccagcgacgacguggccaaggaguucgugagacugaagagcgagaccagaagcaccgaggagagcgccuaa

SEQ ID NO: 25395 - RNA, 3273 nt, Artificial Sequence
  UNC13D__Homo_sapiens__NP_954712
auggccacccugcugagccacccccagcagagaccccccuuccugagacaggccaucaagaucagaagaagaagagugagagaccugcaggacccccccccccagauggcccccgagauccagccccccagccaccacuucagccccgagcagagagcccugcuguacgaggacgcccuguacaccgugcugcacagacugggccaccccgagcccaaccacgugaccgaggccagcgagcugcugagauaccugcaggaggccuuccacguggagcccgaggagcaccagcagacccugcagagagugagagagcuggagaagcccaucuucugccugaaggccaccgugaagcaggccaagggcauccugggcaaggacgugagcggcuucagcgaccccuacugccugcugggcaucgagcagggcgugggcgugcccggcggcagccccggcagcagacacagacagaaggccguggugagacacaccauccccgaggaggagacccacagaacccaggugaucacccagacccugaaccccgugugggacgagaccuucauccuggaguucgaggacaucaccaacgccagcuuccaccuggacaugugggaccuggacaccguggagagcgugagacagaagcugggcgagcugaccgaccugcacggccugagaagaaucuucaaggaggccagaaaggacaagggccaggacgacuuccugggcaacguggugcugagacugcaggaccugagaugcagagaggaccagugguacccccuggagcccagaaccgagaccuaccccgacagaggccagugccaccugcaguuccagcugauccacaagagaagagccaccagcgccagcagaagccagcccagcuacaccgugcaccugcaccugcugcagcagcuggugagccacgaggugacccagcacgaggccggcagcaccagcugggacggcagccugagcccccaggccgccaccgugcuguuccugcacgccacccagaaggaccugagcgacuuccaccagagcauggcccaguggcuggccuacagcagacuguaccagagccuggaguuccccagcagcugccugcugcaccccaucaccagcaucgaguaccaguggauccagggcagacugaaggccgagcagcaggaggagcuggccgccagcuucagcagccugcugaccuacggccugagccugaucagaagauucagaagcguguucccccugagcgugagcgacagccccgccagacugcagagccugcugagagugcuggugcagaugugcaagaugaaggccuucggcgagcugugccccaacaccgccccccugccccagcuggugaccgaggcccugcagaccggcaccaccgagugguuccaccugaagcagcagcaccaccagcccauggugcagggcauccccgaggccggcaaggcccugcugggccuggugcaggacgugaucggcgaccugcaccagugccagagaaccugggacaagaucuuccacaacacccugaagauccaccuguucagcauggccuucagagagcugcaguggcugguggccaagagagugcaggaccacaccaccguggugggcgacguggugagccccgagaugggcgagagccuguuccagcuguacaucagccugaaggagcugugccagcugagaaugagcagcagcgagagagacggcgugcuggcccuggacaacuuccacagaugguuccagcccgccauccccagcuggcugcagaagaccuacaacgaggcccuggccagagugcagagagccgugcagauggacgagcuggugccccugggcgagcugaccaagcacagcaccagcgccguggaccugagcaccugcuucgcccagaucagccacaccgccagacagcuggacuggcccgaccccgaggaggccuucaugaucaccgugaaguucguggaggacaccugcagacuggcccugguguacugcagccugaucaaggccagagccagagagcugagcagcggccagaaggaccagggccaggccgccaacaugcugugcgugguggugaacgacauggagcagcugagacuggugaucggcaagcugcccgcccagcuggccugggaggcccuggagcagagagugggcgccgugcuggagcagggccagcugcagaacacccugcacgcccagcugcagagcgcccuggccggccugggccacgagaucagaaccggcgugagaacccuggccgagcagcuggaggugggcaucgccaagcacauccagaagcuggugggcgugagagagagcgugcugcccgaggacgccauccugccccugaugaaguuccuggagguggagcugugcuacaugaacaccaaccuggugcaggagaacuucagcagccugcugacccugcuguggacccacacccugaccgugcugguggaggccgccgccagccagagaagcagcagccuggccagcaacagacugaagaucgcccugcagaaccuggagaucugcuuccacgccgagggcugcggccugccccccaaggcccugcacaccgccaccuuccaggcccugcagagagaccuggagcugcaggccgccagcagcagagagcugaucagaaaguacuucugcagcagaauccagcagcaggccgagaccaccagcgaggagcugggcgccgugaccgugaaggccagcuacagagccagcgagcagaagcugagaguggagcugcugagcgccagcagccugcugccccuggacagcaacggcagcagcgaccccuucgugcagcugacccuggagcccagacacgaguuccccgagcuggccgccagagagacccagaagcacaagaaggaccugcacccccuguucgacgagaccuucgaguuccuggugcccgccgagcccugcagaaaggccggcgccugccugcugcugaccgugcuggacuacgacacccugggcgccgacgaccuggagggcgaggccuuccugccccugagagaggugcccggccugagcggcagcgaggagcccggcgaggugccccagaccagacugccccugaccuaccccgcccccaacggcgaccccauccugcagcugcuggagggcagaaagggcgacagagaggcccagguguucgugagacugagaagacacagagccaagcaggccagccagcacgcccugagacccgcccccuaa

SEQ ID NO: 25396 - RNA, 2790 nt, Artificial Sequence
  UNC45A__Homo_sapiens__NP_001034764
augaccgccagcagcguggagcagcugagaaaggagggcaacgagcuguucaagugcggcgacuacggcggcgcccuggccgccuacacccaggcccugggccuggacgccaccccccaggaccaggccgugcugcacagaaacagagccgccugccaccugaagcuggaggacuacgacaaggccgagaccgaggccagcaaggccaucgagaaggacggcggcgacgugaaggcccuguacagaagaagccaggcccuggagaagcugggcagacuggaccaggccgugcuggaccugcagagaugcgugagccuggagcccaagaacaagguguuccaggaggcccugagaaacaucggcggccagauccaggagaaggugagauacaugagcagcaccgacgccaagguggagcagauguuccagauccugcuggaccccgaggagaagggcaccgagaagaagcagaaggccagccagaaccugguggugcuggccagagaggacgccggcgccgagaagaucuucagaagcaacggcgugcagcugcugcagagacugcuggacaugggcgagaccgaccugaugcuggccgcccugagaacccuggugggcaucugcagcgagcaccagagcagaaccguggccacccugagcauccugggcaccagaagaguggugagcauccugggcguggagagccaggccgugagccuggccgccugccaccugcugcaggugauguucgacgcccugaaggagggcgugaagaagggcuucagaggcaaggagggcgccaucaucguggaccccgccagagagcugaaggugcugaucagcaaccugcuggaccugcugaccgaggugggcgugagcggccagggcagagacaacgcccugacccugcugaucaaggccgugcccagaaagagccugaaggaccccaacaacagccugacccugugggugaucgaccagggccugaagaagauccuggaggugggcggcagccugcaggacccccccggcgagcuggccgugaccgccaacagcagaaugagcgccagcauccugcugagcaagcuguucgacgaccugaagugcgacgccgagagagagaacuuccacagacugugcgagaacuacaucaagagcugguucgagggccagggccuggccggcaagcugagagccauccagaccgugagcugccugcugcagggccccugcgacgccggcaacagagcccuggagcugagcggcgugauggagagcgugaucgcccugugcgccagcgagcaggaggaggagcagcugguggccguggaggcccugauccacgccgccggcaaggccaagagagccagcuucaucaccgccaacggcgugagccugcugaaggaccuguacaagugcagcgagaaggacagcaucagaaucagagcccuggugggccugugcaagcugggcagcgccggcggcaccgacuucagcaugaagcaguucgccgagggcagcacccugaagcuggccaagcagugcagaaaguggcugugcaacgaccagaucgacgccggcaccagaagaugggccguggagggccuggccuaccugaccuucgacgccgacgugaaggaggaguucguggaggacgccgccgcccugaaggcccuguuccagcugagcagacuggaggagagaagcgugcuguucgccguggccagcgcccuggugaacugcaccaacagcuacgacuacgaggagcccgaccccaagaugguggagcuggccaaguacgccaagcagcacgugcccgagcagcaccccaaggacaagcccagcuucgugagagccagagugaagaagcugcuggccgccggcguggugagcgccauggugugcauggugaagaccgagagccccgugcugaccagcagcugcagagagcugcugagcagaguguuccuggcccugguggaggagguggaggacagaggcaccgugguggcccagggcggcggcagagcccugaucccccuggcccuggagggcaccgacgugggccagaccaaggccgcccaggcccuggccaagcugaccaucaccagcaaccccgagaugaccuuccccggcgagagaaucuacgagguggugagaccccuggugagccugcugcaccugaacugcagcggccugcagaacuucgaggcccugauggcccugaccaaccuggccggcaucagcgagagacugagacagaagauccugaaggagaaggccgugcccaugaucgagggcuacauguucgaggagcacgagaugaucagaagagccgccaccgagugcaugugcaaccuggccaugagcaaggaggugcaggaccuguucgaggcccagggcaacgacagacugaagcugcuggugcuguacagcggcgaggacgacgagcugcugcagagagccgccgccggcggccuggccaugcugaccagcaugagacccacccugugcagcagaaucccccaggugaccacccacuggcuggagauccugcaggcccugcugcugagcagcaaccaggagcugcagcacagaggcgccgugguggugcugaacaugguggaggccagcagagagaucgccagcacccugauggagagcgagaugauggagauccugagcgugcuggccaagggcgaccacagccccgugaccagagccgccgccgccugccuggacaaggccguggaguacggccugauccagcccaaccaggacggcgaguaa

SEQ ID NO: 25397 - RNA, 2790 nt, Artificial Sequence
  UNC45B__Homo_sapiens__NP_001253981
auggccgagguggaggccgugcagcugaaggaggagggcaacagacacuuccagcugcaggacuacaaggccgccaccaacagcuacagccaggcccugaagcugaccaaggacaaggcccugcuggccacccuguacagaaacagagccgccugcggccugaagaccgagagcuacgugcaggccgccagcgacgccagcagagccaucgacaucaacagcagcgacaucaaggcccuguacagaagaugccaggcccuggagcaccugggcaagcuggaccaggccuucaaggacgugcagagaugcgccacccuggagcccagaaaccagaacuuccaggagaugcugagaagacugaacaccagcauccaggagaagcugagagugcaguucagcaccgacagcagagugcagaagauguucgagauccugcuggacgagaacagcgaggccgacaagagagagaaggccgccaacaaccugaucgugcugggcagagaggaggccggcgccgagaagaucuuccagaacaacggcguggcccugcugcugcagcugcuggacaccaagaagcccgagcuggugcuggccgccgugagaacccugagcggcaugugcagcggccaccaggccagagccaccgugauccugcacgccgugagaaucgacagaaucugcagccugauggccguggagaacgaggagaugagccuggccgugugcaaccugcugcaggccaucaucgacagccugagcggcgaggacaagagagagcacagaggcaaggaggaggcccuggugcuggacaccaagaaggaccugaagcagaucaccagccaccugcuggacaugcuggugagcaagaaggugagcggccagggcagagaccaggcccugaaccugcugaacaagaacgugcccagaaaggaccuggccauccacgacaacagcagaaccaucuacgugguggacaacggccugagaaagauccugaagguggugggccaggugcccgaccugcccagcugccugccccugaccgacaacaccagaaugcuggccagcauccugaucaacaagcuguacgacgaccugagaugcgaccccgagagagaccacuucagaaagaucugcgaggaguacaucaccggcaaguucgacccccaggacauggacaagaaccugaacgccauccagaccgugagcggcauccugcagggccccuucgaccugggcaaccagcugcugggccugaagggcgugauggagaugaugguggcccugugcggcagcgagagagagaccgaccagcugguggccguggaggcccugauccacgccagcaccaagcugagcagagccaccuucaucaucaccaacggcgugagccugcugaagcagaucuacaagaccaccaagaacgagaagaucaagaucagaacccuggugggccugugcaagcugggcagcgccggcggcaccgacuacggccugagacaguucgccgagggcagcaccgagaagcuggccaagcagugcagaaaguggcugugcaacaugagcaucgacaccagaaccagaagaugggccguggagggccuggccuaccugacccuggacgccgacgugaaggacgacuucgugcaggacgugcccgcccugcaggccauguucgagcuggccaagaccagcgacaagaccauccuguacagcguggccaccacccuggugaacugcaccaacagcuacgacgugaaggaggugauccccgagcuggugcagcuggccaaguucagcaagcagcacgugcccgaggagcaccccaaggacaagaaggacuucaucgacaugagagugaagagacugcugaaggccggcgugaucagcgcccuggccugcauggugaaggccgacagcgccauccugaccgaccagaccaaggagcugcuggccagaguguuccuggcccugugcgacaaccccaaggacagaggcaccaucguggcccagggcggcggcaaggcccugaucccccuggcccuggagggcaccgacgugggcaaggugaaggccgcccacgcccuggccaagaucgccgccgugagcaaccccgacaucgccuuccccggcgagagaguguacgagguggugagaccccuggugagacugcuggacacccagagagacggccugcagaacuacgaggcccugcugggccugaccaaccugagcggcagaagcgacaagcugagacagaagaucuucaaggagagagcccugcccgacaucgagaacuacauguucgagaaccacgaccagcugagacaggccgccaccgagugcaugugcaacauggugcugcacaaggaggugcaggagagauuccuggccgacggcaacgacagacugaagcugguggugcugcugugcggcgaggacgacgacaaggugcagaacgccgccgccggcgcccuggccaugcugaccgccgcccacaagaagcugugccugaagaugacccaggugaccacccaguggcuggagauccugcagagacugugccugcacgaccagcugagcgugcagcacagaggccuggugaucgccuacaaccugcuggccgccgacgccgagcuggccaagaagcugguggagagcgagcugcuggagauccugaccguggugggcaagcaggagcccgacgagaagaaggccgagguggugcagaccgccagagagugccugaucaagugcauggacuacggcuucaucaagcccgugagcuaa

SEQ ID NO: 25398 - RNA, 2529 nt, Artificial Sequence
  UNC5A__Homo_sapiens__NP_588610
auggccgugagacccggccuguggcccgcccugcugggcaucgugcuggccgccuggcugagaggcagcggcgcccagcagagcgccaccguggccaaccccgugcccggcgccaaccccgaccugcugccccacuuccugguggagcccgaggacguguacaucgugaagaacaagcccgugcugcuggugugcaaggccgugcccgccacccagaucuucuucaagugcaacggcgagugggugagacagguggaccacgugaucgagagaagcaccgacggcagcagcggccugcccaccauggaggugagaaucaacgugagcagacagcagguggagaagguguucggccuggaggaguacuggugccagugcguggccuggagcagcagcggcaccaccaagagccagaaggccuacaucagaaucgccuaccugagaaagaacuucgagcaggagccccuggccaaggaggugagccuggagcagggcaucgugcugcccugcagaccccccgagggcaucccccccgccgagguggaguggcugagaaacgaggaccugguggaccccagccuggaccccaacguguacaucaccagagagcacagccugguggugagacaggccagacuggccgacaccgccaacuacaccugcguggccaagaacaucguggccagaagaagaagcgccagcgccgccgugaucguguacguggacggcagcuggagccccuggagcaaguggagcgccugcggccuggacugcacccacuggagaagcagagagugcagcgaccccgcccccagaaacggcggcgaggagugccagggcaccgaccuggacaccagaaacugcaccagcgaccugugcgugcacaccgccagcggccccgaggacguggcccuguacgugggccugaucgccguggccgugugccuggugcugcugcugcuggugcugauccugguguacugcagaaagaaggagggccuggacagcgacguggccgacagcagcauccugaccagcggcuuccagcccgugagcaucaagcccagcaaggccgacaacccccaccugcugaccauccagcccgaccugagcaccaccaccaccaccuaccagggcagccugugccccagacaggacggccccagccccaaguuccagcugaccaacggccaccugcugagcccccugggcggcggcagacacacccugcaccacagcagccccaccagcgaggccgaggaguucgugagcagacugagcacccagaacuacuucagaagccugcccagaggcaccagcaacaugaccuacggcaccuucaacuuccugggcggcagacugaugauccccaacaccggcaucagccugcugaucccccccgacgccauccccagaggcaagaucuacgagaucuaccugacccugcacaagcccgaggacgugagacugccccuggccggcugccagacccugcugagccccaucgugagcugcggcccccccggcgugcugcugaccagacccgugauccuggccauggaccacugcggcgagcccagccccgacagcuggagccugagacugaagaagcagagcugcgagggcagcugggaggacgugcugcaccugggcgaggaggcccccagccaccuguacuacugccagcuggaggccagcgccugcuacguguucaccgagcagcugggcagauucgcccuggugggcgaggcccugagcguggccgccgccaagagacugaagcugcugcuguucgcccccguggccugcaccagccuggaguacaacaucagaguguacugccugcacgacacccacgacgcccugaaggagguggugcagcuggagaagcagcugggcggccagcugauccaggagcccagagugcugcacuucaaggacagcuaccacaaccugagacugagcauccacgacgugcccagcagccuguggaagagcaagcugcuggugagcuaccaggagauccccuucuaccacaucuggaacggcacccagagauaccugcacugcaccuucacccuggagagagugagccccagcaccagcgaccuggccugcaagcuguggguguggcagguggagggcgacggccagagcuucagcaucaacuucaacaucaccaaggacaccagauucgccgagcugcuggcccuggagagcgaggccggcgugcccgcccuggugggccccagcgccuucaagauccccuuccugaucagacagaagaucaucagcagccuggacccccccugcagaagaggcgccgacuggagaacccuggcccagaagcugcaccuggacagccaccugagcuucuucgccagcaagcccagccccaccgccaugauccugaaccugugggaggccagacacuuccccaacggcaaccugagccagcuggccgccgccguggccggccugggccagcccgacgccggccuguucaccgugagcgaggccgagugcuaa

SEQ ID NO: 25399 - RNA, 2805 nt, Artificial Sequence
  UNC5B__Homo_sapiens__NP_001231818
augggcgccagaagcggcgccagaggcgcccugcugcuggcccugcugcugugcugggaccccagacugagccaggccggcaccgacagcggcagcgaggugcugcccgacagcuuccccagcgcccccgccgagccccugcccuacuuccugcaggagccccaggacgccuacaucgugaagaacaagcccguggagcugagaugcagagccuuccccgccacccagaucuacuucaagugcaacggcgagugggugagccagaacgaccacgugacccaggagggccuggacgaggccaccggccugagagugagagaggugcagaucgaggugagcagacagcagguggaggagcuguucggccuggaggacuacuggugccagugcguggccuggagcagcgccggcaccaccaagagcagaagagccuacgugagaaucgccuaccugagaaagaacuucgaccaggagccccugggcaaggaggugccccuggaccacgaggugcugcugcagugcagaccccccgagggcgugcccguggccgagguggaguggcugaagaacgaggacgugaucgaccccacccaggacaccaacuuccugcugaccaucgaccacaaccugaucaucagacaggccagacugagcgacaccgccaacuacaccugcguggccaagaacaucguggccaagagaagaagcaccaccgccaccgugaucguguacgugaacggcggcuggagcagcugggccgaguggagccccugcagcaacagaugcggcagaggcuggcagaagagaaccagaaccugcaccaaccccgccccccugaacggcggcgccuucugcgagggccaggccuuccagaagaccgccugcaccaccaucugccccguggacggcgccuggaccgaguggagcaaguggagcgccugcagcaccgagugcgcccacuggagaagcagagagugcauggccccccccccccagaacggcggcagagacugcagcggcacccugcuggacagcaagaacugcaccgacggccugugcaugcagaugcuggaggccagcggcgacgccgcccuguacgccggccuggugguggccaucuucguggugguggccauccugauggccgugggcguggugguguacagaagaaacugcagagacuucgacaccgacaucaccgacagcagcgccgcccugaccggcggcuuccaccccgugaacuucaagaccgccagacccagcaacccccagcugcugcaccccagcgugccccccgaccugaccgccagcgccggcaucuacagaggccccguguacgcccugcaggacagcaccgacaagauccccaugaccaacagcccccugcuggacccccugcccagccugaaggugaagguguacagcagcagcaccaccggcagcggccccggccuggccgacggcgccgaccugcugggcgugcugccccccggcaccuaccccagcgacuucgccagagacacccacuuccugcaccugagaagcgccagccugggcagccagcagcugcugggccugcccagagaccccggcagcagcgugagcggcaccuucggcugccugggcggcagacugagcauccccggcaccggcgugagccugcuggugcccaacggcgccaucccccagggcaaguucuacgagauguaccugcugaucaacaaggccgagagcacccugccccugagcgagggcacccagaccgugcugagccccagcgugaccugcggccccaccggccugcugcugugcagacccgugauccugaccaugccccacugcgccgaggugagcgccagagacuggaucuuccagcugaagacccaggcccaccagggccacugggaggagguggugacccuggacgaggagacccugaacacccccugcuacugccagcuggagcccagagccugccacauccugcuggaccagcugggcaccuacguguucaccggcgagagcuacagcagaagcgccgugaagagacugcagcuggccguguucgcccccgcccugugcaccagccuggaguacagccugagaguguacugccuggaggacacccccguggcccugaaggaggugcuggagcuggagagaacccugggcggcuaccugguggaggagcccaagccccugauguucaaggacagcuaccacaaccugagacugagccugcacgaccugccccacgcccacuggagaagcaagcugcuggccaaguaccaggagauccccuucuaccacaucuggagcggcagccagaaggcccugcacugcaccuucacccuggagagacacagccuggccagcaccgagcugaccugcaagaucugcgugagacagguggagggcgagggccagaucuuccagcugcacaccacccuggccgagacccccgccggcagccuggacacccugugcagcgcccccggcagcaccgugaccacccagcugggccccuacgccuucaagaucccccugagcaucagacagaagaucugcaacagccuggacgcccccaacagcagaggcaacgacuggagaaugcuggcccagaagcugagcauggacagauaccugaacuacuucgccaccaaggccagccccaccggcgugauccuggaccugugggaggcccugcagcaggacgacggcgaccugaacagccuggccagcgcccuggaggagaugggcaagagcgagaugcugguggccguggccaccgacggcgacugcuaa

SEQ ID NO: 25400 - RNA, 2796 nt, Artificial Sequence
  UNC5C__Homo_sapiens__NP_003719
augagaaagggccugagagccaccgccgccagaugcggccugggccugggcuaccugcugcagaugcuggugcugcccgcccuggcccugcugagcgccagcggcaccggcagcgccgcccaggacgacgacuucuuccacgagcugcccgagaccuuccccagcgacccccccgagccccugccccacuuccugaucgagcccgaggaggccuacaucgugaagaacaagcccgugaaccuguacugcaaggccagccccgccacccagaucuacuucaagugcaacagcgagugggugcaccagaaggaccacaucguggacgagagaguggacgagaccagcggccugaucgugagagaggugagcaucgagaucagcagacagcagguggaggagcuguucggccccgaggacuacuggugccagugcguggccuggagcagcgccggcaccaccaagagcagaaaggccuacgugagaaucgccuaccugagaaagaccuucgagcaggagccccugggcaaggaggugagccuggagcaggaggugcugcugcagugcagaccccccgagggcauccccguggccgagguggaguggcugaagaacgaggacaucaucgaccccguggaggacagaaacuucuacaucaccaucgaccacaaccugaucaucaagcaggccagacugagcgacaccgccaacuacaccugcguggccaagaacaucguggccaagagaaagagcaccaccgccaccgugaucguguacgugaacggcggcuggagcaccuggaccgaguggagcgugugcaacagcagaugcggcagaggcuaccagaagagaaccagaaccugcaccaaccccgccccccugaacggcggcgccuucugcgagggccagagcgugcagaagaucgccugcaccacccugugccccguggacggcagauggacccccuggagcaaguggagcaccugcggcaccgagugcacccacuggagaagaagagagugcaccgcccccgcccccaagaacggcggcaaggacugcgacggccuggugcugcagagcaagaacugcaccgacggccugugcaugcagaccgcccccgacagcgacgacguggcccuguacgugggcaucgugaucgccgugaucgugugccuggccaucagcguggugguggcccuguucguguacagaaagaaccacagagacuucgagagcgacaucaucgacagcagcgcccugaacggcggcuuccagcccgugaacaucaaggccgccagacaggaccugcuggccgugccccccgaccugaccagcgccgccgccauguacagaggccccguguacgcccugcacgacgugagcgacaagauccccaugaccaacagccccauccuggacccccugcccaaccugaagaucaagguguacaacaccagcggcgccgugaccccccaggacgaccugagcgaguucaccagcaagcugagcccccagaugacccagagccugcuggagaacgaggcccugagccugaagaaccagagccuggccagacagaccgaccccagcugcaccgccuucggcagcuucaacagccugggcggccaccugaucgugcccaacagcggcgugagccugcugauccccgccggcgccaucccccagggcagaguguacgagauguacgugaccgugcacagaaaggagaccaugagaccccccauggacgacagccagacccugcugacccccguggugagcugcggcccccccggcgcccugcugaccagacccguggugcugaccaugcaccacugcgccgaccccaacaccgaggacuggaagauccugcugaagaaccaggccgcccagggccagugggaggacguggugguggugggcgaggagaacuucaccacccccugcuacauccagcuggacgccgaggccugccacauccugaccgagaaccugagcaccuacgcccuggugggccacagcaccaccaaggccgccgccaagagacugaagcuggccaucuucggcccccugugcugcagcagccuggaguacagcaucagaguguacugccuggacgacacccaggacgcccugaaggagauccugcaccuggagagacagaugggcggccagcugcuggaggagcccaaggcccugcacuucaagggcagcacccacaaccugagacugagcauccacgacaucgcccacagccuguggaagagcaagcugcuggccaaguaccaggagauccccuucuaccacguguggagcggcagccagagaaaccugcacugcaccuucacccuggagagauucagccugaacaccguggagcuggugugcaagcugugcgugagacagguggagggcgagggccagaucuuccagcugaacugcaccgugagcgaggagcccaccggcaucgaccugccccugcuggaccccgccaacaccaucaccaccgugaccggccccagcgccuucagcaucccccugcccaucagacagaagcugugcagcagccuggacgccccccagaccagaggccacgacuggagaaugcuggcccacaagcugaaccuggacagauaccugaacuacuucgccaccaagagcagccccaccggcgugauccuggaccugugggaggcccagaacuuccccgacggcaaccugagcaugcuggccgccgugcuggaggagaugggcagacacgagaccguggugagccuggccgccgagggccaguacuaa

SEQ ID NO: 25401 - RNA, 2862 nt, Artificial Sequence
  UNC5D__Homo_sapiens__NP_543148
augggcagagccgccgccaccgccggcggcggcggcggcgccagaagauggcugcccuggcugggccugugcuucugggccgccggcaccgccgccgccagaggcaccgacaacggcgaggcccugcccgagagcauccccagcgcccccggcacccugccccacuucaucgaggagcccgacgacgccuacaucaucaagagcaaccccaucgcccugagaugcaaggccagacccgccaugcagaucuucuucaagugcaacggcgagugggugcaccagaacgagcacgugagcgaggagacccuggacgagagcagcggccugaaggugagagagguguucaucaacgugaccagacagcagguggaggacuuccacggccccgaggacuacuggugccagugcguggccuggagccaccugggcaccagcaagagcagaaaggccagcgugagaaucgccuaccugagaaagaacuucgagcaggacccccagggcagagaggugcccaucgagggcaugaucgugcugcacugcagaccccccgagggcgugcccgccgccgagguggaguggcugaagaacgaggagcccaucgacagcgagcaggacgagaacaucgacaccagagccgaccacaaccugaucaucagacaggccagacugagcgacagcggcaacuacaccugcauggccgccaacaucguggccaagagaagaagccugagcgccaccguggugguguacgugaacggcggcuggagcagcuggaccgaguggagcgccugcaacgugagaugcggcagaggcuggcagaagagaagcagaaccugcaccaaccccgccccccugaacggcggcgccuucugcgagggcaugagcgugcagaagaucaccugcaccagccugugccccguggacggcagcugggagguguggagcgaguggagcgugugcagccccgagugcgagcaccugagaaucagagagugcaccgcccccccccccagaaacggcggcaaguucugcgagggccugagccaggagagcgagaacugcaccgacggccugugcauccuggacaagaagccccugcacgagaucaagccccagagcaucgagaacgccagcgacaucgcccuguacagcggccugggcgccgccgugguggccguggccgugcuggugaucggcgugacccuguacagaagaagccagagcgacuacggcguggacgugaucgacagcagcgcccugaccggcggcuuccagaccuucaacuucaagaccgugagacagggcaacagccugcugcugaacagcgccaugcagcccgaccugaccgugagcagaaccuacagcggccccaucugccugcaggacccccuggacaaggagcugaugaccgagagcagccuguucaacccccugagcgacaucaaggugaaggugcagagcagcuucauggugagccugggcgugagcgagagagccgaguaccacggcaagaaccacagcagaaccuucccccacggcaacaaccacagcuucagcaccaugcaccccagaaacaagaugcccuacauccagaaccugagcagccugcccaccagaaccgagcugagaaccaccggcguguucggccaccugggcggcagacuggugaugcccaacaccggcgugagccugcugaucccccacggcgccauccccgaggagaacagcugggagaucuacaugagcaucaaccagggcgagcccagccugcagagcgacggcagcgaggugcugcugagccccgaggugaccugcggcccccccgacaugaucgugaccacccccuucgcccugaccaucccccacugcgccgacgugagcagcgagcacuggaacauccaccugaagaagagaacccagcagggcaagugggaggaggugaugagcguggaggacgagagcaccagcugcuacugccugcuggaccccuucgccugccacgugcugcuggacagcuucggcaccuacgcccugaccggcgagcccaucaccgacugcgccgugaagcagcugaagguggccguguucggcugcaugagcugcaacagccuggacuacaaccugagaguguacugcguggacaacacccccugcgccuuccaggagguggugagcgacgagagacaccagggcggccagcugcuggaggagcccaagcugcugcacuucaagggcaacaccuucagccugcagaucagcgugcuggacaucccccccuuccuguggagaaucaagcccuucaccgccugccaggaggugcccuucagcagaguguggugcagcaacagacagccccugcacugcgccuucagccuggagagauacacccccaccaccacccagcugagcugcaagaucugcaucagacagcugaagggccacgagcagauccugcaggugcagaccagcauccuggagagcgagagagagaccaucaccuucuucgcccaggaggacagcaccuuccccgcccagaccggccccaaggccuucaagauccccuacagcaucagacagagaaucugcgccaccuucgacacccccaacgccaagggcaaggacuggcagaugcuggcccagaagaacagcaucaacagaaaccugagcuacuucgccacccagagcagccccagcgccgugauccugaaccugugggaggccagacaccagcacgacggcgaccuggacagccuggccugcgcccuggaggagaucggcagaacccacaccaagcugagcaacaucagcgagagccagcuggacgaggccgacuucaacuacagcagacagaacggccuguaa

SEQ ID NO: 25402 - RNA, 7377 nt, Artificial Sequence
  UNC79__Homo_sapiens__NP_065869
augaucagcacccuggccaccuucccccccuuccugcacaaggacaucaucgaguaccugagcaccagcuuccugcccauggccauccugggcagcagcagaagagagggcgugcccgcccacgugaaccugagcgccagcagcaugcugaugaucgccaugcaguacaccagcaaccccguguaccacugccagcugcuggagugccugaugaaguacaagcaggagguguggaaggaccugcuguacgugaucgccuacggccccagccaggugaagccccccgccgugcagaugcuguuccacuacuggcccaaccugaagccccccggcgccaucagcgaguacagaggccugcaguacaccgccuggaaccccauccacugccagcacaucgagugccacaacgccaucaacaagcccgccgugaagaugugcaucgaccccagccugagcguggcccugggcgacaagccccccccccuguaccugugcgaggagugcagcgagagaaucgccggcgaccacagcgaguggcugaucgacgugcugcugccccaggccgagaucagcgccaucugccagaagaagaacugcagcagccacgugagaagagccguggugaccugcuucagcgccggcugcugcggcagacacggcaacagacccgugagauacugcaagagaugccacagcaaccaccacagcaacgaggugggcgccgccgccgagacccaccuguaccagaccagccccccccccaucaacaccagagagugcggcgccgaggagcuggugugcgccguggaggccgugaucagccugcugaaggaggccgaguuccacgccgagcagagagagcacgagcugaacagaagaagacagcugggccugagcagcagccaccacagccuggacaacgccgacuucgacaacaaggacgacgacaagcacgaccagagacugcugagccaguucggcaucugguuccuggugagccugugcacccccagcgagaacacccccaccgagagccuggccagacugguggccaugguguuccagugguuccacagcaccgccuacaugauggacgacgaggugggcagccugguggagaagcugaagccccaguucgugaccaaguggcugaagaccgugugcgacgugagauucgacgugauggugaugugccugcugcccaagcccauggaguucgccagagugggcggcuacugggacaagagcugcagcaccgugacccagcugaaggagggccugaacagaauccugugccugauccccuacaacgugaucaaccagagcgugugggagugcaucaugcccgaguggcuggaggccaucagaaccgaggugcccgacaaccagcugaaggaguucagagaggugcugagcaagauguucgacaucgagcugugcccccugcccuucagcauggaggagauguucggcuucaucagcugcagauucaccggcuaccccagcagcgugcaggagcaggcccugcuguggcugcacgugcugagcgagcuggacaucauggugccccugcagcugcugaucagcauguucagcgacggcgugaacagcgugaaggagcuggccaaccagagaaagagcagagugagcgagcuggccggcaaccuggccagcagaagagugagcguggccagcgaccccggcagaagagugcagcacaacaugcugagccccuuccacagccccuuccagagccccuucagaagcccccugagaagccccuucagaagccccuucaagaacuucggccaccccggcggcagaaccaucgacuucgacugcgaggacgacgagaugaaccugaacugcuucauccugauguucgaccugcugcugaagcagauggagcugcaggacgacggcaucaccaugggccuggagcacagccugagcaaggacaucaucagcaucaucaacaacguguuccaggcccccuggggcggcagccacaccugccagaaggacgagaaggccaucgagugcaaccugugccagagcagcauccugugcuaccagcuggccugcgagcugcuggagagacuggcccccaaggaggagagcagacugguggagcccaccgacagccuggaggacagccugcugagcagcagacccgaguucaucaucggccccgagggcgaggaggaggagaaccccgccagcaagcacggcgagaaccccggcaacugcaccgagcccguggagcacgccgccgugaagaacgacaccgagagaaaguucugcuaccagcagcugcccgugacccugagacugaucuacaccaucuuccaggagauggccaaguucgaggagcccgacauccuguucaacaugcugaacugccugaagauccugugccugcacggcgagugccuguacaucgccagaaaggaccacccccaguuccuggccuacauccaggaccacaugcugaucgccagccuguggagaguggugaagagcgaguucagccagcugagcagccuggccgugccccugcugcugcacgcccugagccugccccacggcgccgacaucuucuggaccaucaucaacggcaacuucaacagcaaggacuggaagaugagauucgaggccguggagaagguggccgugaucugcagauuccuggacauccacagcgugaccaagaaccaccugcugaaguacagccuggcccacgccuucugcugcuuccugaccgccguggaggacgugaaccccgccguggccaccagagccggccugcugcuggacaccaucaagagacccgcccugcagggccugugccugugccuggacuuccaguucgacaccguggugaaggacagacccaccauccugagcaagcugcugcugcugcacuuccugaagcaggacauccccgcccugagcugggaguucuucgugaacagauucgagacccugagccuggaggcccagcugcaccuggacugcaacaaggaguuccccuuccccaccaccaucaccgccgugagaaccaacguggccaaccugagcgacgccgcccuguggaagaucaagagagccagauucgccagaaacagacagaagagcgugagaagccugagagacagcgugaagggccccguggagagcaagagagcccugagccugcccgagacccugaccagcaagaucagacagcagagccccgagaacgacaacaccaucaaggaccugcugcccgaggacgccggcaucgaccaccagaccgugcaccagcugaucaccgugcugaugaaguucauggccaaggacgagagcagcgccgagagcgacaucagcagcgccaaggccuucaacaccgugaagagacaccuguacgugcugcugggcuacgaccagcaggagggcugcuucaugaucgccccccagaagaugagacugagcaccugcuucaacgccuucaucgccggcaucgcccaggugauggacuacaacaucaaccugggcaagcaccugcugccccugguggugcaggugcugaaguacugcagcugcccccagcugagacacuacuuccagcagccccccagaugcagccuguggagccugaagccccacaucagacagauguggcugaaggcccugcuggugauccuguacaaguaccccuacagagacugcgacaucagcaagauccugcugcaccugauccacaucaccgugaacacccugaacgcccaguaccacagcugcaagccccacgccaccgccggcccccuguacagcgacaacagcaacaucagcagauacagcgagaaggagaagggcgagaucgagcuggccgaguacagagagaccggcgcccugcaggacagccugcugcacugcgugagagaggagagcauccccaagaagaagcugagaagcuucaagcagaagagccuggacaucggcaacgccgacagccugcuguucacccuggacgagcacagaagaaagagcugcaucgacagaugcgacaucgagaagccccccacccaggccgccuacaucgcccagagacccaacgaccccggcagaagcagacagaacagcgccaccagacccgacaacagcgagauccccgagaaccccgccauggagggcuuccccgacgccagaagacccgugauccccgaggugagacugaacugcauggagaccuucgaggugaagguggacagccccgugaagcccgcccccaaggaggaccuggaccugaucgaccugagcagcgacagcaccagcggccccgagaagcacagcauccugagcaccagcgacagcgacagccugguguucgagccccugcccccccugagaaucguggagagcgacgaggaggaggagaccaugaaccagggcgacgacggccccagcggcaagaacgccgccagcagccccagcgugcccagccaccccagcgugcugagccugagcaccgccccccuggugcaggugagcguggaggacugcagcaaggacuucagcagcaaggacagcggcaacaaccagagcgccggcaacaccgacagcgcccugaucacccuggaggaccccauggacgccgagggcagcagcaagcccgaggagcugcccgaguucagcugcggcagcccccugacccugaagcagaagagagaccugcugcagaagagcuucgcccugcccgagaugagccuggacgaccaccccgaccccggcaccgagggcgagaagcccggcgagcugaugcccagcagcggcgccaagaccgugcugcugaaggugcccgaggacgccgagaaccccaccgagagcgagaagcccgacaccagcgccgagagcgacaccgagcagaaccccgagagaaagguggaggaggacggcgccgaggagagcgaguucaagauccagaucgugcccagacagagaaagcagagaaagaucgccgugagcgccauccagagagaguaccuggacaucagcuucaacauccuggacaagcugggcgagcagaaggaccccgaccccagcaccaagggccugagcacccuggagaugcccagagagagcagcagcgcccccacccuggacgccggcgugcccgagaccagcagccacagcagcaucagcacccaguacagacagaugaagagaggcagccugggcgugcugaccaugagccagcugaugaagagacagcuggagcaccagagcagcgccccccacaacaucagcaacugggacaccgagcagauccagcccggcaagagacagugcaacgugcccaccugccugaaccccgaccuggagggccagccccugagaaugagaggcgccaccaagagcagccugcugagcgcccccagcaucgugagcauguucgugcccgcccccgaggaguucaccgacgagcagcccaccgugaugaccgacaagugccacgacugcggcgccauccuggaggaguacgacgaggagacccugggccuggccaucguggugcugagcaccuucauccaccugagccccgaccuggccgccccccugcugcuggacaucaugcagagcgugggcagacuggccagcagcaccaccuucagcaaccaggccgagagcaugauggugcccggcaacgccgccggcguggccaagcaguuccugagaugcaucuuccaccagcuggcccccaacggcaucuucccccagcuguuccagagcaccaucaaggacggcaccuuccugagaacccuggccagcagccugauggacuucaacgagcugagcagcaucgccgcccugagccagcugcuggagggccugaacaacaagaagaaccugcccgccggcggcgccaugaucagaugccuggagaacaucgccaccuucauggaggcccugcccauggacagccccagcagccuguggaccaccaucagcaaccaguuccagaccuucuucgccaagcugcccugcgugcugccccugaagugcagccuggacagcagccugagaaucaugaucugccugcugaagauccccagcaccaacgccaccagaagccugcuggagcccuucagcaagcugcugagcuucgugauccagaacgccguguucacccuggccuaccugguggagcugugcggccugugcuacagagccuucaccaaggagagagacaaguucuaccugagcagaagcguggugcuggagcugcugcaggcccugaagcugaagagcccccugcccgacaccaaccugcugcugcuggugcaguucaucugcgccgacgccggcaccaagcuggccgagagcaccauccugagcaagcagaugaucgccagcgugcccggcugcggcaccgccgccauggagugcgugagacaguacaucaacgaggugcuggacuucauggccgacaugcacacccugaccaagcugaagagccacaugaagaccugcagccagccccugcacgaggacaccuucggcggccaccugaaggugggccuggcccagaucgccgccauggacaucagcagaggcaaccacagagacaacaaggccgugaucagauaccugcccuggcuguaccacccccccagcgccaugcagcagggccccaaggaguucaucgagugcgugagccacaucagacugcugagcuggcugcugcugggcagccugacccacaacgccgugugccccaacgccagcagccccugccugcccaucccccuggacgccggcagccacguggccgaccaccugaucgugauccugaucggcuuccccgagcagagcaagaccagcgugcugcacaugugcagccuguuccacgccuucaucuucgcccagcuguggaccguguacugcgagcagagcgccguggccaccaaccugcagaaccagaacgaguucagcuucaccgccauccugaccgcccuggaguucuggagcagagugacccccagcauccugcagcugauggcccacaacaaggugaugguggagauggugugccugcacgugaucagccugauggaggcccugcaggagugcaacagcaccaucuucgugaagcugauccccauguggcugcccaugauccagagcaacaucaagcaccugagcgccggccugcagcugagacugcaggccauccagaaccacgugaaccaccacagccugagaacccugcccggcagcggccagagcagcgccggccuggccgcccugagaaaguggcugcagugcacccaguucaagauggcccagguggagauccagagcagcgaggccgccagccaguucuacccccuguaa

SEQ ID NO: 25403 - RNA, 1248 nt, Artificial Sequence
  UNC93A__Homo_sapiens__NP_001137419
auggacagaagccugagaaacgugcugguggugagcuucggcuuccugcugcuguucaccgccuacggcggccugcagagccugcagagcagccuguacagcgaggagggccugggcgugaccgcccugagcacccuguacggcggcaugcugcugagcagcauguuccugcccccccugcugaucgagagacugggcugcaagggcaccaucauccugagcaugugcggcuacguggccuucagcgugggcaacuucuucgccagcugguacacccugauccccaccagcauccugcugggccugggcgccgccccccuguggagcgcccagugcaccuaccugaccaucaccggcaacacccacgccgagaaggccggcaagagaggcaaggacauggugaaccaguacuucggcaucuucuuccugaucuuccagagcagcggcguguggggcaaccugaucagcagccugguguucggccagacccccagccagggcagcggcgugcuggccgugcugaugaucgccgccuuccugcagcccaucagagacgugcagagagagagcgagggcgagaagaagagcgugcccuucuggagcacccugcugagcaccuucaagcuguacagagacaagagacugugccugcugauccugcugccccuguacagcggccugcagcagggcuuccugagcagcgaguacaccagaagcuacgugaccugcacccugggcauccaguucgugggcuacgugaugaucugcuucagcgccaccgacgcccugugcagcgugcuguacggcaaggugagccaguacaccggcagagccgugcuguacgugcugggcgccgugacccacgugagcugcaugaucgcccugcugcuguggagacccagagccgaccaccuggccguguucuucguguucagcggccuguggggcguggccgacgccguguggcagacccagaacaacgcccuguacggcgugcuguucgagaagagcaaggaggccgccuucgccaacuacagacugugggaggcccugggcuucgugaucgccuucggcuacagcauguuccugugcgugcacgugaagcuguacauccugcugggcgugcugagccugaccaugguggccuacggccugguggagugcguggagagcaagaaccccaucagaccccacgcccccggccaggugaaccaggccgaggacgaggagauccagaccaagauguaa

SEQ ID NO: 25404 - RNA, 1794 nt, Artificial Sequence
  UNC93B1__Homo_sapiens__NP_112192
auggaggccgagcccccccuguaccccauggccggcgccgccggcccccagggcgacgaggaccugcugggcgugcccgacggccccgaggccccccuggacgagcuggugggcgccuaccccaacuacaacgaggaggaggaggagagaagauacuacagaagaaagagacugggcgugcugaagaacgugcuggccgccagcgccggcggcaugcugaccuacggcguguaccugggccugcugcagaugcagcugauccugcacuacgacgagaccuacagagaggugaaguacggcaacaugggccugcccgacaucgacagcaagaugcugaugggcaucaacgugacccccaucgccgcccugcuguacacccccgugcugaucagauucuucggcaccaaguggaugauguuccuggccgugggcaucuacgcccuguucgugagcaccaacuacugggagagauacuacacccuggugcccagcgccguggcccugggcauggccaucgugccccugugggccagcaugggcaacuacaucaccagaauggcccagaaguaccacgaguacagccacuacaaggagcaggacggccagggcaugaagcagagaccccccagaggcagccacgcccccuaccugcugguguuccaggccaucuucuacagcuucuuccaccugagcuucgccugcgcccagcugcccaugaucuacuuccugaaccacuaccuguacgaccugaaccacacccuguacaacgugcagagcugcggcaccaacagccacggcauccugagcggcuucaacaagaccgugcugagaacccugcccagaagcggcaaccugaucgugguggagagcgugcugauggccguggccuuccuggccaugcugcuggugcugggccugugcggcgccgccuacagacccaccgaggagaucgaccugagaagcgugggcuggggcaacaucuuccagcugcccuucaagcacgugagagacuacagacugagacaccuggugcccuucuucaucuacagcggcuucgaggugcuguucgccugcaccggcaucgcccugggcuacggcgugugcagcgugggccuggagagacuggccuaccugcugguggccuacagccugggcgccagcgccgccagccugcugggccugcugggccuguggcugcccagacccgugccccugguggccggcgccggcgugcaccugcugcugaccuucauccuguucuucugggcccccgugcccagagugcugcagcacagcuggauccuguacguggccgccgcccuguggggcgugggcagcgcccugaacaagaccggccugagcacccugcugggcauccuguacgaggacaaggagagacaggacuucaucuucaccaucuaccacugguggcaggccguggccaucuucaccguguaccugggcagcagccugcacaugaaggccaagcuggccgugcugcuggugacccugguggccgccgccgugagcuaccugagaauggagcagaagcugagaagaggcguggcccccagacagcccagaauccccagaccccagcacaaggugagaggcuacagauaccuggaggaggacaacagcgacgagagcgacgccgagggcgagcacggcgacggcgccgaggaggaggccccccccgccggccccagacccggccccgagcccgccggccugggcagaagacccugccccuacgagcaggcccagggcggcgacggccccgaggagcaguaa

SEQ ID NO: 25405 - RNA, 915 nt, Artificial Sequence
  UNG__Homo_sapiens__NP_003353
augggcguguucugccugggccccuggggccugggcagaaagcugagaacccccggcaagggcccccugcagcugcugagcagacugugcggcgaccaccugcaggccauccccgccaagaaggcccccgccggccaggaggagcccggcaccccccccagcagcccccugagcgccgagcagcuggacagaauccagagaaacaaggccgccgcccugcugagacuggccgccagaaacgugcccgugggcuucggcgagagcuggaagaagcaccugagcggcgaguucggcaagcccuacuucaucaagcugaugggcuucguggccgaggagagaaagcacuacaccguguacccccccccccaccagguguucaccuggacccagaugugcgacaucaaggacgugaagguggugauccugggccaggaccccuaccacggccccaaccaggcccacggccugugcuucagcgugcagagacccgugccccccccccccagccuggagaacaucuacaaggagcugagcaccgacaucgaggacuucgugcaccccggccacggcgaccugagcggcugggccaagcagggcgugcugcugcugaacgccgugcugaccgugagagcccaccaggccaacagccacaaggagagaggcugggagcaguucaccgacgccguggugagcuggcugaaccagaacagcaacggccugguguuccugcuguggggcagcuacgcccagaagaagggcagcgccaucgacagaaagagacaccacgugcugcagaccgcccaccccagcccccugagcguguacagaggcuucuucggcugcagacacuucagcaagaccaacgagcugcugcagaagagcggcaagaagcccaucgacuggaaggagcuguaa

SEQ ID NO: 25406 - RNA, 1155 nt, Artificial Sequence
  UPB1__Homo_sapiens__NP_057411
auggccggcgccgaguggaagagccuggaggagugccuggagaagcaccugccccugcccgaccugcaggaggugaagagagugcuguacggcaaggagcugagaaagcuggaccugcccagagaggccuucgaggccgccagcagagaggacuucgagcugcagggcuacgccuucgaggccgccgaggagcagcugagaagacccagaaucgugcacgugggccuggugcagaacagaaucccccugcccgccaacgcccccguggccgagcaggugagcgcccugcacagaagaaucaaggccaucguggagguggccgccaugugcggcgugaacaucaucugcuuccaggaggccuggaccaugcccuucgccuucugcaccagagagaagcugcccuggaccgaguucgccgagagcgccgaggacggccccaccaccagauucugccagaagcuggccaagaaccacgacauggugguggugagccccauccuggagagagacagcgagcacggcgacgugcuguggaacaccgccguggugaucagcaacagcggcgccgugcugggcaagaccagaaagaaccacauccccagagugggcgacuucaacgagagcaccuacuacauggagggcaaccugggccaccccguguuccagacccaguucggcagaaucgccgugaacaucugcuacggcagacaccacccccugaacuggcugauguacagcaucaacggcgccgagaucaucuucaaccccagcgccaccaucggcgcccugagcgagagccuguggcccaucgaggccagaaacgccgccaucgccaaccacugcuucaccugcgccaucaacagagugggcaccgagcacuuccccaacgaguucaccagcggcgacggcaagaaggcccaccaggacuucggcuacuucuacggcagcagcuacguggccgcccccgacagcagcagaacccccggccugagcagaagcagagacggccugcugguggccaagcuggaccugaaccugugccagcaggugaacgacguguggaacuucaagaugaccggcagauacgagauguacgccagagagcuggccgaggccgugaagagcaacuacagccccaccaucgugaaggaguaa

SEQ ID NO: 25407 - RNA, 3357 nt, Artificial Sequence
  UPF1__Homo_sapiens__NP_002902
augagcguggaggccuacggccccagcagccagacccugaccuuccuggacaccgaggaggccgagcugcugggcgccgacacccagggcagcgaguucgaguucaccgacuucacccugcccagccagacccagaccccccccggcggccccggcggccccggcggcggcggcgccggcggccccggcggcgccggcgccggcgccgccgccggccagcuggacgcccaggugggccccgagggcauccugcagaacggcgccguggacgacagcguggccaagaccagccagcugcuggccgagcugaacuucgaggaggacgaggaggacaccuacuacaccaaggaccugcccauccacgccugcagcuacugcggcauccacgaccccgccugcgugguguacugcaacaccagcaagaagugguucugcaacggcagaggcaacaccagcggcagccacaucgugaaccaccuggugagagccaagugcaaggaggugacccugcacaaggacggcccccugggcgagaccgugcuggagugcuacaacugcggcugcagaaacguguuccugcugggcuucauccccgccaaggccgacagcgugguggugcugcugugcagacagcccugcgccagccagagcagccugaaggacaucaacugggacagcagccaguggcagccccugauccaggacagaugcuuccugagcuggcuggugaagauccccagcgagcaggagcagcugagagccagacagaucaccgcccagcagaucaacaagcuggaggagcuguggaaggagaaccccagcgccacccuggaggaccuggagaagcccggcguggacgaggagccccagcacgugcugcugagauacgaggacgccuaccaguaccagaacaucuucggcccccuggugaagcuggaggccgacuacgacaagaagcugaaggagagccagacccaggacaacaucaccgugagaugggaccugggccugaacaagaagagaaucgccuacuucacccugcccaagaccgacagcgacaugagacugaugcagggcgacgagaucugccugagauacaagggcgaccuggccccccuguggaagggcaucggccacgugaucaaggugcccgacaacuacggcgacgagaucgccaucgagcugagaagcagcgugggcgcccccguggaggugacccacaacuuccagguggacuucguguggaagagcaccagcuucgacagaaugcagagcgcccugaagaccuucgccguggacgagaccagcgugagcggcuacaucuaccacaagcugcugggccacgagguggaggacgugaucaucaagugccagcugcccaagagauucaccgcccagggccugcccgaccugaaccacagccagguguacgccgugaagaccgugcugcagagaccccugagccugauccagggcccccccggcaccggcaagaccgugaccagcgccaccaucguguaccaccuggccagacagggcaacggccccgugcuggugugcgcccccagcaacaucgccguggaccagcugaccgagaagauccaccagaccggccugaagguggugagacugugcgccaagagcagagaggccaucgacagccccgugagcuuccuggcccugcacaaccagaucagaaacauggacagcaugcccgagcugcagaagcugcagcagcugaaggacgagaccggcgagcugagcagcgccgacgagaagagauacagagcccugaagagaaccgccgagagagagcugcugaugaacgccgacgugaucugcugcaccugcgugggcgccggcgaccccagacuggccaagaugcaguucagaagcauccugaucgacgagagcacccaggccaccgagcccgagugcauggugcccguggugcugggcgccaagcagcugauccuggugggcgaccacugccagcugggccccguggugaugugcaagaaggccgccaaggccggccugagccagagccuguucgagagacugguggugcugggcaucagacccaucagacugcaggugcaguacagaaugcaccccgcccugagcgccuuccccagcaacaucuucuacgagggcagccugcagaacggcgugaccgccgccgacagagugaagaagggcuucgacuuccaguggccccagcccgacaagcccauguucuucuacgugacccagggccaggaggagaucgccagcagcggcaccagcuaccugaacagaaccgaggccgccaacguggagaagaucaccaccaagcugcugaaggccggcgccaagcccgaccagaucggcaucaucacccccuacgagggccagagaagcuaccuggugcaguacaugcaguucagcggcagccugcacaccaagcuguaccaggagguggagaucgccagcguggacgccuuccagggcagagagaaggacuucaucauccugagcugcgugagagccaacgagcaccagggcaucggcuuccugaacgaccccagaagacugaacguggcccugaccagagccagauacggcgugaucaucgugggcaaccccaaggcccugagcaagcagccccuguggaaccaccugcugaacuacuacaaggagcagaaggugcugguggagggcccccugaacaaccugagagagagccugaugcaguucagcaagcccagaaagcuggugaacaccaucaaccccggcgccagauucaugaccaccgccauguacgacgccagagaggccaucauccccggcagcguguacgacagaagcagccagggcagacccagcagcauguacuuccagacccacgaccagaucggcaugaucagcgccggccccagccacguggccgccaugaacauccccauccccuucaaccuggugaugccccccaugcccccccccggcuacuucggccaggccaacggccccgccgccggcagaggcacccccaagggcaagaccggcagaggcggcagacagaagaacagauucggccugcccggccccagccagaccaaccugcccaacagccaggccagccaggacguggccagccagcccuucagccagggcgcccugacccagggcuacaucagcaugagccagcccagccagaugagccagcccggccugagccagcccgagcugagccaggacagcuaccugggcgacgaguucaagagccagaucgacguggcccugagccaggacagcaccuaccagggcgagagagccuaccagcacggcggcgugaccggccugagccaguacuaa

SEQ ID NO: 25408 - RNA, 3819 nt, Artificial Sequence
  UPF2__Homo_sapiens__NP_542166
augcccgccgagagaaagaagcccgccagcauggaggagaaggacagccugcccaacaacaaggagaaggacugcagcgagagaagaaccgugagcagcaaggagagacccaaggacgacaucaagcugaccgccaagaaggaggugagcaaggcccccgaggacaagaagaagagacuggaggacgacaagagaaagaaggaggacaaggagagaaagaagaaggacgaggagaaggugaaggccgaggaggagagcaagaagaaggaggaggaggagaagaagaagcaccaggaggaggagagaaagaagcaggaggagcaggccaagagacagcaggaggaggaggccgccgcccagaugaaggagaaggaggagagcauccagcugcaccaggaggccugggagagacaccaccugagaaaggagcugagaagcaagaaccagaacgcccccgacagcagacccgaggagaacuucuucagcagacuggacagcagccugaagaagaacaccgccuucgugaagaagcugaagaccaucaccgagcagcagagagacagccugagccacgacuucaacggccugaaccugagcaaguacaucgccgaggccguggccagcaucguggaggccaagcugaagaucagcgacgugaacugcgccgugcaccugugcagccuguuccaccagagauacgccgacuucgcccccagccugcugcagguguggaagaagcacuucgaggccagaaaggaggagaagacccccaacaucaccaagcugagaaccgaccugagauucaucgccgagcugaccaucgugggcaucuucaccgacaaggagggccugagccugaucuacgagcagcugaagaacaucaucaacgccgacagagagagccacacccacgugagcguggugaucagcuucugcagacacugcggcgacgacaucgccggccuggugcccagaaaggugaagagcgccgccgagaaguucaaccugagcuucccccccagcgagaucaucagccccgagaagcagcagcccuuccagaaccugcugaaggaguacuucaccagccugaccaagcaccugaagagagaccacagagagcugcagaacaccgagagacagaacagaagaauccugcacagcaagggcgagcugagcgaggacagacacaagcaguacgaggaguucgccaugagcuaccagaagcugcuggccaacagccagagccuggccgaccugcuggacgagaacaugcccgaccugccccaggacaagcccacccccgaggagcacggccccggcaucgacaucuucacccccggcaagcccggcgaguacgaccuggagggcggcaucugggaggacgaggacgccagaaacuucuacgagaaccugaucgaccugaaggccuucgugcccgccauccuguucaaggacaacgagaagagcugccagaacaaggagagcaacaaggacgacaccaaggaggccaaggagagcaaggagaacaaggaggugagcagccccgacgaccuggagcuggagcuggagaaccuggagaucaacgacgacacccuggagcuggagggcggcgacgaggccgaggaccugaccaagaagcugcuggacgagcaggagcaggaggacgaggaggccagcaccggcagccaccugaagcugaucguggacgccuuccugcagcagcugcccaacugcgugaacagagaccugaucgacaaggccgccauggacuucugcaugaacaugaacaccaaggccaacagaaagaagcuggugagagcccuguucaucgugcccagacagagacuggaccugcugcccuucuacgccagacugguggccacccugcaccccugcaugagcgacguggccgaggaccugugcagcaugcugagaggcgacuucagauuccacgugagaaagaaggaccagaucaacaucgagaccaagaacaagaccgugagauucaucggcgagcugaccaaguucaagauguucaccaagaacgacacccugcacugccugaagaugcugcugagcgacuucagccaccaccacaucgagauggccugcacccugcuggagaccugcggcagauuccuguucagaagccccgagagccaccugagaaccagcgugcugcuggagcagaugaugagaaagaagcaggccaugcaccuggacgccagauacgugaccaugguggagaacgccuacuacuacugcaaccccccccccgccgagaagaccgugaagaagaagagacccccccugcaggaguacgugagaaagcugcuguacaaggaccugagcaaggugaccaccgagaaggugcugagacagaugagaaagcugcccuggcaggaccaggaggugaaggacuacgugaucugcugcaugaucaacaucuggaacgugaaguacaacagcauccacugcguggccaaccugcuggccggccuggugcuguaccaggaggacgugggcauccacgugguggacggcgugcuggaggacaucagacugggcauggaggugaaccagcccaaguucaaccagagaagaaucagcagcgccaaguuccugggcgagcuguacaacuacagaaugguggagagcgccgugaucuucagaacccuguacagcuucaccagcuucggcgugaaccccgacggcagccccagcagccuggacccccccgagcaccuguucagaaucagacuggugugcaccauccuggacaccugcggccaguacuucgacagaggcagcagcaagagaaagcuggacugcuuccugguguacuuccagagauacgugugguggaagaagagccuggagguguggaccaaggaccaccccuuccccaucgacaucgacuacaugaucagcgacacccuggagcugcugagacccaagaucaagcugugcaacagccuggaggagagcaucagacaggugcaggaccuggagagagaguuccugaucaagcugggccuggugaacgacaaggacagcaaggacagcaugaccgagggcgagaaccuggaggaggacgaggaggaggaggagggcggcgccgagaccgaggagcagagcggcaacgagagcgaggugaacgagcccgaggaggaggagggcagcgacaacgacgacgacgagggcgaggaggaggaggaggagaacaccgacuaccugaccgacagcaacaaggagaacgagaccgacgaggagaacaccgaggugaugaucaagggcggcggccugaagcacgugcccugcguggaggacgaggacuucauccaggcccuggacaagaugaugcuggagaaccugcagcagagaagcggcgagagcgugaaggugcaccagcuggacguggccaucccccugcaccugaagagccagcugagaaagggccccccccugggcggcggcgagggcgaggccgagagcgccgacaccaugcccuucgugaugcugaccagaaagggcaacaagcagcaguucaagauccugaacgugcccaugagcagccagcuggccgccaaccacuggaaccagcagcaggccgagcaggaggagagaaugagaaugaagaagcugacccuggacaucaacgagagacaggagcaggaggacuaccaggagaugcugcagagccuggcccagagacccgcccccgccaacaccaacagagagagaagacccagauaccagcaccccaagggcgcccccaacgccgaccugaucuucaagaccggcggcagaagaagauaa

SEQ ID NO: 25409 - RNA, 1431 nt, Artificial Sequence
  UPF3A__Homo_sapiens__NP_075387
augagaagcgagaaggagggcgccggcggccugagagccgccguggccgccagaggccccagcggcagagagaagcugagcgcccuggaggugcaguuccacagagacagccagcagcaggaggccgagaccccccccaccagcagcagcggcugcggcggcggcgccggcaagcccagagaggagaagagaaccgcccugagcaagguggugaucagaagacugccccccggccugaccaaggagcagcuggaggagcagcugagaccccugcccgcccacgacuacuucgaguucuucgccgccgaccugagccuguacccccaccuguacagcagagccuacaucaacuucagaaaccccgacgacauccugcuguucagagacagauucgacggcuacaucuuccuggacagcaagggccuggaguaccccgccgugguggaguucgcccccuuccagaagaucgccaagaagaagcugagaaagaaggacgccaagaccggcagcaucgaggacgaccccgaguacaagaaguuccuggagaccuacugcguggaggaggagaagaccagcgccaaccccgagacccugcugggcgagauggaggccaagaccagagagcugaucgccagaagaaccaccccccugcuggaguacaucaagaacagaaagcuggagaagcagagaaucagagaggagaagagagaggagagaagaagaagagagcuggagaagaagagacugagagaggaggagaagagaagaagaagagaggaggagagaugcaagaagaaggagaccgacaagcagaagaagaucgccgagaaggaggugagaaucaagcugcugaagaagcccgagaagggcgaggagcccaccaccgagaagcccaaggagagaggcgaggagaucgacaccggcggcggcaagcaggagagcugcgcccccggcgccguggugaaggccagacccauggagggcagccuggaggagccccaggagaccagccacagcggcagcgacaaggagcacagagacguggagagaagccaggagcaggagagcgaggcccagagauaccacguggacgacggcagaagacacagagcccaccacgagcccgagagacugagcagaagaagcgaggacgagcagagauggggcaagggccccggccaggacagaggcaagaagggcagccaggacagcggcgcccccggcgaggccauggagagacugggcagagcccagagaugcgacgacagccccgcccccagaaaggagagacuggccaacaaggacagacccgcccugcagcuguacgaccccggcgccagauucagagccagagagugcggcggcaacagaagaaucugcaaggccgagggcagcggcaccggccccgagaagagagaggaggccgaguaa

SEQ ID NO: 25410 - RNA, 1413 nt, Artificial Sequence
  UPF3B__Homo_sapiens__NP_075386
augaaggaggagaaggagcacagacccaaggagaagagagugacccugcugacccccgccggcgccaccggcagcggcggcggcaccagcggcgacagcagcaagggcgaggacaagcaggacagaaacaaggagaagaaggaggcccugagcaagguggugaucagaagacugccccccacccugaccaaggagcagcugcaggagcaccugcagcccaugcccgagcacgacuacuucgaguucuucagcaacgacaccagccuguacccccacauguacgccagagccuacaucaacuucaagaaccaggaggacaucauccuguucagagacagauucgacggcuacguguuccuggacaacaagggccaggaguaccccgccaucguggaguucgcccccuuccagaaggccgccaagaagaagaccaagaagagagacaccaaggugggcaccaucgacgacgaccccgaguacagaaaguuccuggagagcuacgccaccgacaacgagaagaugaccagcacccccgagacccugcuggaggagaucgaggccaagaacagagagcugaucgccaagaagaccaccccccugcugagcuuccugaagaacaagcagagaaugagagaggagaagagagaggagagaagaagaagagagaucgagagaaagagacagagagaggaggagagaagaaaguggaaggaggaggagaagagaaagagaaaggacaucgagaagcugaagaagaucgacagaauccccgagagagacaagcugaaggacgagcccaagaucaagcugcugaagaagcccgagaagggcgacgagaaggagcuggacaagagagagaaggccaagaagcuggacaaggagaaccugagcgacgagagagccagcggccagagcugcacccugcccaagagaagcgacagcgagcugaaggacgagaagcccaagagacccgaggacgagagcggcagagacuacagagagagagagagagaguacgagagagaccaggagagaauccugagagagagagagagacugaagagacaggaggaggagagaagaagacagaaggagagauacgagaaggagaagaccuucaagagaaaggaggaggagaugaagaaggagaaggacacccugagagacaagggcaagaaggccgagagcaccgagagcaucggcagcagcgagaagaccgagaagaaggaggagguggugaagagagacagaaucagaaacaaggacagacccgccaugcagcuguaccagcccggcgccagaagcagaaacagacugugcccccccgacgacagcaccaagagcggcgacagcgccgccgagagaaagcaggagagcggcaucagccacagaaaggagggcggcgaggaguaa

SEQ ID NO: 25411 - RNA, 822 nt, Artificial Sequence
  UPK1A__Homo_sapiens__NP_001268372
auggccagcgccgccgccgccgaggccgagaagggcagccccgugguggugggccugcugguggugggcaacaucaucauccugcugagcggccugagccuguucgccgagaccaucugggugaccgccgaccaguacagaguguacccccugaugggcgugagcggcaaggacgacguguucgccggcgccuggaucgccaucuucugcggcuucagcuucuucaugguggccagcuucggcgugggcgccgcccugugcagaagaagaagcauggugcugaccuaccuggugcugaugcugaucguguacaucuucgagugcgccagcugcaucaccagcuacacccacagagacuacauggugagcaaccccagccugaucaccaagcagaugcugaccuucuacagcgccgacaccgaccagggccaggagcugaccagacugugggacagagugaugaucgagcaggagugcugcggcaccagcggccccauggacugggugaacuucaccagcgccuucagagccgccacccccgaggugguguuccccuggcccccccugugcugcagaagaaccggcaacuucaucccccugaacgaggagggcugcagacugggccacauggacuaccuguucaccaaggccggcgugcaguggcacaaccugagcagccugcagagacugccccccggcuucaagggcuucagccaccugagcuuccagagcagcugggacuacagagccgccagcaacaccagcgccacccccagcaccgccaccagaggcgugagcagaggccugggccugcccagcuaa

SEQ ID NO: 25412 - RNA, 783 nt, Artificial Sequence
  UPK1B__Homo_sapiens__NP_008883
auggccaaggacaacagcaccgugagaugcuuccagggccugcugaucuucggcaacgugaucaucggcugcugcggcaucgcccugaccgccgagugcaucuucuucgugagcgaccagcacagccuguacccccugcuggaggccaccgacaacgacgacaucuacggcgccgccuggaucggcaucuucgugggcaucugccuguucugccugagcgugcugggcaucgugggcaucaugaagagcagcagaaagauccugcuggccuacuucauccugauguucaucguguacgccuucgagguggccagcugcaucaccgccgccacccagcaggacuucuucacccccaaccuguuccugaagcagaugcuggagagauaccagaacaacagcccccccaacaacgacgaccaguggaagaacaacggcgugaccaagaccugggacagacugaugcugcaggacaacugcugcggcgugaacggccccagcgacuggcagaaguacaccagcgccuucagaaccgagaacaacgacgccgacuaccccuggcccagacagugcugcgugaugaacaaccugaaggagccccugaaccuggaggccugcaagcugggcgugcccggcuucuaccacaaccagggcugcuacgagcugaucagcggccccaugaacagacacgccuggggcguggccugguucggcuucgccauccugugcuggaccuucugggugcugcugggcaccauguucuacuggagcagaaucgaguacuaa

SEQ ID NO: 25413 - RNA, 555 nt, Artificial Sequence
  UPK2__Homo_sapiens__NP_006751
auggccccccugcugcccaucagaacccugccccugauccugauccugcuggcccugcugagccccggcgccgccgacuucaacaucagcagccugagcggccugcugagccccgcccugaccgagagccugcugguggcccugccccccugccaccugaccggcggcaacgccacccugauggugagaagagccaacgacagcaagguggugaccagcagcuucguggugccccccugcagaggcagaagagagcuggugagcgugguggacagcggcgccggcuucaccgugaccagacugagcgccuaccaggugaccaaccuggugcccggcaccaaguucuacaucagcuaccuggugaagaagggcaccgccaccgagagcagcagagagauccccaugagcacccugcccagaagaaacauggagagcaucggccugggcauggccagaaccggcggcaugguggugaucaccgugcugcugagcguggccauguuccugcuggugcugggcuucaucaucgcccuggcccugggcagcagaaaguaa

SEQ ID NO: 25414 - RNA, 501 nt, Artificial Sequence
  UPK3A__Homo_sapiens__NP_001161046
augcccccccugugggcccugcuggcccugggcugccugagauucggcagcgccgugaaccugcagccccagcuggccagcgugaccuucgccaccaacaaccccacccugaccaccguggcccuggagaagccccugugcauguucgacagcaaggaggcccugaccggcacccacgagguguaccuguacgugcugguggacagcgugacccccuacagcaccaucgacaccuggcccggcagaagaagcggcggcaugaucgugaucaccagcauccugggcagccugcccuucuuccugcuggugggcuucgccggcgccaucgcccugagccugguggacaugggcagcagcgacggcgagaccacccacgacagccagaucacccaggaggccgugcccaagagccugggcgccagcgagagcagcuacaccagcgugaacagaggccccccccuggacagagccgagguguacagcagcaagcugcaggacuaa

SEQ ID NO: 25415 - RNA, 933 nt, Artificial Sequence
  UPP1__Homo_sapiens__NP_001274355
auggccgccaccggcgccaacgccgagaaggccgagagccacaacgacugccccgugagacugcugaaccccaacaucgccaagaugaaggaggacauccuguaccacuucaaccugaccaccagcagacacaacuuccccgcccuguucggcgacgugaaguucgugugcgugggcggcagccccagcagaaugaaggccuucaucagaugcgugggcgccgagcugggccuggacugccccggcagagacuaccccaacaucugcgccggcaccgacagauacgccauguacaaggugggccccgugcugagcgugagccacggcaugggcauccccagcaucagcaucaugcugcacgagcugaucaagcugcuguacuacgccagaugcagcaacgugaccaucaucagaaucggcaccagcggcggcaucggccuggagcccggcaccguggugaucaccgagcaggccguggacaccugcuucaaggccgaguucgagcagaucgugcugggcaagagagugaucagaaagaccgaccugaacaagaagcuggugcaggagcugcugcugugcagcgccgagcugagcgaguucaccaccguggugggcaacaccaugugcacccuggacuucuacgagggccagggcagacuggacggcgcccugugcagcuacaccgagaaggacaagcaggccuaccuggaggccgccuacgccgccggcgugagaaacaucgagauggagagcagcguguucgccgccaugugcagcgccugcggccugcaggccgccguggugugcgugacccugcugaacagacuggagggcgaccagaucagcagccccagaaacgugcugagcgaguaccagcagagaccccagagacuggugagcuacuucaucaagaagaagcugagcaaggccuaa

SEQ ID NO: 25416 - RNA, 1125 nt, Artificial Sequence
  UPP2__Homo_sapiens__NP_001128570
augcuggcccccggcugcgagcuggaccccgaccaggagguggugagaaccagacccgaggacgugcccgccagccccagcaccagcaccaugaucgugagcgugcugagaccccccagccacgccagcugcaccgccugcggcaccgugaccuuccacaucguggagagaauggccagcgugauccccgccagcaacagaagcaugagaagcgacagaaacaccuacgugggcaagagauucgugcacgugaagaaccccuaccuggaccugauggacgaggacauccuguaccaccuggaccugggcaccaagacccacaaccugcccgccauguucggcgacgugaaguucgugugcgugggcggcagccccaacagaaugaaggccuucgcccuguucaugcacaaggagcugggcuucgaggaggccgaggaggacaucaaggacaucugcgccggcaccgacagauacugcauguacaagaccggccccgugcuggccaucagccacggcaugggcauccccagcaucagcaucaugcugcacgagcugaucaagcugcugcaccacgccagaugcugcgacgugaccaucaucagaaucggcaccagcggcggcaucggcaucgcccccggcaccguggugaucaccgacaucgccguggacagcuucuucaagcccagauucgagcaggugauccuggacaacaucgugaccagaagcaccgagcuggacaaggagcugagcgaggagcuguucaacugcagcaaggagauccccaacuuccccacccuggugggccacaccaugugcaccuacgacuucuacgagggccagggcagacuggacggcgcccugugcagcuucagcagagagaagaagcuggacuaccugaagagagccuucaaggccggcgugagaaacaucgagauggagagcaccguguucgccgccaugugcggccugugcggccugaaggccgccguggugugcgugacccugcuggacagacuggacugcgaccagaucaaccugccccacgacgugcugguggaguaccagcagagaccccagcugcugaucagcaacuucaucagaagaagacugggccugugcgacuaa

SEQ ID NO: 25417 - RNA, 930 nt, Artificial Sequence
  UPRT__Homo_sapiens__NP_659489
auggccaccgagcugcagugccccgacagcaugcccugccacaaccagcaggugaacagcgccagcacccccagccccgagcagcugagacccggcgaccugauccuggaccacgccggcggcaacagagccagcagagccaaggugauccugcugaccggcuacgcccacagcagccugcccgccgagcuggacagcggcgccugcggcggcagcagccugaacagcgagggcaacagcggcagcggcgacagcagcagcuacgacgcccccgccggcaacagcuuccuggaggacugcgagcugagcagacagaucggcgcccagcugaagcugcugcccaugaacgaccagaucagagagcugcagaccaucaucagagacaagaccgccagcagaggcgacuucauguucagcgccgacagacugaucagacuggugguggaggagggccugaaccagcugcccuacaaggagugcauggugaccacccccaccggcuacaaguacgagggcgugaaguucgagaagggcaacugcggcgugagcaucaugagaagcggcgaggccauggagcagggccugagagacugcugcagaagcaucagaaucggcaagauccugauccagagcgacgaggagacccagagagccaagguguacuacgccaaguucccccccgacaucuacagaagaaaggugcugcugauguaccccauccugagcaccggcaacaccgugaucgaggccgugaaggugcugaucgagcacggcgugcagcccagcgugaucauccugcugagccuguucagcaccccccacggcgccaagagcaucauccaggaguuccccgagaucaccauccugaccaccgaggugcaccccguggcccccacccacuucggccagaaguacuucggcaccgacuaa

SEQ ID NO: 25418 - RNA, 696 nt, Artificial Sequence
  UQCC1__Homo_sapiens__NP_001171906
auggcccugcuggugagagugcugagaaaccagaccagcaucagccagugggugcccgugugcagcagacugauccccgugagccccacccagggccagggcgacagagcccugagcagaaccagccagaagaucaagaucgccgcccugagaauguacaccagcugcguggagaagaccgacuucgaggaguucuuccugagaugccagaugcccgacaccuucaacagcugguuccugaucacccugcugcacguguggaugugccuggugagaaugaagcaggagggcagaagcggcaaguacaugugcagaaucaucgugcacuucaugugggaggacgugcagcagagaggcagagugaugggcgugaaccccuacauccugaagaagaacaugauccugaugaccaaccacuucuacgccgccauccugggcuacgacgagggcauccugagcgacgaccacggccuggccgccgcccuguggagaaccuucuucaacagaaagugcgaggaccccagacaccuggagcugcugguggaguacgugagaaagcagauccaguaccuggacagcaugaacggcgaggaccugcugcugaccggcgaggugagcuggagaccccugguggagaagaacccccagagcauccugaagccccacagccccaccuacaacgacgagggccuguaa

SEQ ID NO: 25419 - RNA, 381 nt, Artificial Sequence
  UQCC2__Homo_sapiens__NP_115716
auggccgccagcagauacagaagauuccugaagcugugcgaggaguggcccguggacgagaccaagagaggcagagaccugggcgccuaccugagacagagaguggcccaggccuucagagagggcgagaacacccagguggccgagcccgaggccugcgaccagauguacgagagccuggccagacugcacagcaacuacuacaagcacaaguaccccagacccagagacaccagcuucagcggccugagccuggaggaguacaagcugauccugagcaccgacacccuggaggagcugaaggagaucgacaagggcauguggaagaagcugcaggagaaguucgcccccaagggccccgaggaggaccacaaggccuaa

SEQ ID NO: 25420 - RNA, 336 nt, Artificial Sequence
  UQCRB__Homo_sapiens__NP_006285
auggccggcaagcaggccgugagcgccagcggcaaguggcuggacggcaucagaaagugguacuacaacgccgccggcuucaacaagcugggccugaugagagacgacaccaucuacgaggacgaggacgugaaggaggccaucagaagacugcccgagaaccuguacaacgacagaauguucagaaucaagagagcccuggaccugaaccugaagcaccagauccugcccaaggagcaguggaccaaguacgaggaggagaacuucuaccuggagcccuaccugaaggaggugaucagagagagaaaggagagagaggagugggccaagaaguaa

SEQ ID NO: 25421 - RNA, 1443 nt, Artificial Sequence
  UQCRC1__Homo_sapiens__NP_003356
auggccgccagcguggugugcagagccgccaccgccggcgcccaggugcugcugagagccagaagaagccccgcccugcugagaacccccgcccugagaagcaccgccaccuucgcccaggcccugcaguucgugcccgagacccaggugagccugcuggacaacggccugagaguggccagcgagcagagcagccagcccaccugcaccgugggcguguggaucgacgugggcagcagauucgagaccgagaagaacaacggcgccggcuacuuccuggagcaccuggccuucaagggcaccaagaacagacccggcagcgcccuggagaaggagguggagagcaugggcgcccaccugaacgccuacagcaccagagagcacaccgccuacuacaucaaggcccugagcaaggaccugcccaaggccguggagcugcugggcgacaucgugcagaacugcagccuggaggacagccagaucgagaaggagagagacgugauccugagagagaugcaggagaacgacgccagcaugagagacgugguguucaacuaccugcacgccaccgccuuccagggcaccccccuggcccaggccguggagggccccagcgagaacgugagaaagcugagcagagccgaccugaccgaguaccugagcacccacuacaaggcccccagaauggugcuggccgccgccggcggcguggagcaccagcagcugcuggaccuggcccagaagcaccugggcggcauccccuggaccuacgccgaggacgccgugcccacccugacccccugcagauucaccggcagcgagaucagacacagagacgacgcccugcccuucgcccacguggccaucgccguggagggccccggcugggccagccccgacaacguggcccugcagguggccaacgccaucaucggccacuacgacugcaccuacggcggcggcgugcaccugagcagcccccuggccagcggcgccguggccaacaagcugugccagagcuuccagaccuucagcaucugcuacgccgagaccggccugcugggcgcccacuucgugugcgacagaaugaagaucgacgacaugauguucgugcugcagggccaguggaugagacugugcaccagcgccaccgagagcgagguggccagaggcaagaacauccugagaaacgcccuggugagccaccuggacggcaccacccccgugugcgaggacaucggcagaagccugcugaccuacggcagaagaaucccccuggccgagugggagagcagaaucgccgagguggacgccagcguggugagagagaucugcagcaaguacaucuacgaccagugccccgccguggccggcuacggccccaucgagcagcugcccgacuacaacagaaucagaagcggcauguucuggcugagauucuaa

SEQ ID NO: 25422 - RNA, 1362 nt, Artificial Sequence
  UQCRC2__Homo_sapiens__NP_003357
augaagcugcugaccagagccggcagcuucagcagauucuacagccugaagguggcccccaaggugaaggccaccgccgcccccgccggcgcccccccccagccccaggaccuggaguucaccaagcugcccaacggccuggugaucgccagccuggagaacuacagccccgugagcagaaucggccuguucaucaaggccggcagcagauacgaggacuucagcaaccugggcaccacccaccugcugagacugaccagcagccugaccaccaagggcgccagcagcuucaagaucaccagaggcaucgaggccgugggcggcaagcugagcgugaccgccaccagagagaacauggccuacaccguggagugccugagaggcgacguggacauccugauggaguuccugcugaacgugaccaccgcccccgaguucagaagaugggagguggccgaccugcagccccagcugaagaucgacaaggccguggccuuccagaacccccagacccacgugaucgagaaccugcacgccgccgccuacagaaacgcccuggccaacccccuguacugccccgacuacagaaucggcaaggugaccagcgaggagcugcacuacuucgugcagaaccacuucaccagcgccagaauggcccugaucggccugggcgugagccaccccgugcugaagcagguggccgagcaguuccugaacaugagaggcggccugggccugagcggcgccaaggccaacuacagaggcggcgagaucagagagcagaacggcgacagccuggugcacgccgccuucguggccgagagcgccguggccggcagcgccgaggccaacgccuucagcgugcugcagcacgugcugggcgccggcccccacgugaagagaggcagcaacaccaccagccaccugcaccaggccguggccaaggccacccagcagcccuucgacgugagcgccuucaacgccagcuacagcgacagcggccuguucggcaucuacaccaucagccaggccaccgccgccggcgacgugaucaaggccgccuacaaccaggugaagaccaucgcccagggcaaccugagcaacaccgacgugcaggccgccaagaacaagcugaaggccggcuaccugaugagcguggagagcagcgagugcuuccuggaggaggugggcagccaggcccugguggccggcagcuacaugccccccagcaccgugcugcagcagaucgacagcguggccaacgccgacaucaucaacgccgccaagaaguucgugagcggccagaagagcauggccgccagcggcaaccugggccacacccccuucguggacgagcuguaa

SEQ ID NO: 25423 - RNA, 825 nt, Artificial Sequence
  UQCRFS1__Homo_sapiens__NP_005994
augcugagcguggccagcagaagcggccccuucgcccccgugcugagcgccaccagcagaggcguggccggcgcccugagaccccuggugcaggccaccgugcccgccacccccgagcagcccgugcuggaccugaagagacccuuccugagcagagagagccugagcggccaggccgugagaagaccccugguggccagcgugggccugaacgugcccgccagcgugugcuacagccacaccgacaucaaggugcccgacuucagcgaguacagaagacuggaggugcuggacagcaccaagagcagcagagagagcagcgaggccagaaagggcuucagcuaccuggugaccggcgugaccaccgugggcguggccuacgccgccaagaacgccgugacccaguucgugagcagcaugagcgccagcgccgacgugcuggcccuggccaagaucgagaucaagcugagcgacauccccgagggcaagaacauggccuucaaguggagaggcaagccccuguucgugagacacagaacccagaaggagaucgagcaggaggccgccguggagcugagccagcugagagacccccagcacgaccuggacagagugaagaagcccgagugggugauccugaucggcgugugcacccaccugggcugcgugcccaucgccaacgccggcgacuucggcggcuacuacugccccugccacggcagccacuacgacgccagcggcagaaucagacugggccccgccccccugaaccuggaggugcccaccuacgaguucaccagcgacgacauggugaucgugggcuaa

SEQ ID NO: 25424 - RNA, 249 nt, Artificial Sequence
  UQCRQ__Homo_sapiens__NP_055217
augggcagagaguucggcaaccugaccagaaugagacacgugaucagcuacagccugagccccuucgagcagagagccuacccccacguguucaccaagggcauccccaacgugcugagaagaaucagagagagcuucuucagaguggugccccaguucgugguguucuaccugaucuacaccuggggcaccgaggaguucgagagaagcaagagaaagaaccccgccgccuacgagaacgacaaguaa

SEQ ID NO: 25425 - RNA, 4464 nt, Artificial Sequence
  URB2__Homo_sapiens__XP_005273417
auggccgccguguacagcggcaucagccugaagcugaagagcaagaccaccagcugggaggacaagcugaagcuggcccacuucgccuggaucagccaccagugcuuccugcccaacaaggagcaggugcugcuggacugggccagacagagccugguggccuucuacaagaagaagcuggagcugaaggaggacaucguggagagacuguggaucuacaucgacaacauccugcacagcagaaagcugcagaaccugcugaagaacggcaagaccaucaaccugcagaucagccuggugaagaucaucaacgagagaguggccgaguucagccugagcggcagccagagaaacaucugcgccgugcugagaugcugccagggcauccugagcacccccgcccuggccgugaucuacaccgccaagcaggagcugaugguggcccugcugagccagcugugcuggagcgccugcagacagcccgagggcgccgugguggcccagcuguucgaggugauccaccuggcccugggccacuaccugcugauccugcagcagcaggugaaccccagaagagccuucggcgacgugaccgcccaccugcugcagcccugccuggugcugagacaccugcugagcggcggcaccuggacccaggccggccagggccagcugagacaggugcugagcagagacaucagaagccagaucgaggccauguucagaggcggcaucuuccagcccgagcugcugagcagcuacaaggagggccugcuggaccagcagcagggcgacgugaagaccggcgccaugaagaaccugcuggcccccauggacaccgugcugaacagacugguggacgccggcuacugcgccgccagccugcacaccagcgugguggccaacagcguggcccugcuguacaagcuguuccuggacagcuacuucaaggagggcaaccagcugcugugcuuccaggugcugcccagacuguucggcugccugaagaucagccaccugcaggaggagcagagcaaggcccugagcaccagcgacuggaccaccgagcugcuggugguggagcagcugcugaacagcguggccaacaacaacaucuacaacaucgccgccgacagaaucagacacgaggaggcccaguucagauucuacagacacguggccgagcugcugaucaaccacgcccaggcccccauccccgccugguucagaugccugaagacccugaucagccugaaccaccugauccuggagcccgaccuggacgaccugcuggccagcgccuggaucgacgccgaggugaccgaguucagaaccaagaaggcccaggaggcccugaucagaaccguguuccagaccuacgccaagcugagacaggugcccagacuguucgaggaggugcugggcgugaucugcagacccgccgccgaggcccugagacagcccgugcuggccagcggccccagcaccgugcugagcgccugccugcuggagcugccccccagccagauccuggacaccuggagccuggugcuggagaaguuccagagccuggugcugcccuaccugcagagcgacgccgacauggcccugaagagccugagccugagccugcugcugcacugcaucauguucaacaugagaagccuggacagcagcaccccccugcccaucgugagaagaacccagugcaugauggagagaaugaugagagagcuggugcagccccugcuggcccugcugcccgacacccccggccccgagcccgagcuguggcugcagaaggugagcgacagcgugcugcugcugagcuacaccugggcccagguggacgccauguucagccugaacugcagccaguaccacagcaugagcggcccccugaucggcguggcccuggagaucagcaaccugcccagccugcugcccggcgugaagacccagcacuggaagaagaucgagaaguucaccgcccaguucagcagccugggcaccuacugccuggagcagcuguaccugcagaagaugaagagaacccugaugcagaccagcuucagaagcgagggcgccauccagagccugagaugcgacgccgccuucaucaucggcagcggcagaaagagccugaaccagagaaccaccgccagcugggacggccaggugggcauggugagcggccugaccuaccccguggcccacuggcaccugaucgugagcaaccugaccauccugaucagcuaccugugccccgacgacgugggcuaccuggccagcgugcugcugagaacccugcccaugggcaaggcccaggaggugagcaucgacgaggaggccuacaucacccuggagaagaucagcaaggccuuccugcacagcccccuguuccccgagaugcagagccugcacagcgccuuccugaccugcgugaccaccagcugcagcagcauccugugcagcggcgcccagagagacagcggccuggugagccagcagcugcccuggcuguucgagaaggaccacaugguggugggccacugggagaacagauucgccaaggccggccccgagggcaucgagcccagaggcgagaucgcccagaaccugcugagccuggugaagagcgacuuccccauccagcuggagggcgagcagcuggagagcauccugggccugcuggaggugaucagcgcccugcagcuggacagccugcugccccccuaccacgugcacuacuuccuggugcugcugagcauggccgugaccaagcugggcugcagcugcagcagcagccuggcccugaaguuccugaccaccugcuaccagcugcugggcuaccugcagaagggcaagagcgccagaagcguguucaagaucauguacggcagcgacaucuucgagguggugcugaccagccuguucagagccagcagcagauuccugaucgagauggacgaccccgccuggcuggaguuccugcaggugaucggcaccuuccuggaggagcugaugcagaugcugauccagaugaagcugagccuggugcugaacuucagaaagaucaccgccuuccugagcagcagcaagcccuacaccgaggccgccagcagcaagcagcuggagaaccagaacccccagggcagacagcugcugcuggugagccugaccagacugugccacgugcugggccccuuccugaaggagcagaagcugggccaggaggcccccgccgcccugagcgagcugcugcagcagguggugcugcagaccggcgccgugcugcagcugugcagcgugcccggcgccagaggcuggagacugcccagcgugcugaucagcagcgugagcacccugcuggaggccgaccugggccagcacugcagagacggcggcgccgacaucagccagggcagcgacagaacccugcugagccacguggcccuguaccagggcguguacagccagauccugcuggagcugcccgcccuggccggccacgaccagagcuuccaggccgcccugcaguuccugacccuguucuuccuggcccccgagcugcaccccaagaaggacagcguguucaccagcauguuccacagcgugagaagagugcuggccgaccccgagauccccgugcaggugacccaggacaucgagccccaccugggcgcccuguucacccagaugcuggaggugggcaccaccgaggaccugagacuggugaugcagugcauccugcagggccuggacgugagcaacauguggaaggccgacgugcagcugcugaacagagaggccagccaggagcagcccgugagccugaccguggugggccccgugcuggacgugcuggccgcccugcugagacagggcgaggaggccaucggcaacccccaccacgugagccuggccuucagcauccugcugaccgugccccuggaccaccugaagccccuggaguacggcagcguguuccccagacugcacaacgugcuguucagcauccugcagugccaccccaaggugaugcugaaggccauccccagcuuccugaacagcuucaacagacugguguucagcgugaugagagagggcagacagaaggacaagggcagcaucgacgaccugcccaccgugcugaagugcgccagacugguggagagaauguacagccacaucgccgccagagccgaggaguucgccguguucagccccuucaugguggcccaguacgugcuggaggugcagaaggugacccuguaccccgccgugaagagccugcugcaggagggcaucuaccugauccuggaccugugcaucgagcccgacgugcaguuccugagagccagccugcagcccggcaugagagacaucuucaaggagcuguacaacgacuaccugaaguaccacaaggccaagcacgagggcgagaagagauacaccgccuaa

SEQ ID NO: 25426 - RNA, 2796 nt, Artificial Sequence
  URGCP__Homo_sapiens__NP_001071131
auggccagccccggcaucgagguggagcugcugggcaagggccacagcgaccugggcgagguggcccccgagaucaaggccagcgagagaagaaccgccguggccaucgccgaccuggaguggagagagauggagggcgacgacugcgaguucagauacggcgacggcaccaacgaggcccaggacaacgacuuccccaccguggagagaagcagacugcaggagaugcugagccugcugggccuggagaccuaccaggugcagaagcugagccugcaggacagccugcagaucagcuucgacagcaugaagaacugggccccccaggugcccaaggaccugcccuggaacuuccugagaaagcugcaggcccugaacgccgacgccagaaacaccaccauggugcuggacgugcugcccgacgccagacccguggagaaggagagccagauggaggaggagaucaucuacugggaccccgccgacgaccuggccgccgacaucuacagcuucagcgagcugcccacccccgacacccccgugaacccccuggaccugcugugcgcccugcugcugagcagcgacagcuuccugcagcaggagaucgcccugaagauggcccugugccaguucgcccugccccuggugcugcccgacagcgagaaccacuaccacaccuuccugcugugggccaugagaggcaucgugagaaccugguggagccagccccccagaggcaugggcagcuucagagaggacagcguggugcugagcagagcccccgccuucgccuucgugagaauggacgugagcagcaacagcaagagccagcugcugaacgccgugcugagccccggccacagacagugggacugcuucuggcacagagaccugaaccugggcaccaacgccagagagaucagcgacggccugguggagaucagcugguucuuccccagcggcagagaggaccuggacaucuuccccgagcccguggccuuccugaaccugagaggcgacaucggcagccacuggcugcaguucaagcugcugaccgagaucagcagcgccguguucauccugaccgacaacaucagcaagaaggaguacaagcugcuguacagcaugaaggagagcaccaccaaguacuacuucauccugagccccuacagaggcaagagaaacaccaaccugagauuccugaacaagcugauccccgugcugaagaucgaccacagccacgugcuggugaaggugagcagcaccgacagcgacagcuucgugaagagaaucagagccaucgugggcaacgugcugagagcccccugcagaagagugagcguggaggacauggcccacgccgccagaaagcugggccugaagguggacgaggacugcgaggagugccagaaggccaaggacagaauggagagaaucaccagaaagaucaaggacagcgacgccuacagaagagacgagcugagacugcagggcgaccccuggagaaaggccgcccagguggagaaggaguucugccagcugcagugggccguggacccccccgagaagcacagagccgagcugagaagaagacugcuggagcugagaaugcagcagaacggccacgaccccagcagcggcgugcaggaguucaucagcggcaucagcagccccagccugagcgagaagcaguacuuccugagauggauggaguggggccuggccagaguggcccagcccagacugagacagccccccgagacccugcugacccugagacccaagcacggcggcaccaccgacgugggcgagccccuguggcccgagccccugggcguggagcacuuccugagagagaugggccaguucuacgaggccgagagcugccugguggaggccggcagacugcccgccggccagagaagauucgcccacuuccccggccuggccagcgagcugcugcugaccggccugccccuggagcugaucgacggcagcacccugagcaugcccgugagaugggugaccggccugcugaaggagcugcacgugagacuggagagaagaagcagacugguggugcugagcaccgugggcgugcccggcaccggcaagagcacccugcugaacaccauguucggccugagauucgccaccggcaagagcugcggccccagaggcgccuucaugcagcugaucaccguggccgagggcuucagccaggaccugggcugcgaccacauccuggugaucgacagcggcggccugaucggcggcgcccugaccagcgccggcgacagauucgagcuggaggccagccuggccacccugcugaugggccugagcaacgugaccgugaucagccuggccgagaccaaggacauccccgccgccauccugcacgccuuccugagacuggagaagaccggccacaugcccaacuaccaguucguguaccagaaccugcacgacgugagcgugcccggccccagacccagagacaagagacagcugcuggacccccccggcgaccugagcagagccgccgcccagauggagaagcagggcgacggcuucagagcccuggccggccuggccuucugcgaccccgagaagcagcacaucuggcacauccccggccuguggcacggcgccccccccauggccgccgugagccuggccuacagcgaggccaucuucgagcugaagagaugccugcuggagaacaucagaaacggccugagcaaccagaacaagaacauccagcagcugaucgagcuggugagaagacuguaa

SEQ ID NO: 25427 - RNA, 1428 nt, Artificial Sequence
  URI1__Homo_sapiens__NP_001239570
augaccaccuggagcagccugcagggcagccacgugagcaagagagcccuggccuacgcccugguggugaccaacugccaggagagaauccagcacuggaagaagguggacaacgacuacaacgcccugagagagagacugagcacccugcccgacaagcugagcuacaacaucauggugcccuucggccccuucgccuucaugcccggcaagcuggugcacaccaacgaggugaccgugcugcugggcgacaacugguucgccaagugcagcgccaagcaggccgugggccugguggagcacagaaaggagcacgugagaaagaccaucgacgaccugaagaaggugaugaagaacuucgagagcagaguggaguucaccgaggaccugcagaagaugagcgacgccgccggcgacaucguggacaucagagaggagaucaagugcgacuucgaguucaaggccaagcacagaaucgcccacaagccccacagcaagcccaagaccagcgacaucuucgaggccgacaucgccaacgacgugaagagcaaggaccugcuggccgacaaggagcugugggccagacuggaggagcuggagagacaggaggagcugcugggcgagcuggacagcaagcccgacaccgugaucgccaacggcgaggacaccaccagcagcgaggaggagaaggaggacagaaacaccaacgugaacgccaugcaccaggugaccgacagccacacccccugccacaaggacguggccagcagcgagcccuucagcggccaggugaacagccagcugaacugcagcgugaacggcagcagcagcuaccacagcgacgacgacgacgacgacgacgacgacgacgacgacgacaacaucgacgacgacgacggcgacaacgaccacgaggcccugggcgugggcgacaacagcauccccaccaucuacuucagccacaccguggagcccaagagagugagaaucaacaccggcaagaacaccacccugaaguucagcgagaagaaggaggaggccaagagaaagagaaagaacagcaccggcagcggccacagcgcccaggagcugcccaccaucagaacccccgccgacaucuacagagccuucguggacguggugaacggcgaguacgugcccagaaagagcauccugaagagcagaagcagagagaacagcgugugcagcgacaccagcgagagcagcgccgccgaguucgacgacagaagaggcgugcugagaagcaucagcugcgaggaggccaccugcagcgacaccagcgagagcauccuggaggaggagccccaggagaaccagaagaagcugcugccccugagcgugacccccgaggugcugagacuggugggcuacagcagaaaccuggccccccugaacgugauccuguaa

SEQ ID NO: 25428 - RNA, 441 nt, Artificial Sequence
  URM1__Homo_sapiens__NP_001129419
auggccgccccccugagcguggagguggaguucggcggcggcgccgagcugcuguucgacggcaucaagaagcacagagugacccugcccggccaggaggagcccugggacaucagaaaccugcugaucuggaucaagaagaaccugcugaaggagagacccgagcuguucauccagggcgacagcgugagacccggcauccuggugcugaucaacgacgccgacugggagcugcuggugagcacccugggcgacauccccccccccgcccccgcccuggccgccagcgugggcaagagaugggccagcccccaggcccacaucgaguggcugggcaacccccccccccacagcagccccacccugagacugcuggagagccccacccccggcgaggagggcaugggcagcuggggccacggcagcaccccccccagcuaa

SEQ ID NO: 25429 - RNA, 2211 nt, Artificial Sequence
  UROC1__Homo_sapiens__NP_001159446
augagcagccugcaggcccugugcagcggccugccccugagaccccugcccgagaacagaggcagacaggccggcgugccccacgcccccgugagaacccccagccugagccccguggagaagcagcuggcccugagaaacgcccugagauacuucccccccgacgugcaggagcugcuggcccccgaguucgcccaggagcugcagcuguacggccacaucuacauguacagauucugccccgacaucgagaugagagccuaccccaucgagcaguaccccugccagaccaagguggccgccgccaucaugcacaugaucaugaacaaccuggaccccgccguggcccaguucccccaggagcuggugaccuacggcggcaacggccagguguucagcaacugggcccaguucuggcugaccauguucuaccugagcaagaugaccgaggagcagacccuggugauguacagcggccacccccugggccuguuccccagcagcagaagcgcccccagacuggugaucaccaacggcauggugauccccaacuacagcagcagaaccgaguacgagaagcuguucgcccugggcgugaccauguacggccagaugaccgccggcagcuacugcuacaucggcccccagggcaucgugcacggcaccgugcugaccgugcugaacgccgccagaagauaccugggcaucgaggaccuggccggcaagguguucgugaccagcggccugggcggcaugagcggcgcccaggccaaggccgccgugaucgugggcugcaucggcgugaucgccgagguggacaaggccgcccuggagaagagacacagacagggcuggcugauggaggugaccgacagccuggacagaugcauccagagacugagagugcugcagcugggccugcagcaggcccugggcugggccggccugcccgccgcccugggccugugcgugcugagcugcuucgugaaccuggccccccugggcgagggcagaugccuggcccccagcggcuucagcagaccccugcugggcgcccccgugcugcugcugugccccagcagagaggccagaaagaagaaggaggugcugagccugggcuaccacggcaacgugguggcccugugggagagacuggugcacgagcuggacaccaccggcgagugccugguggaccugggcagcgaccagaccagcugccacaaccccuucaacggcggcuacuaccccgugcagcugagcuucaccgaggcccagagccugauggccagcaaccccgccguguucaaggaccuggugcaggagagccugagaagacaggugagcgccaucaacagacuggccgaggagaaguucuucuucugggacuacggcaacgccuuccugcuggaggcccagagagccggcgccgacguggagaagaagggcgccggcagaaccgaguucagauaccccagcuacgugcagcacaucaugggcgacaucuucagccagggcuucggccccuucagaugggugugcaccagcggcgacccccaggaccuggccgugaccgacgagcuggccaccagcgugcuggaggaggccaucgccgacggcgugaaggugagcgugaagcugcaguacauggacaacaucagauggaucagagaggccgccagacacagacugguggugggcagccaggccagaauccuguacagcgaccagaagggcagaguggccaucgccguggccaucaaccaggccaucgccugcagaagaaucaaggcccccguggugcugagcagagaccaccacgacgugagcggcaccgacagccccuucagagagaccagcaacaucuacgacggcagcgccuucugcgccgacauggccgugcagaacuucgugggcgacgccugcagaggcgccaccuggguggcccugcacaacggcggcggcgugggcuggggcgaggugaucaacggcggcuucggccuggugcuggacggcacccccgaggccgagggcagagccagacugaugcugagcugggacgugagcaacggcguggccagaagaugcuggagcggcaaccagaaggccuacgagaucaucugccagaccaugcaggagaacagcacccugguggugacccugccccacaagguggaggacgagagagugcugcagcaggcccugcagcuguaa

SEQ ID NO: 25430 - RNA, 1041 nt, Artificial Sequence
  UROD__Homo_sapiens__XP_011540382
auggaggccaacggccugggcccccagggcuuccccgagcugaagaacgacaccuuccugagagccgccuggggcgaggagaccgacuacacccccguguggugcaugagacaggccggcagauaccugcccgaguucagagagaccagagccgcccaggacuucuucagcaccugcagaagccccgaggccugcugcgagcugacccugcaggcccugggcauggaggugaccauggugcccggcaagggccccagcuuccccgagccccugagagaggagcaggaccuggagagacugagagaccccgaggugguggccagcgagcugggcuacguguuccaggccaucacccugaccagacagagacuggccggcagagugccccugaucggcuucgccggcgcccccuggacccugaugaccuacaugguggagggcggcggcagcagcaccauggcccaggccaagagauggcuguaccagagaccccaggccagccaccagcugcugagaauccugaccgacgcccuggugcccuaccuggugggccaggugguggccggcgcccaggcccugcagcuguucgagagccacgccggccaccugggcccccagcuguucaacaaguucgcccugcccuacaucagagacguggccaagcaggugaaggccagacugagagaggccggccuggcccccgugcccaugaucaucuucgccaaggacggccacuucgcccuggaggagcuggcccaggccggcuacgagguggugggccuggacuggaccguggcccccaagaaggccagagagugcgugggcaagaccgugacccugcagggcaaccuggaccccugcgcccuguacgccagcgaggaggagaucggccagcuggugaagcagaugcuggacgacuucggcccccacagauacaucgccaaccugggccacggccuguaccccgacauggaccccgagcacgugggcgccuucguggacgccgugcacaagcacagcagacugcugagacagaacuaa

SEQ ID NO: 25431 - RNA, 798 nt, Artificial Sequence
  UROS__Homo_sapiens__NP_000366
augaaggugcugcugcugaaggacgccaaggaggacgacugcggccaggaccccuacaucagagagcugggccuguacggccuggaggccacccugauccccgugcugagcuucgaguuccugagccugcccagcuucagcgagaagcugagccaccccgaggacuacggcggccugaucuucaccagccccagagccguggaggccgccgagcugugccuggagcagaacaacaagaccgaggugugggagagaagccugaaggagaaguggaacgccaagagcguguacguggugggcaacgccaccgccagccuggugagcaagaucggccuggacaccgagggcgagaccugcggcaacgccgagaagcuggccgaguacaucugcagcagagagagcagcgcccugccccugcuguuccccugcggcaaccugaagagagagauccugcccaaggcccugaaggacaagggcaucgccauggagagcaucaccguguaccagaccguggcccaccccggcauccagggcaaccugaacagcuacuacagccagcagggcgugcccgccagcaucaccuucuucagccccagcggccugaccuacagccugaagcacauccaggagcugagcggcgacaacaucgaccagaucaaguucgccgccaucggccccaccaccgccagagcccuggccgcccagggccugcccgugagcugcaccgccgagagccccaccccccaggcccuggccaccggcaucagaaaggcccugcagccccacggcugcugcuaa

SEQ ID NO: 25432 - RNA, 744 nt, Artificial Sequence
  USB1__Homo_sapiens__NP_001182231
augagcgccgccccccuggugggcuacagcagcagcggcagcgaggacgagagcgaggacggcaugagaaccagacccggcgacggcagccacagaagaggccagagcccccugcccagacagagauuccccgugcccgacagcgugcugaacauguuccccggcaccgaggagggccccgaggacgacagcaccaagcacggcggcagagugagaaccuucccccacgagagaggcaacugggccacccacguguacgugcccuacgaggccaaggaggaguuccuggaccugcuggacgugcugcugccccacgcccagaccuacgugcccagacuggugagaaugaagguguuccaccugagccugagccagagcguggugcugagacaccacuggauccugcccuucgugcaggcccugaaggccagaaugaccagcuuccacagaaccuucaucggccuggaggugaccagcggccacgcccaguuccuggaccuggugagcgagguggacagagugauggaggaguucaaccugaccaccuucuaccaggaccccagcuuccaccugagccuggccuggugcgugggcgacgccagacugcagcuggagggccagugccugcaggagcugcaggccaucguggacggcuucgaggacgccgaggugcugcugagagugcacaccgagcaggugagaugcaagagcggcaacaaguucuucagcaugccccugaaguaa

SEQ ID NO: 25433 - RNA, 780 nt, Artificial Sequence
  USE1__Homo_sapiens__NP_060937
auggccgccagcagacuggagcugaaccuggugagacugcugagcagaugcgaggccauggccgccgagaagagagaccccgacgaguggagacuggagaaguacgugggcgcccuggaggacaugcugcaggcccugaaggugcacgccagcaagcccgccagcgaggugaucaacgaguacagcuggaagguggacuuccugaagggcaugcugcaggccgagaagcugaccagcagcagcgagaaggcccuggccaaccaguuccuggcccccggcagagugcccaccaccgccagagagagagugcccgccaccaagaccgugcaccugcagagcagagccagauacaccagcgagaugagaagcgagcugcugggcaccgacagcgccgagcccgagauggacgugagaaagagaaccggcguggccggcagccagcccgugagcgagaagcagagcgccgccgagcuggaccuggugcugcagagacaccagaaccugcaggagaagcuggccgaggagaugcugggccuggccagaagccugaagaccaacacccuggccgcccagagcgugaucaagaaggacaaccagacccugagccacagccugaagauggccgaccagaaccuggagaagcugaagaccgagagcgagagacuggagcagcacacccagaagagcgugaacuggcugcugugggccaugcugaucaucgugugcuucaucuucaucagcaugauccuguucaucagaaucaugcccaagcugaaguaa

SEQ ID NO: 25434 - RNA, 933 nt, Artificial Sequence
  USF1__Homo_sapiens__NP_001263302
augaagggccagcagaagaccgccgagaccgaggagggcaccgugcagauccaggagggcgccguggccaccggcgaggaccccaccagcguggccaucgccagcauccagagcgccgccaccuuccccgaccccaacgugaaguacguguucagaaccgagaacggcggccaggugauguacagagugauccaggugagcgagggccagcuggacggccagaccgagggcaccggcgccaucagcggcuaccccgccacccagagcaugacccaggccgugauccagggcgccuucaccagcgacgacgccguggacaccgagggcaccgccgccgagacccacuacaccuacuuccccagcaccgccgugggcgacggcgccggcggcaccaccagcggcagcaccgccgccguggugaccacccagggcagcgaggcccugcugggccaggccaccccccccggcaccggccaguucuucgugaugaugagcccccaggaggugcugcagggcggcagccagagaagcaucgcccccagaacccaccccuacagccccaagagcgaggcccccagaaccaccagagacgagaagagaagagcccagcacaacgagguggagagaagaagaagagacaagaucaacaacuggaucgugcagcugagcaagaucauccccgacugcagcauggagagcaccaagagcggccagagcaagggcggcauccugagcaaggccugcgacuacauccaggagcugagacagagcaaccacagacugagcgaggagcugcagggccuggaccagcugcagcuggacaacgacgugcugagacagcagguggaggaccugaagaacaagaaccugcugcugagagcccagcugagacaccacggccuggagguggugaucaagaacgacagcaacuaa

SEQ ID NO: 25435 - RNA, 1041 nt, Artificial Sequence
  USF2__Homo_sapiens__NP_003358
auggacaugcuggaccccggccuggaccccgccgccagcgccaccgccgccgccgccgccagccacgacaagggccccgaggccgaggagggcguggagcugcaggagggcggcgacggccccggcgccgaggagcagaccgccguggccaucaccagcgugcagcaggccgccuucggcgaccacaacauccaguaccaguucagaaccgagaccaacggcggccaggugaccuacagaguggugcaggugaccgacggccagcuggacggccagggcgacaccgccggcgccgugagcguggugagcaccgccgccuucgccggcggccagcaggccgugacccaggugggcguggacggcgccgcccagagacccggccccgccgccgccagcgugccccccggccccgccgcccccuucccccuggccgugauccagaaccccuucagcaacggcggcagccccgccgccgaggccgugagcggcgaggccagauucgccuacuuccccgccagcagcgugggcgacaccaccgccgugagcgugcagaccaccgaccagagccugcaggccggcggccaguucuacgugaugaugaccccccaggacgugcugcagaccggcacccagagaaccaucgcccccagaacccaccccuacagccccaagaucgacggcaccagaacccccagagacgagagaagaagagcccagcacaacgagguggagagaagaagaagagacaagaucaacaacuggaucgugcagcugagcaagaucauccccgacugcaacgccgacaacagcaagaccggcgccagcaagggcggcauccugagcaaggccugcgacuacaucagagagcugagacagaccaaccagagaaugcaggagaccuucaaggaggccgagagacugcagauggacaacgagcugcugagacagcagaucgaggagcugaagaacgagaacgcccugcugagagcccagcugcagcagcacaaccuggagauggugggcgagggcaccagacaguaa

SEQ ID NO: 25436 - RNA, 1602 nt, Artificial Sequence
  USH1C__Homo_sapiens__NP_001284693
auggacagaaagguggccagagaguucagacacaagguggacuuccugaucgagaacgacgccgagaaggacuaccuguacgacgugcugagaauguaccaccagaccauggacguggccgugcuggugggcgaccugaagcuggugaucaacgagcccagcagacugccccuguucgacgccaucagaccccugaucccccugaagcaccagguggaguacgaccagcugacccccagaagaagcagaaagcugaaggaggugagacuggacagacugcaccccgagggccugggccugagcgugagaggcggccuggaguucggcugcggccuguucaucagccaccugaucaagggcggccaggccgacagcgugggccugcaggugggcgacgagaucgugagaaucaacggcuacagcaucagcagcugcacccacgaggaggugaucaaccugaucagaaccaagaagaccgugagcaucaaggugagacacaucggccugauccccgugaagagcagccccgacgagccccugaccuggcaguacguggaccaguucgugagcgagagcggcggcgugagaggcagccugggcagccccggcaacagagagaacaaggagaagaagguguucaucagccuggugggcagcagaggccugggcugcagcaucagcagcggccccauccagaagcccggcaucuucaucagccacgugaagcccggcagccugagcgccgaggugggccuggagaucggcgaccagaucguggaggugaacggcguggacuucagcaaccuggaccacaaggagggcagagagcuguucaugaccgacagagagagacuggccgaggccagacagagagagcugcagagacaggagcugcugaugcagaagagacuggccauggagagcaacaagauccugcaggagcagcaggagauggagagacagagaagaaaggagaucgcccagaaggccgccgaggagaacgagagauacagaaaggagauggagcagaucguggaggaggaggagaaguucaagaagcagugggaggaggacuggggcagcaaggagcagcugcugcugcccaagaccaucaccgccgaggugcaccccgugccccugagaaagcccaaguacgaccagggcguggagcccgagcuggagcccgccgacgaccuggacggcggcaccgaggagcagggcgagcaggacuucagaaaguacgaggagggcuucgaccccuacagcauguucacccccgagcagaucaugggcaaggacgugagacugcugagaaucaagaaggagggcagccuggaccuggcccuggagggcggcguggacagccccaucggcaaggugguggugagcgccguguacgagagaggcgccgccgagagacacggcggcaucgugaagggcgacgagaucauggccaucaacggcaagaucgugaccgacuacacccuggccgaggccgaggccgcccugcagaaggccuggaaccagggcggcgacuggaucgaccuggugguggccgugugcccccccaaggaguacgacgacgagcugaccuucuucuaa

SEQ ID NO: 25437 - RNA, 1386 nt, Artificial Sequence
  USH1G__Homo_sapiens__NP_775748
augaacgaccaguaccacagagccgccagagacggcuaccuggagcugcugaaggaggccaccagaaaggagcugaacgcccccgacgaggacggcaugacccccacccugugggccgccuaccacggcaaccuggagagccugagacugaucgugagcagaggcggcgaccccgacaagugcgacaucuggggcaacaccccccugcaccuggccgccagcaacggccaccugcacugccugagcuuccuggugagcuucggcgccaacaucuggugccuggacaacgacuaccacaccccccuggacauggccgccaugaagggccacauggagugcgugagauaccuggacagcaucgccgccaagcagagcagccugaaccccaagcuggugggcaagcugaaggacaaggccuucagagaggccgagagaagaaucagagagugcgccaagcugcagagaagacaccacgagagaauggagagaagauacagaagagagcuggccgagagaagcgacacccugagcuucagcagccugaccagcagcacccugagcagaagacugcagcaccuggcccugggcagccaccugcccuacagccaggccacccugcacggcaccgccagaggcaagaccaagaugcagaagaagcuggagagaagaaagcagggcggcgagggcaccuucaaggugagcgaggacggcagaaagagcgccagaagccugagcggccugcagcugggcagcgacgugauguucgugagacagggcaccuacgccaaccccaaggaguggggcagagccccccugagagacauguuccugagcgacgaggacagcgugagcagagccacccuggccgccgagcccgcccacagcgaggugagcaccgacagcggccacgacagccuguucaccagacccggccugggcaccaugguguucagaagaaacuaccugagcagcggccugcacggccugggcagagaggacggcggccuggacggcgugggcgcccccagaggcagacugcagagcagccccagccuggacgacgacagccugggcagcgccaacagccugcaggacagaagcugcggcgaggagcugcccugggacgagcuggaccugggccuggacgaggaccuggagcccgagaccagcccccuggagaccuuccuggccagccugcacauggaggacuucgccgcccugcugagacaggagaagaucgaccuggaggcccugaugcugugcagcgaccuggaccugagaagcaucagcgugccccugggccccagaaagaagauccugggcgccgugagaagaagaagacaggccauggagagaccccccgcccuggaggacaccgagcuguaa

SEQ ID NO: 25438 - RNA, 4641 nt, Artificial Sequence
  USH2A__Homo_sapiens__NP_009054
augaacugccccgugcugagccugggcagcggcuuccuguuccaggugaucgagaugcugaucuucgccuacuucgccagcaucagccugaccgagagcagaggccuguuccccagacuggagaacgugggcgccuucaagaaggugagcaucgugcccacccaggccgugugcggccugcccgacagaagcaccuucugccacagcagcgccgccgccgagagcauccaguucugcacccagagauucugcauccaggacugccccuacagaagcagccaccccaccuacaccgcccuguucagcgccggccugagcagcugcaucacccccgacaagaacgaccugcaccccaacgcccacagcaacagcgccagcuucaucuucggcaaccacaagagcugcuucagcagcccccccagccccaagcugauggccagcuucacccuggccguguggcugaagcccgagcagcagggcgugaugugcgugaucgagaagaccguggacggccagaucguguucaagcugaccaucagcgagaaggagaccauguucuacuacagaaccgugaacggccugcagccccccaucaaggugaugacccugggcagaauccuggugaagaaguggauccaccugagcgugcaggugcaccagaccaagaucagcuucuucaucaacggcguggagaaggaccacacccccuucaacgccagaacccugagcggcagcaucaccgacuucgccagcggcaccgugcagaucggccagagccugaacggccuggagcaguucgugggcagaaugcaggacuucagacuguaccagguggcccugaccaacagagagauccuggagguguucagcggcgaccugcugagacugcacgcccagagccacugcagaugccccggcagccaccccagagugcacccccuggcccagagauacugcauccccaacgacgccggcgacaccgccgacaacagagugagcagacugaaccccgaggcccacccccugagcuucgugaacgacaacgacgugggcaccagcugggugagcaacguguucaccaacaucacccagcugaaccagggcgugaccaucagcguggaccuggagaacggccaguaccagguguucuacaucaucauccaguucuucagcccccagcccaccgagaucagaauccagagaaagaaggagaacagccuggacugggaggacuggcaguacuucgccagaaacugcggcgccuucggcaugaagaacaacggcgaccuggagaagcccgacagcgugaacugccugcagcugagcaacuucacccccuacagcagaggcaacgugaccuucagcauccugacccccggccccaacuacagacccggcuacaacaacuucuacaacacccccagccugcaggaguucgugaaggccacccagaucagauuccacuuccacggccaguacuacaccaccgagaccgccgugaaccugagacacagauacuacgccguggacgagaucaccaucagcggcagaugccagugccacggccacgccgacaacugcgacaccaccagccagcccuacagaugccugugcagccaggagagcuucaccgagggccugcacugcgacagaugccugccccuguacaacgacaagcccuucagacagggcgaccagguguacgccuucaacugcaagcccugccagugcaacagccacagcaagagcugccacuacaacaucagcguggaccccuuccccuucgagcacuucagaggcggcggcggcgugugcgacgacugcgagcacaacaccaccggcagaaacugcgagcugugcaaggacuacuucuucagacaggugggcgccgaccccagcgccaucgacgugugcaagcccugcgacugcgacaccgugggcaccagaaacggcagcauccugugcgaccagaucggcggccagugcaacugcaagagacacgugagcggcagacagugcaaccagugccagaacggcuucuacaaccugcaggagcuggaccccgacggcugcagccccugcaacugcaacaccagcggcaccguggacggcgacaucaccugccaccagaacagcggccagugcaagugcaaggccaacgugaucggccugagaugcgaccacugcaacuucggcuucaaguuccugagaagcuucaacgacgugggcugcgagcccugccagugcaaccugcacggcagcgugaacaaguucugcaacccccacagcggccagugcgagugcaagaaggaggccaagggccugcagugcgacaccugcagagagaacuucuacggccuggacgugaccaacugcaaggccugcgacugcgacaccgccggcagccugcccggcaccgugugcaacgccaagaccggccagugcaucugcaagcccaacguggagggcagacagugcaacaagugccuggagggcaacuucuaccugagacagaacaacagcuuccugugccugcccugcaacugcgacaagaccggcaccaucaacggcagccugcugugcaacaagagcaccggccagugccccugcaagcugggcgugaccggccugagaugcaaccagugcgagccccacagauacaaccugaccaucgacaacuuccagcacugccagaugugcgagugcgacagccugggcacccugcccggcaccaucugcgaccccaucagcggccagugccugugcgugcccaacagacagggcagaagaugcaaccagugccagcccggcuucuacaucagccccggcaacgccaccggcugccugcccugcagcugccacaccaccggcgccgugaaccacaucugcaacagccugaccggccagugcgugugccaggacgccagcaucgccggccagagaugcgaccagugcaaggaccacuacuucggcuucgacccccagaccggcagaugccagcccugcaacugccaccugagcggcgcccugaacgagaccugccaccuggugaccggccagugcuucugcaagcaguucgugaccggcagcaagugcgacgccugcgugcccagcgccagccaccuggacgugaacaaccugcugggcugcagcaagacccccuuccagcagcccccccccagaggccaggugcagagcagcagcgccaucaaccugagcuggagcccccccgacagccccaacgcccacuggcugaccuacagccugcugagagacggcuucgagaucuacaccaccgaggaccaguaccccuacagcauccaguacuuccuggacaccgaccugcugcccuacaccaaguacagcuacuacaucgagaccaccaacgugcacggcagcaccagaagcguggccgugaccuacaagaccaagcccggcgugcccgagggcaaccugacccugagcuacaucauccccaucggcagcgacagcgugacccugaccuggaccacccugagcaaccagagcggccccaucgagaaguacauccugagcugcgccccccuggccggcggccagcccugcgugagcuacgagggccacgagaccagcgccaccaucuggaaccuggugcccuucgccaaguacgacuucagcgugcaggccugcaccagcggcggcugccugcacagccugcccaucaccgugaccaccgcccaggcccccccccagagacugagcccccccaagaugcagaagaucagcagcaccgagcugcacguggaguggagcccccccgccgagcugaacggcaucaucaucagauacgagcuguacaugagaagacugagaagcaccaaggagaccaccagcgaggagagcagaguguuccagagcagcggcuggcugagcccccacagcuucguggagagcgccaacgagaacgcccugaagcccccccagaccaugaccaccaucaccggccuggagcccuacaccaaguacgaguucagagugcuggccgugaacauggccggcagcgugagcagcgccugggugagcgagagaaccggcgagagcgcccccguguucaugaucccccccagcguguucccccugagcagcuacagccugaacaucagcugggagaagcccgccgacaacgugaccagaggcaagguggugggcuacgacaucaacaugcugagcgagcagagcccccagcagagcauccccauggccuucagccagcugcugcacaccgccaagagccaggagcugagcuacaccguggagggccugaagcccuacagaaucuacgaguucaccaucacccugugcaacagcgugggcugcgugaccagcgccagcggcgccggccagacccuggccgccgcccccgcccagcugagacccccccuggugaagggcaucaacagcaccaccauccaccugaagugguucccccccgaggagcugaacggccccagccccaucuaccagcuggagagaagagagagcagccugcccgcccugaugaccaccaugaugaagggcaucagauucaucggcaacggcuacugcaaguuccccagcagcacccaccccgugaacaccgacuucaccggcaagugcguguaa

SEQ ID NO: 25439 - RNA, 2922 nt, Artificial Sequence
  USO1__Homo_sapiens__NP_001276978
augaacuuccugagaggcgugaugggcggccagagcgccggcccccagcacaccgaggccgagaccauccagaagcugugcgacagaguggccagcagcacccugcuggacgacagaagaaacgccgugagagcccugaagagccugagcaagaaguacagacuggaggugggcauccaggccauggagcaccugauccacgugcugcagaccgacagaagcgacagcgagaucaucggcuacgcccuggacacccuguacaacaucaucagcaacgaggaggaggaggagguggacgacguggaggaggagaacagcaccagacagagcgaggaccugggcagccaguucaccgagaucuucaucaagcagcaggagaacgugacccugcugcugagccugcuggaggaguucgacuuccacgugagauggcccggcgugaagcugcugaccagccugcugaagcagcugggcccccaggugcagcagaucauccuggugagccccaugggcgugagcagacugauggaccugcuggccgacagcagagaggugaucagaaacgacggcgugcugcugcugcaggcccugaccagaagcaacggcgccauccagaagaucguggccuucgagaacgccuucgagagacugcuggacaucaucagcgaggagggcaacagcgacggcggcaucgugguggaggacugccugauccugcugcagaaccugcugaagaacaacaacagcaaccagaacuucuucaaggagggcagcuacauccagagaaugaagcccugguucgaggugggcgacgagaacagcggcuggagcgcccagaaggugaccaaccugcaccugaugcugcagcuggugagagugcuggugagccccaccaacccccccggcgccaccagcagcugccagaaggccauguuccagugcggccugcugcagcagcugugcaccauccugauggccaccggcgugcccgccgacauccugaccgagaccaucaacaccgugagcgaggugaucagaggcugccaggugaaccaggacuacuucgccagcgugaacgcccccagcaacccccccagacccgccaucguggugcugcugaugagcauggugaacgagagacagcccuucgugcugagaugcgccgugcuguacugcuuccagugcuuccuguacaagaaccagaagggccagggcgagaucgugagcacccugcugcccagcaccaucgacgccaccggcaacagcgugagcgccggccagcugcugugcggcggccuguucagcaccgacagccugagcaacuggugcgccgccguggcccuggcccacgcccugcaggagaacgccacccagaaggagcagcugcugagagugcagcuggccaccagcaucggcaacccccccgugagccugcugcagcagugcaccaacauccugagccagggcgacaagaucgacagaagaggcagcaagauccagaccagagugggccugcugaugcugcugugcaccuggcugagcaacugccccaucgccgugacccacuuccugcacaacagcgccaacgugcccuuccugaccggccagaucgccgagaaccugggcgaggaggagcagcuggugcagggccugugcgcccugcugcugggcaucagcaucuacuucaacgacaacagccuggagagcuacaugaaggagaagcugaagcagcugaucgagaagagaaucggcaaggagaacuucaucgagaagcugggcuucaucagcaagcacgagcuguacagcagagccagccagaagccccagcccaacuuccccagccccgaguacaugaucuucgaccacgaguucaccaagcuggugaaggagcuggagggcgugaucaccaaggccaucuacaagagcagcgaggaggacaagaaggaggaggaggugaagaagacccuggagcagcacgacaacaucgugacccacuacaagaacaugaucagagagcaggaccugcagcuggaggagcugagacagcaggugagcacccugaagugccagaacgagcagcugcagaccgccgugacccagcaggugagccagauccagcagcacaaggaccaguacaaccugcugaagauccagcugggcaaggacaaccagcaccagggcagcuacagcgagggcgcccagaugaacggcauccagcccgaggagaucggcagacugagagaggagaucgaggagcugaagagaaaccaggagcugcugcagagccagcugaccgagaaggacagcaugaucgagaacaugaagagcagccagaccagcggcaccaacgagcagagcagcgccaucgugagcgccagagacagcgagcagguggccgagcugaagcaggagcuggccacccugaagagccagcugaacagccagagcguggagaucaccaagcugcagaccgagaagcaggagcugcugcagaagaccgaggccuucgccaagagcguggaggugcagggcgagaccgagaccaucaucgccaccaagaccaccgacguggagggcagacugagcgcccugcugcaggagaccaaggagcugaagaacgagaucaaggcccugagcgaggagagaaccgccaucaaggagcagcuggacagcagcaacagcaccaucgccauccugcagaccgagaaggacaagcuggagcuggagaucaccgacagcaagaaggagcaggacgaccugcuggugcugcuggccgaccaggaccagaagauccugagccugaagaacaagcugaaggaccugggccaccccguggaggaggaggacgagcuggagagcggcgaccaggaggacgaggacgacgagagcgaggaccccggcaaggaccuggaccacaucuaa

SEQ ID NO: 25440 - RNA, 2397 nt, Artificial Sequence
  USP10__Homo_sapiens__NP_005144
auggcccugcacagcccccaguacaucuucggcgacuucagccccgacgaguucaaccaguucuucgugacccccagaagcagcguggagcugccccccuacagcggcaccgugcugugcggcacccaggccguggacaagcugcccgacggccaggaguaccagagaaucgaguucggcguggacgaggugaucgagcccagcgacacccugcccagaacccccagcuacagcaucagcagcacccugaacccccaggcccccgaguucauccugggcugcaccgccagcaagaucacccccgacggcaucaccaaggaggccagcuacggcagcaucgacugccaguaccccggcagcgcccuggcccuggacggcagcagcaacguggaggccgaggugcuggagaacgacggcgugagcggcggccugggccagagagagagaaagaagaagaagaagagaccccccggcuacuacagcuaccugaaggacggcggcgacgacagcaucagcaccgaggcccuggugaacggccacgccaacagcgccgugcccaacagcgugagcgccgaggacgccgaguucaugggcgacaugccccccagcgugacccccagaaccugcaacagcccccagaacagcaccgacagcgugagcgacaucgugcccgacagccccuuccccggcgcccugggcagcgacaccagaaccgccggccagcccgagggcggccccggcgccgacuucggccagagcugcuuccccgccgaggccggcagagacacccugagcagaaccgccggcgcccagcccugcgugggcaccgacaccaccgagaaccugggcguggccaacggccagauccuggagagcagcggcgagggcaccgccaccaacggcguggagcugcacaccaccgagagcaucgaccuggaccccaccaagcccgagagcgccagcccccccgccgacggcaccggcagcgccagcggcacccugcccgugagccagcccaagagcugggccagccuguuccacgacagcaagcccagcagcagcagccccguggccuacguggagaccaaguacagcccccccgccaucagcccccuggugagcgagaagcagguggaggugaaggagggccuggugcccgugagcgaggaccccguggccaucaagaucgccgagcugcuggagaacgugacccugauccacaagcccgugagccugcagcccagaggccugaucaacaagggcaacuggugcuacaucaacgccacccugcaggcccugguggccugcccccccauguaccaccugaugaaguucaucccccuguacagcaaggugcagagacccugcaccagcacccccaugaucgacagcuucgugagacugaugaacgaguucaccaacaugcccgugccccccaagcccagacaggcccugggcgacaagaucgugagagacaucagacccggcgccgccuucgagcccaccuacaucuacagacugcugaccgugaacaagagcagccugagcgagaagggcagacaggaggacgccgaggaguaccugggcuucauccugaacggccugcacgaggagaugcugaaccugaagaagcugcugagccccagcaacgagaagcugaccaucagcaacggccccaagaaccacagcgugaacgaggaggagcaggaggagcagggcgagggcagcgaggacgagugggagcaggugggccccagaaacaagaccagcgugaccagacaggccgacuucgugcagacccccaucaccggcaucuucggcggccacaucagaagcgugguguaccagcagagcagcaaggagagcgccacccugcagcccuucuucacccugcagcuggacauccagagcgacaagaucagaaccgugcaggacgcccuggagagccugguggccagagagagcgugcagggcuacaccaccaagaccaagcaggagguggagaucagcagaagagugacccuggagaagcugccccccgugcuggugcugcaccugaagagauucguguacgagaagaccggcggcugccagaagcugaucaagaacaucgaguaccccguggaccuggagaucagcaaggagcugcugagccccggcgugaagaacaagaacuucaagugccacagaaccuacagacuguucgccgugguguaccaccacggcaacagcgccaccggcggccacuacaccaccgacguguuccagaucggccugaacggcuggcugagaaucgacgaccagaccgugaaggugaucaaccaguaccagguggugaagcccaccgccgagagaaccgccuaccugcuguacuacagaagaguggaccugcuguaa

SEQ ID NO: 25441 - RNA, 2892 nt, Artificial Sequence
  USP11__Homo_sapiens__NP_004642
auggccguggcccccagacuguucggcggccugugcuucagauucagagaccagaaccccgagguggccguggagggcagacugcccaucagccacagcugcgugggcugcagaagagagagaaccgccauggccaccguggccgccaaccccgccgccgccgccgccgccguggccgccgccgccgccgugaccgaggacagagagccccagcacgaggagcugcccggccuggacagccaguggagacagaucgagaacggcgagagcggcagagagagaccccugagagccggcgagagcugguuccugguggagaagcacugguacaagcagugggaggccuacgugcagggcggcgaccaggacagcagcaccuuccccggcugcaucaacaacgccacccuguuccaggacgagaucaacuggagacugaaggagggccugguggagggcgaggacuacgugcugcugcccgccgccgccuggcacuaccuggugagcugguacggccuggagcacggccagccccccaucgagagaaaggugaucgagcugcccaacauccagaagguggagguguaccccguggagcugcugcuggugagacacaacgaccugggcaagagccacaccgugcaguucagccacaccgacagcaucggccuggugcugagaaccgccagagagagauuccugguggagccccaggaggacaccagacugugggccaagaacagcgagggcagccuggacagacuguacgacacccacaucaccgugcuggacgccgcccuggagaccggccagcugaucaucauggagaccagaaagaaggacggcaccuggcccagcgcccagcugcacgugaugaacaacaacaugagcgaggaggacgaggacuucaagggccagcccggcaucugcggccugaccaaccugggcaacaccugcuucaugaacagcgcccugcagugccugagcaacgugccccagcugaccgaguacuuccugaacaacugcuaccuggaggagcugaacuucagaaacccccugggcaugaagggcgagaucgccgaggccuacgccgaccuggugaagcaggccuggagcggccaccacagaagcaucgugccccacguguucaagaacaaggugggccacuucgccagccaguuccugggcuaccagcagcacgacagccaggagcugcugagcuuccugcuggacggccugcacgaggaccugaacagagugaagaagaaggaguacguggagcugugcgacgccgccggcagacccgaccaggagguggcccaggaggccuggcagaaccacaagagaagaaacgacagcgugaucguggacaccuuccacggccuguucaagagcacccuggugugccccgacugcggcaacgugagcgugaccuucgaccccuucugcuaccugagcgugccccugcccaucagccacaagagagugcuggagguguucuucauccccauggaccccagaagaaagcccgagcagcacagacugguggugcccaagaagggcaagaucagcgaccugugcguggcccugagcaagcacaccggcaucagccccgagagaaugaugguggccgacguguucagccacagauucuacaagcuguaccagcuggaggagccccugagcagcauccuggacagagacgacaucuucguguacgaggugagcggcagaaucgaggccaucgagggcagcagagaggacaucguggugcccguguaccugagagagagaacccccgccagagacuacaacaacagcuacuacggccugaugcuguucggccacccccugcuggugagcgugcccagagacagauucaccugggagggccuguacaacgugcugauguacagacugagcagauacgugaccaagcccaacagcgacgacgaggacgacggcgacgagaaggaggacgacgaggaggacaaggacgacgugcccggccccagcaccggcggcagccugagagaccccgagcccgagcaggccggccccagcagcggcgugaccaacagaugccccuuccugcuggacaacugccugggcaccagccaguggccccccagaagaagaagaaagcagcuguucacccugcagaccgugaacagcaacggcaccagcgacagaaccaccagccccgaggaggugcacgcccagcccuacaucgccaucgacugggagcccgagaugaagaagagauacuacgacgagguggaggccgagggcuacgugaagcacgacugcgugggcuacgugaugaagaaggcccccgugagacugcaggagugcaucgagcuguucaccaccguggagacccuggagaaggagaaccccugguacugccccagcugcaagcagcaccagcuggccaccaagaagcuggaccuguggaugcugcccgagauccugaucauccaccugaagagauucagcuacaccaaguucagcagagagaagcuggacacccugguggaguuccccaucagagaccuggacuucagcgaguucgugauccagccccagaacgagagcaaccccgagcuguacaaguacgaccugaucgccgugagcaaccacuacggcggcaugagagacggccacuacaccaccuucgccugcaacaaggacagcggccaguggcacuacuucgacgacaacagcgugagccccgugaacgagaaccagaucgagagcaaggccgccuacgugcuguucuaccagagacaggacguggccagaagacugcugagccccgccggcagcagcggcgcccccgccagccccgccugcagcagcccccccagcagcgaguucauggacgugaacuaa

SEQ ID NO: 25442 - RNA, 1113 nt, Artificial Sequence
  USP12__Homo_sapiens__NP_872294
auggagauccugaugaccgugagcaaguucgccagcaucugcaccaugggcgccaacgccagcgcccuggagaaggagaucggccccgagcaguuccccgugaacgagcacuacuucggccuggugaacuucggcaacaccugcuacugcaacagcgugcugcaggcccuguacuucugcagacccuucagagagaaggugcuggccuacaagagccagcccagaaagaaggagagccugcugaccugccuggccgaccuguuccacagcaucgccacccagaagaagaaggugggcgugaucccccccaagaaguucaucaccagacugagaaaggagaacgagcuguucgacaacuacaugcagcaggacgcccacgaguuccugaacuaccugcugaacaccaucgccgacauccugcaggaggagagaaagcaggagaagcagaacggcagacugcccaacggcaacaucgacaacgagaacaacaacagcacccccgaccccaccugggugcacgagaucuuccagggcacccugaccaacgagaccagaugccugaccugcgagaccaucagcagcaaggacgaggacuuccuggaccugagcguggacguggagcagaacaccagcaucacccacugccugagaggcuucagcaacaccgagacccugugcagcgaguacaaguacuacugcgaggagugcagaagcaagcaggaggcccacaagagaaugaaggugaagaagcugcccaugauccuggcccugcaccugaagagauucaaguacauggaccagcugcacagauacaccaagcugagcuacagagugguguucccccuggagcugagacuguucaacaccagcggcgacgccaccaaccccgacagaauguacgaccugguggccgugguggugcacugcggcagcggccccaacagaggccacuacaucgccaucgugaagagccacgacuucuggcugcuguucgacgacgacaucguggagaagaucgacgcccaggccaucgaggaguucuacggccugaccagcgacaucagcaagaacagcgagagcggcuacauccuguucuaccagagcagagacuaa

SEQ ID NO: 25443 - RNA, 2592 nt, Artificial Sequence
  USP13__Homo_sapiens__NP_003931
augcagagaagaggcgcccuguucggcaugcccggcggcagcggcggcagaaagauggccgccggcgacaucggcgagcugcuggugccccacaugcccaccaucagagugcccagaagcggcgacagaguguacaagaacgagugcgccuucagcuacgacagccccaacagcgagggcggccuguacgugugcaugaacaccuuccuggccuucggcagagagcacguggagagacacuucagaaagaccggccagagcguguacaugcaccugaagagacacgugagagagaaggugagaggcgccagcggcggcgcccugcccaagagaagaaacagcaagaucuuccuggaccuggacaccgacgacgaccugaacagcgacgacuacgaguacgaggacgaggccaagcuggugaucuuccccgaccacuacgagaucgcccugcccaacaucgaggagcugcccgcccuggugaccaucgccugcgacgccgugcugagcagcaagagccccuacagaaagcaggaccccgacaccugggagaacgagcugcccgugagcaaguacgccaacaaccugacccagcuggacaacggcgugagaaucccccccagcggcuggaagugcgccagaugcgaccugagagagaaccuguggcugaaccugaccgacggcagcgugcugugcggcaagugguucuucgacagcagcggcggcaacggccacgcccuggagcacuacagagacaugggcuacccccuggccgugaagcugggcaccaucacccccgacggcgccgacguguacagcuuccaggaggaggagcccgugcuggacccccaccuggccaagcaccuggcccacuucggcaucgacaugcugcacaugcacggcaccgagaacggccugcaggacaacgacaucaagcugagagugagcgagugggaggugauccaggagagcggcaccaagcugaagcccauguacggccccggcuacaccggccugaagaaccugggcaacagcugcuaccugagcagcgugaugcaggccaucuucagcauccccgaguuccagagagccuacgugggcaaccugcccagaaucuucgacuacagcccccuggaccccacccaggacuucaacacccagaugaccaagcugggccacggccugcugagcggccaguacagcaagccccccgugaagagcgagcugaucgagcaggugaugaaggaggagcacaagccccagcagaacggcaucagccccagaauguucaaggccuucgugagcaagagccaccccgaguucagcagcaacagacagcaggacgcccaggaguucuuccugcaccuggugaaccugguggagagaaacagaaucggcagcgagaaccccagcgacguguucagauuccugguggaggagagaauccagugcugccagaccagaaaggugagauacaccgagagaguggacuaccugaugcagcugcccguggccauggaggccgccaccaacaaggacgagcugaucgccuacgagcugaccagaagagaggccgaggccaacagaagaccccugcccgagcuggugagagccaagauccccuucagcgccugccugcaggccuucagcgagcccgagaacguggacgacuucuggagcagcgcccugcaggccaagagcgccggcgugaagaccagcagauucgccagcuuccccgaguaccugguggugcagaucaagaaguucaccuucggccuggacugggugcccaagaaguucgacgugagcaucgacaugcccgaccugcuggacaucaaccaccugagagccagaggccugcagcccggcgaggaggagcugcccgacaucagcccccccaucgugauccccgacgacagcaaggacagacugaugaaccagcugaucgaccccagcgacaucgacgagagcagcgugaugcagcuggccgagaugggcuucccccuggaggccugcagaaaggccguguacuucaccggcaacaugggcgccgagguggccuucaacuggaucaucgugcacauggaggagcccgacuucgccgagccccugaccaugcccggcuacggcggcgccgccagcgccggcgccagcguguucggcgccagcggccuggacaaccagccccccgaggagaucguggccaucaucaccagcaugggcuuccagagaaaccaggccauccaggcccugagagccaccaacaacaaccuggagagagcccuggacuggaucuucagccaccccgaguucgaggaggacagcgacuucgugaucgagauggagaacaacgccaacgccaacaucaucagcgaggccaagcccgagggccccagagugaaggacggcagcggcaccuacgagcuguucgccuucaucagccacaugggcaccagcaccaugagcggccacuacaucugccacaucaagaaggagggcagaugggugaucuacaacgaccacaaggugugcgccagcgagagaccccccaaggaccugggcuacauguacuucuacagaagaauccccagcuaa

SEQ ID NO: 25444 - RNA, 1380 nt, Artificial Sequence
  USP14__Homo_sapiens__NP_001032411
augccccuguacagcgugaccgugaaguggggcaaggagaaguucgagggcguggagcugaacaccgacgagccccccaugguguucaaggcccagcuguucgcccugaccggcgugcagcccgccagacagaaggugauggugaagggcggcacccugaaggacgacgacuggggcaacaucaagaucaagaacauggagcugcccugcggccugaccaaccugggcaacaccugcuacaugaacgccaccgugcagugcaucagaagcgugcccgagcugaaggacgcccugaagagauacgccggcgcccugagagccagcggcgagauggccagcgcccaguacaucaccgccgcccugagagaccuguucgacagcauggacaagaccagcagcagcaucccccccaucauccugcugcaguuccugcacauggccuucccccaguucgccgagaagggcgagcagggccaguaccugcagcaggacgccaacgagugcuggauccagaugaugagagugcugcagcagaagcuggaggccaucgaggacgacagcgugaaggagaccgacagcagcagcgccagcgccgccacccccagcaagaagaagagccugaucgaccaguucuucggcguggaguucgagaccaccaugaagugcaccgagagcgaggaggaggaggugaccaagggcaaggagaaccagcugcagcugagcugcuucaucaaccaggaggugaaguaccuguucaccggccugaagcugagacugcaggaggagaucaccaagcagagccccacccugcagagaaacgcccuguacaucaagagcagcaagaucagcagacugcccgccuaccugaccauccagauggugagauucuucuacaaggagaaggagagcgugaacgccaaggugcugaaggacgugaaguucccccugaugcuggacauguacgagcugugcacccccgagcugcaggagaagauggugagcuucagaagcaaguucaaggaccuggaggacaagaaggugaaccagcagcccaacaccagcgacaagaagagcagcccccagaaggaggugaaguacgagcccuucagcuucgccgacgacaucggcagcaacaacugcggcuacuacgaccugcaggccgugcugacccaccagggcagaagcagcagcagcggccacuacgugagcugggugaagagaaagcaggacgaguggaucaaguucgacgacgacaaggugagcaucgugacccccgaggacauccugagacugagcggcggcggcgacuggcacaucgccuacgugcugcuguacggccccagaagaguggagaucauggaggaggagagcgagcaguaa

SEQ ID NO: 25445 - RNA, 2946 nt, Artificial Sequence
  USP15__Homo_sapiens__NP_001239007
auggccgagggcggcgccgccgaccuggacacccagagaagcgacaucgccacccugcugaagaccagccugagaaagggcgacaccugguaccugguggacagcagaugguucaagcaguggaagaaguacgugggcuucgacagcugggacaaguaccagaugggcgaccagaacguguaccccggccccaucgacaacagcggccugcugaaggacggcgacgcccagagccugaaggagcaccugaucgacgagcuggacuacauccugcugcccaccgagggcuggaacaagcuggugagcugguacacccugauggagggccaggagcccaucgccagaaaggugguggagcagggcauguucgugaagcacugcaagguggagguguaccugaccgagcugaagcugugcgagaacggcaacaugaacaacguggugaccagaagauucagcaaggccgacaccaucgacaccaucgagaaggagaucagaaagaucuucagcauccccgacgagaaggagaccagacuguggaacaaguacaugagcaacaccuucgagccccugaacaagcccgacagcaccauccaggacgccggccuguaccagggccaggugcuggugaucgagcagaagaacgaggacggcaccuggcccagaggccccagcacccccaagagccccggcgccagcaacuucagcacccugcccaagaucagccccagcagccugagcaacaacuacaacaacaugaacaacagaaacgugaagaacagcaacuacugccugcccagcuacaccgccuacaagaacuacgacuacagcgagcccggcagaaacaacgagcagcccggccugugcggccugagcaaccugggcaacaccugcuucaugaacagcgccauccagugccugagcaacacccccccccugaccgaguacuuccugaacgacaaguaccaggaggagcugaacuucgacaacccccugggcaugagaggcgagaucgccaagagcuacgccgagcugaucaagcagauguggagcggcaaguucagcuacgugacccccagagccuucaagacccaggugggcagauucgccccccaguucagcggcuaccagcagcaggacugccaggagcugcuggccuuccugcuggacggccugcacgaggaccugaacagaaucagaaagaagcccuacauccagcugaaggacgccgacggcagacccgacaaggugguggccgaggaggccugggagaaccaccugaagagaaacgacagcaucaucguggacaucuuccacggccuguucaagagcacccuggugugccccgagugcgccaagaucagcgugaccuucgaccccuucugcuaccugacccugccccugcccaugaagaaggagagaacccuggagguguaccuggugagaauggacccccugaccaagcccaugcaguacaaggugguggugcccaagaucggcaacauccuggaccugugcaccgcccugagcgcccugagcggcauccccgccgacaagaugaucgugaccgacaucuacaaccacagauuccacagaaucuucgccauggacgagaaccugagcagcaucauggagagagacgacaucuacguguucgagaucaacaucaacagaaccgaggacaccgagcacgugaucauccccgugugccugagagagaaguucagacacagcagcuacacccaccacaccggcagcagccuguucggccagcccuuccugauggccgugcccagaaacaacaccgaggacaagcuguacaaccugcugcugcugagaaugugcagauacgugaagaucagcaccgagaccgaggagaccgagggcagccugcacugcugcaaggaccagaacaucaacggcaacggccccaacggcauccacgaggagggcagccccagcgagauggagaccgacgagcccgacgacgagagcagccaggaccaggagcugcccagcgagaacgagaacagccagagcgaggacagcgugggcggcgacaacgacagcgagaacggccugugcaccgaggacaccugcaagggccagcugaccggccacaagaagagacuguucaccuuccaguucaacaaccugggcaacaccgacaucaacuacaucaaggacgacaccagacacaucagauucgacgacagacagcugagacuggacgagagaagcuuccuggcccuggacugggaccccgaccugaagaagagauacuucgacgagaacgccgccgaggacuucgagaagcacgagagcguggaguacaagccccccaagaagcccuucgugaagcugaaggacugcaucgagcuguucaccaccaaggagaagcugggcgccgaggaccccugguacugccccaacugcaaggagcaccagcaggccaccaagaagcuggaccuguggagccugccccccgugcugguggugcaccugaagagauucagcuacagcagauacaugagagacaagcuggacacccugguggacuuccccaucaacgaccuggacaugagcgaguuccugaucaaccccaacgccggccccugcagauacaaccugaucgccgugagcaaccacuacggcggcaugggcggcggccacuacaccgccuucgccaagaacaaggacgacggcaagugguacuacuucgacgacagcagcgugagcaccgccagcgaggaccagaucgugagcaaggccgccuacgugcuguucuaccagagacaggacaccuucagcggcaccggcuucuucccccuggacagagagaccaagggcgccagcgccgccaccggcaucccccuggagagcgacgaggacagcaacgacaacgacaacgacaucgagaacgagaacugcaugcacaccaacuaa

SEQ ID NO: 25446 - RNA, 1593 nt, Artificial Sequence
  USP17L2__Homo_sapiens__NP_958804
auggaggacgacagccuguaccugggcggcgaguggcaguucaaccacuucagcaagcugaccagcagcagacccgacgccgccuucgccgagauccagagaaccagccugcccgagaagagcccccugagcagcgaggccagaguggaccugugcgacgaccuggcccccguggccagacagcuggcccccagaaagaagcugccccugagcagcagaagacccgccgccgugggcgccggccugcagaacaugggcaacaccugcuacgagaacgccagccugcagugccugaccuacacccccccccuggccaacuacaugcugagcagagagcacagccagaccugccagagacccaagugcugcaugcugugcaccaugcaggcccacaucaccugggcccugcacagccccggccacgugauccagcccagccaggcccuggccgccggcuuccacagaggcaagcaggaggacgcccacgaguuccugauguucaccguggacgccaugaagaaggccugccugcccggccacaagcagguggaccaccacagcaaggacaccacccugauccaccagaucuucggcggcugcuggagaagccagaucaagugccugcacugccacggcaucagcgacaccuucgaccccuaccuggacaucgcccuggacauccaggccgcccagagcgugaagcaggcccuggagcagcuggugaagcccgaggagcugaacggcgagaacgccuaccacugcggccugugccugcagagagcccccgccagcaagacccugacccugcacaccagcgccaaggugcugauccuggugcugaagagauucagcgacgugaccggcaacaagcuggccaagaacgugcaguaccccgagugccuggacaugcagcccuacaugagccagcagaacaccggcccccugguguacgugcuguacgccgugcuggugcacgccggcuggagcugccacgacggccacuacuucagcuacgugaaggcccaggagggccagugguacaagauggacgacgccaaggugaccgccugcagcaucaccagcgugcugagccagcaggccuacgugcuguucuacauccagaagagcgagugggagagacacagcgagagcgugagcagaggcagagagcccagagcccugggcgccgaggacaccgacagaagagccacccagggcgagcugaagagagaccaccccugccugcaggcccccgagcuggacgagagacugguggagagagccacccaggagagcacccuggaccacuggaaguucccccaggagcagaacaagaccaagcccgaguucaacgugagaaagguggagggcacccugccccccaacgugcuggugauccaccagagcaaguacaagugcggcaugaagaaccaccaccccgagcagcagagcagccugcugaaccugagcagcaccaccagaaccgaccaggagagcgugaacaccggcacccuggccagccugcagggcagaaccagaagaagcaagggcaagaacaagcacagcaagagagcccugcuggugugccaguaa

SEQ ID NO: 25447 - RNA, 1593 nt, Artificial Sequence
  USP17L30__Homo_sapiens__NP_001243796
auggaggacgacagccuguaccugagaggcgaguggcaguucaaccacuucagcaagcugaccagcagcagacccgacgccgccuucgccgagauccagagaaccagccugcccgagaagagcccccugagcugcgagaccagaguggaccugugcgacgaccuggcccccguggccagacagcuggcccccagagagaagcugccccugagcagcagaagacccgccgccgugggcgccggccugcagaacaugggcaacaccugcuacgugaacgccagccugcagugccugaccuacacccccccccuggccaacuacaugcugagcagagagcacagccagaccugccacagacacaagggcugcaugcugugcaccaugcaggcccacaucaccagagcccugcacaaccccggccacgugauccagcccagccaggcccuggccgccggcuuccacagaggcaagcaggaggacgcccacgaguuccugauguucaccguggacgccaugaagaaggccugccugcccggccacaagcagguggaccaccacagcaaggacaccacccugauccaccagaucuucggcggcuacuggagaagccagaucaagugccugcacugccacggcaucagcgacaccuucgaccccuaccuggacaucgcccuggacauccaggccgcccagagcgugcagcaggcccuggagcagcuggugaagcccgaggagcugaacggcgagaacgccuaccacugcggcgugugccugcagagagcccccgccagcaagacccugacccugcacaccagcgccaaggugcugauccuggugcugaagagauucagcgacgugaccggcaacaagaucgccaagaacgugcaguaccccgagugccuggacaugcagcccuacaugagccagcccaacaccggcccccugguguacgugcuguacgccgugcuggugcacgccggcuggagcugccacaacggccacuacuucagcuacgugaaggcccaggagggccagugguacaagauggacgacgccgaggugaccgccagcagcaucaccagcgugcugagccagcaggccuacgugcuguucuacauccagaagagcgagugggagagacacagcgagagcgugagcagaggcagagagcccagagcccugggcgccgaggacaccgacagaagagccacccagggcgagcugaagagagaccaccccugccugcaggcccccgagcuggacgagcaccugguggagagagccacccaggagagcacccuggaccacuggaaguuccugcaggagcagaacaagaccaagcccgaguucaacgugagaaagguggagggcacccugccccccgacgugcuggugauccaccagagcaaguacaagugcggcaugaagaaccaccaccccgagcagcagagcagccugcugaaccugagcagcagcacccccacccaccaggagagcaugaacaccggcacccuggccagccugagaggcagagccagaagaagcaagggcaagaacaagcacagcaagagagcccugcuggugugccaguaa

SEQ ID NO: 25448 - RNA, 1119 nt, Artificial Sequence
  USP18__Homo_sapiens__NP_059110
augagcaaggccuucggccugcugagacagaucugccagagcauccuggccgagagcagccagagccccgccgaccuggaggagaagaaggaggaggacagcaacaugaagagagagcagcccagagagagacccagagccugggacuacccccacggccuggugggccugcacaacaucggccagaccugcugccugaacagccugauccagguguucgugaugaacguggacuucaccagaauccugaagagaaucaccgugcccagaggcgccgacgagcagagaagaagcgugcccuuccagaugcugcugcugcuggagaagaugcaggacagcagacagaaggccgugagaccccuggagcuggccuacugccugcagaagugcaacgugccccuguucgugcagcacgacgccgcccagcuguaccugaagcuguggaaccugaucaaggaccagaucaccgacgugcaccugguggagagacugcaggcccuguacaccaucagagugaaggacagccugaucugcguggacugcgccauggagagcagcagaaacagcagcaugcugacccugccccugagccuguucgacguggacagcaagccccugaagacccuggaggacgcccugcacugcuucuuccagcccagagagcugagcagcaagagcaagugcuucugcgagaacugcggcaagaagaccagaggcaagcaggugcugaagcugacccaccugccccagacccugaccauccaccugaugagauucagcaucagaaacagccagaccagaaagaucugccacagccuguacuucccccagagccuggacuucagccagauccugcccaugaagagagagagcugcgacgccgaggagcagagcggcggccaguacgagcuguucgccgugaucgcccacgugggcauggccgacagcggccacuacugcguguacaucagaaacgccguggacggcaagugguucugcuucaacgacagcaacaucugccuggugagcugggaggacauccagugcaccuacggcaaccccaacuaccacuggcaggagaccgccuaccugcugguguacaugaagauggagugcuaa

SEQ ID NO: 25449 - RNA, 2745 nt, Artificial Sequence
  USP20__Homo_sapiens__XP_005251722
augggcgacagcagagaccugugcccccaccuggacagcaucggcgaggugaccaaggaggaccugcugcugaagagcaagggcaccugccagagcugcggcgugaccggccccaaccugugggccugccugcagguggccugccccuacgugggcugcggcgagagcuucgccgaccacagcaccauccacgcccaggccaagaagcacaaccugaccgugaaccugaccaccuucagacuguggugcuacgccugcgagaaggagguguuccuggagcagagacuggccgccccccugcugggcagcagcagcaaguucagcgagcaggacagccccccccccagccacccccugaaggccgugcccaucgccguggccgacgagggcgagagcgagagcgaggacgacgaccugaagcccagaggccugaccggcaugaagaaccugggcaacagcugcuacaugaacgccgcccugcaggcccugagcaacugccccccccugacccaguucuuccuggagugcggcggccuggugagaaccgacaagaagcccgcccugugcaagagcuaccagaagcuggugagcgagguguggcacaagaagagacccagcuacguggugcccaccagccugagccacggcaucaagcuggugaaccccauguucagaggcuacgcccagcaggacacccaggaguuccugagaugccugauggaccagcugcacgaggagcugaaggagcccgugguggccaccguggcccugaccgaggccagagacagcgacagcagcgacaccgacgagaagagagagggcgacagaagccccagcgaggacgaguuccugagcugcgacagcagcagcgacagaggcgagggcgacggccagggcagaggcggcggcagcagccaggccgagaccgagcugcugauccccgacgaggccggcagagccaucagcgagaaggagagaaugaaggacagaaaguucagcuggggccagcagagaaccaacagcgagcagguggacgaggacgccgacguggacaccgccauggccgcccuggacgaccagcccgccgaggcccagccccccagccccagaagcagcagccccugcagaacccccgagcccgacaacgacgcccaccugagaagcagcagcagacccugcagccccgugcaccaccacgagggccacgccaagcugagcagcagcccccccagagccagccccgugagaauggcccccagcuacgugcugaagaaggcccaggugcugagcgccggcagcagaagaagaaaggagcagagauacagaagcgugaucagcgacaucuucgacggcagcauccugagccuggugcagugccugaccugcgacagagugagcaccaccguggagaccuuccaggaccugagccugcccauccccggcaaggaggaccuggccaagcugcacagcgccaucuaccagaacgugcccgccaagcccggcgccugcggcgacagcuacgccgcccagggcuggcuggccuucaucguggaguacaucagaagauucguggugagcugcacccccagcugguucuggggccccguggugacccuggaggacugccuggccgccuucuucgccgccgacgagcugaagggcgacaacauguacagcugcgagagaugcaagaagcugagaaacggcgugaaguacugcaaggugcugagacugcccgagauccugugcauccaccugaagagauucagacacgaggugauguacagcuucaagaucaacagccacgugagcuucccccuggagggccuggaccugagacccuuccuggccaaggagugcaccagccagaucaccaccuacgaccugcugagcgugaucugccaccacggcaccgccggcagcggccacuacaucgccuacugccagaacgugaucaacggccagugguacgaguucgacgaccaguacgugaccgaggugcacgagaccguggugcagaacgccgagggcuacgugcuguucuacagaaagagcagcgaggaggccaugagagagagacagcagguggugagccuggccgccaugagagagcccagccugcugagauucuacgugagcagagaguggcugaacaaguucaacaccuucgccgagcccggccccaucaccaaccagaccuuccugugcagccacggcggcauccccccccacaaguaccacuacaucgacgaccugguggugauccugccccagaacgugugggagcaccuguacaacagauucggcggcggccccgccgugaaccaccuguacgugugcagcaucugccagguggagaucgaggcccuggccaagagaagaagaaucgagaucgacaccuucaucaagcugaacaaggccuuccaggccgaggagagccccggcgugaucuacugcaucagcaugcagugguucagagagugggaggccuucgugaagggcaaggacaacgagccccccggccccaucgacaacagcagaaucgcccaggugaagggcagcggccacgugcagcugaagcagggcgccgacuacggccagaucagcgaggagaccuggaccuaccugaacagccuguacggcggcggccccgagaucgccaucagacagagcguggcccagccccugggccccgagaaccugcacggcgagcagaagaucgaggccgagaccagagccguguaa

SEQ ID NO: 25450 - RNA, 1578 nt, Artificial Sequence
  USP22__Homo_sapiens__NP_056091
auggugagcagacccgagcccgagggcgaggccauggacgccgagcuggccguggccccccccggcugcagccaccugggcagcuucaagguggacaacuggaagcagaaccugagagccaucuaccagugcuucguguggagcggcaccgccgaggccagaaagagaaaggccaagagcugcaucugccacgugugcggcgugcaccugaacagacugcacagcugccuguacugcguguucuucggcugcuucaccaagaagcacauccacgagcacgccaaggccaagagacacaaccuggccaucgaccugauguacggcggcaucuacugcuuccugugccaggacuacaucuacgacaaggacauggagaucaucgccaaggaggagcagagaaaggccuggaagaugcagggcgugggcgagaaguucagcaccugggagcccaccaagagagagcuggagcugcugaagcacaaccccaagagaagaaagaucaccagcaacugcaccaucggccugagaggccugaucaaccugggcaacaccugcuucaugaacugcaucgugcaggcccugacccacaccccccugcugagagacuucuuccugagcgacagacacagaugcgagaugcagagccccagcagcugccuggugugcgagaugagcagccuguuccaggaguucuacagcggccacagaagcccccacauccccuacaagcugcugcaccugguguggacccacgccagacaccuggccggcuacgagcagcaggacgcccacgaguuccugaucgccgcccuggacgugcugcacagacacugcaagggcgacgacaacggcaagaaggccaacaaccccaaccacugcaacugcaucaucgaccagaucuucaccggcggccugcagagcgacgugaccugccaggugugccacggcgugagcaccaccaucgaccccuucugggacaucagccuggaccugcccggcagcagcacccccuucuggccccugagccccggcagcgagggcaacguggugaacggcgagagccacgugagcggcaccaccacccugaccgacugccugagaagauucaccagacccgagcaccugggcagcagcgccaagaucaagugcagcggcugccacagcuaccaggagagcaccaagcagcugaccaugaagaagcugcccaucguggccugcuuccaccugaagagauucgagcacagcgccaagcugagaagaaagaucaccaccuacgugagcuucccccuggagcuggacaugacccccuucauggccagcagcaaggagagcagaaugaacggccaguaccagcagcccaccgacagccugaacaacgacaacaaguacagccuguucgccguggugaaccaccagggcacccuggagagcggccacuacaccagcuucaucagacagcacaaggaccagugguucaagugcgacgacgccaucaucaccaaggccagcaucaaggacgugcuggacagcgagggcuaccugcuguucuaccacaagcaguuccuggaguacgaguaa

SEQ ID NO: 25451 - RNA, 3378 nt, Artificial Sequence
  USP25__Homo_sapiens__NP_001269970
augaccguggagcagaacgugcugcagcagagcgccgcccagaagcaccagcagaccuuccugaaccagcugagagagaucaccggcaucaacgacacccagauccugcagcaggcccugaaggacagcaacggcaaccuggagcuggccguggccuuccugaccgccaagaacgccaagaccccccagcaggaggagaccaccuacuaccagaccgcccugcccggcaacgacagauacaucagcgugggcagccaggccgacaccaacgugaucgaccugaccggcgacgacaaggacgaccugcagagagccaucgcccugagccuggccgagagcaacagagccuucagagagaccggcaucaccgacgaggagcaggccaucagcagagugcuggaggccagcaucgccgagaacaaggccugccugaagagaacccccaccgagguguggagagacagcagaaaccccuacgacagaaagagacaggacaaggcccccgugggccugaagaacgugggcaacaccugcugguucagcgccgugauccagagccuguucaaccugcuggaguucagaagacuggugcugaacuacaagccccccagcaacgcccaggaccugcccagaaaccagaaggagcacagaaaccugcccuucaugagagagcugagauaccuguucgcccugcuggugggcaccaagagaaaguacguggaccccagcagagccguggagauccugaaggacgccuucaagagcaacgacagccagcagcaggacgugagcgaguucacccacaagcugcuggacuggcuggaggacgccuuccagaugaaggccgaggaggagaccgacgaggagaagcccaagaaccccaugguggagcuguucuacggcagauuccuggccgugggcgugcuggagggcaagaaguucgagaacaccgagauguucggccaguacccccugcaggugaacggcuucaaggaccugcacgagugccuggaggccgccaugaucgagggcgagaucgagagccugcacagcgagaacagcggcaagagcggccaggagcacugguucaccgagcugccccccgugcugaccuucgagcugagcagauucgaguucaaccaggcccugggcagacccgagaagauccacaacaagcuggaguucccccaggugcuguaccuggacagauacaugcacagaaacagagagaucaccagaaucaagagagaggagaucaagagacugaaggacuaccugaccgugcugcagcagagacuggagagauaccugagcuacggcagcggccccaagagauucccccugguggacgugcugcaguacgcccuggaguucgccagcagcaagcccgugugcaccagccccguggacgacaucgacgccagcagcccccccagcggcagcauccccagccagacccugcccagcaccaccgagcagcagggcgcccugagcagcgagcugcccagcaccagccccagcagcguggccgccaucagcagcagaagcgugauccacaagcccuucacccagagcagaaucccccccgaccugcccaugcaccccgcccccagacacaucaccgaggaggagcugagcgugcuggagagcugccugcacagauggagaaccgagaucgagaacgacaccagagaccugcaggagagcaucagcagaauccacagaaccaucgagcugauguacagcgacaagagcaugauccaggugcccuacagacugcacgccgugcuggugcacgagggccaggccaacgccggccacuacugggccuacaucuucgaccacagagagagcagauggaugaaguacaacgacaucgccgugaccaagagcagcugggaggagcuggugagagacagcuucggcggcuacagaaacgccagcgccuacugccugauguacaucaacgacaaggcccaguuccugauccaggaggaguucaacaaggagaccggccagccccuggugggcaucgagacccugccccccgaccugagagacuucguggaggaggacaaccagagauucgagaaggagcuggaggagugggacgcccagcuggcccagaaggcccugcaggagaagcugcuggccagccagaagcugagagagagcgagaccagcgugaccaccgcccaggccgccggcgaccccgaguaccuggagcagcccagcagaagcgacuucagcaagcaccugaaggaggagaccauccagaucaucaccaaggccagccacgagcacgaggacaagagccccgagaccgugcugcagagcaagcccgagaacaccaccagccagccccugagcaaccagagagugguggagguggccaucccccacgugggcaaguucaugaucgagagcaaggagggcggcuacgacgacgagaucaugaugacccccaacaugcagggcaucaucauggccaucggcaagagcagaagcguguacgacagaugcggccccgaggccggcuucuucaaggccaucaagcuggaguacgccagacuggugaagcuggcccaggaggacaccccccccgagaccgacuacagacugcaccacguggugguguacuucauccagaaccaggcccccaagaagaucaucgagaagacccugcuggagcaguucggcgacagaaaccugagcuucgacgagagaugccacaacaucaugaagguggcccaggccaagcuggagaugaucaagcccgaggaggugaaccuggaggaguacgaggaguggcaccaggacuacagaaaguucagagagaccaccauguaccugaucaucggccuggagaacuuccagagagagagcuacaucgacagccugcuguuccugaucugcgccuaccagaacaacaaggagcugcugagcaagggccuguacagaggccacgacgaggagcugaucagccacuacagaagagagugccugcugaagcugaacgagcaggccgccgagcuguucgagagcggcgaggacagagaggugaacaacggccugaucaucaugaacgaguucaucgugcccuuccugccccugcugcugguggacgagauggaggagaaggacauccuggccguggaggacaugagaaacagauggugcagcuaccugggccaggagauggagccccaccugcaggagaagcugaccgacuuccugcccaagcugcuggacugcagcauggagaucaagagcuuccacgagccccccaagcugcccagcuacagcacccacgagcugugcgagagauucgccagaaucaugcugagccugagcagaacccccgccgacggcagauaa

SEQ ID NO: 25452 - RNA, 2742 nt, Artificial Sequence
  USP26__Homo_sapiens__NP_114113
auggccgcccuguuccugagaggcuucgugcagaucggcaacugcaagaccggcaucagcaagagcaaggaggccuucaucgaggccguggagagaaagaagaaggacagacuggugcuguacuucaagagcggcaaguacagcaccuucagacugagcgacaacauccagaacguggugcugaagagcuacagaggcaaccagaaccaccugcaccugacccugcagaacaacaacggccuguucaucgagggccugagcagcaccgacgccgagcagcugaagaucuuccuggacagagugcaccagaacgaggugcagccccccgugagacccggcaagggcggcagcguguucagcagcaccacccagaaggagaucaacaagaccagcuuccacaagguggacgagaagagcagcagcaagagcuucgagaucgccaagggcagcggcaccggcgugcugcagagaaugccccugcugaccagcaagcugacccugaccugcggcgagcugagcgagaaccagcacaagaagagaaagagaaugcugagcagcagcagcgagaugaacgaggaguuccugaaggagaacaacagcguggaguacaagaagagcaaggccgacugcagcagaugcgugagcuacaacagagagaagcagcugaagcugaaggagcuggaggagaacaagaagcuggagugcgagagcagcugcaucaugaacgccaccggcaaccccuaccuggacgacaucggccugcugcaggcccugaccgagaagauggugcugguguuccugcugcagcagggcuacagcgacggcuacaccaagugggacaagcugaagcuguucuucgagcuguuccccgagaagaucugccacggccugcccaaccugggcaacaccugcuacaugaacgccgugcugcagagccugcugagcauccccagcuucgccgacgaccugcugaaccagagcuuccccuggggcaagaucccccugaacgcccugaccaugugccuggccagacugcuguucuucaaggacaccuacaacaucgagaucaaggagaugcugcugcugaaccugaagaaggccaucagcgccgccgccgagaucuuccacggcaacgcccagaacgacgcccacgaguuccuggcccacugccuggaccagcugaaggacaacauggagaagcugaacaccaucuggaagcccaagagcgaguucggcgaggacaacuuccccaagcagguguucgccgacgaccccgacaccagcggcuucagcugccccgugaucaccaacuucgagcuggagcugcugcacagcaucgccugcaaggccugcggccaggugauccugaagaccgagcugaacaacuaccugagcaucaaccugccccagagaaucaaggcccaccccagcagcauccagagcaccuucgaccuguucuucggcgccgaggagcuggaguacaagugcgccaagugcgagcacaagaccagcgugggcgugcacagcuucagcagacugcccagaauccugaucgugcaccugaagagauacagccugaacgaguucugcgcccugaagaagaacgaccaggaggugaucaucagcaaguaccugaaggugagcagccacugcaacgagggcaccagacccccccugccccugagcgaggacggcgagaucaccgacuuccagcugcugaaggugaucagaaagaugaccagcggcaacaucagcgugagcuggcccgccaccaaggagagcaaggacauccuggccccccacaucggcagcgacaaggagagcgagcagaagaagggccagaccguguucaagggcgccagcagaagacagcagcagaaguaccugggcaagaacagcaagcccaacgagcuggagagcguguacagcggcgacagagccuucaucgagaaggagccccuggcccaccugaugaccuaccuggaggacaccagccugugccaguuccacaaggccggcggcaagcccgccagcagccccggcaccccccugagcaagguggacuuccagaccgugcccgagaaccccaagagaaagaaguacgugaagaccagcaaguucguggccuucgacagaaucaucaaccccaccaaggaccuguacgaggacaagaacaucagaauccccgagagauuccagaaggugagcgagcagacccagcagugcgacggcaugagaaucugcgagcaggccccccagcaggcccugccccagagcuuccccaagcccggcacccagggccacaccaagaaccugcugagacccaccaagcugaaccugcagaagagcaacagaaacagccugcuggcccugggcagcaacaagaaccccagaaacaaggacauccuggacaagaucaagagcaaggccaaggagaccaagagaaacgacgacaagggcgaccacaccuacagacugaucagcguggugagccaccugggcaagacccugaagagcggccacuacaucugcgacgccuacgacuucgagaagcagaucugguucaccuacgacgacaugagagugcugggcauccaggaggcccagaugcaggaggacagaagaugcaccggcuacaucuucuucuacaugcacaacgagaucuucgaggagaugcugaagagagaggagaacgcccagcugaacagcaaggagguggaggagacccugcagaaggaguaa

SEQ ID NO: 25453 - RNA, 3234 nt, Artificial Sequence
  USP28__Homo_sapiens__NP_065937
augaccgccgagcugcagcaggacgacgccgccggcgccgccgacggccacggcagcagcugccagaugcugcugaaccagcugagagagaucaccggcauccaggaccccagcuuccugcacgaggcccugaaggccagcaacggcgacaucacccaggccgugagccugcugaccgacgagagagugaaggagcccagccaggacaccguggccaccgagcccagcgagguggagggcagcgccgccaacaaggaggugcuggccaaggugaucgaccugacccacgacaacaaggacgaccugcaggccgccaucgcccugagccugcuggagagccccaagauccaggccgacggcagagaccugaacagaaugcacgaggccaccagcgccgagaccaagagaagcaagagaaagagaugcgagguguggggcgagaaccccaaccccaacgacuggagaagaguggacggcuggcccgugggccugaagaacgugggcaacaccugcugguucagcgccgugauccagagccuguuccagcugcccgaguucagaagacuggugcugagcuacagccugccccagaacgugcuggagaacugcagaagccacaccgagaagagaaacaucauguucaugcaggagcugcaguaccuguucgcccugaugaugggcagcaacagaaaguucguggaccccagcgccgcccuggaccugcugaagggcgccuucagaagcagcgaggagcagcagcaggacgugagcgaguucacccacaagcugcuggacuggcuggaggacgccuuccagcuggccgugaacgugaacagccccagaaacaagagcgagaaccccauggugcagcuguucuacggcaccuuccugaccgagggcgugagagagggcaagcccuucugcaacaacgagaccuucggccaguacccccugcaggugaacggcuacagaaaccuggacgagugccuggagggcgccaugguggagggcgacguggagcugcugcccagcgaccacagcgugaaguacggccaggagagaugguucaccaagcugccccccgugcugaccuucgagcugagcagauucgaguucaaccagagccugggccagcccgagaagauccacaacaagcuggaguucccccagaucaucuacauggacagauacauguacagaagcaaggagcugaucagaaacaagagagagugcaucagaaagcugaaggaggagaucaagauccugcagcagaagcuggagagauacgugaaguacggcagcggccccgccagauucccccugcccgacaugcugaaguacgugaucgaguucgccagcaccaagcccgccagcgagagcugcccccccgagagcgacacccacaugacccugccccugagcagcgugcacugcagcgugagcgaccagaccagcaaggagagcaccagcaccgagagcagcagccaggacguggagagcaccuucagcagccccgaggacagccugcccaagagcaagccccugaccagcagcagaagcagcauggagaugcccagccagcccgcccccagaaccgugaccgacgaggagaucaacuucgugaagaccugccugcagagauggagaagcgagaucgagcaggacauccaggaccugaagaccugcaucgccagcaccacccagaccaucgagcagauguacugcgacccccugcugagacaggugcccuacagacugcacgccgugcuggugcacgagggccaggccaacgccggccacuacugggccuacaucuacaaccagcccagacagagcuggcugaaguacaacgacaucagcgugaccgagagcagcugggaggagguggagagagacagcuacggcggccugagaaacgugagcgccuacugccugauguacaucaacgacaagcugcccuacuucaacgccgaggccgcccccaccgagagcgaccagaugagcgagguggaggcccugagcguggagcugaagcacuacauccaggaggacaacuggagauucgagcaggagguggaggagugggaggaggagcagagcugcaagaucccccagauggagagcagcaccaacagcagcagccaggacuacagcaccagccaggagcccagcguggccagcagccacggcgugagaugccugagcagcgagcacgccgugaucgugaaggagcagaccgcccaggccaucgccaacaccgccagagccuacgagaagagcggcguggaggccgcccugagcgaggugaugcugagccccgccaugcagggcgugauccuggccaucgccaaggccagacagaccuucgacagagacggcagcgaggccggccugaucaaggccuuccacgaggaguacagcagacuguaccagcuggccaaggagacccccaccagccacagcgaccccagacugcagcacgugcugguguacuucuuccagaacgaggcccccaagagagugguggagagaacccugcuggagcaguucgccgacaagaaccugagcuacgacgagagaagcaucagcaucaugaagguggcccaggccaagcugaaggagaucggccccgacgacaugaacauggaggaguacaagaaguggcacgaggacuacagccuguucagaaaggugagcguguaccugcugaccggccuggagcuguaccagaagggcaaguaccaggaggcccugagcuaccugguguacgccuaccagagcaacgccgcccugcugaugaagggccccagaagaggcgugaaggagagcgugaucgcccuguacagaagaaagugccugcuggagcugaacgccaaggccgccagccuguucgagaccaacgacgaccacagcgugaccgagggcaucaacgugaugaacgagcugaucauccccugcauccaccugaucaucaacaacgacaucagcaaggacgaccuggacgccaucgaggugaugagaaaccacuggugcagcuaccugggccaggacaucgccgagaaccugcagcugugccugggcgaguuccugcccagacugcuggaccccagcgccgagaucaucgugcugaaggagccccccaccaucagacccaacagccccuacgaccugugcagcagauucgccgccgugauggagagcauccagggcgugagcaccgugaccgugaaguaa

SEQ ID NO: 25454 - RNA, 1089 nt, Artificial Sequence
  USP2__Homo_sapiens__NP_001230688
augcuggugcccggcagcaccagacccuacagcaagaagagacagaacagcaagagcgcccagggccuggccggccugagaaaccugggcaacaccugcuucaugaacagcauccugcagugccugagcaacaccagagagcugagagacuacugccugcagagacuguacaugagagaccugcaccacggcagcaacgcccacaccgcccugguggaggaguucgccaagcugauccagaccaucuggaccagcagccccaacgacguggugagccccagcgaguucaagacccagauccagagauacgcccccagauucgugggcuacaaccagcaggacgcccaggaguuccugagauuccugcuggacggccugcacaacgaggugaacagagugacccugagacccaagagcaaccccgagaaccuggaccaccugcccgacgacgagaagggcagacagauguggagaaaguaccuggagagagaggacagcagaaucggcgaccuguucgugggccagcugaagagcagccugaccugcaccgacugcggcuacugcagcaccguguucgaccccuucugggaccugagccugcccaucgccaagagaggcuaccccgaggugacccugauggacugcaugagacuguucaccaaggaggacgugcuggacggcgacgagaagcccaccugcugcagaugcagaggcagaaagagaugcaucaagaaguucagcauccagagauuccccaagauccuggugcugcaccugaagagauucagcgagagcagaaucagaaccagcaagcugaccaccuucgugaacuucccccugagagaccuggaccugagagaguucgccagcgagaacaccaaccacgccguguacaaccuguacgccgugagcaaccacagcggcaccaccaugggcggccacuacaccgccuacugcagaagccccggcaccggcgaguggcacaccuucaacgacagcagcgugacccccaugagcagcagccaggugagaaccagcgacgccuaccugcuguucuacgagcuggccagcccccccagcagaauguaa

SEQ ID NO: 25455 - RNA, 4815 nt, Artificial Sequence
  USP32__Homo_sapiens__NP_115971
augggcgccaaggagagcagaaucggcuuccugagcuacgaggaggcccugagaagagugaccgacguggagcugaagagacugaaggacgccuucaagagaaccugcggccugagcuacuacaugggccagcacugcuucaucagagaggugcugggcgacggcgugccccccaagguggccgaggugaucuacugcagcuucggcggcaccagcaagggccugcacuucaacaaccugaucgugggccuggugcugcugaccagaggcaaggacgaggagaaggccaaguacaucuucagccuguucagcagcgagagcggcaacuacgugaucagagaggagauggagagaaugcugcacgugguggacggcaaggugcccgacacccugagaaagugcuucagcgagggcgagaaggugaacuacgagaaguucagaaacuggcuguuccugaacaaggacgccuucaccuucagcagauggcugcugagcggcggcguguacgugacccugaccgacgacagcgacacccccaccuucuaccagacccuggccggcgugacccaccuggaggagagcgacaucaucgaccuggagaagagauacuggcugcugaaggcccagagcagaaccggcagauucgaccuggagaccuucggcccccuggugagcccccccaucagacccagccugagcgagggccuguucaacgccuucgacgagaacagagacaaccacaucgacuucaaggagaucagcugcggccugagcgccugcugcagaggcccccuggccgagagacagaaguucugcuucaagguguucgacguggacagagacggcgugcugagcagaguggagcugagagacauggugguggcccugcuggagguguggaaggacaacagaaccgacgacauccccgagcugcacauggaccugagcgacaucguggagggcauccugaacgcccacgacaccaccaagaugggccaccugacccuggaggacuaccagaucuggagcgugaagaacgugcuggccaacgaguuccugaaccugcuguuccaggugugccacaucgugcugggccugagacccgccacccccgaggaggagggccagaucaucagaggcuggcuggagagagagagcagauacggccugcaggccggccacaacugguucaucaucagcaugcagugguggcagcaguggaaggaguacgugaaguacgacgccaaccccguggugaucgagcccagcagcgugcugaacggcggcaaguacagcuucggcaccgccgcccaccccauggagcagguggaggacagaaucggcagcagccugagcuacgugaacaccaccgaggagaaguucagcgacaacaucagcaccgccagcgaggccagcgagaccgccggcagcggcuuccuguacagcgccacccccggcgccgacgugugcuucgccagacagcacaacaccagcgacaacaacaaccagugccugcugggcgccaacggcaacauccugcugcaccugaacccccagaagcccggcgccaucgacaaccagccccuggugacccaggagcccgugaaggccaccagccugacccuggagggcggcagacugaagagaaccccccagcugauccacggcagagacuacgagauggugcccgagcccguguggagagcccuguaccacugguacggcgccaaccuggcccugcccagacccgugaucaagaacagcaagaccgacauccccgagcuggagcuguuccccagauaccugcuguuccugagacagcagcccgccaccagaacccagcagagcaacaucugggugaacaugggcaacgugcccagccccaacgccccccugaagagagugcuggccuacaccggcugcuucagcagaaugcagaccaucaaggagauccacgaguaccugagccagagacugagaaucaaggaggaggacaugagacuguggcuguacaacagcgagaacuaccugacccugcuggacgacgaggaccacaagcuggaguaccugaagauccaggacgagcagcaccuggugaucgaggugagaaacaaggacaugagcuggcccgaggagaugagcuucaucgccaacagcagcaagaucgacagacacaaggugcccaccgagaagggcgccaccggccugagcaaccugggcaacaccugcuucaugaacagcagcauccagugcgugagcaacacccagccccugacccaguacuucaucagcggcagacaccuguacgagcugaacagaaccaaccccaucggcaugaagggccacauggccaagugcuacggcgaccuggugcaggagcuguggagcggcacccagaagaacguggccccccugaagcugagauggaccaucgccaaguacgcccccagauucaacggcuuccagcagcaggacagccaggagcugcuggccuuccugcuggacggccugcacgaggaccugaacagagugcacgagaagcccuacguggagcugaaggacagcgacggcagacccgacugggagguggccgccgaggccugggacaaccaccugagaagaaacagaagcaucgugguggaccuguuccacggccagcugagaagccaggugaagugcaagaccugcggccacaucagcgugagauucgaccccuucaacuuccugagccugccccugcccauggacagcuacaugcaccuggagaucaccgugaucaagcuggacggcaccacccccgugagauacggccugagacugaacauggacgagaaguacaccggccugaagaagcagcugagcgaccugugcggccugaacagcgagcagauccugcuggccgaggugcacggcagcaacaucaagaacuucccccaggacaaccagaaggugagacugagcgugagcggcuuccugugcgccuucgagauccccgugcccgugagccccaucagcgccagcagccccacccagaccgacuucagcagcagccccagcaccaacgagauguucacccugaccaccaacggcgaccugcccagacccaucuucauccccaacggcaugcccaacaccguggugcccugcggcaccgagaagaacuucaccaacggcauggugaacggccacaugcccagccugcccgacagccccuucaccggcuacaucaucgccgugcacagaaagaugaugagaaccgagcuguacuuccugagcagccagaagaacagacccagccuguucggcaugccccugaucgugcccugcaccgugcacaccagaaagaaggaccuguacgacgccguguggauccaggugagcagacuggccagcccccugcccccccaggaggccagcaaccacgcccaggacugcgacgacagcaugggcuaccaguaccccuucacccugagaguggugcagaaggacggcaacagcugcgccuggugccccugguacagauucugcagaggcugcaagaucgacugcggcgaggacagagccuucaucggcaacgccuacaucgccguggacugggaccccaccgcccugcaccugagauaccagaccagccaggagagagugguggacgagcacgagagcguggagcagagcagaagagcccaggccgagcccaucaaccuggacagcugccugagagccuucaccagcgaggaggagcugggcgagaacgagauguacuacugcagcaagugcaagacccacugccuggccaccaagaagcuggaccuguggagacugccccccauccugaucauccaccugaagagauuccaguucgugaacggcagauggaucaagagccagaagaucgugaaguuccccagagagagcuucgaccccagcgccuuccuggugcccagagaccccgcccugugccagcacaagccccugaccccccagggcgacgagcugagcgagcccagaauccuggccagagaggugaagaagguggacgcccagagcagcgccggcgaggaggacgugcugcugagcaagagccccagcagccugagcgccaacaucaucagcagccccaagggcagccccagcagcagcagaaagagcggcaccagcugccccagcagcaagaacagcagccccaacagcagccccagaacccugggcagaagcaagggcagacugagacugccccagaucggcagcaagaacaagcugagcagcagcaaggagaaccuggacgccagcaaggagaacggcgccggccagaucugcgagcuggccgacgcccugagcagaggccacgugcugggcggcagccagcccgagcuggugaccccccaggaccacgagguggcccuggccaacggcuuccuguacgagcacgaggccugcggcaacggcuacagcaacggccagcugggcaaccacagcgaggaggacagcaccgacgaccagagagaggacaccagaaucaagcccaucuacaaccuguacgccaucagcugccacagcggcauccugggcggcggccacuacgugaccuacgccaagaaccccaacugcaagugguacugcuacaacgacagcagcugcaaggagcugcaccccgacgagaucgacaccgacagcgccuacauccuguucuacgagcagcagggcaucgacuacgcccaguuccugcccaagaccgacggcaagaagauggccgacaccagcagcauggacgaggacuucgagagcgacuacaagaaguacugcgugcugcaguaa

SEQ ID NO: 25456 - RNA, 1803 nt, Artificial Sequence
  USP33__Homo_sapiens__XP_011539358
augaccggcagcaacagccacaucaccauccugacccugaaggugcugccccacuucgagagccugggcaagcaggagaagauccccaacaagaugagcgccuucagaaaccacugcccccaccuggacagcgugggcgagaucaccaaggaggaccugauccagaagagccugggcaccugccaggacugcaaggugcagggccccaaccugugggccugccuggagaacagaugcagcuacgugggcugcggcgagagccagguggaccacagcaccauccacagccaggagaccaagcacuaccugaccgugaaccugaccacccugagaguguggugcuacgccugcagcaaggagguguuccuggacagaaagcugggcacccagcccagccugccccacgugagacagccccaccagauccaggagaacagcgugcaggacuucaagauccccagcaacaccacccugaagaccccccugguggccguguucgacgaccuggacaucgaggccgacgaggaggacgagcugagagccagaggccugaccggccugaagaacaucggcaacaccugcuacaugaacgccgcccugcaggcccugagcaacugccccccccugacccaguucuuccuggacugcggcggccuggccagaaccgacaagaagcccgccaucugcaagagcuaccugaagcugaugaccgagcuguggcacaagagcagacccggcagcguggugcccaccacccuguuccagggcaucaagaccgugaaccccaccuucagaggcuacagccagcaggacgcccaggaguuccugagaugccugauggaccugcugcacgaggagcugaaggagcaggugauggagguggaggaggacccccagaccaucaccaccgaggagaccauggaggaggacaagagccagagcgacguggacuuccagagcugcgagagcugcagcaacagcgacagagccgagaacgagaacggcagcagaugcuucagcgaggacaacaacgagaccaccaugcugauccaggacgacgagaacaacagcgagaugagcaaggacuggcagaaggagaagaugugcaacaagaucaacaaggugaacagcgagggcgaguucgacaaggacagagacagcaucagcgagaccguggaccugaacaaccaggagaccgugaaggugcagauccacagcagagccagcgaguacaucaccgacgugcacagcaacgaccugagcaccccccagauccugcccagcaacgagggcgugaaccccagacugagcgccagcccccccaagagcggcaaccuguggcccggccuggcccccccccacaagaaggcccagagcgccagccccaagagaaagaagcagcacaagaaguacagaagcgugaucagcgacaucuucgacggcaccaucaucagcagcgugcagugccugaccugcgacagagugagcgugacccuggagaccuuccaggaccugagccugcccauccccggcaaggaggaccuggccaagcugcacagcagcagccaccccaccagcaucgugaaggccggcagcugcggcgaggccuacgccccccagggcuggaucgccuucuucauggaguacgugaagagauucguggugagcugcgugcccagcugguucuggggccccguggugacccugcaggacugccuggccgccuucuucgccagagacgagcugaagggcgacaacauguacagcugcgagaagugcaagaagaacgccaccgccugcuaa

SEQ ID NO: 25457 - RNA, 3372 nt, Artificial Sequence
  USP36__Homo_sapiens__XP_005257599
augcccaucguggacaagcugaaggaggcccugaagcccggcagaaaggacagcgccgacgacggcgagcugggcaagcugcuggccagcagcgccaagaaggugcugcugcagaagaucgaguucgagcccgccagcaagagcuucagcuaccagcuggaggcccugaagagcaaguacgugcugcugaaccccaagaccgagggcgccagcagacacaagagcggcgacgacccccccgccagaagacagggcagcgagcacaccuacgagagcugcggcgacggcgugcccgccccccagaaggugcuguuccccaccgagagacugagccugagaugggagagaguguucagagugggcgccggccugcacaaccugggcaacaccugcuuccugaacgccaccauccagugccugaccuacacccccccccuggccaacuaccugcugagcaaggagcacgccagaagcugccaccagggcagcuucugcaugcugugcgugaugcagaaccacaucgugcaggccuucgccaacagcggcaacgccaucaagcccgugagcuucaucagagaccugaagaagaucgccagacacuucagauucggcaaccaggaggacgcccacgaguuccugagauacaccaucgacgccaugcagaaggccugccugaacggcugcgccaagcuggacagacagacccaggccaccacccuggugcaccagaucuucggcggcuaccugagaagcagagugaagugcagcgugugcaagagcgugagcgacaccuacgaccccuaccuggacguggcccuggagaucagacaggccgccaacaucgugagagcccuggagcuguucgugaaggccgacgugcugagcggcgagaacgccuacaugugcgccaagugcaagaagaaggugcccgccagcaagagauucaccauccacagaaccagcaacgugcugacccugagccugaagagauucgccaacuucagcggcggcaagaucaccaaggacgugggcuaccccgaguuccugaacaucagacccuacaugagccagaacaacggcgaccccgugauguacggccuguacgccgugcuggugcacagcggcuacagcugccacgccggccacuacuacugcuacgugaaggccagcaacggccagugguaccagaugaacgacagccuggugcacagcagcaacgugaagguggugcugaaccagcaggccuacgugcuguucuaccugagaauccccggcagcaagaagagccccgagggccugaucagcagaaccggcagcagcagccugcccggcagacccagcgugauccccgaccacagcaagaagaacaucggcaacggcaucaucagcagcccccugaccggcaagagacaggacagcggcaccaugaagaagccccacaccaccgaggagaucggcgugcccaucagcagaaacggcagcacccugggccugaagagccagaacggcugcaucccccccaagcugcccagcggcagccccagccccaagcugagccagacccccacccacaugcccaccauccuggacgaccccggcaagaaggugaagaagcccgcccccccccagcacuucagccccagaaccgcccagggccugcccggcaccagcaacagcaacagcagcagaagcggcagccagagacagggcagcugggacagcagagacguggugcugagcaccagccccaagcugcuggccaccgccaccgccaacggccacggccugaagggcaacgacgagagcgccggccuggacagaagaggcagcagcagcagcagccccgagcacagcgccagcagcgacagcaccaaggccccccagacccccagaagcggcgccgcccaccugugcgacagccaggagaccaacugcagcaccgccggccacagcaagaccccccccagcggcgccgacagcaagaccgugaagcugaagagccccgugcugagcaacaccaccaccgagcccgccagcaccaugagccccccccccgccaagaagcuggcccugagcgccaagaaggccagcacccuguggagagccaccggcaacgaccugagaccccccccccccagccccagcagcgaccugacccaccccaugaagaccagccaccccgugguggccagcaccuggcccgugcacagagccagagccgugagccccgccccccagagcagcagcagacugcagccccccuucagcccccaccccacccugcugagcagcacccccaagccccccggcaccagcgagcccagaagcugcagcagcaucagcaccgcccugccccaggugaacgaggaccuggugagccugccccaccagcugcccgaggccagcgagcccccccagagccccagcgagaagagaaagaagaccuucgugggcgagccccagagacugggcagcgagaccagacugccccagcacaucagagaggccaccgccgccccccacggcaagagaaagagaaagaagaagaagagacccgaggacaccgccgccagcgcccugcaggagggccagacccagagacagcccggcagccccauguacagaagagagggccaggcccagcugcccgccgugagaagacaggaggacggcacccagccccaggugaacggccagcaggugggcugcgugaccgacggccaccacgccagcagcagaaagagaagaagaaagggcgccgagggccugggcgaggagggcggccugcaccaggacccccugagacacagcugcagccccaugggcgacggcgaccccgaggccauggaggagagccccagaaagaagaagaagaagaagagaaagcaggagacccagagagccguggaggaggacggccaccugaagugccccagaagcgccaagccccaggacgccguggugcccgagagcagcagcugcgcccccagcgccaacggcuggugccccggcgacagaaugggccugagccaggccccccccgugagcuggaacggcgagagagagagcgacguggugcaggagcugcugaaguacagcagcgacaaggccuacggcagaaaggugcugaccugggacggcaagaugagcgccgugagccaggacgccaucgaggacagcagacaggccagaaccgagaccgugguggacgacugggacgaggaguucgacagaggcaaggagaagaagaucaagaaguucaagagagagaagagaagaaacuucaacgccuuccagaagcugcagaccagaagaaacuucuggagcgugacccaccccgccaaggccgccagccugagcuacagaagauaa

SEQ ID NO: 25458 - RNA, 2940 nt, Artificial Sequence
  USP37__Homo_sapiens__XP_005246779
augagcccccugaagauccacggccccaucagaaucagaagcaugcagaccggcaucaccaaguggaaggagggcagcuucgagaucguggagaaggagaacaaggugagccugguggugcacuacaacaccggcggcauccccagaaucuuccagcugagccacaacaucaagaacguggugcugagacccagcggcgccaagcagagcagacugaugcugacccugcaggacaacagcuuccugagcaucgacaaggugcccagcaaggacgccgaggagaugagacuguuccuggacgccgugcaccagaacagacugcccgccgccaugaagcccagccagggcagcggcagcuucggcgccauccugggcagcagaaccagccagaaggagaccagcagacagcugagcuacagcgacaaccaggccagcgccaagagaggcagccuggagaccaaggacgacauccccuucagaaaggugcugggcaaccccggcagaggcagcaucaagaccguggccggcagcggcaucgccagaaccauccccagccugaccagcaccagcaccccccugagaagcggccugcuggagaacagaaccgagaagagaaagagaaugaucagcaccggcagcgagcugaacgaggacuaccccaaggagaacgacagcagcagcaacaacaaggccaugaccgaccccagcagaaaguaccugaccagcagcagagagaagcagcugagccugaagcagagcgaggagaacagaaccagcggccugcugccccugcagagcagcagcuucuacggcagcagagccggcagcaaggagcacagcagcggcggcaccaaccuggacagaaccaacgugagcagccagacccccagcgccaagagaagccugggcuuccugccccagcccgugccccugagcgugaagaagcugagaugcaaccaggacuacaccggcuggaacaagcccagagugccccugagcagccaccagcagcagcagcugcagggcuucagcaaccugggcaacaccugcuacaugaacgccauccugcagagccuguucagccugcagagcuucgccaacgaccugcugaagcagggcauccccuggaagaagaucccccugaacgcccugaucagaagauucgcccaccugcuggugaagaaggacaucugcaacagcgagaccaagaaggaccugcugaagaaggugaagaacgccaucagcgccaccgccgagagauucagcggcuacaugcagaacgacgcccacgaguuccugagccagugccuggaccagcugaaggaggacauggagaagcugaacaagaccuggaagaccgagcccgugagcggcgaggagaacagccccgacaucagcgccaccagagccuacaccugccccgugaucaccaaccuggaguucgaggugcagcacagcaucaucugcaaggccugcggcgagaucauccccaagagagagcaguucaacgaccugagcaucgaccugcccagaagaaagaagccccugccccccagaagcauccaggacagccuggaccuguucuucagagccgaggagcuggaguacagcugcgagaagugcggcggcaagugcgcccuggugagacacaaguucaacagacugcccagagugcugauccugcaccugaagagauacagcuucaacguggcccugagccugaacaacaagaucggccagcaggugaucauccccagauaccugacccugagcagccacugcaccgagaacaccaagccccccuucacccugggcuggagcgcccacauggccaucagcagaccccugaaggccagccagauggugaacagcugcaucaccagccccagcacccccagcaagaaguucaccuucaagagcaagagcagccuggcccugugccuggacagcgacagcgaggacgagcugaagagaagcguggcccugagccagagacugugcgagaugcugggcaacgagcagcagcaggaggaccuggagaaggacagcaagcugugccccaucgagcccgacaagagcgagcuggagaacagcggcuucgacagaaugagcgaggaggagcugcuggccgccgugcuggagaucagcaagagagacgccagccccagccugagccacgaggacgacgacaagcccaccagcagccccgacaccggcuucgccgaggacgacauccaggagaugcccgagaaccccgacaccauggagaccgagaagcccaagaccaucaccgagcuggaccccgccagcuucaccgagaucaccaaggacugcgacgagaacaaggagaacaagacccccgagggcagccagggcgagguggacuggcugcagcaguacgacauggagagagagagagaggagcaggagcugcagcaggcccuggcccagagccugcaggagcaggaggccugggagcagaaggaggacgacgaccugaagagagccaccgagcugagccugcaggaguucaacaacagcuucguggacgcccugggcagcgacgaggacagcggcaacgaggacguguucgacauggaguacaccgaggccgaggccgaggagcugaagagaaacgccgagaccggcaaccugccccacagcuacagacugaucagcguggugagccacaucggcagcaccagcagcagcggccacuacaucagcgacguguacgacaucaagaagcaggccugguucaccuacaacgaccuggaggugagcaagauccaggaggccgccgugcagagcgacagagacagaagcggcuacaucuucuucuacaugcacaaggagaucuucgacgagcugcuggagaccgagaagaacagccagagccugagcaccgaggugggcaagaccaccagacaggcccuguaa

SEQ ID NO: 25459 - RNA, 1431 nt, Artificial Sequence
  USP3__Homo_sapiens__NP_001243631
auggagugcccccaccugagcagcagcgugugcaucgcccccgacagcgccaaguuccccaacggcagccccagcagcuggugcugcagcgugugcagaagcaacaagagccccugggugugccugaccugcagcagcgugcacugcggcagcuacagaugcgacgacuucguggugaacgacaccaagcugggccuggugcagaaggugagagagcaccugcagaaccuggagaacagcgccuucaccgccgacagacacaagaagagaaagcugcuggagaacagcacccugaacagcaagcugcugaaggugaacggcagcaccaccgccaucugcgccaccggccugagaaaccugggcaacaccugcuucaugaacgccauccugcagagccugagcaacaucgagcaguucugcugcuacuucaaggagcugcccgccguggagcugagaaacggcaagaccgccggcagaagaaccuaccacaccagaagccagggcgacaacaacgugagccugguggaggaguucagaaagacccugugcgcccuguggcagggcagccagaccgccuucagccccgagagccuguucuacgugguguggaagaucaugcccaacuucagaggcuaccagcagcaggacgcccacgaguucaugagauaccugcuggaccaccugcaccuggagcugcagggcggcuucaacggcgugagcagaagcgccauccugcaggagaacagcacccugagcgccagcaacaagugcugcaucaacggcgccagcaccguggugaccgccaucuucggcggcauccugcagaacgaggugaacugccugaucugcggcaccgagagcagaaaguucgaccccuuccuggaccugagccuggacauccccagccaguucagaagcaagagaagcaagaaccaggagaacggccccgugugcagccugagagacugccugagaagcuucaccgaccuggaggagcuggacgagaccgagcuguacaugugccacaagugcaagaagaagcagaagagcaccaagaaguucuggauccagaagcugcccaaggugcugugccugcaccugaagagauuccacuggaccgccuaccugagaaacaagguggacaccuacguggaguucccccugagaggccuggacaugaagugcuaccugcuggagcccgagaacagcggccccgagagcugccuguacgaccuggccgccgugguggugcaccacggcagcggcgugggcagcggccacuacaccgccuacgccacccacgagggcagaugguuccacuucaacgacagcaccgugacccugaccgacgaggagaccguggugaaggccaaggccuacauccuguucuacguggagcaccaggccaaggccggcagcgacaagcuguaa

SEQ ID NO: 25460 - RNA, 3744 nt, Artificial Sequence
  USP40__Homo_sapiens__NP_060688
augagccuguuccugagagugguguucagcuucaccauguucggcgaccuguucgaggaggaguacagcaccgugagcaacaaccaguacggcaagggcaagaagcugaagaccaaggcccuggagccccccgcccccagagaguucaccaaccugagcggcaucagaaaccagggcggcaccugcuaccugaacagccugcugcagacccugcacuucacccccgaguucagagaggcccuguucagccugggccccgaggagcugggccuguucgaggacaaggacaagcccgacgccaaggugagaaucaucccccugcagcugcagagacuguucgcccagcugcugcugcuggaccaggaggccgccagcaccgccgaccugaccgacagcuucggcuggaccagcaacgaggagaugagacagcacgacgugcaggagcugaacagaauccuguucagcgcccuggagaccagccuggugggcaccagcggccacgaccugaucuacagacuguaccacggcaccaucgugaaccagaucgugugcaaggagugcaagaacgugagcgagagacaggaggacuuccuggaccugaccguggccgugaagaacgugagcggccuggaggacgcccuguggaacauguacguggaggaggagguguucgacugcgacaaccuguaccacugcggcaccugcgacagacuggugaaggccgccaagagcgccaagcugagaaagcugccccccuuccugaccgugagccugcugagauucaacuucgacuucgugaagugcgagagauacaaggagaccagcugcuacaccuucccccugagaaucaaccugaagcccuucugcgagcagagcgagcuggacgaccuggaguacaucuacgaccuguucagcgugaucauccacaagggcggcugcuacggcggccacuaccacguguacaucaaggacguggaccaccugggcaacuggcaguuccaggaggagaagagcaagcccgacgugaaccugaaggaccugcagagcgaggaggagaucgaccacccccugaugauccugaaggccauccugcuggaggagaacaaccugauccccguggaccagcugggccagaagcugcugaagaagaucggcaucagcuggaacaagaaguacagaaagcagcacggcccccugagaaaguuccugcagcugcacagccagaucuuccugcugagcagcgacgagagcaccgugagacugcugaagaacagcagccugcaggccgagagcgacuuccagagaaacgaccagcagaucuucaagaugcugccccccgagagccccggccugaacaacagcaucagcugcccccacugguucgacaucaacgacagcaaggugcagcccaucagagagaaggacaucgagcagcaguuccagggcaaggagagcgccuacaugcuguucuacagaaagagccagcugcagagaccccccgaggccagagccaaccccagauacggcgugcccugccaccugcugaacgagauggacgccgccaacaucgagcugcagaccaagagagccgagugcgacagcgccaacaacaccuucgagcugcaccugcaccugggcccccaguaccacuucuucaacggcgcccugcaccccguggugagccagaccgagagcgugugggaccugaccuucgacaagagaaagacccugggcgaccugagacagagcaucuuccagcugcuggaguucugggagggcgacauggugcugagcguggccaagcuggugcccgccggccugcacaucuaccagagccugggcggcgacgagcugacccugugcgagaccgagaucgccgacggcgaggacaucuucguguggaacggcguggaggugggcggcgugcacauccagaccggcaucgacugcgagccccugcugcugaacgugcugcaccuggacaccagcagcgacggcgagaagugcugccaggugaucgagagcccccacguguuccccgccaacgccgaggugggcaccgugcugaccgcccuggccauccccgccggcgugaucuucaucaacagcgccggcugccccggcggcgagggcuggaccgccauccccaaggaggacaugagaaagaccuucagagagcagggccugagaaacggcagcagcauccugauccaggacagccacgacgacaacagccugcugaccaaggaggagaagugggugaccagcaugaacgagaucgacuggcugcacgugaagaaccugugccagcuggagagcgaggagaagcaggugaagaucagcgccaccgugaacaccaugguguucgacaucagaaucaaggccaucaaggagcugaagcugaugaaggagcuggccgacaacagcugccugagacccaucgacagaaacggcaagcugcugugccccgugcccgacagcuacacccugaaggaggccgagcugaagaugggcagcagccugggccugugccugggcaaggcccccagcagcagccagcuguuccuguucuucgccaugggcagcgacgugcagcccggcaccgagauggagaucgugguggaggagaccaucagcgugagagacugccugaagcugaugcugaagaagagcggccugcagggcgacgccuggcaccugagaaagauggacuggugcuacgaggccggcgagccccugugcgaggaggacgccacccugaaggagcugcugaucugcagcggcgacacccugcugcugaucgagggccagcugcccccccugggcuuccugaaggugcccaucuggugguaccagcugcagggccccagcggccacugggagagccaccaggaccagaccaacugcaccagcagcuggggcagaguguggagagccaccagcagccagggcgccagcggcaacgagcccgcccaggugagccugcuguaccugggcgacaucgagaucagcgaggacgccacccuggccgagcugaagagccaggccaugacccugccccccuuccuggaguucggcgugcccagccccgcccaccugagagccuggaccguggagagaaagagacccggcagacugcugagaaccgacagacagccccugagagaguacaagcugggcagaagaaucgagaucugccuggagccccugcagaagggcgagaaccugggcccccaggacgugcugcugagaacccaggugagaauccccggcgagagaaccuacgcccccgcccuggaccugguguggaacgccgcccagggcggcaccgccggcagccugagacagagaguggccgacuucuacagacugcccguggagaagaucgagaucgccaaguacuuccccgagaaguucgaguggcugcccaucagcagcuggaaccagcagaucaccaagagaaagaagaagaagaagcaggacuaccugcagggcgcccccuacuaccugaaggacggcgacaccaucggcgugaagaaccugcugaucgacgacgacgacgacuucagcaccaucagagacgacaccggcaaggagaagcagaagcagagagcccugggcagaagaaagagccaggaggcccugcacgagcagagcagcuacauccugagcagcgccgagacccccgccagacccagagcccccgagaccagccugagcauccacgugggcagcuucagauaa

SEQ ID NO: 25461 - RNA, 3951 nt, Artificial Sequence
  USP42__Homo_sapiens__NP_115548
augaccaucguggacaaggccagcgagagcagcgaccccagcgccuaccagaaccagcccggcagcagcgaggccgugagccccggcgacauggacgccggcagcgccagcuggggcgccgugagcagccugaacgacgugagcaaccacacccugagccugggccccgugcccggcgccgugguguacagcagcagcagcgugcccgacaagagcaagcccagcccccagaaggaccaggcccugggcgacggcaucgcccccccccagaaggugcuguuccccagcgagaagaucugccugaaguggcagcagacccacagagugggcgccggccugcagaaccugggcaacaccugcuucgccaacgccgcccugcagugccugaccuacacccccccccuggccaacuacaugcugagccacgagcacagcaagaccugccacgccgagggcuucugcaugaugugcaccaugcaggcccacaucacccaggcccugagcaaccccggcgacgugaucaagcccauguucgugaucaacgagaugagaagaaucgccagacacuucagauucggcaaccaggaggacgcccacgaguuccugcaguacaccguggacgccaugcagaaggccugccugaacggcagcaacaagcuggacagacacacccaggccaccacccuggugugccagaucuucggcggcuaccugagaagcagagugaagugccugaacugcaagggcgugagcgacaccuucgaccccuaccuggacaucacccuggagaucaaggccgcccagagcgugaacaaggcccuggagcaguucgugaagcccgagcagcuggacggcgagaacagcuacaagugcagcaagugcaagaagauggugcccgccagcaagagauucaccauccacagaagcagcaacgugcugacccugagccugaagagauucgccaacuucaccggcggcaagaucgccaaggacgugaaguaccccgaguaccuggacaucagacccuacaugagccagcccaacggcgagcccaucguguacgugcuguacgccgugcuggugcacaccggcuucaacugccacgccggccacuacuucugcuacaucaaggccagcaacggccugugguaccagaugaacgacagcaucgugagcaccagcgacaucagaagcgugcugagccagcaggccuacgugcuguucuacaucagaagccacgacgugaagaacggcggcgagcugacccaccccacccacagccccggccagagcagccccagacccgugaucagccagagaguggugaccaacaagcaggccgcccccggcuucaucggcccccagcugcccagccacaugaucaagaaccccccccaccugaacggcaccggcccccugaaggacacccccagcagcagcaugagcagccccaacggcaacagcagcgugaacagagccagccccgugaacgccagcgccagcgugcagaacuggagcgugaacagaagcagcgugauccccgagcaccccaagaagcagaagaucaccaucagcauccacaacaagcugcccgugagacagugccagagccagcccaaccugcacagcaacagccuggagaaccccaccaagcccgugcccagcagcaccaucaccaacagcgccgugcagagcaccagcaacgccagcaccaugagcgugagcagcaaggugaccaagcccauccccagaagcgagagcugcagccagcccgugaugaacggcaagagcaagcugaacagcagcgugcuggugcccuacggcgccgagagcagcgaggacagcgacgaggagagcaagggccugggcaaggagaacggcaucggcaccaucgugagcagccacagccccggccaggacgccgaggacgaggaggccaccccccacgagcugcaggagcccaugacccugaacggcgccaacagcgccgacagcgacagcgaccccaaggagaacggccuggcccccgacggcgccagcugccagggccagcccgcccugcacagcgagaaccccuucgccaaggccaacggccugcccggcaagcugaugcccgccccccugcugagccugcccgaggacaagauccuggagaccuucagacugagcaacaagcugaagggcagcaccgacgagaugagcgcccccggcgccgagagaggcccccccgaggacagagacgccgagccccagcccggcagccccgccgccgagagccuggaggagcccgacgccgccgccggccugagcagcaccaagaaggcccccccccccagagaccccggcacccccgccaccaaggagggcgccugggaggccauggccguggcccccgaggagcccccccccagcgccggcgaggacaucgugggcgacaccgccccccccgaccugugcgaccccggcagccugaccggcgacgccagcccccugagccaggacgccaagggcaugaucgccgagggccccagagacagcgcccuggccgaggcccccgagggccugagccccgccccccccgccagaagcgaggagcccugcgagcagccccugcuggugcaccccagcggcgaccacgccagagacgcccaggaccccagccagagccugggcgcccccgaggccgccgagagaccccccgcccccgugcuggacauggcccccgccggccaccccgagggcgacgccgagcccagccccggcgagagaguggaggacgccgccgcccccaaggcccccggccccagccccgccaaggagaagaucggcagccugagaaagguggacagaggccacuacagaagcagaagagagagaagcagcagcggcgagcccgccagagagagcagaagcaagaccgagggccacagacacagaagaagaagaaccugccccagagagagagacagacaggacagacacgcccccgagcaccaccccggccacggcgacagacugagccccggcgagagaagaagccugggcagaugcagccaccaccacagcagacacagaagcggcguggagcuggacugggugagacaccacuacaccgagggcgagagaggcuggggcagagagaaguucuaccccgacagacccagaugggacagaugcagauacuaccacgacagauacgcccuguacgccgccagagacuggaagcccuuccacggcggcagagagcacgagagagccggccugcacgagagaccccacaaggaccacaacagaggcagaagaggcugcgagcccgccagagagagagagagacacagacccagcagccccagagccggcgccccccacgcccuggccccccaccccgacagauucagccacgacagaaccgcccugguggccggcgacaacugcaaccugagcgacagauuccacgagcacgagaacggcaagagcagaaagagaagacacgacagcguggagaacagcgacagccacguggagaagaaggccagaagaagcgagcagaaggacccccuggaggagcccaaggccaagaagcacaagaagagcaagaagaagaagaagagcaaggacaagcacagagacagagacagcagacaccagcaggacagcgaccugagcgccgccugcagcgacgccgaccugcacagacacaagaagaagaagaagaagaagaagagacacagcagaaagagcgaggacuucgugaaggacagcgagcugcaccugcccagagugaccagccuggagaccguggcccaguucagaagagcccagggcggcuucccccugagcggcggccccccccuggagggcgugggccccuucagagagaagaccaagcaccugagaauggagagcagagacgacagaugcagacuguucgaguacggccagggcgacuaa

SEQ ID NO: 25462 - RNA, 3357 nt, Artificial Sequence
  USP43__Homo_sapiens__NP_001254505
auggaccugggccccggcgacgccgccggcggcggcccccuggcccccagacccagaagaagaagaagccugagaagacuguucagcagauuccugcuggcccugggcagcagaagcagacccggcgacagcccccccagaccccagcccggccacugcgacggcgacggcgagggcggcuucgccugcgcccccggccccgugcccgccgcccccggcagccccggcgaggagagaccccccggcccccagccccagcugcagcugcccgccggcgacggcgccagaccccccggcgcccagggccugaagaaccacggcaacaccugcuucaugaacgccguggugcagugccugagcaacaccgaccugcuggccgaguuccuggcccugggcagauacagagccgcccccggcagagccgaggugaccgagcagcuggccgcccuggugagagcccuguggaccagagaguacaccccccagcugagcgccgaguucaagaacgccgugagcaaguacggcagccaguuccagggcaacagccagcacgacgcccuggaguuccugcuguggcugcuggacagagugcacgaggaccuggagggcagcagcagaggccccgugagcgagaagcugccccccgaggccaccaagaccagcgagaacugccugagccccagcgcccagcugccccugggccagagcuucgugcagagccacuuccaggcccaguacagaagcagccugaccugcccccacugccugaagcagagcaacaccuucgaccccuuccugugcgugagccugcccaucccccugagacagaccagauuccugagcgugacccugguguuccccagcaagagccagagauuccugagagugggccuggccgugcccauccugagcaccguggccgcccugagaaagaugguggccgaggagggcggcgugcccgccgacgaggugauccugguggagcuguaccccagcggcuuccagagaagcuucuucgacgaggaggaccugaacaccaucgccgagggcgacaacguguacgccuuccaggugccccccagccccagccagggcacccugagcgcccacccccugggccugagcgccagccccagacuggccgccagagagggccagagauucagccugagccugcacagcgagagcaaggugcugauccuguucugcaaccuggugggcagcggccagcaggccagcagauucggcccccccuuccugaucagagaggacagagccgugagcugggcccagcugcagcagagcauccugagcaaggugagacaccugaugaagagcgaggcccccgugcagaaccugggcagccuguucagcaucagaguggugggccugagcguggccugcagcuaccugagccccaaggacagcagaccccugugccacugggccguggacagagugcugcaccugagaagacccggcggccccccccacgugaagcuggccguggagugggacagcagcgugaaggagagacuguucggcagccugcaggaggagagagcccaggacgccgacagcguguggcagcagcagcaggcccaccagcagcacagcugcacccuggacgagugcuuccaguucuacaccaaggaggagcagcuggcccaggacgacgccuggaagugcccccacugccaggugcugcagcagggcauggugaagcugagccuguggacccugcccgacauccugaucauccaccugaagagauucugccaggugggcgagagaagaaacaagcugagcacccuggugaaguucccccugagcggccugaacauggccccccacguggcccagagaagcaccagccccgaggccggccugggccccuggcccagcuggaagcagcccgacugccugcccaccagcuacccccuggacuuccuguacgaccuguacgccgugugcaaccaccacggcaaccugcaggccuacugcagaaacagccuggacggccagugguacagcuacgacgacagcaccguggagccccugagagaggacgaggugaacaccagaggcgccuacauccuguucuaccagaagagaaacagcaucccccccuggagcgccagcagcagcaugagaggcagcaccagcagcagccugagcgaccacuggcugcugagacugggcagccacgccggcagcaccagaggcagccugcugagcuggagcagcgcccccugccccagccugccccaggugcccgacagccccaucuucaccaacagccugugcaaccaggagaagggcggccuggagcccagaagacuggugagaggcgugaagggcagaagcaucagcaugaaggcccccaccaccagcagagccaagcagggccccuucaagaccaugccccugagauggagcuucggcagcaaggagaagccccccggcgccagcguggagcugguggaguaccuggagagcagaagaagacccagaagcaccagccagagcaucgugagccugcugaccggcaccgccggcgaggacgagaagagcgccagccccagaagcaacguggcccugcccgccaacagcgaggacggcggcagagccaucgagagaggccccgccggcgugcccugccccagcgcccagcccaaccacugccuggcccccggcaacagcgacggccccaacaccgccagaaagcugaaggagaacgccggccaggacaucaagcugcccagaaaguucgaccugccccugaccgugaugcccagcguggagcacgagaagcccgccagacccgagggccagaaggccaugaacuggaaggagagcuuccagaugggcagcaagagcagcccccccagccccuacaugggcuucagcggcaacagcaaggacagcagaagaggcaccagcgagcuggacagaccccugcagggcacccugacccugcugagaagcguguucagaaagaaggagaacagaagaaacgagagagccgaggugagcccccaggugccccccgugagccuggugagcggcggccugagccccgccauggacggccaggcccccggcagcccccccgcccugagaauccccgagggccuggccagaggccugggcagcagacuggagagagacguguggagcgcccccagcagccugagacugcccagaaaggccagcagagcccccagaggcagcgcccugggcaugagccagagaaccgugcccggcgagcaggccagcuacggcaccuuccagagagugaaguaccacacccugagccugggcagaaagaagacccugcccgagagcagcuucuaa

SEQ ID NO: 25463 - RNA, 2139 nt, Artificial Sequence
  USP44__Homo_sapiens__NP_001265322
augcuggccauggacaccugcaagcacgugggccagcugcagcuggcccaggaccacagcagccugaacccccagaaguggcacugcguggacugcaacaccaccgagagcaucugggccugccugagcugcagccacguggccugcggcagauacaucgaggagcacgcccugaagcacuuccaggagagcagccaccccguggcccuggaggugaacgagauguacguguucugcuaccugugcgacgacuacgugcugaacgacaacaccaccggcgaccugaagcugcugagaagaacccugagcgccaucaagagccagaacuaccacugcaccaccagaagcggcagauuccugagaagcaugggcaccggcgacgacagcuacuuccugcacgacggcgcccagagccugcugcagagcgaggaccagcuguacaccgcccuguggcacagaagaagaauccugaugggcaagaucuucagaaccugguucgagcagagccccaucggcagaaagaagcaggaggagcccuuccaggagaagaucguggugaagagagaggugaagaagagaagacaggagcuggaguaccaggugaaggccgagcuggagagcaugccccccagaaagagccugagacugcagggccuggcccagagcaccaucaucgagaucgugagcgugcaggugcccgcccagacccccgccagccccgccaaggacaaggugcugagcaccagcgagaacgagaucagccagaaggugagcgacagcagcgugaagagaagacccaucgugacccccggcgugaccggccugagaaaccugggcaacaccugcuacaugaacagcgugcugcaggugcugagccaccugcugaucuucagacagugcuuccugaagcuggaccugaaccaguggcuggccaugaccgccagcgagaagaccagaagcugcaagcacccccccgugaccgacaccgugguguaccagaugaacgagugccaggagaaggacaccggcuucgugugcagcagacagagcagccugagcagcggccugagcggcggcgccagcaagggcagaaagauggagcugauccagcccaaggagcccaccagccaguacaucagccugugccacgagcugcacacccuguuccaggugauguggagcggcaagugggcccuggugagccccuucgccaugcugcacagcguguggagacugauccccgccuucagaggcuacgcccagcaggacgcccaggaguuccugugcgagcugcuggacaagauccagagagagcuggagaccaccggcaccagccugcccgcccugauccccaccagccagagaaagcugaucaagcaggugcugaacguggugaacaacaucuuccacggccagcugcugagccaggugaccugccuggccugcgacaacaagagcaacaccaucgagcccuucugggaccugagccuggaguuccccgagagauaccagugcagcggcaaggacaucgccagccagcccugccuggugaccgagaugcuggccaaguucaccgagaccgaggcccuggagggcaagaucuacgugugcgaccagugcaacagcaagagaagaagauucagcagcaagcccguggugcugaccgaggcccagaagcagcugaugaucugccaccugccccaggugcugagacugcaccugaagagauucagauggagcggcagaaacaacagagagaagaucggcgugcacgugggcuucgaggagauccugaacauggagcccuacugcugcagagagacccugaagagccugagacccgagugcuucaucuacgaccugagcgccguggugaugcaccacggcaagggcuucggcagcggccacuacaccgccuacugcuacaacagcgagggcggcuucugggugcacugcaacgacagcaagcugagcaugugcaccauggacgaggugugcaaggcccaggccuacauccuguucuacacccagagagugaccgagaacggccacagcaagcugcugccccccgagcugcugcugggcagccagcaccccaacgaggacgccgacaccagcagcaacgagauccugagcuaa

SEQ ID NO: 25464 - RNA, 1080 nt, Artificial Sequence
  USP46__Homo_sapiens__NP_001127695
augaacugcuuccagggcaccaacgccagcgcccuggagaaggacaucggccccgagcaguuccccaucaacgagcacuacuucggccuggugaacuucggcaacaccugcuacugcaacagcgugcugcaggcccuguacuucugcagacccuucagagagaacgugcuggccuacaaggcccagcagaagaagaaggagaaccugcugaccugccuggccgaccuguuccacagcaucgccacccagaagaagaaggugggcgugaucccccccaagaaguucaucagcagacugagaaaggagaacgaccuguucgacaacuacaugcagcaggacgcccacgaguuccugaacuaccugcugaacaccaucgccgacauccugcaggaggagaagaagcaggagaagcagaacggcaagcugaagaacggcaacaugaacgagcccgccgagaacaacaagcccgagcugaccugggugcacgagaucuuccagggcacccugaccaacgagaccagaugccugaacugcgagaccgugagcagcaaggacgaggacuuccuggaccugagcguggacguggagcagaacaccagcaucacccacugccugagagacuucagcaacaccgagacccugugcagcgagcagaaguacuacugcgagaccugcugcagcaagcaggaggcccagaagagaaugagagugaagaagcugcccaugauccuggcccugcaccugaagagauucaaguacauggagcagcugcacagauacaccaagcugagcuacagagugguguucccccuggagcugagacuguucaacaccagcagcgacgccgugaaccuggacagaauguacgaccugguggccgugguggugcacugcggcagcggccccaacagaggccacuacaucaccaucgugaagagccacggcuucuggcugcuguucgacgacgacaucguggagaagaucgacgcccaggccaucgaggaguucuacggccugaccagcgacaucagcaagaacagcgagagcggcuacauccuguucuaccagagcagagaguaa

SEQ ID NO: 25465 - RNA, 3105 nt, Artificial Sequence
  USP48__Homo_sapiens__XP_011540564
auggcccccagacugcagcuggagaaggccgccuggagaugggccgagaccgugagacccgaggaggugagccaggagcacaucgagaccgccuacagaaucuggcuggagcccugcaucagaggcgugugcagaagaaacugcaagggcaaccccaacugccuggugggcaucggcgagcacaucuggcugggcgagaucgacgagaacagcuuccacaacaucgacgaccccaacugcgagagaagaaagaagaacagcuucgugggccugaccaaccugggcgccaccugcuacgugaacaccuuccugcaggugugguuccugaaccuggagcugagacaggcccuguaccugugccccagcaccugcagcgacuacaugcugggcgacggcauccaggaggagaaggacuacgagccccagaccaucugcgagcaccugcaguaccuguucgcccugcugcagaacagcaacagaagauacaucgaccccagcggcuucgugaaggcccugggccuggacaccggccagcagcaggacgcccaggaguucagcaagcuguucaugagccugcuggaggacacccugagcaagcagaagaaccccgacgugagaaacaucgugcagcagcaguucugcggcgaguacgccuacgugaccgugugcaaccagugcggcagagagagcaagcugcugagcaaguucuacgagcuggagcugaacauccagggccacaagcagcugaccgacugcaucagcgaguuccugaaggaggagaagcuggagggcgacaacagauacuucugcgagaacugccagagcaagcagaacgccaccagaaagaucagacugcugagccugcccugcacccugaaccugcagcugaugagauucguguucgacagacagaccggccacaagaagaagcugaacaccuacaucggcuucagcgagauccuggacauggagcccuacguggagcacaagggcggcagcuacguguacgagcugagcgccgugcugauccacagaggcgugagcgccuacagcggccacuacaucgcccacgugaaggacccccagagcggcgagugguacaaguucaacgacgaggacaucgagaagauggagggcaagaagcugcagcugggcaucgaggaggaccuggagcccagcaagagccagaccagaaagcccaagugcggcaagggcacccacugcagcagaaacgccuacaugcugguguacagacugcagacccaggagaagcccaacaccaccgugcaggugcccgccuuccugcaggagcugguggacagagacaacagcaaguucgaggaguggugcaucgagauggccgagaugagaaagcagagcguggacaagggcaaggccaagcacgaggaggugaaggagcuguaccagagacugcccgccggcgccgagcccuacgaguucgugagccuggaguggcugcagaaguggcuggacgagagcacccccaccaagcccaucgacaaccacgccugccugugcagccacgacaagcugcaccccgacaagaucagcaucaugaagagaaucagcgaguacgccgccgacaucuucuacagcagauacggcggcggccccagacugaccgugaaggcccugugcaaggagugcgugguggagagaugcagaauccugagacugaagaaccagcugaacgaggacuacaagaccgugaacaaccugcugaaggccgccgugaagggcagcgacggcuucugggugggcaagagcagccugagaagcuggagacagcuggcccuggagcagcuggacgagcaggacggcgacgccgagcagagcaacggcaagaugaacggcagcacccugaacaaggacgagagcaaggaggagagaaaggaggaggaggagcugaacuucaacgaggacauccugugcccccacggcgagcugugcaucagcgagaacgagagaagacuggugagcaaggaggccuggagcaagcugcagcaguacuuccccaaggcccccgaguuccccagcuacaaggagugcugcagccagugcaagauccuggagagagagggcgaggagaacgaggcccugcacaagaugaucgccaacgagcagaagaccagccugcccaaccuguuccaggacaagaacagacccugccugagcaacuggcccgaggacaccgacgugcuguacaucgugagccaguucuucguggaggaguggagaaaguucgugagaaagcccaccagaugcagccccgugagcagcgugggcaacagcgcccugcugugcccccacggcggccugauguucaccuucgccagcaugaccaaggaggacagcaagcugaucgcccugaucuggcccagcgaguggcagaugauccagaagcuguucgugguggaccacgugaucaagaucaccagaaucgaggugggcgacgugaaccccagcgagacccaguacaucagcgagcccaagcugugccccgagugcagagagggccugcugugccagcagcagagagaccugagagaguacacccaggccaccaucuacgugcacaaggugguggacaacaagaaggugaugaaggacagcgcccccgagcugaacgugagcagcagcgagaccgaggaggacaaggaggaggccaagcccgacggcgagaaggaccccgacuucaaccagagcaacggcggcaccaagagacagaagaucagccaccagaacuacaucgccuaccagaagcaggugaucagaagaagcaugagacacagaaaggugagaggcgagaaggcccugcuggugagcgccaaccagacccugaaggagcugaagauccagaucaugcacgccuucagcguggcccccuucgaccagaaccugagcaucgacggcaagauccugagcgacgacugcgccacccugggcacccugggcgugauccccgagagcgugauccugcugaaggccgacgagcccaucgccgacuacgccgccauggacgacgugaugcaggugugcaugcccgaggagggcuucaagggcaccggccugcugggccacuaa

SEQ ID NO: 25466 - RNA, 2067 nt, Artificial Sequence
  USP49__Homo_sapiens__NP_001273483
auggacagaugcaagcacgugggcagacugagacuggcccaggaccacagcauccugaacccccagaaguggugcugccuggagugcgccaccaccgagagcgugugggccugccugaagugcagccacguggccugcggcagauacaucgaggaccacgcccugaagcacuucgaggagaccggccacccccuggccauggaggugagagaccuguacguguucugcuaccugugcaaggacuacgugcugaacgacaaccccgagggcgaccugaagcugcugagaagcagccugcuggccgugagaggccagaagcaggacacccccgugagaagaggcagaacccugagaagcauggccagcggcgaggacguggugcugccccagagagccccccagggccagccccagaugcugaccgcccugugguacagaagacagagacugcuggccagaacccugagacugugguucgagaagagcagcagaggccaggccaagcuggagcagagaagacaggaggaggcccuggagagaaagaaggaggaggccagaagaagaagaagagaggugaagagaagacugcuggaggagcuggccagcaccccccccagaaagagcgccagacugcugcugcacacccccagagacgccggccccgccgccagcagacccgccgcccugcccaccagcagaagagugcccgccgccacccugaagcugagaagacagcccgccauggcccccggcgugaccggccugagaaaccugggcaacaccugcuacaugaacagcauccugcaggugcugagccaccugcagaaguucagagagugcuuccugaaccuggaccccagcaagaccgagcaccuguuccccaaggccaccaacggcaagacccagcugagcggcaagcccaccaacagcagcgccaccgagcugagccugagaaacgacagagccgaggccugcgagagagagggcuucugcuggaacggcagagccagcaucagcagaagccuggagcugauccagaacaaggagcccagcagcaagcacaucagccugugcagagagcugcacacccuguucagagugauguggagcggcaagugggcccuggugagccccuucgccaugcugcacagcguguggagccugauccccgccuucagaggcuacgaccagcaggacgcccaggaguuccugugcgagcugcugcacaaggugcagcaggagcuggagagcgagggcaccaccagaagaauccugauccccuucagccagagaaagcugaccaagcaggugcugaagguggugaacaccaucuuccacggccagcugcugagccaggugaccugcaucagcugcaacuacaagagcaacaccaucgagcccuucugggaccugagccuggaguuccccgagagauaccacugcaucgagaagggcuucgugccccugaaccagaccgagugccugcugaccgagaugcuggccaaguucaccgagaccgaggcccuggagggcagaaucuacgccugcgaccagugcaacagcaagagaagaaagagcaaccccaagccccuggugcugagcgaggccagaaagcagcugaugaucuacagacugccccaggugcugagacugcaccugaagagauucagauggagcggcagaaaccacagagagaagaucggcgugcacgugguguucgaccaggugcugaccauggagcccuacugcugcagagacaugcugagcagccuggacaaggagaccuucgccuacgaccugagcgccguggugaugcaccacggcaagggcuucggcagcggccacuacaccgccuacugcuacaacaccgagggcggcuucugggugcacugcaacgacagcaagcugaacgugugcagcguggaggaggugugcaagacccaggccuacauccuguucuacacccagagaaccgugcagggcaacgccagaaucagcgagacccaccugcaggcccaggugcagagcagcaacaacgacgagggcagaccccagaccuucagcuaa

SEQ ID NO: 25467 - RNA, 942 nt, Artificial Sequence
  USP4__Homo_sapiens__NP_001238806
auggccgagggcggcggcugcagagagagacccgacgccgagacccagaagagcgagcugggcccccugaugagaaccacccugcagagaggcgcccagugguaccugaucgacagcagaugguucaagcaguggaagaaguacgugggcuucgacagcugggacauguacaacgugggcgagcacaaccuguuccccggccccaucgacaacagcggccuguucagcgaccccgagagccagacccugaaggagcaccugaucgacgagcuggacuacgugcuggugcccaccgaggccuggaacaagcugcugaacugguacggcugcguggagggccagcagcccaucgugagaaaggugguggagcacggccuguucgugaagcacugcaagguggagguguaccugcuggagcugaagcugugcgagaacagcgaccccaccaacgugcugagcugccacuucagcaaggccgacaccaucgccaccaucgagaaggagaugagaaagcuguucaacauccccgccgagagagagaccagacuguggaacaaguacaugagcaacaccuacgagcagcugagcaagcuggacaacaccgugcaggacgccggccuguaccagggccaggugcuggugaucgagccccagaacgaggacggcaccuggcccagacagacccugcagagcaaggugagcuucuuccugcccagacuggagugcaacggcgccauccuggcccacugcaacuucugccugcccggcagcagcaacagccccgccagcgccagcagaguggcccccagccaccuggccaacuucuucuucuucgagauggagagccacagcgugaccaagcuggagugcggcggcgccgugagcgccuacagcagagugcaggugaugcugcugccccagccccccgaguggcugggcuaa

SEQ ID NO: 25468 - RNA, 2577 nt, Artificial Sequence
  USP5__Homo_sapiens__NP_001092006
auggccgagcugagcgaggaggcccugcugagcgugcugcccaccaucagagugcccaaggccggcgacagagugcacaaggacgagugcgccuucagcuucgacacccccgagagcgagggcggccuguacaucugcaugaacaccuuccugggcuucggcaagcaguacguggagagacacuucaacaagaccggccagagaguguaccugcaccugagaagaaccagaagacccaaggaggaggaccccgccaccggcaccggcgacccccccagaaagaagcccaccagacuggccaucggcguggagggcggcuucgaccugagcgaggagaaguucgagcuggacgaggacgugaagaucgugauccugcccgacuaccuggagaucgccagagacggccugggcggccugcccgacaucgugagagacagagugaccagcgccguggaggcccugcugagcgccgacagcgccagcagaaagcaggaggugcaggccugggacggcgaggugagacaggugagcaagcacgccuucagccugaagcagcuggacaaccccgccagaaucccccccugcggcuggaagugcagcaagugcgacaugagagagaaccuguggcugaaccugaccgacggcagcauccugugcggcagaagauacuucgacggcagcggcggcaacaaccacgccguggagcacuacagagagaccggcuacccccuggccgugaagcugggcaccaucacccccgacggcgccgacguguacagcuacgacgaggacgacauggugcuggaccccagccuggccgagcaccugagccacuucggcaucgacaugcugaagaugcagaagaccgacaagaccaugaccgagcuggagaucgacaugaaccagagaaucggcgagugggagcugauccaggagagcggcgugccccugaagccccuguucggccccggcuacaccggcaucagaaaccugggcaacagcugcuaccugaacagcguggugcaggugcuguucagcauccccgacuuccagagaaaguacguggacaagcuggagaagaucuuccagaacgcccccaccgaccccacccaggacuucagcacccagguggccaagcugggccacggccugcugagcggcgaguacagcaagcccgugcccgagagcggcgacggcgagagagugcccgagcagaaggaggugcaggacggcaucgcccccagaauguucaaggcccugaucggcaagggccaccccgaguucagcaccaacagacagcaggacgcccaggaguucuuccugcaccugaucaacaugguggagagaaacugcagaagcagcgagaaccccaacgagguguucagauuccugguggaggagaagaucaagugccuggccaccgagaaggugaaguacacccagagaguggacuacaucaugcagcugcccgugcccauggacgccgcccugaacaaggaggagcugcuggaguacgaggagaagaagagacaggccgaggaggagaagauggcccugcccgagcuggugagagcccaggugcccuucagcagcugccuggaggccuacggcgcccccgagcagguggacgacuucuggagcaccgcccugcaggccaagagcguggccgugaagaccaccagauucgccagcuuccccgacuaccuggugauccagaucaagaaguucaccuucggccuggacugggugcccaagaagcuggacgugagcaucgagaugcccgaggagcuggacaucagccagcugagaggcaccggccugcagcccggcgaggaggagcugcccgacaucgcccccccccuggugacccccgacgagcccaagggcagccugggcuucuacggcaacgaggacgaggacagcuucugcagcccccacuucagcagccccaccagccccaugcuggacgagagcgugaucauccagcugguggagaugggcuuccccauggacgccugcagaaaggccguguacuacaccggcaacagcggcgccgaggccgccaugaacugggugaugagccacauggacgaccccgacuucgccaacccccugauccugcccggcagcagcggccccggcagcaccagcgccgccgccgaccccccccccgaggacugcgugaccaccaucgugagcaugggcuucagcagagaccaggcccugaaggcccugagagccaccaacaacagccuggagagagccguggacuggaucuucagccacaucgacgaccuggacgccgaggccgccauggacaucagcgagggcagaagcgccgccgacagcaucagcgagagcgugcccgugggccccaaggugagagacggccccggcaaguaccagcuguucgccuucaucagccacaugggcaccagcaccaugugcggccacuacgugugccacaucaagaaggagggcagaugggugaucuacaacgaccagaaggugugcgccagcgagaagccccccaaggaccugggcuacaucuacuucuaccagagaguggccagcuaa

SEQ ID NO: 25469 - RNA, 4221 nt, Artificial Sequence
  USP6__Homo_sapiens__NP_001291213
auggacaugguggagaacgccgacagccugcaggcccaggagagaaaggacauccugaugaaguacgacaagggccacagagccggccugcccgaggacaagggccccgagcccgugggcaucaacagcagcaucgacagauucggcauccugcacgagaccgagcugccccccgugaccgccagagaggccaagaagaucagaagagagaugaccagaaccagcaaguggauggagaugcugggcgagugggagaccuacaagcacagcagcaagcugaucgacagaguguacaagggcauccccaugaacaucagaggccccguguggagcgugcugcugaacauccaggagaucaagcugaagaaccccggcagauaccagaucaugaaggagagaggcaagagaagcagcgagcacauccaccacaucgaccuggacgugagaaccacccugagaaaccacguguucuucagagacagauacggcgccaagcagagagagcuguucuacauccugcuggccuacagcgaguacaaccccgaggugggcuacugcagagaccugagccacaucaccgcccuguuccugcuguaccugcccgaggaggacgccuucugggcccuggugcagcugcuggccagcgagagacacagccugcccggcuuccacagccccaacggcggcaccgugcagggccugcaggaccagcaggagcacguggugcccaagagccagcccaagaccauguggcaccaggacaaggagggccugugcggccagugcgccagccugggcugccugcugagaaaccugaucgacggcaucagccugggccugacccugagacugugggacguguaccugguggagggcgagcaggugcugaugcccaucaccagcaucgcccugaaggugcagcagaagagacugaugaagaccagcagaugcggccugugggccagacugagaaaccaguucuucgacaccugggccaugaacgacgacaccgugcugaagcaccugagagccagcaccaagaagcugaccagaaagcagggcgaccugcccccccccgccaagagagagcagggcagccuggcccccagacccgugcccgccagcagaggcggcaagacccugugcaagggcuacagacaggccccccccggcccccccgcccaguuccagagacccaucugcagcgccagcccccccugggccagcagauucagcacccccugccccggcggcgccgugagagaggacaccuaccccgugggcacccagggcgugcccagccuggcccuggcccagggcggcccccagggcagcuggagauuccuggaguggaagagcaugcccagacugcccaccgaccuggacaucggcggccccugguucccccacuacgacuucgaguggagcugcugggugagagccaucagccaggaggaccagcuggccaccugcuggcaggccgagcacugcggcgaggugcacaacaaggacaugagcuggcccgaggagaugagcuucaccgccaacagcagcaagaucgacagacagaaggugcccaccgagaagggcgccaccggccugagcaaccugggcaacaccugcuucaugaacagcagcauccagugcgugagcaacacccagccccugacccaguacuucaucagcggcagacaccuguacgagcugaacagaaccaaccccaucggcaugaagggccacauggccaagugcuacggcgaccuggugcaggagcuguggagcggcacccagaagagcguggccccccugaagcugagaagaaccaucgccaaguacgcccccaaguucgacggcuuccagcagcaggacagccaggagcugcuggccuuccugcuggacggccugcacgaggaccugaacagagugcacgagaagcccuacguggagcugaaggacagcgacggcagacccgacugggagguggccgccgaggccugggacaaccaccugagaagaaacagaagcaucaucguggaccuguuccacggccagcugagaagccaggugaagugcaagaccugcggccacaucagcgugagauucgaccccuucaacuuccugagccugccccugcccauggacagcuacauggaccuggagaucaccgugaucaagcuggacggcaccacccccgugagauacggccugagacugaacauggacgagaaguacaccggccugaagaagcagcugagagaccugugcggccugaacagcgagcagauccugcuggccgaggugcacgacagcaacaucaagaacuucccccaggacaaccagaaggugcagcugagcgugagcggcuuccugugcgccuucgagauccccgugcccagcagccccaucagcgccagcagccccacccagaucgacuucagcagcagccccagcaccaacggcauguucacccugaccaccaacggcgaccugcccaagcccaucuucauccccaacggcaugcccaacaccguggugcccugcggcaccgagaagaacuucaccaacggcauggugaacggccacaugcccagccugcccgacagccccuucaccggcuacaucaucgccgugcacagaaagaugaugagaaccgagcuguacuuccugagcccccaggagaacagacccagccuguucggcaugccccugaucgugcccugcaccgugcacaccagaaagaaggaccuguacgacgccguguggauccaggugagcuggcuggccagaccccugcccccccaggaggccagcauccacgcccaggacagagacaacugcaugggcuaccaguaccccuucacccugagaguggugcagaaggacggcaacagcugcgccuggugcccccaguacagauucugcagaggcugcaagaucgacugcggcgaggacagagccuucaucggcaacgccuacaucgccguggacuggcaccccaccgcccugcaccugagauaccagaccagccaggagagagugguggacaagcacgagagcguggagcagagcagaagagcccaggccgagcccaucaaccuggacagcugccugagagccuucaccagcgaggaggagcugggcgagagcgagauguacuacugcagcaagugcaagacccacugccuggccaccaagaagcuggaccuguggagacugccccccuuccugaucauccaccugaagagauuccaguucgugaacgaccaguggaucaagagccagaagaucgugagauuccugagagagagcuucgaccccagcgccuuccuggugcccagagaccccgcccugugccagcacaagccccugaccccccagggcgacgagcugagcaagcccagaauccuggccagagaggugaagaagguggacgcccagagcagcgccggcaaggaggacaugcugcugagcaagagccccagcagccugagcgccaacaucagcagcagccccaagggcagccccagcagcagcagaaagagcggcaccagcugccccagcagcaagaacagcagccccaacagcagccccagaacccugggcagaagcaagggcagacugagacugccccagaucggcagcaagaacaagcccagcagcagcaagaagaaccuggacgccagcaaggagaacggcgccggccagaucugcgagcuggccgacgcccugagcagaggccacaugagaggcggcagccagcccgagcuggugaccccccaggaccacgagguggcccuggccaacggcuuccuguacgagcacgaggccugcggcaacggcugcggcgacggcuacagcaacggccagcugggcaaccacagcgaggaggacagcaccgacgaccagagagaggacacccacaucaagcccaucuacaaccuguacgccaucagcugccacagcggcauccugagcggcggccacuacaucaccuacgccaagaaccccaacugcaagugguacugcuacaacgacagcagcugcgaggagcugcaccccgacgagaucgacaccgacagcgccuacauccuguucuacgagcagcagggcaucgacuacgcccaguuccugcccaagaucgacggcaagaagauggccgacaccagcagcaccgacgaggacagcgagagcgacuacgagaaguacagcaugcugcaguaa

SEQ ID NO: 25470 - RNA, 2538 nt, Artificial Sequence
  USP6NL__Homo_sapiens__NP_001073960
augagaaccgaggccguggugaacagccagggccagaccgacuaccugaccaaggacagcgaccaggacguggcccugaagcuggcccaggagagagccgagaucguggccaaguacgacagaggcagagagggcgccgagaucgagcccugggaggacgccgacuaccugguguacaaggugaccgacagauucggcuuccugcacgaggaggagcugcccgaccacaacguggccguggagagacagaagcaccuggagaucgagagaaccaccaaguggcugaagaugcugaagggcugggagaaguacaagaacaccgagaaguuccacagaagaaucuacaagggcaucccccugcagcugagaggcgaggugugggcccugcugcuggagauccccaagaugaaggaggagaccagagaccuguacagcaagcugaagcacagagccagaggcugcagccccgacaucagacagaucgaccuggacgugaacagaaccuucagagaccacaucauguucagagacagauacggcgugaagcagcagagccuguuccacgugcuggccgccuacagcaucuacaacaccgaggugggcuacugccagggcaugagccagaucaccgcccugcugcugauguacaugaacgaggaggacgccuucugggcccuggugaagcuguucagcggccccaagcacgccaugcacggcuucuucgugcagggcuuccccaagcugcugagauuccaggagcaccacgagaagauccugaacaaguuccugagcaagcugaagcagcaccuggacagccaggagaucuacaccagcuucuacaccaugaagugguucuuccagugcuuccuggacagaacccccuucacccugaaccugagaaucugggacaucuacaucuucgagggcgagagagugcugaccgccaugagcuacaccauccugaagcugcacaagaagcaccugaugaagcugagcauggaggagcugguggaguucuuccaggagacccuggccaaggacuucuucuucgaggacgacuucgugaucgagcagcugcagaucagcaugaccgagcugaagagagccaagcuggaccugcccgagcccggcaaggaggacgaguaccccaagaagccccugggccagcugccccccgagcugcagagcuggggcgugcaccaccugagcaacggccagagaagcgugggcagacccagcccccuggccagcggcagaagagagagcggcgccccccacagaagacacgagcacagcccccacccccagagcagaaccggcacccccgagagagcccagccccccagaagaaagagcguggaggaggagagcaagaagcugaaggacgaggccgacuuccagagaaagcugcccagcggcccccaggacagcagcagacaguacaaccacgccgccgccaaccagaacagcaacgccaccagcaacaucagaaaggaguucgugcccaaguggaacaagcccagcgacgugagcgccaccgagagaaccgccaaguacaccauggagggcaagggcagagccgcccaccccgcccuggccgugaccgugcccggccccgccgaggugagagugagcaacgugagacccaagaugaaggcccuggacgccgaggacggcaagagaggcagcaccgccagccaguacgacaacgugcccggccccgagcuggacagcggcgccagcguggaggaggcccuggagagagccuacagccagagccccagacacgcccuguacccccccagccccagaaagcacgccgagcccagcagcagccccagcaaggugagcaacaaguucaccuucaaggugcagccccccagccacgccagauaccccagccagcuggacggcgaggccagaggccuggcccacccccccagcuacagcaacccccccguguaccacggcaacagccccaagcacuuccccaccgccaacagcagcuucgccagcccccaguucagccccggcacccagcugaaccccagcagaagaccccacggcagcacccugagcgugagcgccagccccgagaagagcuacagcagacccagcccccuggugcugcccagcagcagaaucgaggugcugcccguggacaccggcgccggcggcuacagcggcaacagcggcagccccaagaacggcaagcugaucaucccccccguggacuaccugcccgacaacagaaccuggagcgaggugagcuacaccuacagacccgagacccagggccagagcuggaccagagacgccagcagaggcaaccugcccaaguacagcgccuuccagcuggcccccuuccaggaccacggccugcccgccgugagcguggacagccccgugagauacaaggccagccccgccgccgaggacgccagccccagcggcuaccccuacagcggcccccccccccccgccuaccacuacagaaacagagacggccugagcauccaggagagcgugcugcuguaa

SEQ ID NO: 25471 - RNA, 3261 nt, Artificial Sequence
  USP7__Homo_sapiens__NP_001273386
auggccggcaaccacagacugggccuggaggccggcgacaccgacgacccccccagaaucacccagaaccccgugaucaacggcaacguggcccugagcgacggccacaacaccgccgaggaggacauggaggacgacaccagcuggagaagcgaggccaccuuccaguucaccguggagagauucagcagacugagcgagagcgugcugagcccccccugcuucgugagaaaccugcccuggaagaucauggugaugcccagauucuaccccgacagaccccaccagaagagcgugggcuucuuccugcagugcaacgccgagagcgacagcaccagcuggagcugccacgcccaggccgugcugaagaucaucaacuacagagacgacgagaagagcuucagcagaagaaucagccaccuguucuuccacaaggagaacgacuggggcuucagcaacuucauggccuggagcgaggugaccgaccccgagaagggcuucaucgacgacgacaaggugaccuucgagguguucgugcaggccgacgccccccacggcguggccugggacagcaagaagcacaccggcuacgugggccugaagaaccagggcgccaccugcuacaugaacagccugcugcagacccuguucuucaccaaccagcugagaaaggccguguacaugaugcccaccgagggcgacgacagcagcaagagcgugccccuggcccugcagagaguguucuacgagcugcagcacagcgacaagcccgugggcaccaagaagcugaccaagagcuucggcugggagacccuggacagcuucaugcagcacgacgugcaggagcugugcagagugcugcuggacaacguggagaacaagaugaagggcaccugcguggagggcaccauccccaagcuguucagaggcaagauggugagcuacauccagugcaaggagguggacuacagaagcgacagaagagaggacuacuacgacauccagcugagcaucaagggcaagaagaacaucuucgagagcuucguggacuacguggccgugggccagcuggacggcgacaacaaguacgacgccggcgagcacggccugcaggaggccgagaagggcgugaaguuccugacccugccccccgugcugcaccugcagcugaugagauucauguacgacccccagaccgaccagaacaucaagaucaacgacagauucgaguuccccgagcagcugccccuggacgaguuccugcagaagaccgaccccaaggaccccgccaacuacauccugcacgccgugcuggugcacagcggcgacaaccacggcggccacuacgugguguaccugaaccccaagggcgacggcaaguggugcaaguucgacgacgacguggugagcagaugcaccaaggaggaggccaucgagcacaacuacggcggccacgacgacgaccugagcgugagacacugcaccaacgccuacaugcugguguacaucagagagagcaagcugagcgaggugcugcaggccgugaccgaccacgacaucccccagcagcugguggagagacugcaggaggagaagagaaucgaggcccagaagagaaaggagagacaggaggcccaccuguacaugcaggugcagaucguggccgaggaccaguucugcggccaccagggcaacgacauguacgacgaggagaaggugaaguacaccguguucaaggugcugaagaacagcagccuggccgaguucgugcagagccugagccagaccaugggcuucccccaggaccagaucagacuguggcccaugcaggccagaagcaacggcaccaagagacccgccaugcuggacaacgaggccgacggcaacaagaccaugaucgagcugagcgacaacgagaaccccuggaccaucuuccuggagaccguggaccccgagcuggccgccagcggcgccacccugcccaaguucgacaaggaccacgacgugaugcuguuccugaagauguacgaccccaagaccagaagccugaacuacugcggccacaucuacacccccaucagcugcaagaucagagaccugcugcccgugaugugcgacagagccggcuucauccaggacaccagccugauccuguacgaggaggugaagcccaaccugaccgagagaauccaggacuacgacgugagccuggacaaggcccuggacgagcugauggacggcgacaucaucguguuccagaaggacgaccccgagaacgacaacagcgagcugcccaccgccaaggaguacuucagagaccuguaccacagaguggacgugaucuucugcgacaagaccauccccaacgaccccggcuucguggugacccugagcaacagaaugaacuacuuccagguggccaagaccguggcccagagacugaacaccgaccccaugcugcugcaguucuucaagagccagggcuacagagacggccccggcaacccccugagacacaacuacgagggcacccugagagaccugcugcaguucuucaagcccagacagcccaagaagcuguacuaccagcagcugaagaugaagaucaccgacuucgagaacagaagaagcuucaagugcaucuggcugaacagccaguucagagaggaggagaucacccuguaccccgacaagcacggcugcgugagagaccugcuggaggagugcaagaaggccguggagcugggcgagaaggccagcggcaagcugagacugcuggagaucgugagcuacaagaucaucggcgugcaccaggaggacgagcugcuggagugccugagccccgccaccagcagaaccuucagaaucgaggagaucccccuggaccagguggacaucgacaaggagaacgagaugcuggugaccguggcccacuuccacaaggagguguucggcaccuucggcauccccuuccugcugagaauccaccagggcgagcacuucagagaggugaugaagagaauccagagccugcuggacauccaggagaaggaguucgagaaguucaaguucgccaucgugaugaugggcagacaccaguacaucaacgaggacgaguacgaggugaaccugaaggacuucgagccccagcccggcaacaugagccaccccagacccuggcugggccuggaccacuucaacaaggcccccaagagaagcagauacaccuaccuggagaaggccaucaagauccacaacuaa

SEQ ID NO: 25472 - RNA, 3357 nt, Artificial Sequence
  USP8__Homo_sapiens__NP_001122082
augcccgccguggccagcgugcccaaggagcuguaccugagcagcagccugaaggaccugaacaagaagaccgaggugaagcccgagaagaucagcaccaagagcuacgugcacagcgcccugaagaucuucaagaccgccgaggagugcagacuggacagagacgaggagagagccuacgugcuguacaugaaguacgugaccguguacaaccugaucaagaagagacccgacuucaagcagcagcaggacuacuuccacagcauccugggccccggcaacaucaagaaggccguggaggaggccgagagacugagcgagagccugaagcugagauacgaggaggccgaggugagaaagaagcuggaggagaaggacagacaggaggaggcccagagacugcagcagaagagacaggagaccggcagagaggacggcggcacccuggccaagggcagccuggagaacgugcuggacagcaaggacaagacccagaagagcaacggcgagaagaacgagaagugcgagaccaaggagaagggcgccaucaccgccaaggagcuguacaccaugaugaccgacaagaacaucagccugaucaucauggacgccagaagaaugcaggacuaccaggacagcugcauccugcacagccugagcgugcccgaggaggccaucagccccggcgugaccgccagcuggaucgaggcccaccugcccgacgacagcaaggacaccuggaagaagagaggcaacguggaguacguggugcugcuggacugguucagcagcgccaaggaccugcagaucggcaccacccugagaagccugaaggacgcccuguucaagugggagagcaagaccgugcugagaaacgagccccuggugcuggagggcggcuacgagaacuggcugcugugcuacccccaguacaccaccaacgccaaggugacccccccccccagaagacagaacgaggaggugagcaucagccuggacuucaccuaccccagccuggaggagagcauccccagcaagcccgccgcccagaccccccccgccagcaucgagguggacgagaacaucgagcugaucagcggccagaacgagagaaugggcccccugaacaucagcacccccguggagcccguggccgccagcaagagcgacgugagccccaucauccagcccgugcccagcaucaagaacgugccccagaucgacagaaccaagaagcccgccgugaagcugcccgaggagcacagaaucaagagcgagagcaccaaccacgagcagcagagcccccagagcggcaaggugauccccgacagaagcaccaagcccgugguguucagccccacccugaugcugaccgacgaggagaaggccagaauccacgccgagaccgcccugcugauggagaagaacaagcaggagaaggagcugagagagagacagcaggaggagcagaaggagaagcugagaaaggaggagcaggagcagaaggccaagaagaagcaggaggccgaggagaacgagaucaccgagaagcagcagaaggccaaggaggagauggagaagaaggagagcgagcaggccaagaaggaggacaaggagaccagcgccaagagaggcaaggagaucaccggcgugaagagacagagcaagagcgagcacgagaccagcgacgccaagaagagcguggaggacagaggcaagagaugccccacccccgagauccagaagaagagcaccggcgacgugccccacaccagcgugaccggcgacagcggcagcggcaagcccuucaagaucaagggccagcccgagagcggcauccugagaaccggcaccuucagagaggacaccgacgacaccgagagaaacaaggcccagagagagccccugaccagagccagaagcgaggagaugggcagaaucgugcccggccugcccagcggcugggccaaguuccuggaccccaucaccggcaccuucagauacuaccacagccccaccaacaccgugcacauguacccccccgagauggcccccagcagcgccccccccagcaccccccccacccacaaggccaagccccagauccccgccgagagagacagagagcccagcaagcugaagagaagcuacagcagccccgacaucacccaggccauccaggaggaggagaagagaaagcccaccgugacccccaccgugaacagagagaacaagcccaccugcuaccccaaggccgagaucagcagacugagcgccagccagaucagaaaccugaaccccguguucggcggcagcggccccgcccugaccggccugagaaaccugggcaacaccugcuacaugaacagcauccugcagugccugugcaacgccccccaccuggccgacuacuucaacagaaacugcuaccaggacgacaucaacagaagcaaccugcugggccacaagggcgagguggccgaggaguucggcaucaucaugaaggcccuguggaccggccaguacagauacaucagccccaaggacuucaagaucaccaucggcaagaucaacgaccaguucgccggcuacagccagcaggacagccaggagcugcugcuguuccugauggacggccugcacgaggaccugaacaaggccgacaacagaaagagauacaaggaggagaacaacgaccaccuggacgacuucaaggccgccgagcacgccuggcagaagcacaagcagcugaacgagagcaucaucguggcccuguuccagggccaguucaagagcaccgugcagugccugaccugccacaagaagagcagaaccuucgaggccuucauguaccugagccugccccuggccagcaccagcaagugcacccugcaggacugccugagacuguucagcaaggaggagaagcugaccgacaacaacagauucuacugcagccacugcagagccagaagagacagccugaagaagaucgagaucuggaagcugccccccgugcugcuggugcaccugaagagauucagcuacgacggcagauggaagcagaagcugcagaccagcguggacuucccccuggagaaccuggaccugagccaguacgugaucggccccaagaacaaccugaagaaguacaaccuguucagcgugagcaaccacuacggcggccuggacggcggccacuacaccgccuacugcaagaacgccgccagacagagaugguucaaguucgacgaccacgaggugagcgacaucagcgugagcagcgugaagagcagcgccgccuacauccuguucuacaccagccugggccccagagugaccgacguggccaccuaa

SEQ ID NO: 25473 - RNA, 7713 nt, Artificial Sequence
  USP9X__Homo_sapiens__NP_001034679
augaccgccaccaccagaggcagccccgugggcggcaacgacaaccagggccaggcccccgacggccagagccagcccccccugcagcagaaccagaccagcagccccgacagcagcaacgagaacagccccgccaccccccccgacgagcagggccagggcgacgcccccccccagcuggaggacgaggagcccgccuucccccacaccgaccuggccaagcuggacgacaugaucaacagacccagauggguggugcccgugcugcccaagggcgagcuggaggugcugcuggaggccgccaucgaccugagcaagaagggccuggacgugaagagcgaggccugccagagauucuucagagacggccugaccaucagcuucaccaagauccugaccgacgaggccgugagcggcuggaaguucgagauccacagaugcaucaucaacaacacccacagacugguggagcugugcguggccaagcugagccaggacugguucccccugcuggagcugcuggccauggcccugaacccccacugcaaguuccacaucuacaacggcaccagacccugcgagagcgugagcagcagcgugcagcugcccgaggacgagcuguucgccagaagccccgaccccagaagccccaagggcuggcugguggaccugcugaacaaguucggcacccugaacggcuuccagauccugcacgacagauucaucaacggcagcgcccugaacgugcagaucaucgccgcccugaucaagcccuucggccagugcuacgaguuccugacccugcacaccgugaagaaguacuuccugcccaucaucgagauggugccccaguuccuggagaaccugaccgacgaggagcugaagaaggaggccaagaacgaggccaagaacgacgcccugagcaugaucaucaagagccugaagaaccuggccagcagagugcccggccaggaggagaccgugaagaaccuggagaucuucagacugaagaugauccugagacugcugcagaucagcagcuucaacggcaagaugaacgcccugaacgaggugaacaaggugaucagcagcgugagcuacuacacccacagacacggcaaccccgaggaggaggaguggcugaccgccgagagaauggccgaguggauccagcagaacaacauccugagcaucgugcugagagacagccugcaccagccccaguacguggagaagcuggagaagauccugagauucgugaucaaggagaaggcccugacccugcaggaccuggacaacaucugggccgcccaggccggcaagcacgaggccaucgugaagaacgugcacgaccugcuggccaagcuggccugggacuucagccccgagcagcuggaccaccuguucgacugcuucaaggccagcuggaccaacgccagcaagaagcagagagagaagcugcuggagcugaucagaagacuggccgaggacgacaaggacggcgugauggcccacaaggugcugaaccugcuguggaaccuggcccacagcgacgacgugcccguggacaucauggaccuggcccugagcgcccacaucaagauccuggacuacagcugcagccaggacagagacacccagaagauccaguggaucgacagauucaucgaggagcugagaaccaacgacaagugggugauccccgcccugaagcagaucagagagaucugcagccuguucggcgaggccccccagaaccugagccagacccagagaagcccccacguguucuacagacacgaccugaucaaccagcugcagcacaaccacgcccuggugacccugguggccgagaaccuggccaccuacauggagagcaugagacuguacgccagagaccacgaggacuacgacccccagaccgugagacugggcagcagauacagccacgugcaggaggugcaggagagacugaacuuccugagauuccugcugaaggacggccagcuguggcugugcgccccccaggccaagcagaucuggaagugccuggccgagaacgccguguaccugugcgacagagaggccugcuucaagugguacagcaagcugaugggcgacgagcccgaccuggaccccgacaucaacaaggacuucuucgagagcaacgugcugcagcuggaccccagccugcugaccgagaacggcaugaagugcuucgagagauucuucaaggccgugaacugcagagagggcaagcugguggccaagagaagagccuacaugauggacgaccuggagcugaucggccuggacuaccuguggagaguggugauccagagcaacgacgacaucgccagcagagccaucgaccugcugaaggagaucuacaccaaccugggccccagacugcaggugaaccagguggugauccacgaggacuucauccagagcugcuucgacagacugaaggccagcuacgacacccugugcgugcuggacggcgacaaggacagcgugaacugcgccagacaggaggccgugagaauggugagagugcugaccgugcugagagaguacaucaacgagugcgacagcgacuaccacgaggagagaaccauccugcccaugagcagagccuucagaggcaagcaccugagcuucguggugagauuccccaaccagggcagacagguggacgaccuggagguguggagccacaccaacgacaccaucggcagcgugagaagaugcauccugaacagaaucaaggccaacguggcccacaccaagaucgagcuguucgugggcggcgagcugaucgaccccgccgacgacagaaagcugaucggccagcugaaccugaaggacaagagccugaucaccgccaagcugacccagaucagcagcaacaugcccagcagccccgacagcagcagcgacagcagcaccggcagccccggcaaccacggcaaccacuacagcgacggccccaaccccgagguggagagcugccugcccggcgugaucaugagccugcaccccagauacaucagcuuccuguggcagguggccgaccugggcagcagccugaacaugcccccccugagagacggcgccagagugcugaugaagcugaugccccccgacagcaccaccaucgagaagcugagagccaucugccuggaccacgccaagcugggcgagagcagccugagccccagccuggacagccuguucuucggccccagcgccagccaggugcuguaccugaccgaggugguguacgcccugcugaugcccgccggcgccccccuggccgacgacagcagcgacuuccaguuccacuuccugaagagcggcggccugccccuggugcugagcaugcugaccagaaacaacuuccugcccaacgccgacauggagaccagaagaggcgccuaccugaacgcccugaagaucgccaagcugcugcugaccgccaucggcuacggccacgugagagccguggccgaggccugccagcccggcguggagggcgugaaccccaugacccagaucaaccaggugacccacgaccaggccguggugcugcagagcgcccugcagagcauccccaaccccagcagcgagugcaugcugagaaacgugagcgugagacuggcccagcagaucagcgacgaggccagcagauacaugcccgacaucugcgugaucagagccauccagaagaucaucugggccagcggcugcggcagccugcagcugguguucagccccaacgaggagaucaccaagaucuacgagaagaccaacgccggcaacgagcccgaccuggaggacgagcaggugugcugcgaggcccuggaggugaugacccugugcuucgcccugauccccaccgcccuggacgcccugagcaaggagaaggccuggcagaccuucaucaucgaccugcugcugcacugccacagcaagaccgugagacagguggcccaggagcaguucuuccugaugugcaccagaugcugcaugggccacagaccccugcuguucuucaucacccugcuguucaccgugcugggcagcaccgccagagagagagccaagcacagcggcgacuacuucacccugcugagacaccugcugaacuacgccuacaacagcaacaucaacgugcccaacgccgaggugcugcugaacaacgagaucgacuggcugaagagaaucagagacgacgugaagagaaccggcgagaccggcaucgaggagaccauccuggagggccaccugggcgugaccaaggagcugcuggccuuccagaccagcgagaagaaguuccacaucggcugcgagaagggcggcgccaaccugaucaaggagcugaucgacgacuucaucuuccccgccagcaacguguaccugcaguacaugagaaacggcgagcugcccgccgagcaggccauccccgugugcggcagcccccccaccaucaacgccggcuucgagcugcugguggcccuggccgugggcugcgugagaaaccugaagcagaucguggacagccugaccgagauguacuacaucggcaccgccaucaccaccugcgaggcccugaccgagugggaguaccugccccccgugggccccagaccccccaagggcuucgugggccugaagaacgccggcgccaccugcuacaugaacagcgugauccagcagcuguacaugauccccagcaucagaaacggcauccuggccaucgagggcaccggcagcgacguggacgacgacaugagcggcgacgagaagcaggacaacgagagcaacguggaccccagagacgacguguucggcuacccccagcaguucgaggacaagcccgcccugagcaagaccgaggacagaaaggaguacaacaucggcgugcugagacaccugcaggugaucuucggccaccuggccgccagcagacugcaguacuacgugcccagaggcuucuggaagcaguucagacuguggggcgagcccgugaaccugagagagcagcacgacgcccuggaguucuucaacagccugguggacagccuggacgaggcccugaaggcccugggccaccccgccaugcugagcaaggugcugggcggcagcuucgccgaccagaagaucugccagggcugcccccacagauacgagugcgaggagagcuucaccacccugaacguggacaucagaaaccaccagaaccugcuggacagccuggagcaguacgugaagggcgaccugcuggagggcgccaacgccuaccacugcgagaagugcaacaagaagguggacaccgugaagagacugcugaucaagaagcugccccccgugcuggccauccagcugaagagauucgacuacgacugggagagagagugcgccaucaaguucaacgacuacuucgaguuccccagagagcuggacauggagcccuacaccguggccggcguggccaagcuggagggcgacaacgugaaccccgagagccagcugauccagcagagcgagcagagcgagagcgagaccgccggcagcaccaaguacagacuggugggcgugcuggugcacagcggccaggccagcggcggccacuacuacagcuacaucauccagagaaacggcggcgacggcgagagaaacagaugguacaaguucgacgacggcgacgugaccgagugcaagauggacgacgacgaggagaugaagaaccagugcuucggcggcgaguacaugggcgagguguucgaccacaugaugaagagaaugagcuacagaagacagaagagaugguggaacgccuacauccuguucuacgagagaauggacaccaucgaccaggacgacgagcugaucagauacaucagcgagcuggccaucaccaccagaccccaccagaucaucaugcccagcgccaucgagagaagcgugagaaagcagaacgugcaguucaugcacaacagaaugcaguacagcauggaguacuuccaguucaugaagaagcugcugaccugcaacggcguguaccugaaccccccccccggccaggaccaccugcugcccgaggccgaggagaucaccaugaucagcauccagcuggccgccagauuccuguucaccaccggcuuccacaccaagaagguggugagaggcagcgccagcgacugguacgacgcccugugcauccugcugagacacagcaagaacgugagauucugguucgcccacaacgugcuguucaacgugagcaacagauucagcgaguaccugcuggagugccccagcgccgaggugagaggcgccuucgccaagcugaucguguucaucgcccacuucagccugcaggacggccccugccccagccccuucgccagccccggccccagcagccaggccuacgacaaccugagccugagcgaccaccugcugagagccgugcugaaccugcugagaagagaggugagcgagcacggcagacaccugcagcaguacuucaaccuguucgugauguacgccaaccugggcguggccgagaagacccagcugcugaagcugagcgugcccgccaccuucaugcuggugagccuggacgagggccccggcccccccaucaaguaccaguacgccgagcugggcaagcuguacagcguggugagccagcugaucagaugcugcaacgugagcagcagaaugcagagcagcaucaacggcaaccccccccugcccaaccccuucggcgaccccaaccugagccagcccaucaugcccauccagcagaacguggccgacauccuguucgugagaaccagcuacgugaagaagaucaucgaggacugcagcaacagcgaggagaccgugaagcugcugagauucugcugcugggagaacccccaguucagcagcaccgugcugagcgagcugcuguggcagguggccuacagcuacaccuacgagcugagacccuaccuggaccugcugcugcagauccugcugaucgaggacagcuggcagacccacagaauccacaacgcccugaagggcauccccgacgacagagacggccuguucgacaccauccagagaagcaagaaccacuaccagaagagagccuaccagugcaucaagugcaugguggcccuguucagcaacugccccguggccuaccagauccugcagggcaacggcgaccugaagagaaaguggaccugggccguggaguggcugggcgacgagcuggagagaagacccuacaccggcaacccccaguacaccuacaacaacuggagcccccccgugcagagcaacgagaccagcaacggcuacuuccuggagagaagccacagcgccagaaugacccuggccaaggccugcgagcugugccccgaggaggugaagaaggccaccagcgugcagcagaucgagauggaggagagcaaggagcccgacgaccaggacgcccccgacgagcacgagagccccccccccgaggacgccccccuguacccccacagccccggcagccaguaccagcagaacaaccacgugcacggccagcccuacaccggccccgccgcccaccacaugaacaacccccagagaaccggccagagagcccaggagaacuacgagggcagcgaggaggugagccccccccagaccaaggaccaguaa

SEQ ID NO: 25474 - RNA, 7668 nt, Artificial Sequence
  USP9Y__Homo_sapiens__XP_011529771
augaccgccaucacccacggcagccccgugggcggcaacgacagccagggccaggugcuggacggccagagccagcaccuguuccagcagaaccagaccagcagccccgacagcagcaacgagaacagcguggccacccccccccccgaggagcagggccagggcgacgcccccccccagcacgaggacgaggagcccgccuucccccacaccgagcuggccaaccuggacgacaugaucaacagacccagauggguggugcccgugcugcccaagggcgagcuggaggugcugcuggaggccgccaucgaccugagcgugaagggccuggacgugaagagcgaggccugccagagauucuucagagacggccugaccaucagcuucaccaagauccugauggacgaggccgugagcggcuggaaguucgagauccacagaugcaucaucaacaacacccacagacugguggagcugugcguggccaagcugagccaggacugguucccccugcuggagcugcuggccauggcccugaacccccacugcaaguuccacaucuacaacggcaccagacccugcgagcugaucagcagcaacgcccagcugcccgaggacgagcuguucgccagaagcagcgaccccagaagccccaagggcuggcugguggaccugaucaacaaguucggcacccugaacggcuuccagauccugcacgacagauucuucaacggcagcgcccugaacauccagaucaucgccgcccugaucaagcccuucggccagugcuacgaguuccugagccagcacacccugaagaaguacuucauccccgugaucgagaucgugccccaccugcuggagaaccugaccgacgaggagcugaagaaggaggccaagaacgaggccaagaacgacgcccugagcaugaucaucaagagccugaagaaccuggccagcagaaucagcggccaggacgagaccaucaagaaccuggagaucuucagacugaagaugauccugagacugcugcagaucagcagcuucaacggcaagaugaacgcccugaacgagaucaacaaggugaucagcagcgugagcuacuacacccacagacacagcaaccccgaggaggaggaguggcugaccgccgagagaauggccgaguggauccagcagaacaacauccugagcaucgugcugcaggacagccugcaccagccccaguacguggagaagcuggagaagauccugagauucgugaucaaggagaaggcccugacccugcaggaccuggacaacaucugggccgcccaggccggcaagcacgaggccaucgugaagaacgugcacgaccugcuggccaagcuggccugggacuucagccccggccagcuggaccaccuguucgacugcuucaaggccagcuggaccaacgccagcaagaagcagagagagaagcugcuggagcugaucagaagacuggccgaggacgacaaggacggcgugauggcccacaaggugcugaaccugcuguggaaccuggcccagagcgacgacgugcccguggacaucauggaccuggcccugagcgcccacaucaagauccuggacuacagcugcagccaggacagagacgcccagaagauccaguggaucgaccacuucaucgaggagcugagaaccaacgacaagugggugauccccgcccugaagcagaucagagagaucugcagccuguucggcgaggccagccagaaccugagccagacccagagaagcccccacaucuucuacagacacgaccugaucaaccagcugcagcagaaccacgcccuggugacccugguggccgagaaccuggccaccuacaugaacagcaucagacuguacgccggcgaccacgaggacuacgacccccagaccgugagacugggcagcagauacagccacgugcaggaggugcaggagagacugaacuuccugagauuccugcugaaggacggccagcuguggcugugcgccccccaggccaagcagaucuggaagugccuggccgagaacgccguguaccugugcgacagagaggccugcuucaagugguacagcaagcugaugggcgacgagcccgaccuggaccccgacaucaacaaggacuucuucgagagcaacgugcugcagcuggaccccagccugcugaccgagaacggcaugaagugcuucgagagauucuucaaggccgugaacugcagagagagaaagcugaucgccaagagaagaagcuacaugauggacgaccuggagcugaucggccuggacuaccuguggagaguggugauccagagcagcgacgagaucgccaacagagccaucgaccugcugaaggagaucuacaccaaccugggccccagacugaaggccaaccagguggugauccacgaggacuucauccagagcugcuucgacagacugaaggccagcuacgacacccugugcguguucgacggcgacaagaacagcaucaacugcgccagacaggaggccaucagaauggugagagugcugaccgugaucaaggaguacaucaacgagugcgacagcgacuaccacaaggagagaaugauccugcccaugagcagagccuucagaggcaagcaccugagccugaucgugagauuccccaaccagggcagacagguggacgagcuggacaucuggagccacaccaacgacaccaucggcagcgugagaagaugcaucgugaacagaaucaaggccaacguggcccacaagaagaucgagcuguucgugggcggcgagcugaucgacagcgaggacgacagaaagcugaucggccagcugaaccugaaggacaagagccugaucaccgccaagcugacccagaucaacuucaacaugcccagcagccccgacagcagcagcgacagcagcaccgccagccccggcaaccacagaaaccacuacaacgacggccccaaccuggagguggagagcugccugcccggcgugaucaugagcgugcaccccagauacaucagcuuccuguggcagguggccgaccugggcagcaaccugaacaugcccccccugagagacggcgccagagugcugaugaagcugaugccccccgacagaaccgccguggagaagcugagagccgugugccuggaccacgccaagcugggcgagggcaagcugagccccccccuggacagccuguucuucggccccagcgccagccaggugcuguaccugaccgaggugguguacgcccugcugaugcccgccggcgugccccugaccgacggcagcagcgacuuccaggugcacuuccugaagagcggcggccugccccuggugcugagcaugcugaucagaaacaacuuccugcccaacaccgacauggagaccagaagaggcgccuaccugaacgcccugaagaucgccaagcugcugcugaccgccaucggcuacggccacgugagagccguggccgaggccugccagcccgugguggacggcaccgaccccaucacccagaucaaccaggugacccacgaccaggccguggugcugcagagcgcccugcagagcauccccaaccccagcagcgagugcgugcugagaaacgagagcauccugcuggcccaggagaucagcaacgaggccagcagauacaugcccgacaucugcgugaucagagccauccagaagaucaucugggccagcgccugcggcgcccugggccugguguucagccccaacgaggagaucaccaagaucuaccagaugaccaccaacggcagcaacaagcuggagguggaggacgagcaggugugcugcgaggcccuggaggugaugacccugugcuucgcccugcugcccaccgcccuggacgcccugagcaaggagaaggccuggcagaccuucaucaucgaccugcugcugcacugccccagcaagaccgugagacagcuggcccaggagcaguucuuccugaugugcaccagaugcugcaugggccacagaccccugcuguucuucaucacccugcuguucaccauccugggcagcaccgccagagagaagggcaaguacagcggcgacuacuucacccugcugagacaccugcugaacuacgccuacaacggcaacaucaacauccccaacgccgaggugcugcuggugagcgagaucgacuggcugaagagaaucagagacaacgugaagaacaccggcgagaccggcguggaggagcccauccuggagggccaccugggcgugaccaaggagcugcuggccuuccagaccagcgagaagaaguaccacuucggcugcgagaagggcggcgccaaccugaucaaggagcugaucgacgacuucaucuuccccgccagcaagguguaccugcaguaccugagaagcggcgagcugcccgccgagcaggccauccccgugugcagcagccccgugaccaucaacgccggcuucgagcugcugguggcccuggccaucggcugcgugagaaaccugaagcagaucguggacugccugaccgagauguacuacaugggcaccgccaucaccaccugcgaggcccugaccgagugggaguaccugccccccgugggccccagaccccccaagggcuucgugggccugaagaacgccggcgccaccugcuacaugaacagcgugauccagcagcuguacaugauccccagcaucagaaacagcauccuggccaucgagggcaccggcagcgaccugcacgacgacauguucggcgacgagaagcaggacagcgagagcaacguggaccccagagacgacguguucggcuacccccaccaguucgaggacaagcccgcccugagcaagaccgaggacagaaaggaguacaacaucggcgugcugagacaccugcaggugaucuucggccaccuggccgccagccagcugcaguacuacgugcccagaggcuucuggaagcaguucagacuguggggcgagcccgugaaccugagagagcagcacgacgcccuggaguucuucaacagccugguggacagccuggacgaggcccugaaggcccugggccaccccgccauccugagcaaggugcugggcggcagcuucgccgaccagaagaucugccagggcugcccccacagauacgagugcgaggagagcuucaccacccugaacguggacaucagaaaccaccagaaccugcuggacagccuggagcaguacaucaagggcgaccugcuggagggcgccaacgccuaccacugcgagaagugcgacaagaagguggacaccgugaagagacugcugaucaagaagcugcccagagugcuggccauccagcugaagagauucgacuacgacugggagagagagugcgccaucaaguucaacgacuacuucgaguuccccagagagcuggacaugggccccuacaccguggccggcguggccaaccuggagagagacaacgugaacagcgagaacgagcugaucgagcagaaggagcagagcgacaacgagaccgccggcggcaccaaguacagacuggugggcgugcuggugcacagcggccaggccagcggcggccacuacuacagcuacaucauccagagaaacggcaaggacgaccagaccgaccacugguacaaguucgacgacggcgacgugaccgagugcaagauggacgacgacgaggagaugaagaaccagugcuucggcggcgaguacaugggcgagguguucgaccacaugaugaagagaaugagcuacagaagacagaagagaugguggaacgccuacauccuguucuacgagcagauggacaugaucgacgaggacgacgagaugaucagauacaucagcgagcugaccaucgccagaccccaccagaucaucaugagccccgccaucgagagaagcgugagaaagcagaacgugaaguucaugcacaacagacugcaguacagccuggaguacuuccaguucgugaagaagcugcugaccugcaacggcguguaccugaaccccgcccccggccaggacuaccugcugcccgaggccgaggagaucaccaugaucagcauccagcuggccgccagauuccuguucaccaccggcuuccacaccaagaagaucgugagaggccccgccagcgacugguacgacgcccugugcgugcugcugagacacagcaagaacgugagauucugguucacccacaacgugcuguucaacgugagcaacagauucagcgaguaccugcuggagugccccagcgccgaggugagaggcgccuucgccaagcugaucguguucaucgcccacuucagccugcaggacggcagcugccccagccccuucgccagccccggccccagcagccaggccugcgacaaccugagccugagcgaccaccugcugagagccacccugaaccugcugagaagagaggugagcgagcacggccaccaccugcagcaguacuucaaccuguucgugauguacgccaaccugggcguggccgagaagacccagcugcugaagcugaacgugcccgccaccuucaugcuggugagccuggacgagggccccggcccccccaucaaguaccaguacgccgagcugggcaagcuguacagcguggugagccagcugaucagaugcugcaacgugagcagcaccaugcagagcagcaucaacggcaaccccccccugcccaaccccuucggcgaccugaaccugagccagcccaucaugcccauccagcagaacgugcuggacauccuguucgugagaaccagcuacgugaagaagaucaucgaggacugcagcaacagcgaggacaccaucaagcugcugagauucugcagcugggagaacccccaguucagcagcaccgugcugagcgagcugcuguggcagguggccuacagcuacaccuacgagcugagacccuaccuggaccugcuguuccagauccugcugaucgaggacagcuggcagacccacagaauccacaacgcccugaagggcauccccgacgacagagacggccuguucgacaccauccagagaagcaagaaccacuaccagaagagagccuaccagugcaucaagugcaugguggcccuguucagcagcugccccguggccuaccagauccugcagggcaacggcgaccugaagagaaaguggaccugggccguggaguggcugggcgacgagcuggagagaagacccuacaccggcaacccccaguacagcuacaacaacuggagcccccccgugcagagcaacgagaccgccaacggcuacuuccuggagagaagccacagcgccagaaugacccuggccaaggccugcgagcugugccccgaggaggagcccgacgaccaggacgcccccgacgagcacgagcccagccccagcgaggacgccccccuguacccccacagccccgccagccaguaccagcagaacaaccacgugcacggccagcccuacaccggccccgccgcccaccaccugaacaacccccagaagaccggccagagaacccaggagaacuacgagggcaacgaggaggugagcagcccccagaugaaggaccaguaa

SEQ ID NO: 25475 - RNA, 3279 nt, Artificial Sequence
  USPL1__Homo_sapiens__NP_005791
augauggacagccccaagaucggcaacggccugcccgugaucggccccggcaccgacaucggcaucagcagccugcacauggugggcuaccugggcaagaacuucgacagcgccaaggugcccagcgacgaguacugccccgccugcagagagaagggcaagcugaaggcccugaagaccuacagaaucagcuuccaggagagcaucuuccugugcgaggaccugcagugcaucuacccccugggcagcaagagccugaacaaccugaucagccccgaccuggaggagugccacaccccccacaagccccagaagagaaagagccuggagagcagcuacaaggacagccugcugcuggccaacagcaagaagaccagaaacuacaucgccaucgacggcggcaaggugcugaacagcaagcacaacggcgagguguacgacgagaccagcagcaaccugcccgacagcagcggccagcagaaccccaucagaaccgccgacagccuggagagaaacgagauccuggaggccgacaccguggacauggccaccaccaaggaccccgccaccguggacgugagcggcaccggcagacccagcccccagaacgagggcugcaccagcaagcuggagaugccccuggagagcaagugcaccagcuucccccaggcccugugcgugcaguggaagaacgccuacgcccugugcuggcuggacugcauccugagcgcccuggugcacagcgaggagcugaagaacaccgugaccggccugugcagcaaggaggagagcaucuucuggagacugcugaccaaguacaaccaggccaacacccugcuguacaccagccagcugagcggcgugaaggacggcgacugcaagaagcugaccagcgagaucuucgccgagaucgagaccugccugaacgaggugagagacgagaucuucaucagccugcagccccagcugagaugcacccugggcgacauggagagccccguguucgccuucccccugcugcugaagcuggagacccacaucgagaagcuguuccuguacagcuucagcugggacuucgagugcagccagugcggccaccaguaccagaacagacacaugaagagccuggugaccuucaccaacgugauccccgaguggcacccccugaacgccgcccacuucggccccugcaacaacugcaacagcaagagccagaucagaaagauggugcuggagaaggugagccccaucuucaugcugcacuucguggagggccugccccagaacgaccugcagcacuacgccuuccacuucgagggcugccuguaccagaucaccagcgugauccaguacagagccaacaaccacuucaucaccuggauccuggacgccgacggcagcuggcuggagugcgacgaccugaagggccccugcagcgagagacacaagaaguucgaggugcccgccagcgagauccacaucgugaucugggagagaaagaucagccaggugaccgacaaggaggccgccugccugccccugaagaagaccaacgaccagcacgcccugagcaacgagaagcccgugagccugaccagcugcagcgugggcgacgccgccagcgccgagaccgccagcgugacccaccccaaggacaucagcguggcccccagaacccugagccaggacaccgccgugacccacggcgaccaccugcugagcggccccaagggccugguggacaacauccugccccugacccuggaggagaccauccagaagaccgccagcgugagccagcugaacagcgaggccuuccugcuggagaacaagcccguggccgagaacaccggcauccugaagaccaacacccugcugagccaggagagccugauggccagcagcgugagcgcccccugcaacgagaagcugauccaggaccaguucguggacaucagcuuccccagccagguggugaacaccaacaugcagagcgugcagcugaacaccgaggacaccgugaacaccaagagcgugaacaacaccgacgccaccggccugauccagggcgugaagagcguggagaucgagaaggacgcccagcugaagcaguuccugacccccaagaccgagcagcugaagcccgagagagugaccagccaggugagcaaccugaagaagaaggagaccaccgccgacagccagaccaccaccagcaagagccugcagaaccagagccugaaggagaaccagaagaagcccuucgugggcagcugggugaagggccugaucagcagaggcgccagcuucaugccccugugcgugagcgcccacaacagaaacaccaucaccgaccugcagcccagcgugaagggcgugaacaacuucggcggcuucaagaccaagggcaucaaccagaaggccagccacgugagcaagaaggccagaaagagcgccagcaagcccccccccaucagcaagccccccgccggcccccccagcagcaacggcaccgccgcccacccccacgcccacgccgccagcgaggugcuggagaagagcggcagcaccagcugcggcgcccagcugaaccacagcagcuacggcaacggcaucagcagcgccaaccacgaggaccugguggagggccagauccacaagcugagacugaagcugagaaagaagcugaaggccgagaagaagaagcuggccgcccugaugagcagcccccagagcagaaccgugagaagcgagaaccuggagcaggugccccaggacggcagccccaacgacugcgagagcaucgaggaccugcugaacgagcugcccuaccccaucgacaucgccagcgagagcgccugcaccaccgugcccggcgugagccuguacagcagccagacccacgaggagauccuggccgagcugcugagccccacccccgugagcaccgagcugagcgagaacggcgagggcgacuucagauaccugggcaugggcgacagccacauccccccccccgugcccagcgaguucaacgacgugagccagaacacccaccugagacaggaccacaacuacugcagccccaccaagaagaaccccugcgaggugcagcccgacagccugaccaacaacgccugcgugagaacccugaaccuggagagccccaugaagaccgacaucuucgacgaguucuucagcagcagcgcccugaacgcccuggccaacgacacccuggaccugccccacuucgacgaguaccuguucgagaacuacuaa

SEQ ID NO: 25476 - RNA, 1221 nt, Artificial Sequence
  UST__Homo_sapiens__NP_005706
augaagaagaagcagcagcaccccggcggcggcgccgaccccuggccccacggcgcccccaugggcggcgccccccccggccugggcagcuggaagagaagagugccccugcugcccuuccugagauucagccugagagacuacggcuucugcauggccacccugcugguguucugccugggcagccugcuguaccagcugagcggcggcccccccagauuccugcuggaccugagacaguaccugggcaacagcaccuaccuggacgaccacggccccccccccagcaaggugcugcccuuccccagccaggugguguacaacagagugggcaagugcggcagcagaaccguggugcugcugcugagaauccugagcgagaagcacggcuucaaccuggugaccagcgacauccacaacaagaccagacugaccaagaacgagcagauggagcugaucaagaacaucagcaccgccgagcagcccuaccuguucaccagacacgugcacuuccugaacuucagcagauucggcggcgaccagcccguguacaucaacaucaucagagaccccgugaacagauuccugagcaacuacuucuucagaagauucggcgacuggagaggcgagcagaaccacaugaucagaacccccagcaugagacaggaggagagauaccuggacaucaacgagugcauccuggagaacuaccccgagugcagcaaccccagacuguucuacaucauccccuacuucugcggccagcaccccagaugcagagagcccggcgagugggcccuggagagagccaagcugaacgugaacgagaacuuccugcuggugggcauccuggaggagcuggaggacgugcugcugcugcuggagagauuccugccccacuacuucaagggcgugcugagcaucuacaaggaccccgagcacagaaagcugggcaacaugaccgugaccgugaagaagaccgugcccagccccgaggccgugcagauccuguaccagagaaugagauacgaguacgaguucuaccacuacgugaaggagcaguuccaccugcugaagagaaaguucggccugaagagccacgugagcaagcccccccugagaccccacuucuucauccccaccccccuggagaccgaggagcccaucgacgacgaggagcaggacgacgagaaguggcuggaggacaucuacaagagauaa

SEQ ID NO: 25477 - RNA, 1026 nt, Artificial Sequence
  UTF1__Homo_sapiens__NP_003568
augcugcugagacccagaagaccccccccccuggccccccccgccccccccagccccgccagccccgaccccgagcccagaacccccggcgacgcccccggcaccccccccagaagacccgccagccccagcgcccugggcgagcugggccugcccgugagccccggcagcgcccagagaacccccuggagcgccagagagaccgagcugcugcugggcacccugcugcagcccgccguguggagagcccugcugcuggacagaagacaggcccugcccaccuacagaagagugagcgccgcccuggcccagcagcaggugagaagaacccccgcccagugcagaagaagauacaaguuccugaaggacaaguucagagaggcccacggccagccccccggccccuucgacgagcagaucagaaagcugaugggccugcugggcgacaacggcagaaagagacccagaagaagaagccccggcagcggcagaccccagagagccagaagacccgugcccaacgcccacgcccccgcccccagcgagcccgacgccaccccccugcccaccgccagagacagagacgccgaccccaccuggacccugagauucagccccagcccccccaagagcgccgacgccagccccgcccccggcagcccccccgcccccgcccccaccgcccuggccaccugcauccccgaggacagagcccccgugagaggccccggcagccccccccccccccccgccagagaggaccccgacagcccccccggcagacccgaggacugcgcccccccccccgccgccccccccagccugaacaccgcccugcugcagacccugggccaccugggcgacaucgccaacauccugggcccccugagagaccagcugcugacccugaaccagcacguggagcagcugagaggcgccuucgaccagaccgugagccuggccgugggcuucauccugggcagcgccgccgccgagagaggcgugcugagagaccccugccaguaa

SEQ ID NO: 25478 - RNA, 2160 nt, Artificial Sequence
  UTP14A__Homo_sapiens__NP_001159693
augaccgccaacagacuggccgagagccugcuggcccugagccagcaggaggagcuggccgaccugcccaaggacuaccugcugagcgagagcgaggacgagggcgacaacgacggcgagagaaagcaccagaagcugcuggaggccaucagcagccuggacggcaagaacagaagaaagcuggccgagagaagcgaggccagccugaaggugagcgaguucaacgugagcagcgagggcagcggcgagaagcuggugcuggccgaccugcuggagcccgugaagaccagcagcagccuggccaccgugaagaagcagcugagcagagugaagagcaagaagaccguggagcugccccugaacaaggaggagaucgagagagccagaaccccccuggagcaggagaucuucaaccugcugcacaagaacaagcagcccgugaccgacccccugcugacccccguggagaaggccagccugagagccaugagccuggaggaggccaagaugagaagagccgagcugcagagagccagagcccugcagagcuacuacgaggccaaggccagaagagagaagaagaucaagagcaagaaguaccacaagguggugaagaagggcaaggccaagaaggcccugaaggaguucgagcagcugagaaaggugaaccccgccgccgcccuggaggagcuggagaagaucgagaaggccagaaugauggagagaaugagccugaagcaccagaacagcggcaagugggccaagagcaaggccaucauggccaaguacgaccuggaggccagacaggccaugcaggagcagcugagcaagaacaaggagcugacccagaagcugcagguggccagcgagagcgaggaggaggagggcggcaccgaggacguggaggagcugcuggugcccgacguggugaacgaggugcagaugaacgccgacggccccaaccccuggaugcugagaagcugcaccagcgacaccaaggaggccgccacccaggaggaccccgagcagcugcccgagcuggaggcccacggcgugagcgagagcgagggcgaggagagacccguggccgaggaggagauccugcugagagaguucgaggagagaagaagccugagaaagagaagcgagcugagccaggacgccgagcccgccggcagccaggagaccaaggacagcggcagccaggaggugcugagcgagcugagagugcugagccagaagcugaaggagaaccaccagagcagaaagcagaaggccagcagcgagggcaccaucccccaggugcagagagaggagcccgcccccgaggaggaggagccccugcugcugcagagacccgagagagugcagacccuggaggagcuggaggagcugggcaaggaggagugcuuccagaacaaggagcugcccagacccgugcuggagggccagcagagcgagagaacccccaacaacagacccgacgcccccaaggagaagaagaagaaggagcagaugaucgaccugcagaaccugcugaccacccagagccccagcgugaagagccuggccgugcccaccaucgaggagcuggaggacgaggaggagagaaaccacagacagaugaucaaggaggccuucgccggcgacgacgugaucagagacuuccugaaggagaagagagaggccguggaggccagcaagcccaaggacguggaccugacccugcccggcuggggcgaguggggcggcgugggccugaagcccagcgccaagaagagaagaagauuccugaucaaggcccccgagggcccccccagaaaggacaagaaccugcccaacgugaucaucaacgagaagagaaacauccacgccgccgcccaccaggugagagugcugcccuaccccuucacccaccacuggcaguucgagagaaccauccagacccccaucggcagcaccuggaacacccagagagccuuccagaagcugaccacccccaagguggugaccaagcccggccacaucaucaaccccaucaaggccgaggacgugggcuacagaagcagcagcagaagcgaccugagcgugauccagagaaaccccaagagaaucaccaccagacacaagaagcagcugaagaagugcagcguggacuaa

SEQ ID NO: 25479 - RNA, 2301 nt, Artificial Sequence
  UTP14C__Homo_sapiens__NP_067677
augaacgugaaccagguggccgagaaccuggcccugagccaccaggaggagcugguggaccugcccaagaacuacccccugagcgagaacgaggacgagggcgacagcgacggcgagagaaagcaccagaagcugcuggaggccaucaucagccuggacggcaagaacagaagaaagcuggccgagagaagcgaggccagccugaaggugagcgaguucagcgugagcagcgagggcagcggcgagaagcugggccuggccgaccugcuggagcccgugaagaccagcagcagccuggccaccgugaagaagcagcugaacagagugaagagcaagaaggugguggagcugccccugaacaaggagaagaucgagcagauccacagagagguggccuucagcaagaccagccaggugcugagcaagugggaccccaucauccugaagaaccagcaggccgagcagcugguguucccccugggcaaggagcagcccgccaucgcccccaucgagcacgcccugagcggcuggaaggccagaaccccccuggagcaggagaucuucaaccugcugcacaagaacaagcagcccgugaccgacccccugcugacccccauggagaaggccagccugcaggccaugagccuggaggaggccaagaugcacagagccgagcugcagagagccagagcccugcagagcuacuacgaggccaaggccagaaaggagaagaagaucaagagcaagaaguaccacaagguggugaagaagggcaaggccaagaaggcccugaaggaguucgagcagcugcagaaggugaaccccaccguggcccuggaggagauggagaagaucgagaacgccagaaugauggagagaaugagccugaagcaccagaacagcggcaagugggccaagagcaaggccaucauggccaaguacgaccuggaggccagacaggccaugcaggagcagcuggccaagaacaaggagcugacccagaagcugcagguggccagcgagagcgaggaggaggagggcggcaccgagguggaggagcugcuggugccccacguggccaacgaggugcagaugaacguggacggccccaaccccuggauguucagaagcugcaccagcgacaccaaggaggccgccacccaggaggaccccgagcaggugcccgagcuggccgcccacgaggugagcgccagcgaggccgaggagagacccguggccgaggaggagauccugcugagagaguucgaggagagacagagccugagaaagagaagcgagcugaaccaggacgccgagcccgccagcagccaggagaccaaggacagcagcagccaggaggugcugagcgagcugagagcccugagccagaagcugaaggagaagcaccagagcagaaagcagaaggccagcagcgagggcaccgugccccaggugcagagagaggagcccgcccccgaggaggccgagccccugcugcugcagagaagcgagagagugcagacccuggaggagcuggaggagcugggcaaggaggacugcuuccagaacaaggagcugcccagacccgugcuggagggccagcagagcgagagaacccccaacaacagacccgacgcccccaaggagaagaaggagaaggagcagcugaucaaccugcagaacuuccugaccacccagagccccagcgugagaagccuggccgugcccaccaucaucgaggagcuggaggacgaggaggagagagaccagagacagaugaucaaggaggccuucgccggcgacgacgugaucagagacuuccugaaggagaagagagaggccguggaggccagcaagcccaaggacguggaccugacccugcccggcuggggcgaguggggcggcgugggccugaagcccagcgccaagaagagaagacaguuccugaucaaggcccccgagggcccccccagaaaggacaagaaccugcccaacgugaucaucagcgagaagagaaacauccacgccgccgcccaccaggugcaggugcugcccuaccccuucacccaccacagacaguucgagagaaccauccagacccccaucggcagcaccuggaacacccagagagccuuccagaagcugaccacccccaagguggugaccaagcccggccacaucaucaagcccaucaaggccgaggacgugggcuaccagagcagcagcagaagcgaccugcccgugauccagagaaaccccaagagaaucaccaccagacacaacaaggaggagaagcuguaa

SEQ ID NO: 25480 - RNA, 8358 nt, Artificial Sequence
  UTP20__Homo_sapiens__NP_055318
augaagaccaagcccgugagccacaagaccgagaacaccuacagauuccugaccuucgccgagagacugggcaacgugaacaucgacaucauccacagaaucgacagaaccgccagcuacgaggaggagguggagaccuacuucuucgagggccugcugaaguggagagagcugaaccugaccgagcacuucggcaaguucuacaaggaggugaucgacaagugccagagcuucaaccagcugguguaccaccagaacgagaucgugcagagccugaagacccaccugcaggugaagaacagcuucgccuaccagccccugcuggaccugguggugcagcuggccagagaccugcagauggacuucuacccccacuuccccgaguucuuccugaccaucaccagcauccuggagacccaggacaccgagcugcuggagugggccuucaccagccugagcuaccuguacaaguaccuguggagacugauggugaaggacaugagcagcaucuacagcauguacagcacccugcuggcccacaagaagcugcacaucagaaacuucgccgccgagagcuucaccuuccugaugagaaaggugagcgacaagaacgcccuguucaaccugauguuccuggaccuggacaagcaccccgagaagguggagggcgugggccagcugcuguucgagaugugcaagggcgugagaaacauguuccacagcugcaccggccaggccgugaagcugauccugagaaagcugggccccgugaccgagaccgagacccagcugcccuggaugcugaucggcgagacccugaagaacauggugaagagcaccgugagcuacaucagcaaggagcacuucggcaccuucuucgagugccugcaggagagccugcuggaccugcacaccaaggugaccaagaccaacugcugcgagagcagcgagcagaucaagagacugcuggagaccuaccugauccuggugaagcacggcagcggcaccaagauccccacccccgccgacgugugcaaggugcugagccagacccugcagguggccagccugagcaccagcugcugggagacccugcuggacgugaucagcgcccugauccugggcgagaacgugagccugcccgagacccugaucaaggagaccaucgagaagaucuucgagagcagauucgagaagagacugaucuucagcuucagcgaggugauguucgccaugaagcaguucgagcagcuguuccugcccagcuuccugagcuacaucgugaacugcuuccugaucgacgacgccguggugaaggacgaggcccuggccauccuggccaagcugauccugaacaaggccgccccccccaccgccggcagcauggccaucgagaaguacccccugguguucagcccccagauggugggcuucuacaucaagcagaagaagaccagaagcaagggcagaaacgagcaguuccccgugcuggaccaccugcugagcaucaucaagcugccccccaacaaggacaccaccuaccugagccagagcugggccgcccugguggugcugccccacaucagaccccuggagaaggagaaggugaucccccuggugaccggcuucaucgaggcccuguucaugaccguggacaagggcagcuucggcaagggcaaccuguucgugcugugccaggccgugaacacccugcugagccuggaggagagcagcgagcugcugcaccuggugcccguggagagagugaagaaccuggugcugaccuucccccuggagcccagcgugcugcugcugaccgaccuguacuaccagagacuggcccugugcggcugcaagggcccccugagccaggaggcccugauggagcuguuccccaagcugcaggccaacaucagcaccggcgugagcaagaucagacugcugaccaucagaauccugaaccacuucgacgugcagcugcccgagagcauggaggacgacggccugagcgagagacagagcguguucgccauccugagacaggccgagcuggugcccgccaccgugaacgacuacagagagaagcugcugcaccugagaaagcugagacacgacguggugcagaccgccgugcccgacggcccccugcaggaggugccccugagauaccugcugggcaugcuguacaucaacuucagcgcccugugggaccccgugaucgagcugaucagcagccacgcccacgagauggagaacaagcaguucuggaagguguacuacgagcaccuggagaaggccgccacccacgccgagaaggagcugcagaacgacaugaccgacgagaagagcgugggcgacgagagcugggagcagacccaggagggcgacgugggcgcccuguaccacgagcagcuggcccugaagaccgacugccaggagagacuggaccacaccaacuucagauuccugcuguggagagcccugaccaaguuccccgagagaguggagcccagaagcagagagcugagcccccuguuccugagauucaucaacaacgaguacuaccccgccgaccugcagguggcccccacccaggaccugagaagaaagggcaagggcaugguggccgaggagaucgaggaggagcccgccgccggcgacgacgaggagcuggaggaggaggccgugccccaggacgagagcagccagaagaagaagaccagaagagccgccgccaagcagcugaucgcccaccugcagguguucagcaaguucagcaaccccagagcccuguaccuggagagcaagcuguacgagcuguaccugcagcugcugcugcaccaggaccagauggugcagaagaucacccuggacugcaucaugaccuacaagcacccccacgugcugcccuacagagagaaccugcagagacugcuggaggacagaagcuucaaggaggagaucgugcacuucagcaucagcgaggacaacgccguggugaagaccgcccacagagccgaccuguuccccauccugaugagaauccuguacggcagaaugaagaacaagaccggcagcaagacccagggcaagagcgccagcggcaccagaauggccaucgugcugagauuccuggccggcacccagcccgaggagauccagaucuuccuggaccugcuguucgagcccgugagacacuucaagaacggcgagugccacagcgccgugauccaggccguggaggaccuggaccugagcaaggugcugccccugggcagacagcacggcauccugaacagccuggagaucgugcugaagaacaucagccaccugaucagcgccuaccugcccaagauccugcagauccugcugugcaugaccgccaccgugagccacauccuggaccagagagagaagauccagcugagauucaucaacccccugaagaaccugagaagacugggcaucaagauggugaccgacaucuuccuggacugggagagcuaccaguucagaaccgaggagaucgacgccguguuccacggcgccguguggccccagaucagcagacugggcagcgagagccaguacagccccaccccccugcugaagcugaucagcaucuggagcagaaacgccagauacuucccccugcuggccaagcagaagcccggccaccccgagugcgacauccugaccaacguguucgccauccugagcgccaagaaccugagcgacgccaccgccagcaucgugauggacaucguggacgaccugcugaaccugcccgacuucgagcccaccgagaccgugcugaaccugcuggugaccggcugcguguaccccggcaucgccgagaacaucggcgagagcaucaccaucggcggcagacugauccugccccacgugcccgccauccugcaguaccugagcaagaccaccaucagcgccgagaaggugaagaagaagaagaacagagcccaggugagcaaggagcugggcauccugagcaagaucagcaaguucaugaaggacaaggagcagagcagcgugcugaucacccugcugcugcccuuccugcacagaggcaacaucgccgaggacaccgagguggacauccuggugaccgugcagaaccugcugaagcacugcguggaccccaccagcuuccugaagcccaucgccaagcuguucagcgugaucaagaacaagcugagcagaaagcugcugugcaccguguucgagacccugagcgacuucgagagcggccugaaguacaucaccgacguggugaagcugaacgccuucgaccagagacaccuggacgacaucaacuucgacgugagauucgagaccuuccagaccaucaccagcuacaucaaggagaugcagaucguggacgugaacuaccugauccccgugaugcacaacugcuucuacaaccuggagcugggcgacaugagccugagcgacaacgccagcaugugccugaugagcaucaucaagaagcuggccgcccugaacgugaccgagaaggacuacagagagaucauccacagaagccugcuggagaagcugagaaagggccugaagagccagaccgagagcauccagcaggacuacaccaccauccugagcugccugauccagaccuuccccaaccagcuggaguucaaggaccuggugcagcugacccacuaccacgaccccgagauggacuucuucgagaacaugaagcacauccagauccacagaagagccagagcccugaagaagcuggccaagcagcugauggagggcaagguggugcugagcagcaagagccugcagaacuacaucaugcccuacgccaugacccccaucuucgacgagaagaugcugaagcacgagaacaucaccaccgccgccaccgagaucaucggcgccaucugcaagcaccugagcuggagcgccuacauguacuaccugaagcacuucauccacgugcugcagaccggccagaucaaccagaagcugggcgugagccugcuggugaucgugcuggaggccuuccacuucgaccacaagacccuggaggagcagaugggcaagaucgagaacgaggagaacgccaucgaggccaucgagcugcccgagcccgaggccauggagcuggagagaguggacgaggaggagaaggaguacaccugcaagagccugagcgacaacggccagcccggcacccccgaccccgccgacagcggcggcaccagcgccaaggagagcgagugcaucaccaagcccgugagcuuccugccccagaacaaggaggagaucgagagaaccaucaagaacauccagggcaccaucaccggcgacauccugcccagacugcacaagugccuggccagcaccaccaagagagaggaggagcacaagcuggugaagagcaagguggugaacgacgaggagguggugagagugccccuggccuucgccauggugaagcugaugcagagccugccccaggaggugauggaggccaaccugcccagcauccugcugaaggugugcgcccugcugaagaacagagcccaggagaucagagacaucgccagaagcacccuggccaagaucaucgaggaccugggcgugcacuuccugcuguacgugcugaaggagcugcagaccacccuggugagaggcuaccaggugcacgugcugaccuucaccgugcacaugcugcugcagggccugaccaacaagcugcaggugggcgaccuggacagcugccuggacaucaugaucgagaucuucaaccacgagcuguucggcgccguggccgaggagaaggaggugaagcagauccugagcaaggugauggaggccagaagaagcaagagcuacgacagcuacgagauccugggcaaguucgugggcaaggaccaggugaccaagcugauccugccccugaaggagauccugcagaacaccaccagccugaagcuggccagaaaggugcacgagacccugagaagaaucaccgugggccugaucgugaaccaggagaugaccgccgagagcauccugcugcugagcuacggccugaucagcgagaaccugccccugcugaccgagaaggagaagaaccccguggcccccgcccccgaccccagacugcccccccagagcugccugcugcugccccccacccccgugagaggcggccagaaggccguggugagcagaaagaccaacaugcacaucuucaucgagagcggccugagacugcugcaccugagccugaagaccagcaagaucaagagcagcggcgagugcgugcuggagaugcuggaccccuucgugagccugcugaucgacugccugggcagcauggacgugaaggugaucaccggcgcccugcagugccugaucugggugcugagauucccccugcccagcaucgagaccaaggccgagcagcugaccaagcaccuguuccugcugcugaaggacuacgccaagcugggcgccgccagaggccagaacuuccaccugguggugaacugcuucaagugcgugaccauccuggugaagaaggugaagagcuaccagaucaccgagaagcagcugcaggugcugcuggccuacgccgaggaggacaucuacgacaccagcagacaggccaccgccuucggccugcugaaggccauccugagcagaaagcugcuggugcccgagaucgacgaggugaugagaaaggugagcaagcuggccgugagcgcccagagcgagcccgccagagugcagugcagacagguguuccugaaguacauccuggacuacccccugggcgacaagcugagacccaaccuggaguucaugcuggcccagcugaacuacgagcacgagaccggcagagagagcacccuggagaugaucgccuaccuguucgacaccuucccccagggccugcugcacgagaacugcggcauguucuucaucccccugugccugaugaccaucaacgacgacagcgccaccugcaagaagauggccagcaugaccaucaagagccugcugggcaagaucagccuggagaagaaggacuggcuguucgacauggugaccaccugguucggcgccaagaagagacugaacagacagcuggccgcccugaucugcggccuguucguggagagcgagggcguggacuucgagaagagacugggcaccgugcugcccgugaucgagaaggagaucgaccccgagaacuucaaggacaucauggaggagaccgaggagaaggccgccgacagacugcuguucagcuuccugacccugaucaccaagcugaucaaggagugcaacaucauccaguucaccaagcccgccgagacccugagcaagaucuggagccacgugcacagccaccugagacacccccacaacuggguguggcugaccgccgcccagaucuucggccugcuguucgccagcugccagcccgaggagcugauccagaaguggaacaccaagaagaccaagaagcaccugcccgagcccguggccaucaaguuccuggccagcgaccuggaccagaagaugaagagcaucagccuggccagcugccaccagcugcacagcaaguuccuggaccagagccugggcgagcagguggugaagaaccugcuguucgccgccaaggugcuguaccugcuggagcuguacugcgaggacaagcagagcaagaucaaggaggaccuggaggagcaggaggcccuggaggacggcguggccugcgccgacgagaaggccgagagcgacggcgaggagaaggaggaggugaaggaggagcugggcagacccgccacccugcuguggcugauccagaagcugagcagaaucgccaagcuggaggccgccuacagccccagaaacccccugaagagaaccugcaucuucaaguuccugggcgccguggccauggaccugggcaucgacaaggugaagcccuaccugcccaugaucaucgccccccuguucagagagcugaacagcaccuacagcgagcaggacccccugcugaagaaccugagccaggagaucaucgagcugcugaagaagcuggugggccuggagagcuucagccuggccuucgccagcgugcagaagcaggccaacgagaagagagcccugagaaagaagagaaaggcccuggaguucgugaccaaccccgacaucgccgccaagaagaagaugaagaagcacaagaacaagagcgaggccaagaagagaaagaucgaguuccugagacccggcuacaaggccaagagacagaagagccacagccugaaggaccuggccaugguggaguaa

SEQ ID NO: 25481 - RNA, 10302 nt, Artificial Sequence
  UTRN__Homo_sapiens__NP_009055
auggccaaguacggcgagcacgaggccagccccgacaacggccagaacgaguucagcgacaucaucaagagcagaagcgacgagcacaacgacgugcagaagaagaccuucaccaaguggaucaacgccagauucagcaagagcggcaagccccccaucaacgacauguucaccgaccugaaggacggcagaaagcugcuggaccugcuggagggccugaccggcaccagccugcccaaggagagaggcagcaccagagugcacgcccugaacaacgugaacagagugcugcaggugcugcaccagaacaacguggagcuggugaacaucggcggcaccgacaucguggacggcaaccacaagcugacccugggccugcuguggagcaucauccugcacuggcaggugaaggacgugaugaaggacgugaugagcgaccugcagcagaccaacagcgagaagauccugcugagcugggugagacagaccaccagacccuacagccaggugaacgugcugaacuucaccaccagcuggaccgacggccuggccuucaacgccgugcugcacagacacaagcccgaccuguucagcugggacaagguggugaagaugagccccaucgagagacuggagcacgccuucagcaaggcccagaccuaccugggcaucgagaagcugcuggaccccgaggacguggccgugcagcugcccgacaagaagagcaucaucauguaccugaccagccuguucgaggugcugccccagcaggugaccaucgacgccaucagagagguggagacccugcccagaaaguacaagaaggagugcgaggaggaggccaucaacauccagagcaccgcccccgaggaggagcacgagagccccagagccgagacccccagcaccgugaccgagguggacauggaccuggacagcuaccagaucgcccuggaggaggugcugaccuggcugcugagcgccgaggacaccuuccaggagcaggacgacaucagcgacgacguggaggaggugaaggaccaguucgccacccacgaggccuucaugauggagcugaccgcccaccagagcagcgugggcagcgugcugcaggccggcaaccagcugaucacccagggcacccugagcgacgaggaggaguucgagauccaggagcagaugacccugcugaacgccagaugggaggcccugagaguggagagcauggacagacagagcagacugcacgacgugcugauggagcugcagaagaagcagcugcagcagcugagcgccuggcugacccugaccgaggagagaauccagaagauggagaccugcccccuggacgacgacgugaagagccugcagaagcugcuggaggagcacaagagccugcagagcgaccuggaggccgagcaggugaaggugaacagccugacccacaugguggugaucguggacgagaacagcggcgagagcgccaccgccauccuggaggaccagcugcagaagcugggcgagagauggaccgccgugugcagauggaccgaggagagauggaacagacugcaggagaucaacauccuguggcaggagcugcuggaggagcagugccugcugaaggccuggcugaccgagaaggaggaggcccugaacaaggugcagaccagcaacuucaaggaccagaaggagcugagcgugagcgugagaagacuggccauccugaaggaggacauggagaugaagagacagacccuggaccagcugagcgagaucggccaggacgugggccagcugcuggacaacagcaaggccagcaagaagaucaacagcgacagcgaggagcugacccagagaugggacagccuggugcagagacuggaggacagcagcaaccaggugacccaggccguggccaagcugggcaugagccagaucccccagaaggaccugcuggagaccgugagagugagagagcaggccaucaccaagaagagcaagcaggagcugccccccccccccccccccaagaagagacagauccacguggacaucgaggccaagaagaaguucgacgccaucagcgccgagcugcugaacuggauccugaaguggaagaccgccauccagaccaccgagaucaaggaguacaugaagaugcaggacaccagcgagaugaagaagaagcugaaggcccuggagaaggagcagagagagagaauccccagagccgacgagcugaaccagaccggccagauccugguggagcagaugggcaaggagggccugcccaccgaggagaucaagaacgugcuggagaaggugagcagcgaguggaagaacgugagccagcaccuggaggaccuggagagaaagauccagcugcaggaggacaucaacgccuacuucaagcagcuggacgagcuggagaaggugaucaagaccaaggaggagugggugaagcacaccagcaucagcgagagcagcagacagagccugcccagccugaaggacagcugccagagagagcugaccaaccugcugggccugcaccccaagaucgagauggccagagccagcugcagcgcccugaugagccagcccagcgcccccgacuucgugcagagaggcuucgacagcuuccugggcagauaccaggccgugcaggaggccguggaggacagacagcagcaccuggagaacgagcugaagggccagcccggccacgccuaccuggagacccugaagacccugaaggacgugcugaacgacagcgagaacaaggcccaggugagccugaacgugcugaacgaccuggccaagguggagaaggcccugcaggagaagaagacccuggacgagauccuggagaaccagaagcccgcccugcacaagcuggccgaggagaccaaggcccuggagaagaacgugcaccccgacguggagaagcuguacaagcaggaguucgacgacgugcagggcaaguggaacaagcugaaggugcuggugagcaaggaccugcaccugcuggaggagaucgcccugacccugagagccuucgaggccgacagcaccgugaucgagaaguggauggacggcgugaaggacuuccugaugaagcagcaggccgcccagggcgacgacgccggccugcagagacagcuggaccagugcagcgccuucgugaacgagaucgagaccaucgagagcagccugaagaacaugaaggagaucgagaccaaccugagaagcggccccguggccggcaucaagaccugggugcagaccagacugggcgacuaccagacccagcuggagaagcugagcaaggagaucgccacccagaagagcagacugagcgagagccaggagaaggccgccaaccugaagaaggaccuggccgagaugcaggaguggaugacccaggccgaggaggaguaccuggagagagacuucgaguacaagagccccgaggagcuggagagcgccguggaggagaugaagagagccaaggaggacgugcugcagaaggaggugagagugaagauccugaaggacaacaucaagcugcuggccgccaaggugcccagcggcggccaggagcugaccagcgagcugaacguggugcuggagaacuaccagcugcugugcaacagaaucagaggcaagugccacacccuggaggagguguggagcugcuggaucgagcugcugcacuaccuggaccuggagaccaccuggcugaacacccuggaggagagaaugaagagcaccgaggugcugcccgagaagaccgacgccgugaacgaggcccuggagagccuggagagcgugcugagacaccccgccgacaacagaacccagaucagagagcugggccagacccugaucgacggcggcauccuggacgacaucaucagcgagaagcuggaggccuucaacagcagauacgaggaccugagccaccuggccgagagcaagcagaucagccuggagaagcagcugcaggugcugagagagaccgaccagaugcugcaggugcugcaggagagccugggcgagcuggacaagcagcugaccaccuaccugaccgacagaaucgacgccuuccaggugccccaggaggcccagaagauccaggccgagaucagcgcccacgagcugacccuggaggagcugagaagaaacaugagaagccagccccugaccagccccgagagcagaaccgccagaggcggcagccagauggacgugcugcagagaaagcugagagaggugagcaccaaguuccagcuguuccagaagcccgccaacuucgagcagagaaugcuggacugcaagagagugcuggacggcgugaaggccgagcugcacgugcuggacgugaaggacguggaccccgacgugauccagacccaccuggacaagugcaugaagcuguacaagacccugagcgaggugaagcuggagguggagaccgugaucaagaccggcagacacaucgugcagaagcagcagaccgacaaccccaagggcauggacgagcagcugaccagccugaaggugcuguacaacgaccugggcgcccaggugaccgagggcaagcaggaccuggagagagccagccagcuggccagaaagaugaagaaggaggccgccagccugagcgaguggcugagcgccaccgagaccgagcuggugcagaagagcaccagcgagggccugcugggcgaccuggacaccgagaucagcugggccaagaacgugcugaaggaccuggagaagagaaaggccgaccugaacaccaucaccgagagcagcgccgcccugcagaaccugaucgagggcagcgagcccauccuggaggagagacugugcgugcugaacgccggcuggagcagagugagaaccuggaccgaggacuggugcaacacccugaugaaccaccagaaccagcuggagaucuucgacggcaacguggcccacaucagcaccuggcuguaccaggccgaggcccugcuggacgagaucgagaagaagcccaccagcaagcaggaggagaucgugaagagacuggugagcgagcuggacgacgccaaccugcagguggagaacgugagagaccaggcccugauccugaugaacgccagaggcagcagcagcagagagcugguggagcccaagcuggccgagcugaacagaaacuucgagaaggugagccagcacaucaagagcgccaagcugcugaucgcccaggagccccuguaccagugccuggugaccaccgagaccuucgagaccggcgugcccuucagcgaccuggagaagcuggagaacgacaucgagaacaugcugaaguucguggagaagcaccuggagagcagcgacgaggacgagaagauggacgaggagagcgcccagaucgaggaggugcugcagagaggcgaggagaugcugcaccagcccauggaggacaacaagaaggagaagaucagacugcagcugcugcugcugcacaccagauacaacaagaucaaggccauccccauccagcagagaaagaugggccagcuggccagcggcaucagaagcagccugcugcccaccgacuaccugguggagaucaacaagauccugcugugcauggacgacguggagcugagccugaacgugcccgagcugaacaccgccaucuacgaggacuucagcuuccaggaggacagccugaagaacaucaaggaccagcuggacaagcugggcgagcagaucgccgugauccacgagaagcagcccgacgugauccuggaggccagcggccccgaggccauccagaucagagacacccugacccagcugaacgccaagugggacagaaucaacagaauguacagcgacagaaagggcugcuucgacagagccauggaggaguggagacaguuccacugcgaccugaacgaccugacccaguggaucaccgaggccgaggagcugcugguggacaccugcgcccccggcggcagccuggaccuggagaaggccagaauccaccagcaggagcuggaggugggcaucagcagccaccagcccagcuucgccgcccugaacagaaccggcgacggcaucgugcagaagcugagccaggccgacggcagcuuccugaaggagaagcuggccggccugaaccagagaugggacgccaucguggccgaggugaaggacagacagcccagacugaagggcgagagcaagcaggugaugaaguacagacaccagcuggacgagaucaucugcuggcugaccaaggccgagcacgccaugcagaagagaagcaccaccgagcugggcgagaaccugcaggagcugagagaccugacccaggagauggaggugcacgccgagaagcugaaguggcugaacagaaccgagcuggagaugcugagcgacaagagccugagccugcccgagagagacaagaucagcgagagccugagaaccgugaacaugaccuggaacaagaucugcagagaggugcccaccacccugaaggagugcauccaggagcccagcagcgugagccagaccagaaucgccgcccaccccaacgugcagaagguggugcuggugagcagcgccagcgacauccccgugcagagccacagaaccagcgagaucagcauccccgccgaccuggacaagaccaucaccgagcuggccgacuggcuggugcugaucgaccagaugcugaagagcaacaucgugaccgugggcgacguggaggagaucaacaagaccgugagcagaaugaagaucaccaaggccgaccuggagcagagacacccccagcuggacuacguguucacccuggcccagaaccugaagaacaaggccagcagcagcgacaugagaaccgccaucaccgagaagcuggagagagugaagaaccagugggacggcacccagcacggcguggagcugagacagcagcagcuggaggacaugaucaucgacagccugcagugggacgaccacagagaggagaccgaggagcugaugagaaaguacgaggccagacuguacauccugcagcaggccagaagagacccccugaccaagcagaucagcgacaaccagauccugcugcaggagcugggccccggcgacggcaucgugauggccuucgacaacgugcugcagaagcugcuggaggaguacggcagcgacgacaccagaaacgugaaggagaccaccgaguaccugaagaccagcuggaucaaccugaagcagagcaucgccgacagacagaacgcccuggaggccgaguggagaaccgugcaggccagcagaagagaccuggagaacuuccugaaguggauccaggaggccgagaccaccgugaacgugcugguggacgccagccacagagagaacgcccugcaggacagcauccuggccagagagcugaagcagcagaugcaggacauccaggccgagaucgacgcccacaacgacaucuucaagagcaucgacggcaacagacagaagauggugaaggcccugggcaacagcgaggaggccaccaugcugcagcacagacuggacgacaugaaccagagauggaacgaccugaaggccaagagcgccagcaucagagcccaccuggaggccagcgccgagaaguggaacagacugcugaugagccuggaggagcugaucaaguggcugaacaugaaggacgaggagcugaagaagcagaugcccaucggcggcgacgugcccgcccugcagcugcaguacgaccacugcaaggcccugagaagagagcugaaggagaaggaguacagcgugcugaacgccguggaccaggccagaguguuccuggccgaccagcccaucgaggcccccgaggagcccagaagaaaccugcagagcaagaccgagcugacccccgaggagagagcccagaagaucgccaaggccaugagaaagcagagcagcgaggugaaggagaagugggagagccugaacgccgugaccagcaacuggcagaagcagguggacaaggcccuggagaagcugagagaccugcagggcgccauggacgaccuggacgccgacaugaaggaggccgagagcgugagaaacggcuggaagcccgugggcgaccugcugaucgacagccugcaggaccacaucgagaagaucauggccuucagagaggagaucgcccccaucaacuucaaggugaagaccgugaacgaccugagcagccagcugagcccccuggaccugcaccccagccugaagaugagcagacagcuggacgaccugaacaugagauggaagcugcugcaggugagcguggacgacagacugaagcagcugcaggaggcccacagagacuucggccccagcagccagcacuuccugagcaccagcgugcagcugcccuggcagagaagcaucagccacaacaaggugcccuacuacaucaaccaccagacccagaccaccugcugggaccaccccaagaugaccgagcuguuccagagccuggccgaccugaacaacgugagauucagcgccuacagaaccgccaucaagaucagaagacugcagaaggcccugugccuggaccugcuggagcugagcaccaccaacgagaucuucaagcagcacaagcugaaccagaacgaccagcugcugagcgugcccgacgugaucaacugccugaccaccaccuacgacggccuggagcagaugcacaaggaccuggugaacgugccccugugcguggacaugugccugaacuggcugcugaacguguacgacaccggcagaaccggcaagaucagagugcagagccugaagaucggccugaugagccugagcaagggccugcuggaggagaaguacagauaccuguucaaggagguggccggccccaccgagaugugcgaccagagacagcugggccugcugcugcacgacgccauccagauccccagacagcugggcgagguggccgccuucggcggcagcaacaucgagcccagcgugagaagcugcuuccagcagaacaacaacaagcccgagaucagcgugaaggaguucaucgacuggaugcaccuggagccccagagcaugguguggcugcccgugcugcacagaguggccgccgccgagaccgccaagcaccaggccaagugcaacaucugcaaggagugccccaucgugggcuucagauacagaagccugaagcacuucaacuacgacgugugccagagcugcuucuucagcggcagaaccgccaagggccacaagcugcacuaccccaugguggaguacugcauccccaccaccagcggcgaggacgugagagacuucaccaaggugcugaagaacaaguucagaagcaagaaguacuucgccaagcaccccagacugggcuaccugcccgugcagaccgugcuggagggcgacaaccuggagacccccaucacccugaucagcauguggcccgagcacuacgaccccagccagagcccccagcuguuccacgacgacacccacagcagaaucgagcaguacgccaccagacuggcccagauggagagaaccaacggcagcuuccugaccgacagcagcagcaccaccggcagcguggaggacgagcacgcccugauccagcaguacugccagacccugggcggcgagagccccgugagccagccccagagccccgcccagauccugaagagcguggagagagaggagagaggcgagcuggagagaaucaucgccgaccuggaggaggagcagagaaaccugcagguggaguacgagcagcugaaggaccagcaccugagaagaggccugcccgugggcagcccccccgagagcaucaucagcccccaccacaccagcgaggacagcgagcugaucgccgaggccaagcugcugagacagcacaagggcagacuggaggccagaaugcagauccuggaggaccacaacaagcagcuggagagccagcugcacagacugagacagcugcuggagcagcccgagagcgacagcagaaucaacggcgugagccccugggccagcccccagcacagcgcccugagcuacagccuggaccccgacgccagcggcccccaguuccaccaggccgccggcgaggaccugcuggcccccccccacgacaccagcaccgaccugaccgaggugauggagcagauccacagcaccuuccccagcugcugccccaacgugcccagcagaccccaggccauguaa

SEQ ID NO: 25482 - RNA, 360 nt, Artificial Sequence
  UTS2B__Homo_sapiens__NP_937795
augaacaagauccugagcagcaccgugugcuucggccugcugacccugcugagcgugcugagcuuccugcagagcgugcacggcagacccuaccugacccagggcaacgagaucuuccccgacaagaaguacaccaacagagaggagcugcugcuggcccugcugaacaagaacuucgacuuccagagacccuucaacaccgaccuggcccugcccaacaagcuggaggagcugaaccagcuggagaagcugaaggagcagcugguggaggagaaggacagcgagaccagcuacgccguggacggccuguucagcagccaccccagcaagagagccugcuucuggaaguacugcguguaa

SEQ ID NO: 25483 - RNA, 420 nt, Artificial Sequence
  UTS2__Homo_sapiens__XP_011538839
auggagaccaacguguuccaccugaugcugugcgugaccagcgccagaacccacaagagcaccagccugugcuucggccacuucaacagcuaccccagccugccccugauccacgaccugcugcuggagaucagcuuccagcugagcgccccccacgaggacgccagacugacccccgaggagcuggagagagccagccugcugcagauccugcccgagaugcugggcgccgagagaggcgacauccugagaaaggccgacagcagcaccaacaucuucaaccccagaggcaaccugagaaaguuccaggacuucagcggccaggaccccaacauccugcugagccaccugcuggccagaaucuggaagcccuacaagaagagagagacccccgacugcuucuggaaguacugcguguaa

SEQ ID NO: 25484 - RNA, 1170 nt, Artificial Sequence
  UTS2R__Homo_sapiens__NP_061822
auggcccugacccccgagagccccagcagcuuccccggccuggccgccaccggcagcagcgugcccgagccccccggcggccccaacgccacccugaacagcagcugggccagccccaccgagcccagcagccuggaggaccugguggccaccggcaccaucggcacccugcugagcgccaugggcguggugggcguggugggcaacgccuacacccugguggugaccugcagaagccugagagccguggccagcauguacguguacguggugaaccuggcccuggccgaccugcuguaccugcugagcauccccuucaucguggccaccuacgugaccaaggaguggcacuucggcgacgugggcugcagagugcuguucggccuggacuuccugaccaugcacgccagcaucuucacccugaccgugaugagcagcgagagauacgccgccgugcugagaccccuggacaccgugcagagacccaagggcuacagaaagcugcuggcccugggcaccuggcugcuggcccugcugcugacccugcccgugaugcuggccaugagacuggugagaagaggccccaagagccugugccugcccgccuggggccccagagcccacagagccuaccugacccugcuguucgccaccagcaucgccggccccggccugcugaucggccugcuguacgccagacuggccagagccuacagaagaagccagagagccagcuucaagagagccagaagacccggcgccagagcccugagacuggugcugggcaucgugcugcuguucugggccugcuuccugcccuucuggcuguggcagcugcuggcccaguaccaccaggccccccuggcccccagaaccgccagaaucgugaacuaccugaccaccugccugaccuacggcaacagcugcgccaaccccuuccuguacacccugcugaccagaaacuacagagaccaccugagaggcagagugagaggccccggcagcggcggcggcagaggccccgugcccagccugcagcccagagccagauuccagagaugcagcggcagaagccugagcagcugcagcccccagcccaccgacagccuggugcuggcccccgccgcccccgccagacccgcccccgagggccccagagcccccgccuaa

SEQ ID NO: 25485 - RNA, 4179 nt, Artificial Sequence
  UTY__Homo_sapiens__NP_001245181
augaagagcugcgccgugagccugaccaccgccgccguggccuucggcgacgaggccaagaagauggccgagggcaaggccagcagagagagcgaggaggagagcgugagccugaccguggaggagagagaggcccugggcggcauggacagcagacuguucggcuucgugagacugcacgaggacggcgccagaaccaagacccugcugggcaaggccgugagaugcuacgagagccugauccugaaggccgagggcaagguggagagcgacuucuucugccagcugggccacuucaaccugcugcuggaggacuacagcaaggcccugagcgccuaccagagauacuacagccugcaggccgacuacuggaagaacgccgccuuccuguacggccugggccugguguacuucuacuacaacgccuuccacugggccaucaaggccuuccaggacgugcuguacguggaccccagcuucugcagagccaaggagauccaccugagacugggccugauguucaaggugaacaccgacuacaagagcagccugaagcacuuccagcuggcccugaucgacugcaaccccugcacccugagcaacgccgagauccaguuccacaucgcccaccuguacgagacccagagaaaguaccacagcgccaaggaggccuacgagcagcugcugcagaccgagaaccugcccgcccaggugaaggccaccgugcugcagcagcugggcuggaugcaccacaacauggaccuggugggcgacaaggccaccaaggagagcuacgccauccaguaccugcagaagagccuggaggccgaccccaacagcggccagagcugguacuuccugggcagaugcuacagcagcaucggcaaggugcaggacgccuucaucagcuacagacagagcaucgacaagagcgaggccagcgccgacaccuggugcagcaucggcgugcuguaccagcagcagaaccagcccauggacgcccugcaggccuacaucugcgccgugcagcuggaccacggccacgccgccgccuggauggaccugggcacccuguacgagagcugcaaccagccccaggacgccaucaagugcuaccugaacgccgccagaagcaagagaugcagcaacaccagcacccuggccgccagaaucaaguuccugcaggcccagcugugcaaccugccccagagcagccugcagaacaagaccaagcugcugcccagcaucgaggaggccuggagccugcccauccccgccgagcugaccagcagacagggcgccaugaacaccgcccagcagaacggcagcgacaacuggaacggcggccagagccugagccaccaccccgugcagcagguguacagccugugccugaccccccagaagcugcagcaccuggagcagcugagagccaacagagacaaccugaaccccgcccagaagcaccagcuggagcagcuggagagccaguucgugcugaugcagcagaugagacacaaggagguggcccaggugagaaccaccggcauccacaacggcgccaucaccgacagcagccugcccaccaacagcgugagcaacagacagccccacggcgcccugaccagagugagcagcgugagccagcccggcgugagacccgccugcguggagaagcugcugagcagcggcgccuucagcgccggcugcauccccugcggcaccagcaagauccugggcagcaccgacaccauccugcugggcagcaacugcaucgccggcagcgagagcaacggcaacgugcccuaccugcagcagaacacccacacccugccccacaaccacaccgaccugaacagcagcaccgaggagcccuggagaaagcagcugagcaacagcgcccagggccugcacaagagccagagcagcugccugagcggccccaacgaggagcagccccuguucagcaccggcagcgcccaguaccaccaggccaccagcaccggcaucaagaaggccaacgagcaccugacccugcccagcaacagcgugccccagggcgacgccgacagccaccugagcugccacaccgccaccagcggcggccagcagggcaucauguucaccaaggagagcaagcccagcaagaacagaagccuggugcccgagaccagcagacacaccggcgacaccagcaacggcugcgccgacgugaagggccugagcaaccacgugcaccagcugaucgccgacgccgugagcagccccaaccacggcgacagccccaaccugcugaucgccgacaacccccagcugagcgcccugcugaucggcaaggccaacggcaacgugggcaccggcaccugcgacaaggugaacaacauccaccccgccgugcacaccaagaccgaccacagcguggccagcagccccagcagcgccaucagcaccgccacccccagccccaagagcaccgagcagagaagcaucaacagcgugaccagccugaacagcccccacagcggccugcacaccgugaacggcgagggccugggcaagagccagagcagcaccaagguggaccugccccuggccagccacagaagcaccagccagauccugcccagcaugagcgugagcaucugccccagcagcaccgaggugcugaaggccugcagaaaccccggcaagaacggccugagcaacagcugcauccugcuggacaagugccccccccccagaccccccaccagccccuaccccccccugcccaaggacaagcugaacccccccacccccagcaucuaccuggagaacaagagagacgccuucuuccccccccugcaccaguucugcaccaaccccaagaaccccgugaccgugaucagaggccuggccggcgcccugaagcuggaccugggccuguucagcaccaagacccugguggaggccaacaacgagcacaugguggaggugagaacccagcugcugcagcccgccgacgagaacugggaccccaccggcaccaagaagaucuggagaugcgagagcaacagaagccacaccaccaucgccaaguacgcccaguaccaggccagcagcuuccaggagagccugagagaggagaacgagaagagaacccagcacaaggaccacagcgacaacgagagcaccagcagcgagaacagcggcagaagaagaaagggccccuucaagaccaucaaguucggcaccaacaucgaccugagcgacaacaagaaguggaagcugcagcugcacgagcugaccaagcugcccgccuucgccagaguggugagcgccggcaaccugcugacccacgugggccacaccauccugggcaugaacaccgugcagcuguacaugaaggugcccggcagcagaacccccggccaccaggagaacaacaacuucugcagcgugaacaucaacaucggccccggcgacugcgagugguucguggugcccgaggacuacuggggcgugcugaacgacuucugcgagaagaacaaccugaacuuccugaugagcagcugguggcccaaccuggaggaccuguacgaggccaacgugcccguguacagauucauccagagacccggcgaccugguguggaucaacgccggcaccgugcacugggugcaggccgugggcuggugcaacaacaucgccuggaacgugggcccccugaccgccugccaguacaagcuggccguggagagauacgaguggaacaagcugaagagcgugaagagccccgugcccauggugcaccugagcuggaacauggccagaaacaucaaggugagcgaccccaagcuguucgagaugaucaaguacugccugcugaagauccugaagcaguaccagacccugagagaggcccugguggccgccggcaaggaggugaucuggcacggcagaaccaacgacgagcccgcccacuacugcagcaucugcgagguggagguguucaaccugcuguucgugaccaacgagagcaacacccagaagaccuacaucgugcacugccacgacugcgccagaaagaccagcaagagccuggagaacuucguggugcuggagcaguacaagauggaggaccugauccagguguacgaccaguucacccuggcccugagccugagcagcagcagcuaa

SEQ ID NO: 25486 - RNA, 2100 nt, Artificial Sequence
  UVRAG__Homo_sapiens__NP_003360
augagcgccagcgccagcgugggcggccccgugccccagcccccccccggccccgccgccgcccugccccccggcagcgccgccagagcccugcacguggagcugcccagccagcagagaagacugagacaccugagaaacaucgccgccagaaacaucgugaacagaaacggccaccagcugcuggacaccuacuucacccugcaccugugcagcaccgagaagaucuacaaggaguucuacagaagcgaggugaucaagaacagccugaaccccaccuggagaagccuggacuucggcaucaugcccgacagacuggacaccagcgugagcugcuucguggugaagaucuggggcggcaaggagaacaucuaccagcugcugaucgaguggaaggugugccuggacggccugaaguaccugggccagcagauccacgccagaaaccagaacgagaucaucuucggccugaacgacggcuacuacggcgcccccuucgagcacaagggcuacagcaacgcccagaagaccauccugcugcagguggaccagaacugcgugagaaacagcuacgacguguucagccugcugagacugcacagagcccagugcgccaucaagcagacccaggugaccgugcagaagaucggcaaggagaucgaggagaagcugagacugaccagcaccagcaacgagcugaagaagaagagcgagugccugcagcugaagauccuggugcugcagaacgagcuggagagacagaagaaggcccugggcagagagguggcccugcugcacaagcagcagaucgcccugcaggacaagggcagcgccuucagcgccgagcaccugaagcugcagcugcagaaggagagccugaacgagcugagaaaggagugcaccgccaagagagagcuguuccugaagaccaacgcccagcugaccaucagaugcagacagcugcugagcgagcugagcuacaucuaccccaucgaccugaacgagcacaaggacuacuucgugugcggcgugaagcugcccaacagcgaggacuuccaggccaaggacgacggcagcaucgccguggcccugggcuacaccgcccaccuggugagcaugaucagcuucuuccugcaggugccccugagauaccccaucauccacaagggcagcagaagcaccaucaaggacaacaucaacgacaagcugaccgagaaggagagagaguucccccuguaccccaagggcggcgagaagcugcaguucgacuacggcguguaccugcugaacaagaacaucgcccagcugagauaccagcacggccugggcacccccgaccugagacagacccugcccaaccugaagaacuucauggagcacggccugauggugagaugcgacagacaccacaccagcagcgccauccccgugcccaagagacagagcagcaucuucggcggcgccgacgugggcuucagcggcggcauccccagccccgacaagggccacagaaagagagccagcagcgagaacgagagacugcaguacaagacccccccccccagcuacaacagcgcccuggcccagcccgugaccaccgugcccagcaugggcgagaccgagagaaagaucaccagccugagcagcagccuggacaccagccuggacuucagcaaggagaacaagaagaagggcgaggaccuggugggcagccugaacggcggccacgccaacgugcaccccagccaggagcagggcgaggcccugagcggccacagagccaccgugaacggcacccugcugcccagcgagcaggccggcagcgccagcgugcagcugcccggcgaguuccaccccgugagcgaggccgagcugugcugcaccguggagcaggccgaggagaucaucggccuggaggccaccggcuucgccagcggcgaccagcuggaggccuucaacugcauccccguggacagcgccguggccguggagugcgacgagcaggugcugggcgaguucgaggaguucagcagaagaaucuacgcccugaacgagaacgugagcagcuucagaagacccagaagaagcagcgacaaguaa

SEQ ID NO: 25487 - RNA, 2457 nt, Artificial Sequence
  UVSSA__Homo_sapiens__XP_011511824
augcagggccacgcccacccccccgagaaggagacccccgccagaagaagaagacccccccccugcacccagcccagagagcccagcagagccagcgcccugagaggccugugcagagcccccagagaguggggcccccaccacgccccccccaagcccagauuccccaagagaggccugcaggugagacccagcgccgccgaccuggcccugcccugcgugagaggcugcggccugagaagacaggacggcagaagacugugcuucagcuucagacccggccccgccagagcccagggcuaccugcugugcguguggagaagagacauggaccagaagcugagcaagcugguggaggagcugaccaccagcggcgagcccagacugaaccccgagaagaugaaggagcugaagaagaucugcaagagcagcgaggagcagcugagcagagccuacagacugcugaucgcccagcugacccaggagcacgccgagaucagacugagcgccuuccagaucguggaggagcuguucgugagaagccaccaguucagaaugcugguggugagcaacuuccaggaguuccuggagcugacccugggcaccgaccccgcccagccccugcccccccccagagaggccgcccagagacugagacaggccaccaccagagccguggagggcuggaacgagaaguucggcgaggccuacaagaagcuggcccugggcuaccacuuccugagacacaacaagaagguggacuuccaggacaccaacgccagaagccuggccgagagaaagagagaggaggagaagcagaagcaccuggacaagaucuaccaggagagagccagccaggccgagagagagaugcaggagaugagcggcgagaucgagagcugccugaccgagguggagagcugcuucagacugcuggugcccuucgacuucgaccccaaccccgagaccgagagccugggcauggccagcggcaugagcgacgcccugagaagcagcugcgccggccaggugggccccugcagaagcggcacccccgaccccagagacggcgagcagcccugcugcagcagagaccugcccgccagcgccggccaccccagagccggcggcggcgcccagcccagccagaccgccaccggcgaccccagcgacgaggacgaggacagcgaccuggaggaguucgugagaagccacggccugggcagccacaaguacacccuggacguggagcugugcagcgagggccugaaggugcaggagaacgaggacaaccuggcccugauccacgccgccagagacacccugaagcugaucagaaacaaguuccugcccgccgugugcagcuggauccagagauucaccagagugggcacccacggcggcugccugaagagagccaucgaccugaaggccgagcuggagcuggugcugagaaaguacaaggagcuggacaucgagcccgagggcggcgagagaagaagaaccgaggcccugggcgacgccgaggaggacgaggacgacgaggacuucguggaggugcccgagaaggagggcuacgagccccacauccccgaccaccugagacccgaguacggccuggaggccgcccccgagaaggacaccguggugagaugccugagaaccagaaccagaauggacgaggaggugagcgaccccaccagcgccgccgcccagcugagacagcugagagaccaccugcccccccccagcagcgccagccccagcagagcccugcccgagccccaggaggcccagaagcuggccgccgagagagccagagcccccguggugcccuacggcguggaccugcacuacuggggccaggagcugcccaccgccggcaagaucgugaagagcgacagccagcacagauucuggaagcccagcgagguggaggaggagguggugaacgccgacaucagcgagaugcugagaagcagacacaucaccuucgccggcaaguucgagcccgugcagcacuggugcagagcccccagacccgacggcagacugugcgagagacaggacagacugaagugccccuuccacggcaagaucgugcccagagacgacgagggcagaccccuggaccccgaggacagagccagagagcagagaagacagcugcagaagcaggagagacccgaguggcaggaccccgagcugaugagagacguggaggccgccaccggccaggaccugggcagcagcagauacagcggcaagggcagaggcaagaagagaagauaccccagccugaccaaccugaaggcccaggccgacaccgccagagccagaaucggcagaaagguguucgccaaggccgccgugagaagagugguggccgccaugaacagaauggaccagaagaagcacgagaaguucagcaaccaguucaacuacgcccugaacuaa

SEQ ID NO: 25488 - RNA, 1278 nt, Artificial Sequence
  UXS1__Homo_sapiens__NP_001240804
auggugagcaaggcccugcugagacuggugagcgccgugaacagaagaagaaugaagcugcugcugggcaucgcccugcuggccuacguggccagcguguggggcaacuucgugaacaugagcuuccugcugaacagaagcauccaggagaacggcgagcugaagaucgagagcaagaucgaggagaugguggagccccugagagagaagaucagagaccuggagaagagcuucacccagaaguacccccccgugaaguuccugagcgagaaggacagaaagagaauccugaucaccggcggcgccggcuucgugggcagccaccugaccgacaagcugaugauggacggccacgaggugaccgugguggacaacuucuucaccggcagaaagagaaacguggagcacuggaucggccacgagaacuucgagcugaucaaccacgacgugguggagccccuguacaucgagguggaccagaucuaccaccuggccagccccgccagcccccccaacuacauguacaaccccaucaagacccugaagaccaacaccaucggcacccugaacaugcugggccuggccaagagagugggcgccagacugcugcuggccagcaccagcgagguguacggcgaccccgaggugcacccccagagcgaggacuacuggggccacgugaaccccaucggccccagagccugcuacgacgagggcaagagaguggccgagaccaugugcuacgccuacaugaagcaggagggcguggaggugagaguggccagaaucuucaacaccuucggccccagaaugcacaugaacgacggcagaguggugagcaacuucauccugcaggcccugcagggcgagccccugaccguguacggcagcggcagccagaccagagccuuccaguacgugagcgaccuggugaacggccugguggcccugaugaacagcaacgugagcagccccgugaaccugggcaaccccgaggagcacaccauccuggaguucgcccagcugaucaagaaccuggugggcagcggcagcgagauccaguuccugagcgaggcccaggacgacccccagaagagaaagcccgacaucaagaaggccaagcugaugcugggcugggagcccguggugccccuggaggagggccugaacaaggccauccacuacuucagaaaggagcuggaguaccaggccaacaaccaguacauccccaagcccaagcccgccagaaucaagaagggcagaaccagacacagcuaa

SEQ ID NO: 25489 - RNA, 474 nt, Artificial Sequence
  UXT__Homo_sapiens__NP_004173
auggccaccccccccaagagaagagccguggaggccaccggcgagaaggugcugagauacgagaccuucaucagcgacgugcugcagagagaccugagaaaggugcuggaccacagagacaagguguacgagcagcuggccaaguaccugcagcugagaaacgugaucgagagacugcaggaggccaagcacagcgagcuguacaugcagguggaccugggcugcaacuucuucguggacaccguggugcccgacaccagcagaaucuacguggcccugggcuacggcuucuuccuggagcugacccuggccgaggcccugaaguucaucgacagaaagagcagccugcugaccgagcugagcaacagccugaccaaggacagcaugaacaucaaggcccacauccacaugcugcuggagggccugagagagcugcagggccugcagaacuuccccgagaagccccaccacuaa

SEQ ID NO: 25490 - RNA, 2349 nt, Artificial Sequence
  VAC14__Homo_sapiens__NP_060522
augaaccccgagaaggacuucgccccccugacccccaacaucgugagagcccugaacgacaagcuguacgagaagagaaagguggccgcccuggagaucgagaagcuggugagagaguucguggcccagaacaacaccgugcagaucaagcacgugauccagacccugagccaggaguucgcccugagccagcacccccacagcagaaagggcggccugaucggccuggccgccugcagcaucgcccugggcaaggacagcggccuguaccugaaggagcugaucgagcccgugcugaccugcuucaacgacgccgacagcagacugagauacuacgccugcgaggcccuguacaacaucgugaagguggccagaggcgccgugcugccccacuucaacgugcuguucgacggccugagcaagcuggccgccgaccccgaccccaacgugaagagcggcagcgagcugcuggacagacugcugaaggacaucgugaccgagagcaacaaguucgaccuggugagcuucaucccccugcugagagagagaaucuacagcaacaaccaguacgccagacaguucaucaucagcuggauccuggugcuggagagcgugcccgacaucaaccugcuggacuaccugcccgagauccuggacggccuguuccagauccugggcgacaacggcaaggagaucagaaagaugugcgagguggugcugggcgaguuccugaaggagaucaagaagaaccccagcagcgugaaguucgccgagauggccaacauccuggugauccacugccagaccaccgacgaccugauccagcugaccgccaugugcuggaugagagaguucauccagcuggccggcagagugaugcugcccuacagcagcggcauccugaccgccgugcugcccugccuggccuacgacgacagaaagaagagcaucaaggagguggccaacgugugcaaccagagccugaugaagcuggugacccccgaggacgacgagcuggacgagcugagacccggccagagacaggccgagcccacccccgacgacgcccugcccaagcaggagggcaccgccagcggcggccccgacggcagcugcgacagcagcuucagcagcggcaucagcguguucaccgccgccagcaccgagagagcccccgugacccugcaccuggacggcaucgugcaggugcugaacugccaccugagcgacaccgccaucggcaugaugaccagaaucgccgugcugaaguggcuguaccaccuguacaucaagacccccagaaagauguucagacacaccgacagccuguuccccauccugcugcagacccugagcgacgagagcgacgaggugauccugaaggaccuggaggugcuggccgagaucgccagcagccccgccggccagaccgacgaccccggcccccuggacggccccgaccugcaggccagccacagcgagcugcaggugcccacccccggcagagccggccugcugaacaccagcggcaccaagggccuggagugcagccccagcacccccaccaugaacagcuacuucuacaaguucaugaucaaccugcugaagagauucagcagcgagagaaagcugcuggaggugagaggccccuucaucaucagacagcugugccugcugcugaacgccgagaacaucuuccacagcauggccgacauccugcugagagaggaggaccugaaguucgccagcaccauggugcacgcccugaacaccauccugcugaccagcaccgagcuguuccagcugagaaaccagcugaaggaccugaagacccuggagagccagaaccuguucugcugccuguacagaagcuggugccacaaccccgugaccaccgugagccugugcuuccugacccagaacuacagacacgccuacgaccugauccagaaguucggcgaccuggaggugaccguggacuuccuggccgagguggacaagcuggugcagcugaucgagugccccaucuucaccuaccugagacugcagcugcuggacgugaagaacaaccccuaccugaucaaggcccuguacggccugcugaugcugcugccccagagcagcgccuuccagcugcugagccacagacugcagugcgugcccaaccccgagcugcugcagaccgaggacagccugaaggccgcccccaagagccagaaggccgacagccccagcaucgacuacgccgagcugcugcagcacuucgagaaggugcagaacaagcaccuggaggugagacaccagagaagcggcagaggcgaccaccuggacagaagaguggugcuguaa

SEQ ID NO: 25491 - RNA, 351 nt, Artificial Sequence
  VAMP1__Homo_sapiens__NP_001284367
augagcgcccccgcccagccccccgccgagggcaccgagggcaccgcccccggcggcggcccccccggccccccccccaacaugaccagcaacagaagacugcagcagacccaggcccagguggaggaggugguggacaucaucagagugaacguggacaaggugcuggagagagaccagaagcugagcgagcuggacgacagagccgacgcccugcaggccggcgccagccaguucgagagcagcgccgccaagcugaagagaaaguacugguggaagaacugcaagaugaugaucaugcugggcgccaucugcgccaucaucgugguggugaucgugagaagaggcuaa

SEQ ID NO: 25492 - RNA, 351 nt, Artificial Sequence
  VAMP2__Homo_sapiens__NP_055047
augagcgccaccgccgccaccgccccccccgccgcccccgccggcgagggcggcccccccgcccccccccccaaccugaccagcaacagaagacugcagcagacccaggcccagguggacgaggugguggacaucaugagagugaacguggacaaggugcuggagagagaccagaagcugagcgagcuggacgacagagccgacgcccugcaggccggcgccagccaguucgagaccagcgccgccaagcugaagagaaaguacugguggaagaaccugaagaugaugaucauccugggcgugaucugcgccaucauccugaucaucaucaucguguacuucagcaccuaa

SEQ ID NO: 25493 - RNA, 423 nt, Artificial Sequence
  VAMP4__Homo_sapiens__NP_001172056
augccccccaaguucaagagacaccugaacgacgacgacgugaccggcagcgugaagagcgagagaagaaaccugcuggaggacgacagcgacgaggaggaggacuucuuccugggccccagcggccccagauucggccccagaaacgacaagaucaagcacgugcagaaccagguggacgaggugaucgacgugaugcaggagaacaucaccaaggugaucgagagaggcgagagacuggacgagcugcaggacaagagcgagagccugagcgacaacgccaccgccuucagcaacagaagcaagcagcugagaagacagaugugguggagaggcugcaagaucaaggccaucauggcccugguggccgccauccugcugcuggugaucaucauccugaucgugaugaaguacagaaccuaa

SEQ ID NO: 25494 - RNA, 540 nt, Artificial Sequence
  VAMP7__Homo_sapiens__NP_001138621
auggccauccuguucgccgugguggccagaggcaccaccauccuggccaagcacgccuggugcggcggcaacuuccuggaggacuucgagagaagcagagccuucaacuuccugaacgagaucaagaagagauuccagaccaccuacggcagcagagcccagaccgcccugcccuacgccaugaacagcgaguucagcagcgugcuggccgcccagcugaagcaccacagcgagaacaagggccuggacaaggugauggagacccaggcccagguggacgagcugaagggcaucauggugagaaacaucgaccugguggcccagagaggcgagagacuggagcugcugaucgacaagaccgagaaccugguggacagcagcgugaccuucaagaccaccagcagaaaccuggccagagccaugugcaugaagaaccugaagcugaccaucaucaucaucaucgugagcaucguguucaucuacaucaucgugagcccccugugcggcggcuucaccuggcccagcugcgugaagaaguaa

SEQ ID NO: 25495 - RNA, 303 nt, Artificial Sequence
  VAMP8__Homo_sapiens__NP_003752
auggaggaggccagcgagggcggcggcaacgacagagugagaaaccugcagagcgagguggagggcgugaagaacaucaugacccagaacguggagagaauccuggccagaggcgagaaccuggagcaccugagaaacaagaccgaggaccuggaggccaccagcgagcacuucaagaccaccagccagaagguggccagaaaguucugguggaagaacgugaagaugaucgugcugaucugcgugaucguguucaucaucauccuguucaucgugcuguucgccaccggcgccuucagcuaa

SEQ ID NO: 25496 - RNA, 1566 nt, Artificial Sequence
  VANGL2__Homo_sapiens__NP_065068
auggacaccgagagccaguacagcggcuacagcuacaagagcggccacagcagaagcagcagaaagcacagagacagaagagacagacacagaagcaagagcagagacggcggcagaggcgacaagagcgugaccauccaggcccccggcgagccccugcuggacaacgagagcaccagaggcgacgagagagacgacaacuggggcgagaccaccaccguggugaccggcaccagcgagcacagcaucagccacgacgaccugaccagaaucgccaaggacauggaggacagcgugccccuggacugcagcagacaccugggcguggccgccggcgccacccuggcccugcugagcuuccugaccccccuggccuuccugcugcugcccccccugcuguggagagaggagcuggagcccugcggcaccgccugcgagggccuguucaucagcguggccuucaagcugcugauccugcugcugggcagcugggcccuguucuucagaagacccaaggccagccugcccagaguguucgugcugagagcccugcugauggugcugguguuccugcugguggugagcuacuggcuguucuacggcgugagaauccuggacgccagagagagaagcuaccagggcguggugcaguucgccgugagccugguggacgcccugcuguucgugcacuaccuggccguggugcugcuggagcugagacagcugcagccccaguucacccugaagguggugagaagcaccgacggcgccagcagauucuacaacgugggccaccugagcauccagagaguggccguguggauccuggagaaguacuaccacgacuuccccguguacaaccccgcccugcugaaccugcccaagagcgugcuggccaagaaggugagcggcuucaagguguacagccugggcgaggagaacagcaccaacaacagcaccggccagagcagagccgugaucgccgccgccgccagaagaagagacaacagccacaacgaguacuacuacgaggaggccgagcacgagagaagagugagaaagagaagagccagacuggugguggccguggaggaggccuucacccacaucaagagacugcaggaggaggagcagaagaaccccagagaggugauggaccccagagaggccgcccaggccaucuucgccagcauggccagagccaugcagaaguaccugagaaccaccaagcagcagcccuaccacaccauggagagcauccugcagcaccuggaguucugcaucacccacgacaugacccccaaggccuuccuggagagauaccuggccgccggccccaccauccaguaccacaaggagagauggcuggccaagcaguggacccuggugagcgaggagcccgugaccaacggccugaaggacggcaucguguuccugcugaagagacaggacuucagccugguggugagcaccaagaaggugcccuucuucaagcugagcgaggaguucguggaccccaagagccacaaguucgugaugagacugcagagcgagaccagcguguaa

SEQ ID NO: 25497 - RNA, 885 nt, Artificial Sequence
  VAPA__Homo_sapiens__NP_003565
auggccagcgccagcggcgccauggccaagcacgagcagauccuggugcuggacccccccaccgaccugaaguucaagggccccuucaccgacguggugaccaccaaccugaagcugagaaaccccagcgacagaaaggugugcuucaaggugaagaccaccgcccccagaagauacugcgugagacccaacagcggcaucaucgaccccggcagcaccgugaccgugagcgugaugcugcagcccuucgacuacgaccccaacgagaagagcaagcacaaguucauggugcagaccaucuucgccccccccaacaccagcgacauggaggccguguggaaggaggccaagcccgacgagcugauggacagcaagcugagaugcguguucgagaugcccaacgagaacgacaagcugggcaucaccccccccggcaacgcccccaccgugaccagcaugagcagcaucaacaacaccguggccacccccgccagcuaccacaccaaggacgaccccagaggccugagcgugcugaagcaggagaagcagaagaacgacauggagcccagcaaggccgugccccugaacgccagcaagcaggacggccccaugcccaagccccacagcgugagccugaacgacaccgagaccagaaagcugauggaggagugcaagagacugcagggcgagaugaugaagcugagcgaggagaacagacaccugagagacgagggccugagacugagaaagguggcccacagcgacaagcccggcagcaccagcaccgccagcuucagagacaacgugaccagcccccugcccagccugcugguggugaucgccgccaucuucaucggcuucuuccugggcaaguucauccuguaa

SEQ ID NO: 25498 - RNA, 300 nt, Artificial Sequence
  VAPB__Homo_sapiens__NP_001182606
auggccaagguggagcaggugcugagccuggagccccagcacgagcugaaguucagaggccccuucaccgacguggugaccaccaaccugaagcugggcaaccccaccgacagaaacgugugcuucaaggugaagaccaccgcccccagaagauacugcgugagacccaacagcggcaucaucgacgccggcgccagcaucaacgugagcggcagaagauggaccgccgacgaggaggacagcgccgagcagcagccccacuucagcaucagccccaacugggagggcagaagacccuaa

SEQ ID NO: 25499 - RNA, 2772 nt, Artificial Sequence
  VARS2__Homo_sapiens__NP_001161205
augugcauccccccccccaacgugaccggcagccugcacaucggccacgcccugaccguggccauccaggacgcccuggugagauggcacagaaugagaggcgaccaggugcugugggugcccggcagcgaccacgccggcaucgccacccaggccgugguggagaagcagcuguggaaggagagaggcgugagaagacacgagcugagcagagaggccuuccugagagagguguggcaguggaaggaggccaagggcggcgagaucugcgagcagcugagagcccugggcgccagccuggacugggacagagagugcuucaccauggacgugggcagcagcguggccgugaccgaggccuucgugagacuguacaaggccggccugcuguacagaaaccaccagcuggugaacuggagcugcgcccugagaagcgccaucagcgacaucgagguggagaacagaccccugcccggccacacccagcugagacugcccggcugccccacccccgugagcuucggccugcuguucagcguggccuuccccguggacggcgagcccgacgccgaggugguggugggcaccaccagacccgagacccugcccggcgacguggccguggccgugcaccccgacgacagcagauacacccaccugcacggcagacagcugagacacccccugaugggccagccccugccccugaucaccgacuacgccgugcagccccacgugggcaccggcgccgugaaggugacccccgcccacagccccgccgacgccgagaugggcgccagacacggccugagcccccugaacgugaucgccgaggacggcaccaugaccagccugugcggcgacuggcugcagggccugcacagauucguggccagagagaagaucaugagcgugcugagcgaguggggccuguucagaggccugcagaaccaccccauggugcugcccaucugcagcagaagcggcgacgugaucgaguaccugcugaagaaccagugguucgugagaugccaggagaugggcgccagagccgccaaggccguggagagcggcgcccuggagcugagccccagcuuccaccagaagaacuggcagcacugguucagccacaucggcgacuggugcgugagcagacagcugugguggggccaccagauccccgccuaccuggugguggaggaccacgcccagggcgaggaggacugcuggguggugggcagaagcgaggccgaggccagagagguggccgccgagcugaccggcagacccggcgccgagcugacccuggagagagaccccgacgugcuggacaccugguucagcagcgcccuguuccccuucagcgcccugggcuggccccaggagacccccgaccuggccagauucuacccccugagccugcuggagaccggcagcgaccugcugcuguucugggugggcagaauggugaugcugggcacccagcugaccggccagcugcccuucagcaaggugcugcugcaccccauggugagagacagacagggcagaaagaugagcaagagccugggcaacgugcuggaccccagagacaucaucagcggcguggagaugcaggugcugcaggagaagcugagaagcggcaaccuggaccccgccgagcuggccaucguggccgccgcccagaagaaggacuucccccacggcauccccgagugcggcaccgacgcccugagauucacccugugcagccacggcgugcaggccggcgaccugcaccugagcgugagcgaggugcagagcugcagacacuucugcaacaagaucuggaacgcccugagauucauccugaacgcccugggcgagaaguucgugccccagcccgccgaggagcugagccccagcagccccauggacgccuggauccugagcagacuggcccuggccgcccaggagugcgagagaggcuuccugaccagagagcugagccuggugacccacgcccugcaccacuucuggcugcacaaccugugcgacguguaccuggaggccgugaagcccgugcuguggcacagccccagaccccugggccccccccaggugcuguucagcugcgccgaccugggccugagacugcuggccccccugaugcccuuccuggccgaggagcuguggcagagacugccccccagacccggcugcccccccgcccccagcaucagcguggcccccuaccccagcgccugcagccuggagcacuggagacagcccgagcuggagagaagauucagcagagugcaggagguggugcaggugcugagagcccugagagccaccuaccagcugaccaaggccagacccagagugcugcugcagagcagcgagcccggcgaccagggccuguucgaggccuuccuggagccccugggcacccugggcuacugcggcgccgugggccugcugccccccggcgccgccgcccccagcggcugggcccaggccccccugagcgacaccgcccagguguacauggagcugcagggccugguggacccccagauccagcugccccugcuggccgccagaagauacaagcugcagaagcagcuggacagccugaccgccagaacccccagcgagggcgaggccggcacccagagacagcagaagcugagcagccugcagcuggagcugagcaagcuggacaaggccgccagccaccugagacagcugauggacgagccccccgcccccggcagccccgagcuguaa

SEQ ID NO: 25500 - RNA, 3795 nt, Artificial Sequence
  VARS__Homo_sapiens__NP_006286
augagcacccuguacgugagcccccaccccgacgccuuccccagccugagagcccugaucgccgccagauacggcgaggccggcgagggccccggcuggggcggcgcccaccccagaaucugccugcagcccccccccaccagcagaacccccuuccccccccccagacugcccgcccuggagcagggccccggcggccuguggguguggggcgccaccgccguggcccagcugcuguggcccgccggccugggcggccccggcggcagcagagccgccgugcuggugcagcagugggugagcuacgccgacaccgagcugauccccgccgccugcggcgccacccugcccgcccugggccugagaagcagcgcccaggacccccaggccgugcugggcgcccugggcagagcccugagcccccuggaggaguggcugagacugcacaccuaccuggccggcgaggcccccacccuggccgaccuggccgccgugaccgcccugcugcugcccuucagauacgugcuggacccccccgccagaagaaucuggaacaacgugaccagaugguucgugaccugcgugagacagcccgaguucagagccgugcugggcgagguggugcuguacagcggcgccagaccccugagccaccagcccggccccgaggcccccgcccugcccaagaccgccgcccagcugaagaaggaggccaagaagagagagaagcuggagaaguuccagcagaagcagaagauccagcagcagcagcccccccccggcgagaagaagcccaagcccgagaagagagagaagagagaccccggcgugaucaccuacgaccugcccaccccccccggcgagaagaaggacgugagcggccccaugcccgacagcuacagccccagauacguggaggccgccugguaccccuggugggagcagcagggcuucuucaagcccgaguacggcagacccaacgugagcgccgccaaccccagaggcguguucaugaugugcauccccccccccaacgugaccggcagccugcaccugggccacgcccugaccaacgccauccaggacagccugaccagauggcacagaaugagaggcgagaccacccuguggaaccccggcugcgaccacgccggcaucgccacccagguggugguggagaagaagcuguggagagagcagggccugagcagacaccagcugggcagagaggccuuccugcaggagguguggaaguggaaggaggagaagggcgacagaaucuaccaccagcugaagaagcugggcagcagccuggacugggacagagccugcuucaccauggaccccaagcugagcgccgccgugaccgaggccuucgugagacugcacgaggagggcaucaucuacagaagcaccagacuggugaacuggagcugcacccugaacagcgccaucagcgacaucgagguggacaagaaggagcugaccggcagaacccugcugagcgugcccggcuacaaggagaagguggaguucggcgugcuggugagcuucgccuacaaggugcagggcagcgacagcgacgaggagguggugguggccaccaccagaaucgagaccaugcugggcgacguggccguggccgugcaccccaaggacaccagauaccagcaccugaagggcaagaacgugauccaccccuuccugagcagaagccugcccaucguguucgacgaguucguggacauggacuucggcaccggcgccgugaagaucacccccgcccacgaccagaacgacuacgaggugggccagagacacggccuggaggccaucagcaucauggacagcagaggcgcccugaucaacgugcccccccccuuccugggccugcccagauucgaggccagaaaggccgugcugguggcccugaaggagagaggccuguucagaggcaucgaggacaaccccaugguggugccccugugcaacagaagcaaggacgugguggagccccugcugagaccccagugguacgugagaugcggcgagauggcccaggccgccagcgccgccgugaccagaggcgaccugagaauccugcccgaggcccaccagagaaccuggcacgccuggauggacaacaucagagaguggugcaucagcagacagcugugguggggccacagaauccccgccuacuucgugaccgugagcgaccccgccgugccccccggcgaggaccccgacggcagauacugggugagcggcagaaacgaggccgaggccagagagaaggccgccaaggaguucggcgugagccccgacaagaucagccugcagcaggacgaggacgugcuggacaccugguucagcagcggccuguucccccugagcauccugggcuggcccaaccagagcgaggaccugagcguguucuaccccggcacccugcuggagaccggccacgacauccuguucuucuggguggccagaauggugaugcugggccugaagcugaccggcagacugcccuucagagagguguaccugcacgccaucgugagagacgcccacggcagaaagaugagcaagagccugggcaacgugaucgacccccuggacgugaucuacggcaucagccugcagggccugcacaaccagcugcugaacagcaaccuggaccccagcgagguggagaaggccaaggagggccagaaggccgacuuccccgccggcauccccgagugcggcaccgacgcccugagauucggccugugcgccuacaugagccagggcagagacaucaaccuggacgugaacagaauccugggcuacagacacuucugcaacaagcuguggaacgccaccaaguucgcccugagaggccugggcaagggcuucgugcccagccccaccagccagcccggcggccacgagagccugguggacagauggaucagaagcagacugaccgaggccgugagacugagcaaccagggcuuccaggccuacgacuuccccgccgugaccaccgcccaguacagcuucuggcuguacgagcugugcgacguguaccuggagugccugaagcccgugcugaacggcguggaccagguggccgccgagugcgccagacagacccuguacaccugccuggacgugggccugagacugcugagccccuucaugcccuucgugaccgaggagcuguuccagagacugcccagaagaaugccccaggccccccccagccugugcgugacccccuaccccgagcccagcgagugcagcuggaaggaccccgaggccgaggccgcccuggagcuggcccugagcaucaccagagccgugagaagccugagagccgacuacaaccugaccagaaucagacccgacugcuuccuggagguggccgacgaggccaccggcgcccuggccagcgccgugagcggcuacgugcaggcccuggccagcgccggcgugguggccgugcuggcccugggcgcccccgccccccagggcugcgccguggcccuggccagcgacagaugcagcauccaccugcagcugcagggccugguggaccccgccagagagcugggcaagcugcaggccaagagaguggaggcccagagacaggcccagagacugagagagagaagagccgccagcggcuaccccgugaaggugccccuggaggugcaggaggccgacgaggccaagcugcagcagaccgaggccgagcugagaaagguggacgaggccaucgcccuguuccagaagaugcuguaa

SEQ ID NO: 25501 - RNA, 1098 nt, Artificial Sequence
  VASH1__Homo_sapiens__NP_055724
augcccggcggcaagaagguggccggcggcggcagcagcggcgccacccccaccagcgccgccgccaccgcccccagcggcgugagaagacuggagaccagcgagggcaccagcgcccagagagacgaggagcccgaggaggagggcgaggaggaccugagagacggcggcgugcccuucuucgugaacagaggcggccugcccguggacgaggccaccugggagagaauguggaagcacguggccaagauccaccccgacggcgagaagguggcccagagaaucagaggcgccaccgaccugcccaagauccccauccccagcgugcccaccuuccagcccagcacccccgugcccgagagacuggaggccgugcagagauacaucagagagcugcaguacaaccacaccggcacccaguucuucgagaucaagaagagcagaccccugaccggccugauggaccuggccaaggagaugaccaaggaggcccugcccaucaagugccuggaggccgugauccugggcaucuaccugaccaacagcaugcccacccuggagagauuccccaucagcuucaagaccuacuucagcggcaacuacuucagacacaucgugcugggcgugaacuucgccggcagauacggcgcccugggcaugagcagaagagaggaccugauguacaagccccccgccuucagaacccugagcgagcuggugcuggacuucgaggccgccuacggcagaugcuggcacgugcugaagaaggugaagcugggccagagcgugagccacgacccccacagcguggagcagaucgaguggaagcacagcgugcuggacguggagagacugggcagagacgacuucagaaaggagcuggagagacacgccagagacaugagacugaagaucggcaagggcaccggcccccccagccccaccaaggacagaaagaaggacgugagcagcccccagagagcccagagcagcccccacagaagaaacagcagaagcgagagaagacccagcggcgacaagaagaccagcgagcccaaggccaugcccgaccugaacggcuaccagaucagaguguaa

SEQ ID NO: 25502 - RNA, 873 nt, Artificial Sequence
  VASH2__Homo_sapiens__NP_001129946
auguggaugcacguggccaaggugcaccccaagggcggcgagauggugggcgccaucagaaacgccgccuuccuggccaagcccagcaucccccaggugcccaacuacagacugagcaugaccauccccgacuggcugcaggccauccagaacuacaugaagacccugcaguacaaccacaccggcacccaguucuucgagaucagaaagaugagaccccugagcggccugauggagaccgccaaggagaugaccagagagagccugcccaucaagugccuggaggccgugauccugggcaucuaccugaccaacggccagcccagcaucgagagauuccccaucagcuucaagaccuacuucagcggcaacuacuuccaccacguggugcugggcaucuacugcaacggcagauacggcagccugggcaugagcagaagagccgagcugauggacaagccccugaccuucagaacccugagcgaccugaucuucgacuucgaggacagcuacaagaaguaccugcacaccgugaagaaggugaagaucggccuguacgugccccacgagccccacagcuuccagcccaucgaguggaagcagcuggugcugaacgugagcaagaugcugagagccgacaucagaaaggagcuggagaaguacgccagagacaugagaaugaagauccugaagcccgccagcgcccacagccccacccaggugagaagcagaggcaagagccugagccccagaagaagacaggccagcccccccagaagacugggcagaagagagaagagccccgcccugcccgagaagaagguggccgaccugagcacccugaacgaggugggcuaccagaucagaaucuaa

SEQ ID NO: 25503 - RNA, 1143 nt, Artificial Sequence
  VASP__Homo_sapiens__NP_003361
augagcgagaccgugaucugcagcagcagagccaccgugaugcuguacgacgacggcaacaagagauggcugcccgccggcaccggcccccaggccuucagcagagugcagaucuaccacaaccccaccgccaacagcuucagaguggugggcagaaagaugcagcccgaccagcagguggugaucaacugcgccaucgugagaggcgugaaguacaaccaggccacccccaacuuccaccaguggagagacgccagacagguguggggccugaacuucggcagcaaggaggacgccgcccaguucgccgccggcauggccagcgcccuggaggcccuggagggcggcggccccccccccccccccgcccugcccaccuggagcgugcccaacggccccagccccgaggagguggagcagcagaagagacagcagcccggccccagcgagcacaucgagagaagagugagcaacgccggcggcccccccgccccccccgccggcggccccccccccccccccggccccccccccccccccggccccccccccccccccggccugccccccagcggcgugcccgccgccgcccacggcgccggcggcggccccccccccgcccccccccugcccgccgcccagggccccggcggcggcggcgccggcgcccccggccuggccgccgccaucgccggcgccaagcugagaaaggugagcaagcaggaggaggccagcggcggccccaccgcccccaaggccgagagcggcagaagcggcggcggcggccugauggaggagaugaacgccaugcuggccagaagaagaaaggccacccaggugggcgagaagacccccaaggacgagagcgccaaccaggaggagcccgaggccagagugcccgcccagagcgagagcgugagaagacccugggagaagaacagcaccacccugcccagaaugaagagcagcagcagcgugaccaccagcgagacccagcccugcacccccagcagcagcgacuacagcgaccugcagagagugaagcaggagcugcuggaggaggugaagaaggagcugcagaaggugaaggaggagaucaucgaggccuucgugcaggagcugagaaagagaggcagccccuaa

SEQ ID NO: 25504 - RNA, 1182 nt, Artificial Sequence
  VAT1__Homo_sapiens__NP_006364
augagcgacgagagagagguggccgaggccgccaccggcgaggacgccagcagccccccccccaagaccgaggccgccagcgacccccagcaccccgccgccagcgagggcgccgccgccgccgccgccagccccccccugcugagaugccuggugcugaccggcuucggcggcuacgacaaggugaagcugcagagcagacccgccgccccccccgcccccggccccggccagcugacccugagacugagagccugcggccugaacuucgccgaccugauggccagacagggccuguacgacagacugcccccccugcccgugacccccggcauggagggcgccggcguggugaucgccgugggcgagggcgugagcgacagaaaggccggcgacagagugauggugcugaacagaagcggcauguggcaggaggaggugaccgugcccagcgugcagaccuuccugauccccgaggccaugaccuucgaggaggccgccgcccugcuggugaacuacaucaccgccuacauggugcuguucgacuucggcaaccugcagcccggccacagcgugcuggugcacauggccgccggcggcgugggcauggccgccgugcagcugugcagaaccguggagaacgugaccguguucggcaccgccagcgccagcaagcacgaggcccugaaggagaacggcgugacccaccccaucgacuaccacaccaccgacuacguggacgagaucaagaagaucagccccaagggcguggacaucgugauggacccccugggcggcagcgacaccgccaagggcuacaaccugcugaagcccaugggcaagguggugaccuacggcauggccaaccugcugaccggccccaagagaaaccugauggcccuggccagaaccugguggaaccaguucagcgugaccgcccugcagcugcugcaggccaacagagccgugugcggcuuccaccugggcuaccuggacggcgagguggagcuggugagcggcgugguggccagacugcuggcccuguacaaccagggccacaucaagccccacaucgacagcguguggcccuucgagaagguggccgacgccaugaagcagaugcaggagaagaagaacgugggcaaggugcugcuggugcccggccccgagaaggagaacuaa

SEQ ID NO: 25505 - RNA, 1260 nt, Artificial Sequence
  VAT1L__Homo_sapiens__NP_065978
auggccaaggagggcguggagaaggccgaggagaccgagcagaugaucgagaaggaggccggcaaggagcccgccgagggcggcggcggcgacggcagccacagacugggcgacgcccaggagaugagagccguggugcuggccggcuucggcggccugaacaagcugagacuguucagaaaggccaugcccgagccccaggacggcgagcugaagaucagagugaaggccugcggccugaacuucaucgaccugauggugagacagggcaacaucgacaacccccccaagaccccccuggugcccggcuucgagugcagcggcaucguggaggcccugggcgacagcgugaagggcuacgagaucggcgacagagugauggccuucgugaacuacaacgccugggccgagguggugugcacccccguggaguucguguacaagauccccgacgacaugagcuucagcgaggccgccgccuuccccaugaacuucgugaccgccuacgugaugcuguucgagguggccaaccugagagagggcaugagcgugcuggugcacagcgccggcggcggcgugggccaggccguggcccagcugugcagcaccgugcccaacgugaccguguucggcaccgccagcaccuucaagcacgaggccaucaaggacagcgugacccaccuguucgacagaaacgccgacuacgugcaggaggugaagagaaucagcgccgagggcguggacaucgugcuggacugccugugcggcgacaacaccggcaagggccugagccugcugaagccccugggcaccuacauccuguacggcagcagcaacauggugaccggcgagaccaagagcuucuucagcuucgccaagagcugguggcagguggagaaggugaaccccaucaagcuguacgaggagaacaaggugaucgccggcuucagccugcugaaccugcuguucaagcagggcagagccggccugaucagaggcgugguggagaagcugaucggccuguacaaccagaagaagaucaagcccgugguggacagccugugggcccuggaggaggugaaggaggccaugcagagaauccacgacagaggcaacaucggcaagcugauccuggacguggagaagacccccaccccccugauggccaacgacagcaccgagaccagcgaggccggcgaggaggaggaggaccacgagggcgacagcgagaacaaggagagaaugcccuucauccaguaa

SEQ ID NO: 25506 - RNA, 2442 nt, Artificial Sequence
  VAV1__Homo_sapiens__NP_001245136
auggagcuguggagacagugcacccacuggcugauccagugcagagugcugccccccagccacagagugaccugggacggcgcccaggugugcgagcuggcccaggcccugagagacggcgugcugcugugccagcugcugaacaaccugcugccccacgccaucaaccugagagaggugaaccugagaccccagaugagccaguuccugugccugaagaacaucagaaccuuccugagcaccugcugcgagaaguucggccugaagagaagcgagcuguucgaggccuucgaccuguucgacgugcaggacuucggcaaggugaucuacacccugagcgcccugagcuggacccccaucgcccagaacagaggcaucaugcccuuccccaccgaggaggagagcgugggcgacgaggacaucuacagcggccugagcgaccagaucgacgacaccguggaggaggacgaggaccuguacgacugcguggagaacgaggaggccgagggcgacgagaucuacgaggaccugaugagaagcgagcccgugagcaugccccacuuccugaagccccugcagagauuccugaagccccaggacaucgagaucaucuucaucaacaucgaggaccugcugagagugcacacccacuuccugaaggagaugaaggaggcccugggcacccccggcgccgccaaccuguaccagguguucaucaaguacaaggagagauuccugguguacggcagauacugcagccagguggagagcgccagcaagcaccuggacagaguggccgccgccagagaggacgugcagaugaagcuggaggagugcagccagagagccaacaacggcagauucacccugagagaccugcugauggugcccaugcagagagugcugaaguaccaccugcugcugcaggagcuggugaagcacacccaggaggccauggagaaggagaaccugagacuggcccuggacgccaugagagaccuggcccagugcgugaacgaggugaagagagacaacgagacccugagacagaucaccaacuuccagcugagcaucgagaaccuggaccagagccuggcccacuacggcagacccaagaucgacggcgagcugaagaucaccagcguggagagaagaagcaagauggacagauacgccuuccugcuggacaaggcccugcugaucugcaagagaagaggcgacagcuacgaccugaaggacuucgugaaccugcacagcuuccaggugagagacgacagcagcggcgacagagacaacaagaaguggagccacauguuccugcugaucgaggaccagggcgcccagggcuacgagcuguucuucaagaccagagagcugaagaagaaguggauggagcaguucgagauggccaucagcaacaucuaccccgagaacgccaccgccaacggccacgacuuccagauguucagcuucgaggagaccaccagcugcaaggccugccagaugcugcugagaggcaccuucuaccagggcuacagaugccacagaugcagagccagcgcccacaaggagugccugggcagagugccccccugcggcagacacggccaggacuuccccggcaccaugaagaaggacaagcugcacagaagagcccaggacaagaagagaaacgagcugggccugcccaagauggagguguuccaggaguacuacggccugccccccccccccggcgccaucggccccuuccugagacugaaccccggcgacaucguggagcugaccaaggccgaggccgagcagaacuggugggagggcagaaacaccagcaccaacgagaucggcugguuccccugcaacagagugaagcccuacgugcacggccccccccaggaccugagcgugcaccugugguacgccggccccauggagagagccggcgccgagagcauccuggccaacagaagcgacggcaccuuccuggugagacagagagugaaggacgccgccgaguucgccaucagcaucaaguacaacguggaggugaagcacaucaagaucaugaccgccgagggccuguacagaaucaccgagaagaaggccuucagaggccugaccgagcugguggaguucuaccagcagaacagccugaaggacugcuucaagagccuggacaccacccugcaguuccccuucaaggagcccgagaagagaaccaucagcagacccgccgugggcagcaccaaguacuucggcaccgccaaggccagauacgacuucugcgccagagacagaagcgagcugagccugaaggagggcgacaucaucaagauccugaacaagaagggccagcagggcugguggagaggcgagaucuacggcagagugggcugguuccccgccaacuacguggaggaggacuacagcgaguacugcuaa

SEQ ID NO: 25507 - RNA, 2637 nt, Artificial Sequence
  VAV2__Homo_sapiens__NP_001127870
auggagcaguggagacagugcggcagauggcugaucgacugcaaggugcugccccccaaccacagagugguguggcccagcgccgugguguucgaccuggcccaggcccugagagacggcgugcugcugugccagcugcugcacaaccugagccccggcagcaucgaccugaaggacaucaacuucagaccccagaugagccaguuccugugccugaagaacaucagaaccuuccugaaggugugccacgacaaguucggccugagaaacagcgagcuguucgaccccuucgaccuguucgacgugagagacuucggcaaggugaucagcgccgugagcagacugagccugcacagcaucgcccagaacaagggcaucagacccuuccccagcgaggagaccaccgagaacgacgacgacguguacagaagccuggaggagcuggccgacgagcacgaccugggcgaggacaucuacgacugcgugcccugcgaggacggcggcgacgacaucuacgaggacaucaucaagguggaggugcagcagcccaugaucagauacaugcagaagaugggcaugaccgaggacgacaagagaaacugcugccugcuggagauccaggagaccgaggccaaguacuacagaacccuggaggacaucgagaagaacuacaugagcccccugagacuggugcugagccccgccgacauggccgccguguucaucaaccuggaggaccugaucaaggugcaccacagcuuccugagagccaucgacgugagcgugauggugggcggcagcacccuggccaagguguuccuggacuucaaggagagacugcugaucuacggcgaguacugcagccacauggagcacgcccagaacacccugaaccagcugcuggccagcagagaggacuucagacagaagguggaggagugcacccugaaggugcaggacggcaaguucaagcugcaggaccugcugguggugcccaugcagagagugcugaaguaccaccugcugcugaaggagcugcugagccacagcgccgagagacccgagagacagcagcugaaggaggcccuggaggccaugcaggaccuggccauguacaucaacgaggugaagagagacaaggagacccugagaaagaucagcgaguuccagagcagcaucgagaaccugcaggugaagcuggaggaguucggcagacccaagaucgacggcgagcugaaggugagaagcaucgugaaccacaccaagcaggacagauaccuguuccuguucgacaagguggugaucgugugcaagagaaagggcuacagcuacgagcugaaggagaucaucgagcugcuguuccacaagaugaccgacgaccccaugaacaacaaggacgugaagaagagccacggcaagauguggagcuacggcuucuaccugauccaccugcagggcaagcagggcuuccaguucuucugcaagaccgaggacaugaagagaaaguggauggagcaguucgagauggccaugagcaacaucaagcccgacaaggccaacgccaaccaccacagcuuccagauguacaccuucgacaagaccaccaacugcaaggccugcaagauguuccugagaggcaccuucuaccagggcuacaugugcaccaagugcggcgugggcgcccacaaggagugccuggaggugaucccccccugcaaguucaccagccccgccgaccuggacgccagcggcgccggccccggccccaagaugguggccaugcagaacuaccacggcaaccccgccccccccggcaagcccgugcugaccuuccagaccggcgacgugcuggagcugcugagaggcgaccccgagagccccuggugggagggcagacuggugcagaccagaaagagcggcuacuuccccagcagcagcgugaagcccugccccguggacggcagaccccccaucagcagaccccccagcagagagaucgacuacaccgccuaccccugguucgccggcaacauggagagacagcagaccgacaaccugcugaagagccacgccagcggcaccuaccugaucagagagagacccgccgaggccgagagauucgccaucagcaucaaguucaacgacgaggugaagcacaucaaggugguggagaaggacaacuggauccacaucaccgaggccaagaaguucgacagccugcuggagcugguggaguacuaccagugccacagccugaaggagagcuucaagcagcuggacaccacccugaaguaccccuacaagagcagagagagaagcgccagcagagccagcagcagaagccccgccagcugcgccagcuacaacuucagcuuccugagcccccagggccugagcuucgccagccagggccccagcgcccccuucuggagcguguucacccccagagugaucggcaccgccguggccagauacaacuucgccgccagagacaugagagagcugagccugagagagggcgacguggugagaaucuacagcagaaucggcggcgaccagggcugguggaagggcgagaccaacggcagaaucggcugguuccccagcaccuacguggaggaggagggcauccaguaa

SEQ ID NO: 25508 - RNA, 2520 nt, Artificial Sequence
  VAV3__Homo_sapiens__XP_011538805
augacccagagccugagcuaccuggccaccagagccgcccccuucaagaaggagagaacccuguacgaccugaucagcauguaccugaagcuggagcacacccagagcagcgugauccugggcgugagcgugagcagcggcagccccgcccugcagauccugcacagccugcccgugugccugcagcccgccggcggccagagccugagaaagaacagacacggcagcggcgagagccacaccuaccugaaguuccugugccugaagaacaucagaaccuuccugaccgccugcugcgagaccuucggcaugagaaagagcgagcuguucgaggccuucgaccuguucgacgugagagacuucggcaaggugaucgagacccugagcagacugagcagaacccccaucgcccuggccaccggcaucagacccuuccccaccgaggagagcaucaacgacgaggacaucuacaagggccugcccgaccugaucgacgagacccugguggaggacgaggaggaccuguacgacugcguguacggcgaggacgagggcggcgagguguacgaggaccugaugaaggccgaggaggcccaccagcccaagugccccgagaacgacaucagaagcugcugccuggccgagaucaagcagaccgaggagaaguacaccgagacccuggagagcaucgagaaguacuucauggccccccugaagagauuccugaccgccgccgaguucgacagcguguucaucaacauccccgagcuggugaagcugcacagaaaccugaugcaggagauccacgacagcaucgugaacaagaacgaccagaaccuguaccagguguucaucaacuacaaggagagacuggugaucuacggccaguacugcagcggcguggagagcgccaucagcagccuggacuacaucagcaagaccaaggaggacgugaagcugaagcuggaggagugcagcaagagagccaacaacggcaaguucacccugagagaccugcugguggugcccaugcagagagugcugaaguaccaccugcugcugcaggagcuggugaagcacaccaccgaccccaccgagaaggccaaccugaagcuggcccuggacgccaugaaggaccuggcccaguacgugaacgaggugaagagagacaacgagacccugagagagaucaagcaguuccagcugagcaucgagaaccugaaccagcccgugcugcuguucggcagaccccagggcgacggcgagaucagaaucaccacccuggacaagcacaccaagcaggagagacacaucuuccuguucgaccuggccgugaucgugugcaagagaaagggcgacaacuacgagaugaaggagaucaucgaccugcagcaguacaagaucgccaacaaccccaccaccgacaaggagaacaagaaguggagcuacggcuucuaccugauccacacccagggccagaacggccuggaguucuacugcaagaccaaggaccugaagaagaaguggcuggagcaguucgagauggcccugagcaacaucagacccgacuacgccgacagcaacuuccacgacuucaagaugcacaccuucaccagagugaccagcugcaaggugugccagaugcugcugagaggcaccuucuaccagggcuaccugugcuucaagugcggcgccagagcccacaaggagugccugggcagaguggacaacugcggcagagugaacagcggcggccugcccaagaugcaggugaucagaaacuacagcggcacccccccccccgcccugcacgagggccccccccugcagcugcaggccggcgacaccguggagcugcugaagggcgacgcccacagccuguucuggcagggcagaaaccuggccagcggcgaggugggcuucuuccccagcgacgccgugaagcccugccccugcgugcccaagcccguggacuacagcugccagcccugguacgccggcgccauggagagacugcaggccgagaccgagcugaucaacagagugaacagcaccuaccuggugagacacagaaccaaggagagcggcgaguacgccaucagcaucaaguacaacaacgaggccaagcacaucaagauccugaccagagacggcuucuuccacaucgccgagaacagaaaguucaagagccugauggagcugguggaguacuacaagcaccacagccugaaggagggcuucagaacccuggacaccacccugcaguuccccuacaaggagcccgagcacagcgccggccagagaggcaacagagccggcaacagccugcugagccccaaggugcugggcaucgccaucgccagauacgacuucugcgccagagacaugagagagcugagccugcugaagggcgacguggugaagaucuacaccaagaugagcgccaacggcugguggagaggcgaggugaacggcagagugggcugguuccccagcaccuacguggaggaggacgaguaa

SEQ ID NO: 25509 - RNA, 1005 nt, Artificial Sequence
  VAX1__Homo_sapiens__NP_001106175
auguucggcaagcccgacaagauggacgugagaugccacagcgacgccgaggccgccagagugagcaagaacgcccacaaggagagcagagagagcaagggcgccgagggcaaccugcccgccgccuuccugaaggagccccagggcgccuucagcgccagcggcgccgccgaggacugcaacaagagcaagagcaacagcgccgccgaccccgacuacugcagaagaauccuggugagagacgccaagggcagcaucagagagaucauccugcccaagggccuggaccuggacagacccaagagaaccagaaccagcuucaccgccgagcagcuguacagacuggagauggaguuccagagaugccaguacguggugggcagagagagaaccgagcuggccagacagcugaaccugagcgagacccaggugaaggugugguuccagaacagaagaaccaagcagaagaaggaccagggcaaggacagcgagcugagaagcguggugagcgagaccgccgccaccugcagcgugcugagacugcuggagcagggcagacugcugagcccccccggccugcccgcccugcugccccccugcgccaccggcgcccugggcagcgcccugagaggccccagccugcccgcccugggcgccggcgccgccgccggcagcgccgccgccgccgccgccgccgcccccggccccgccggcgccgccagcccccacccccccgccgugggcggcgcccccggccccggccccgccggccccggcggccugcacgccggcgcccccgccgccggccacagccuguucagccugcccgugcccagccugcugggcagcguggccagcagacugagcagcgccccccugaccauggccggcagccuggccggcaaccugcaggagcugagcgccagauaccugagcagcagcgccuucgagcccuacagcagaaccaacaacaaggagggcgccgagaagaaggcccuggacuaa

SEQ ID NO: 25510 - RNA, 873 nt, Artificial Sequence
  VAX2__Homo_sapiens__NP_036608
augggcgacggcggcgccgagagagacagaggccccgccagaagagccgagagcggcggcggcggcggcagaugcggcgacagaagcggcgccggcgaccugagagccgacggcggcggccacagccccaccgagguggccggcaccagcgccagcagccccgccggcagcagagagagcggcgccgacagcgacggccagcccggccccggcgaggccgaccacugcagaagaauccuggugagagacgccaagggcaccaucagagagaucgugcugcccaagggccuggaccuggacagacccaagagaaccagaaccagcuucaccgccgagcagcuguacagacuggagauggaguuccagagaugccaguacguggugggcagagagagaaccgagcuggccagacagcugaaccugagcgagacccaggugaaggugugguuccagaacagaagaaccaagcagaagaaggaccagagcagagaccuggagaagagagccagcagcagcgccagcgaggccuucgccaccagcaacauccugagacugcuggagcagggcagacugcugagcgugcccagagcccccagccugcuggcccugacccccagccugcccggccugcccgccagccacagaggcaccagccugggcgaccccagaaacagcagccccagacugaacccccugagcagcgccagcgccagccccccccugccccccccccugcccgccgugugcuucagcagcgccccccugcuggaccugcccgccggcuacgagcugggcagcagcgccuucgagcccuacagcuggcuggagagaaaggugggcagcgccagcagcugcaagaaggccaacaccuaa

SEQ ID NO: 25511 - RNA, 702 nt, Artificial Sequence
  VBP1__Homo_sapiens__NP_001290472
augaacgugcacggcgacggcgaggccggccugcaggugagaaccagccagagcagaaaccccggcggcagaagacccggcagacagagcagagccagaauccccaagauggccgccgugaaggacagcugcggcaagggcgagauggccaccggcaacggcagaagacugcaccugggcauccccgaggccguguucguggaggacguggacagcuucaugaagcagcccggcaacgagaccgccgacaccgugcugaagaagcuggacgagcaguaccagaaguacaaguucauggagcugaaccuggcccagaagaagagaagacugaagggccagauccccgagaucaagcagacccuggagauccugaaguacaugcagaagaagaaggagagcaccaacagcauggagaccagauuccugcuggccgacaaccuguacugcaaggccagcgugccccccaccgacaaggugugccuguggcugggcgccaacgugaugcuggaguacgacaucgacgaggcccaggcccugcuggagaagaaccugagcaccgccaccaagaaccuggacagccuggaggaggaccuggacuuccugagagaccaguucaccaccaccgaggugaacauggccagaguguacaacugggacgugaagagaagaaacaaggacgacagcaccaagaacaaggccuaa

SEQ ID NO: 25512 - RNA, 1968 nt, Artificial Sequence
  VCAN__Homo_sapiens__NP_001119808
auguucaucaacaucaagagcauccuguggaugugcagcacccugaucgugacccacgcccugcacaaggugaaggugggcaagagcccccccgugagaggcagccugagcggcaaggugagccugcccugccacuucagcaccaugcccacccugccccccagcuacaacaccagcgaguuccugagaaucaaguggagcaagaucgagguggacaagaacggcaaggaccugaaggagaccaccgugcugguggcccagaacggcaacaucaagaucggccaggacuacaagggcagagugagcgugcccacccaccccgaggccgugggcgacgccagccugaccguggugaagcugcuggccagcgacgccggccuguacagaugcgacgugauguacggcaucgaggacacccaggacaccgugagccugaccguggacggcgugguguuccacuacagagccgccaccagcagauacacccugaacuucgaggccgcccagaaggccugccuggacgugggcgccgugaucgccacccccgagcagcuguucgccgccuacgaggacggcuucgagcagugcgacgccggcuggcuggccgaccagaccgugagauaccccaucagagcccccagagugggcugcuacggcgacaagaugggcaaggccggcgugagaaccuacggcuucagaagcccccaggagaccuacgacguguacugcuacguggaccaccuggacggcgacguguuccaccugaccgugcccagcaaguucaccuucgaggaggccgccaaggagugcgagaaccaggacgccagacuggccaccgugggcgagcugcaggccgccuggagaaacggcuucgaccagugcgacuacggcuggcugagcgacgccagcgugagacaccccgugaccguggccagagcccagugcggcggcggccugcugggcgugagaacccuguacagauucgagaaccagaccggcuuccccccccccgacagcagauucgacgccuacugcuucaagagacccgacagaugcaagaugaaccccugccugaacggcggcaccugcuaccccaccgagaccagcuacgugugcaccugcgugcccggcuacagcggcgaccagugcgagcuggacuucgacgagugccacagcaaccccugcagaaacggcgccaccugcguggacggcuucaacaccuucagaugccugugccugcccagcuacgugggcgcccugugcgagcaggacaccgagaccugcgacuacggcuggcacaaguuccagggccagugcuacaaguacuucgcccacagaagaaccugggacgccgccgagagagagugcagacugcagggcgcccaccugaccagcauccugagccacgaggagcagauguucgugaacagagugggccacgacuaccaguggaucggccugaacgacaagauguucgagcacgacuucagauggaccgacggcagcacccugcaguacgagaacuggagacccaaccagcccgacagcuucuucagcgccggcgaggacugcguggugaucaucuggcacgagaacggccaguggaacgacgugcccugcaacuaccaccugaccuacaccugcaagaagggcaccguggccugcggccagccccccgugguggagaacgccaagaccuucggcaagaugaagcccagauacgagaucaacagccugaucagauaccacugcaaggacggcuucauccagagacaccugcccaccaucagaugccugggcaacggcagaugggccauccccaagaucaccugcaugaaccccagcgccuaccagagaaccuacagcaugaaguacuucaagaacagcagcagcgccaaggacaacagcaucaacaccagcaagcacgaccacagauggagcagaagauggcaggagagcagaagauaa

SEQ ID NO: 25513 - RNA, 3201 nt, Artificial Sequence
  VCL__Homo_sapiens__NP_003364
augcccguguuccacaccagaaccaucgagagcauccuggagcccguggcccagcagaucagccaccuggugaucaugcacgaggagggcgagguggacggcaaggccauccccgaccugaccgcccccguggccgccgugcaggccgccgugagcaaccuggugagagugggcaaggagaccgugcagaccaccgaggaccagauccugaagagagacaugccccccgccuucaucaagguggagaacgccugcaccaagcuggugcaggccgcccagaugcugcagagcgaccccuacagcgugcccgccagagacuaccugaucgacggcagcagaggcauccugagcggcaccagcgaccugcugcugaccuucgacgaggccgaggugagaaagaucaucagagugugcaagggcauccuggaguaccugaccguggccgaggugguggagaccauggaggaccuggugaccuacaccaagaaccugggccccggcaugaccaagauggccaagaugaucgacgagagacagcaggagcugacccaccaggagcacagagugaugcuggugaacagcaugaacaccgugaaggagcugcugcccgugcugaucagcgccaugaagaucuucgugaccaccaagaacagcaagaaccagggcaucgaggaggcccugaagaacagaaacuucaccguggagaagaugagcgccgagaucaacgagaucaucagagugcugcagcugaccagcugggacgaggacgccugggccagcaaggacaccgaggccaugaagagagcccuggccagcaucgacagcaagcugaaccaggccaagggcuggcugagagaccccagcgccagccccggcgacgccggcgagcaggccaucagacagauccuggacgaggccggcaaggugggcgagcugugcgccggcaaggagagaagagagauccugggcaccugcaagaugcugggccagaugaccgaccagguggccgaccugagagccagaggccagggcagcagccccguggccaugcagaaggcccagcaggugagccagggccuggacgugcugaccgccaagguggagaacgccgccagaaagcuggaggccaugaccaacagcaagcagagcaucgccaagaagaucgacgccgcccagaacuggcuggccgaccccaacggcggccccgagggcgaggagcagaucagaggcgcccuggccgaggccagaaagaucgccgagcugugcgacgaccccaaggagagagacgacauccugagaagccugggcgagaucagcgcccugaccagcaagcuggccgaccugagaagacagggcaagggcgacagccccgaggccagagcccuggccaagcagguggccaccgcccugcagaaccugcagaccaagaccaacagagccguggccaacagcagacccgccaaggccgccgugcaccuggagggcaagaucgagcaggcccagagauggaucgacaaccccaccguggacgacagaggcgugggccaggccgccaucagaggccugguggccgagggccacagacuggccaacgugaugaugggccccuacagacaggaccugcuggccaagugcgacagaguggaccagcugaccgcccagcuggccgaccuggccgccagaggcgagggcgagagcccccaggccagagcccuggccagccagcugcaggacagccugaaggaccugaaggccagaaugcaggaggccaugacccaggaggugagcgacguguucagcgacaccaccacccccaucaagcugcuggccguggccgccaccgccccccccgacgcccccaacagagaggagguguucgacgagagagccgccaacuucgagaaccacagcggcaagcugggcgccaccgccgagaaggccgccgccgugggcaccgccaacaagagcaccguggagggcauccaggccagcgugaagaccgccagagagcugaccccccagguggugagcgccgccagaauccugcugagaaaccccggcaaccaggccgccuacgagcacuucgagaccaugaagaaccaguggaucgacaacguggagaagaugaccggccugguggacgaggccaucgacaccaagagccugcuggacgccagcgaggaggccaucaagaaggaccuggacaagugcaagguggccauggccaacauccagccccagaugcugguggccggcgccaccagcaucgccagaagagccaacagaauccugcugguggccaagagagagguggagaacagcgaggaccccaaguucagagaggccgugaaggccgccagcgacgagcugagcaagaccaucagccccauggugauggacgccaaggccguggccggcaacaucagcgaccccggccugcagaagagcuuccuggacagcggcuacagaauccugggcgccguggccaaggugagagaggccuuccagccccaggagcccgacuuccccccccccccccccgaccuggagcagcugagacugaccgacgagcuggccccccccaagcccccccugcccgagggcgaggugcccccccccagaccccccccccccgaggagaaggacgaggaguuccccgagcagaaggccggcgaggugaucaaccagcccaugaugauggccgccagacagcugcacgacgaggccagaaaguggagcagcaagggcaacgacaucaucgccgccgccaagagaauggcccugcugauggccgagaugagcagacuggugagaggcggcagcggcaccaagagagcccugauccagugcgccaaggacaucgccaaggccagcgacgaggugaccagacuggccaaggagguggccaagcagugcaccgacaagagaaucagaaccaaccugcugcaggugugcgagagaauccccaccaucagcacccagcugaagauccugagcaccgugaaggccaccaugcugggcagaaccaacaucagcgacgaggagagcgagcaggccaccgagaugcuggugcacaacgcccagaaccugaugcagagcgugaaggagaccgugagagaggccgaggccgccagcaucaagaucagaaccgacgccggcuucacccugagaugggugagaaagacccccugguaccaguaa

SEQ ID NO: 25514 - RNA, 2421 nt, Artificial Sequence
  VCP__Homo_sapiens__NP_009057
auggccagcggcgccgacagcaagggcgacgaccugagcaccgccauccugaagcagaagaacagacccaacagacugaucguggacgaggccaucaacgaggacaacagcguggugagccugagccagcccaagauggacgagcugcagcuguucagaggcgacaccgugcugcugaagggcaagaagagaagagaggccgugugcaucgugcugagcgacgacaccugcagcgacgagaagaucagaaugaacagaguggugagaaacaaccugagagugagacugggcgacgugaucagcauccagcccugccccgacgugaaguacggcaagagaauccacgugcugcccaucgacgacaccguggagggcaucaccggcaaccuguucgagguguaccugaagcccuacuuccuggaggccuacagacccaucagaaagggcgacaucuuccuggugagaggcggcaugagagccguggaguucaaggugguggagaccgaccccagccccuacugcaucguggcccccgacaccgugauccacugcgagggcgagcccaucaagagagaggacgaggaggagagccugaacgaggugggcuacgacgacaucggcggcugcagaaagcagcuggcccagaucaaggagaugguggagcugccccugagacaccccgcccuguucaaggccaucggcgugaagccccccagaggcauccugcuguacggcccccccggcaccggcaagacccugaucgccagagccguggccaacgagaccggcgccuucuucuuccugaucaacggccccgagaucaugagcaagcuggccggcgagagcgagagcaaccugagaaaggccuucgaggaggccgagaagaacgcccccgccaucaucuucaucgacgagcuggacgccaucgcccccaagagagagaagacccacggcgagguggagagaagaaucgugagccagcugcugacccugauggacggccugaagcagagagcccacgugaucgugauggccgccaccaacagacccaacagcaucgaccccgcccugagaagauucggcagauucgacagagagguggacaucggcauccccgacgccaccggcagacuggagauccugcagauccacaccaagaacaugaagcuggccgacgacguggaccuggagcagguggccaacgagacccacggccacgugggcgccgaccuggccgcccugugcagcgaggccgcccugcaggccaucagaaagaagauggaccugaucgaccuggaggacgagaccaucgacgccgaggugaugaacagccuggccgugaccauggacgacuucagaugggcccugagccagagcaaccccagcgcccugagagagaccgugguggaggugccccaggugaccugggaggacaucggcggccuggaggacgugaagagagagcugcaggagcuggugcaguaccccguggagcaccccgacaaguuccugaaguucggcaugacccccagcaagggcgugcuguucuacggcccccccggcugcggcaagacccugcuggccaaggccaucgccaacgagugccaggccaacuucaucagcaucaagggccccgagcugcugaccaugugguucggcgagagcgaggccaacgugagagagaucuucgacaaggccagacaggccgcccccugcgugcuguucuucgacgagcuggacagcaucgccaaggccagaggcggcaacaucggcgacggcggcggcgccgccgacagagugaucaaccagauccugaccgagauggacggcaugagcaccaagaagaacguguucaucaucggcgccaccaacagacccgacaucaucgaccccgccauccugagacccggcagacuggaccagcugaucuacaucccccugcccgacgagaagagcagaguggccauccugaaggccaaccugagaaagagccccguggccaaggacguggaccuggaguuccuggccaagaugaccaacggcuucagcggcgccgaccugaccgagaucugccagagagccugcaagcuggccaucagagagagcaucgagagcgagaucagaagagagagagagagacagaccaaccccagcgccauggagguggaggaggacgaccccgugcccgagaucagaagagaccacuucgaggaggccaugagauucgccagaagaagcgugagcgacaacgacaucagaaaguacgagauguucgcccagacccugcagcagagcagaggcuucggcagcuucagauuccccagcggcaaccagggcggcgccggccccagccagggcagcggcggcggcaccggcggcagcguguacaccgaggacaacgacgacgaccuguacggcuaa

SEQ ID NO: 25515 - RNA, 420 nt, Artificial Sequence
  VCX2__Homo_sapiens__NP_057462
augagccccaagcccagagccagcggcccccccgccaaggccaccgaggccggcaagagaaagagcagcagccagcccagccccagcgaccccaagaagaagaccaccaagguggccaagaagggcaaggccgugagaagaggcagaagaggcaagaagggcgccgccaccaagauggccgccgugaccgcccccgaggccgagagcgcccccgccgcccccggccccagcgaccagcccagccaggagcugccccagcacgagcugccccccgaggagcccgugagcgagggcacccagcacgacccccugagccaggagagcgagguggaggagccccugagccaggagagcgagguggaggagccccugaccguguggauggccagcuucagccccgugagcgagagcaccgacuaa

SEQ ID NO: 25516 - RNA, 561 nt, Artificial Sequence
  VCX3A__Homo_sapiens__NP_057463
augagccccaagcccagagccagcggcccccccgccaaggccaccgaggccggcaagagaaagagcagcagccagcccagccccagcgaccccaagaagaagaccaccaagguggccaagaagggcaaggccgugagaagaggcagaagaggcaagaagggcgccgccaccaagauggccgccgugaccgcccccgaggccgagagcggccccgccgcccccggccccagcgaccagcccagccaggagcugccccagcacgagcugccccccgaggagcccgugagcgagggcacccagcacgacccccugagccaggagagcgagcuggaggagccccugagccaggagagcgagguggaggagccccugagccaggagagccagguggaggagccccugagccaggagagcgagguggaggagccccugagccaggagagccagguggaggagccccugagccaggagagcgagguggaggagccccugagccaggagagccagguggaggagccccugagccaggagagcgagauggaggagcugcccagcguguaa

SEQ ID NO: 25517 - RNA, 741 nt, Artificial Sequence
  VCX3B__Homo_sapiens__NP_001001888
augagccccaagcccagagccagcggcccccccgccaaggccaaggaggccggcaagagaaagagcagcagccagcccagccccagcgaccccaagaagaagaccaccaagguggccaagaagggcaaggccgugagaagaggcagaagaggcaagaagggcgccgccaccaagauggccgccgugaccgcccccgaggccgagagcggccccgccgcccccggccccagcgaccagcccagccaggagcugccccagcacgagcugccccccgaggagcccgugagcgagggcacccagcacgacccccugagccaggagagcgagcuggaggagccccugagccaggagagcgagguggaggagccccugagccaggagagccagguggaggagccccugagccaggagagcgagguggaggagccccugagccaggagagccagguggaggagccccugagccaggagagcgagguggaggagccccugagccaggagagcgagguggaggagccccugagccaggagagccagguggaggagccccugagccaggagagcgagguggaggagccccugagccaggagagccagguggaggagccccugagccaggagagcgagauggaggagccccugagccaggagagccagguggaggagccccugagccaggagagcgagauggaggagccccugagccaggagagcgagauggaggagcugcccagcguguaa

SEQ ID NO: 25518 - RNA, 621 nt, Artificial Sequence
  VCX__Homo_sapiens__NP_038480
augagccccaagcccagagccagcggcccccccgccaaggccaccgaggccggcaagagaaagagcagcagccagcccagccccagcgaccccaagaagaagaccaccaagguggccaagaagggcaaggccgugagaagaggcagaagaggcaagaagggcgccgccaccaagauggccgccgugaccgcccccgaggccgagagcgcccccgccgcccccggccccagcgaccagcccagccaggagcugccccagcacgagcugccccccgaggagcccgugagcgagggcacccagcacgacccccugagccaggaggccgagcuggaggagccccugagccaggagagcgagguggaggagccccugagccaggagagccagguggaggagccccugagccaggagagcgagguggaggagccccugagccaggagagccagguggaggagccccugagccaggagagcgagguggaggagccccugagccaggagagccagguggaggagccccugagccaggagagcgagauggaggagccccugagccaggagagccagguggaggagccccccagccaggagagcgagauggaggagcugcccagcguguaa

SEQ ID NO: 25519 - RNA, 378 nt, Artificial Sequence
  VCY__Homo_sapiens__NP_004670
augagccccaagcccagagccagcggcccccccgccaaggccaaggagaccggcaagagaaagagcagcagccagcccagccccagcggccccaagaagaagaccaccaagguggccgagaagggcgaggccgugagaggcggcagaagaggcaagaagggcgccgccaccaagauggccgccgugaccgcccccgaggccgagagcggccccgccgcccccggccccagcgaccagcccagccaggagcugccccagcacgagcugccccccgaggagcccgugagcgagggcacccagcacgacccccugagccaggagagcgagcuggaggagccccugagcaagggcagacccagcaccccccugagccccuaa

SEQ ID NO: 25520 - RNA, 852 nt, Artificial Sequence
  VDAC1__Homo_sapiens__XP_005272132
auggccgugccccccaccuacgccgaccugggcaagagcgccagagacguguucaccaagggcuacggcuucggccugaucaagcuggaccugaagaccaagagcgagaacggccuggaguucaccagcagcggcagcgccaacaccgagaccaccaaggugaccggcagccuggagaccaaguacagauggaccgaguacggccugaccuucaccgagaaguggaacaccgacaacacccugggcaccgagaucaccguggaggaccagcuggccagaggccugaagcugaccuucgacagcagcuucagccccaacaccggcaagaagaacgccaagaucaagaccggcuacaagagagagcacaucaaccugggcugcgacauggacuucgacaucgccggccccagcaucagaggcgcccuggugcugggcuacgagggcuggcuggccggcuaccagaugaacuucgagaccgccaagagcagagugacccagagcaacuucgccgugggcuacaagaccgacgaguuccagcugcacaccaacgugaacgacggcaccgaguucggcggcagcaucuaccagaaggugaacaagaagcuggagaccgccgugaaccuggccuggaccgccggcaacagcaacaccagauucggcaucgccgccaaguaccagaucgaccccgacgccugcuucagcgccaaggugaacaacagcagccugaucggccugggcuacacccagacccugaagcccggcaucaagcugacccugagcgcccugcuggacggcaagaacgugaacgccggcggccacaagcugggccugggccuggaguuccaggccuaa

SEQ ID NO: 25521 - RNA, 930 nt, Artificial Sequence
  VDAC2__Homo_sapiens__NP_001171712
augagcuggugcaacgagcugagacugcccgcccugaagcagcacagcaucggcagaggccuggagagccacaucaccaugugcaucccccccagcuacgccgaccugggcaaggccgccagagacaucuucaacaagggcuucggcuucggccuggugaagcuggacgugaagaccaagagcugcagcggcguggaguucagcaccagcggcagcagcaacaccgacaccggcaaggugaccggcacccuggagaccaaguacaaguggugcgaguacggccugaccuucaccgagaaguggaacaccgacaacacccugggcaccgagaucgccaucgaggaccagaucugccagggccugaagcugaccuucgacaccaccuucagccccaacaccggcaagaagagcggcaagaucaagagcagcuacaagagagagugcaucaaccugggcugcgacguggacuucgacuucgccggccccgccauccacggcagcgccguguucggcuacgagggcuggcuggccggcuaccagaugaccuucgacagcgccaagagcaagcugaccagaaacaacuucgccgugggcuacagaaccggcgacuuccagcugcacaccaacgugaacgacggcaccgaguucggcggcagcaucuaccagaaggugugcgaggaccuggacaccagcgugaaccuggccuggaccagcggcaccaacugcaccagauucggcaucgccgccaaguaccagcuggaccccaccgccagcaucagcgccaaggugaacaacagcagccugaucggcgugggcuacacccagacccugagacccggcgugaagcugacccugagcgcccugguggacggcaagagcaucaacgccggcggccacaaggugggccuggcccuggagcuggaggccuaa

SEQ ID NO: 25522 - RNA, 1284 nt, Artificial Sequence
  VDR__Homo_sapiens__NP_000367
auggaggccauggccgccagcaccagccugcccgaccccggcgacuucgacagaaacgugcccagaaucugcggcgugugcggcgacagagccaccggcuuccacuucaacgccaugaccugcgagggcugcaagggcuucuucagaagaagcaugaagagaaaggcccuguucaccugccccuucaacggcgacugcagaaucaccaaggacaacagaagacacugccaggccugcagacugaagagaugcguggacaucggcaugaugaaggaguucauccugaccgacgaggaggugcagagaaagagagagaugauccugaagagaaaggaggaggaggcccugaaggacagccugagacccaagcugagcgaggagcagcagagaaucaucgccauccugcuggacgcccaccacaagaccuacgaccccaccuacagcgacuucugccaguucagaccccccgugagagugaacgacggcggcggcagccaccccagcagacccaacagcagacacacccccagcuucagcggcgacagcagcagcagcugcagcgaccacugcaucaccagcagcgacaugauggacagcagcagcuucagcaaccuggaccugagcgaggaggacagcgacgaccccagcgugacccuggagcugagccagcugagcaugcugccccaccuggccgaccuggugagcuacagcauccagaaggugaucggcuucgccaagaugauccccggcuucagagaccugaccagcgaggaccagaucgugcugcugaagagcagcgccaucgaggugaucaugcugagaagcaacgagagcuucaccauggacgacaugagcuggaccugcggcaaccaggacuacaaguacagagugagcgacgugaccaaggccggccacagccuggagcugaucgagccccugaucaaguuccaggugggccugaagaagcugaaccugcacgaggaggagcacgugcugcugauggccaucugcaucgugagccccgacagacccggcgugcaggacgccgcccugaucgaggccauccaggacagacugagcaacacccugcagaccuacaucagaugcagacaccccccccccggcagccaccugcuguacgccaagaugauccagaagcuggccgaccugagaagccugaacgaggagcacagcaagcaguacagaugccugagcuuccagcccgagugcagcaugaagcugaccccccuggugcuggagguguucggcaacgagaucagcuaa

SEQ ID NO: 25523 - RNA, 1239 nt, Artificial Sequence
  VEGFA__Homo_sapiens__NP_001020537
augaccgacagacagaccgacaccgcccccagccccagcuaccaccugcugcccggcagaagaagaaccguggacgccgccgccagcagaggccagggccccgagcccgcccccggcggcggcguggagggcgugggcgccagaggcguggcccugaagcuguucgugcagcugcugggcugcagcagauucggcggcgccguggugagagccggcgaggccgagcccagcggcgccgccagaagcgccagcagcggcagagaggagccccagcccgaggagggcgaggaggaggaggagaaggaggaggagagaggcccccaguggagacugggcgccagaaagcccggcagcuggaccggcgaggccgccgugugcgccgacagcgcccccgccgccagagccccccaggcccuggccagagccagcggcagaggcggcagaguggccagaagaggcgccgaggagagcggccccccccacagccccagcagaagaggcagcgccagcagagccggccccggcagagccagcgagaccaugaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagauaa

SEQ ID NO: 25524 - RNA, 567 nt, Artificial Sequence
  VEGFB__Homo_sapiens__NP_001230662
augagcccccugcugagaagacugcugcuggccgcccugcugcagcuggcccccgcccaggcccccgugagccagcccgacgcccccggccaccagagaaagguggugagcuggaucgacguguacaccagagccaccugccagcccagagaggugguggugccccugaccguggagcugaugggcaccguggccaagcagcuggugcccagcugcgugaccgugcagagaugcggcggcugcugccccgacgacggccuggagugcgugcccaccggccagcaccaggugagaaugcagauccugaugaucagauaccccagcagccagcugggcgagaugagccuggaggagcacagccagugcgagugcagacccaagaagaaggacagcgccgugaagcccgacagccccagaccccugugccccagaugcacccagcaccaccagagacccgaccccagaaccugcagaugcagaugcagaagaagaagcuuccugagaugccagggcagaggccuggagcugaaccccgacaccugcagaugcagaaagcugagaagauaa

SEQ ID NO: 25525 - RNA, 1260 nt, Artificial Sequence
  VEGFC__Homo_sapiens__NP_005420
augcaccugcugggcuucuucagcguggccugcagccugcuggccgccgcccugcugcccggccccagagaggcccccgccgccgccgccgccuucgagagcggccuggaccugagcgacgccgagcccgacgccggcgaggccaccgccuacgccagcaaggaccuggaggagcagcugagaagcgugagcagcguggacgagcugaugaccgugcuguaccccgaguacuggaagauguacaagugccagcugagaaagggcggcuggcagcacaacagagagcaggccaaccugaacagcagaaccgaggagaccaucaaguucgccgccgcccacuacaacaccgagauccugaagagcaucgacaacgaguggagaaagacccagugcaugcccagagaggugugcaucgacgugggcaaggaguucggcguggccaccaacaccuucuucaagccccccugcgugagcguguacagaugcggcggcugcugcaacagcgagggccugcagugcaugaacaccagcaccagcuaccugagcaagacccuguucgagaucaccgugccccugagccagggccccaagcccgugaccaucagcuucgccaaccacaccagcugcagaugcaugagcaagcuggacguguacagacaggugcacagcaucaucagaagaagccugcccgccacccugccccagugccaggccgccaacaagaccugccccaccaacuacauguggaacaaccacaucugcagaugccuggcccaggaggacuucauguucagcagcgacgccggcgacgacagcaccgacggcuuccacgacaucugcggccccaacaaggagcuggacgaggagaccugccagugcgugugcagagccggccugagacccgccagcugcggcccccacaaggagcuggacagaaacagcugccagugcgugugcaagaacaagcuguuccccagccagugcggcgccaacagagaguucgacgagaacaccugccagugcgugugcaagagaaccugccccagaaaccagccccugaaccccggcaagugcgccugcgagugcaccgagagcccccagaagugccugcugaagggcaagaaguuccaccaccagaccugcagcugcuacagaagacccugcaccaacagacagaaggccugcgagcccggcuucagcuacagcgaggaggugugcagaugcgugcccagcuacuggaagagaccccagaugagcuaa

SEQ ID NO: 25526 - RNA, 777 nt, Artificial Sequence
  VENTX__Homo_sapiens__NP_055283
augagacugagcagcagcccccccagaggcccccagcagcugagcagcuucggcagcguggacuggcugagccagagcagcugcagcggccccacccacacccccagacccgccgacuucagccugggcagccugcccggccccggccagaccagcggcgccagagagcccccccaggccgugagcaucaaggaggccgccggcagcagcaaccugcccgcccccgagagaaccauggccggccugagcaaggagcccaacacccugagagcccccagagugagaaccgccuucaccauggagcaggugagaacccuggagggcguguuccagcaccaccaguaccugagcccccuggagagaaagagacuggccagagagaugcagcugagcgaggugcagaucaagaccugguuccagaacagaagaaugaagcacaagagacagaugcaggacccccagcugcacagccccuucagcggcagccugcacgccccccccgccuucuacagcaccagcagcggccuggccaacggccugcagcugcugugccccugggccccccugagcggcccccaggcccugaugcugccccccggcagcuucuggggccugugccagguggcccaggaggcccuggccagcgccggcgccagcugcugcggccagccccuggccagccacccccccacccccggcagacccagccugggccccgcccugagcaccggccccagaggccugugcgccaugccccagaccggcgacgccuucuaa

SEQ ID NO: 25527 - RNA, 2367 nt, Artificial Sequence
  VEPH1__Homo_sapiens__NP_001161383
augcaccagcuguucagacuggugcugggccagaaggaccugagcagagccggcgaccuguucagccuggacgacagcgagaucgaggacagccugaccgaggcccuggagcagaucaagaucaucagcagcagcagcgacuaccagaccaacaacaacgaccaggccgugguggagaucugcaucaccagaaucaccaccgccaucagagagaccgagagcaucgagaagcacgccaaggcccuggugggccugugggacagcugccuggagcacaaccugagacccuucggcaaggacgaggacaccccccacgccaagaucgccagcgacaucaugagcugcauccugcagaacuacaacagaccccccgugauggcccuggccauccccaucgccgugaaguuccugcacagaggcaacaaggagcugugcagaaacaugagcaacuaccugagccuggccgccaucaccaaggccgaccugcuggccgaccacaccgaggugaucgugaagagcauccugcagggcaacaccaugcugcugagagugcugcccgccguguacgagaagcagccccagcccaucaacagacaccugaccgagcugcuggcccugaugagccagcuggagcagcccgagcaguaccaccugcugagacugcugcacguggccgccaagaagaagcagcuggagguggugcagaagugcauccccuuccugaucggccaccugaaggacagcacccacaacgacaucauccugaacauccugaucgagaucgccguguacgagcccguggcccugaacagcuuccugcccaugcugaaggagaucggcgagagauuccccuaccugaccggccagauggccagaaucuacggcgccgugggccacguggacgaggagagagccagaagcugccugaccuaccuggugagccagcuggccaacauggagcacagcuuccaccacauccugcugcuggagaucaagagcaucaccgacaccuucagcagcauccugggcccccagagcagagacaucuucagaaugagcaacagcuucaccgccaucgccaagcugcugaccagacagcuggagaacaccaaggccggcagcggcagaagaaagaucagcaccgagaucgaguuccccgagaagcuggaggagaccaagcugaucgugaccgagaacgaggaccacgagaagcugcaggugaagauccaggccuucgaggacaagaucaacgccggcagcaacacccccggcagcaucagaagauacagccugggccaggugagcaaggaggagagaaagaacaucagauucaacagaagcaagagccuggccuuccacaccaugcugaccaagggcgugggcagcgacgacggcgaggacgagaacagaggcgacauccccgccagcaucagccugagcgagaucgacccccugggccagggcaacgacaagcugcccuucaagaccgacaccgagagaagccagcugggcgagagcagcgugagcuaccccaacaucauccacaucgacagcgagaaccugagcgagaccgugaaggagaacagccaggaggagacccccgagaccaccgccagccccaucgaguaccaggacaagcuguaccugcaccugaagaagaaccugagcaaggugaaggccuacgccauggagaucggcaagaagauccccgugcccgaccagugcaccaucgaggacaccgugagaagcugcguggccaagcuguucuucaccugcagccugaagggccacuacugccuguacagcaagagcagcuucauccugaucagccaggagccccagcccuggauccagaucauguuccuguuccagcaggaccuggaccaggugcagcugcaccuggaggaggugagauucuucgacguguucggcuucagcgagaccgccggcgccuggcagugcuucaugugcaacaaccccgagaaggccaccguggugaaccaggacggccagccccugaucgagggcaagcugaaggagaagcaggugagauggaaguucaucaagagauggaagaccagauacuucacccuggccggcaaccagcugcuguuccagaagggcaagagcaaggacgaccccgacgacugccccaucgagcugagcaaggugcagagcgugaaggccguggccaagaagagaagagacagaagccugcccagagccuucgagaucuucaccgacaacaagaccuacguguucaaggccaaggacgagaagaacgccgaggaguggcugcagugcaucaacguggccguggcccaggccaaggagagagagagcagagaggugaccaccuaccuguaa

SEQ ID NO: 25528 - RNA, 2340 nt, Artificial Sequence
  VEZT__Homo_sapiens__NP_060069
augacccccgaguucgacgaggaggugguguucgagaacagcccccuguaccaguaccugcaggaccugggccacaccgacuucgagaucugcagcagccugagccccaagaccgagaagugcaccaccgagggccagcagaagccccccaccagagugcugcccaagcagggcauccugcugaagguggccgagaccaucaagagcuggaucuucuucagccagugcaacaagaaggacgaccugcugcacaagcuggacaucggcuucagacuggacagccugcacaccauccugcagcaggaggugcugcugcaggaggacguggagcugaucgagcugcuggaccccagcauccugagcgccggccagagccagcagcaggagaacggccaccugcccacccugugcagccuggccacccccaacaucugggaccugagcaugcuguucgccuucaucagccugcuggugaugcugcccaccugguggaucgugagcagcuggcugguguggggcgugauccuguucguguaccuggugaucagagcccugagacuguggagaaccgccaagcugcaggugacccugaagaaguacagcgugcaccuggaggacauggccaccaacagcagagccuucaccaaccuggugagaaaggcccugagacugauccaggagaccgaggugaucagcagaggcuucacccuggugagcgccgccugccccuucaacaaggccggccagcaccccagccagcaccugaucggccugagaaaggccguguacagaacccugagagccaacuuccaggccgccagacuggccacccuguacaugcugaagaacuacccccugaacagcgagagcgacaacgugaccaacuacaucugcguggugcccuucaaggagcugggccugggccugagcgaggagcagaucagcgaggaggaggcccacaacuucaccgacggcuucagccugcccgcccugaaggugcuguuccagcuguggguggcccagagcagcgaguucuucagaagacuggcccugcugcugagcaccgccaacagcccccccggcccccugcugacccccgcccugcugccccacagaauccugagcgacgugacccagggccugccccacgcccacagcgccugccuggaggagcugaagagaagcuacgaguucuacagauacuucgagacccagcaccagagcgugccccagugccugagcaagacccagcagaagagcagagagcugaacaacgugcacaccgccgugagaagccugcagcugcaccugaaggcccugcugaacgaggugaucauccuggaggacgagcuggagaagcuggugugcaccaaggagacccaggagcuggugagcgaggccuaccccauccuggagcagaagcugaagcugauccagccccacgugcaggccagcaacaacugcugggaggaggccaucagccagguggacaagcugcugagaagaaacaccgacaagaagggcaagcccgagaucgccugcgagaacccccacugcaccguggugccccugaagcagcccacccugcacaucgccgacaaggaccccauccccgaggagcaggagcuggaggccuacguggacgacaucgacaucgacagcgacuucagaaaggacgacuucuacuaccugagccaggaggacaaggagagacagaagagagagcacgaggagagcaagagagugcugcaggagcugaagagcgugcugggcuucaaggccagcgaggccgagagacagaaguggaagcagcugcuguucagcgaccacgccgugcugaagagccugagccccguggaccccguggagcccaucagcaacagcgagcccagcaugaacagcgacaugggcaaggugagcaagaacgacaccgaggaggagagcaacaagagcgccaccaccgacaacgagaucagcagaaccgaguaccugugcgagaacagccuggagggcaagaacaaggacaacagcagcaacgagguguucccccagggcgccgaggagagaaugugcuaccagugcgagagcgaggacgagccccaggccgacggcagcggccugaccaccgccccccccacccccagagacagccugcagcccagcaucaagcagagacuggccagacugcagcugagccccgacuucaccuucaccgccggccuggccgccgagguggccgccagaagccugagcuucaccaccaugcaggagcagaccuucggcggcgaggaggaggagcagaucaucgaggagaacaagaacgagaucgaggagaaguaa

SEQ ID NO: 25529 - RNA, 1848 nt, Artificial Sequence
  VGF__Homo_sapiens__XP_011514851
augaaggcccugagacugagcgccagcgcccuguucugccugcugcugaucaacggccugggcgccgccccccccggcagacccgaggcccagccccccccccugagcagcgagcacaaggagcccguggccggcgacgccgugcccggccccaaggacggcagcgcccccgaggugagaggcgccagaaacagcgagccccaggacgagggcgagcuguuccagggcguggaccccagagcccuggccgccgugcugcugcaggcccuggacagacccgccagcccccccgcccccagcggcagccagcagggccccgaggaggaggccgccgaggcccugcugaccgagaccgugagaagccagacccacagccugcccgcccccgagagccccgagcccgccgccccccccagaccccagacccccgagaacggccccgaggccagcgaccccagcgaggagcuggaggcccuggccagccugcugcaggagcugagagacuucagccccagcagcgccaagagacagcaggagaccgccgccgccgagaccgagaccagaacccacacccugaccagagugaaccuggagagccccggccccgagagaguguggagagccagcuggggcgaguuccaggccagagugcccgagagagccccccugcccccccccgcccccagccaguuccaggccagaaugcccgacagcggcccccugcccgagacccacaaguucggcgagggcgugagcagccccaagacccaccugggcgaggcccuggccccccugagcaaggccuaccagggcguggccgcccccuuccccaaggccagaagacccgagagcgcccugcugggcggcagcgaggccggcgagagacugcugcagcagggccuggcccagguggaggccggcagaagacaggccgaggccaccagacaggccgccgcccaggaggagagacuggccgaccuggccagcgaccugcugcugcaguaccugcugcagggcggcgccagacagagaggccugggcggcagaggccugcaggaggccgccgaggagagagagagcgccagagaggaggaggaggccgagcaggagagaagaggcggcgaggagagagugggcgaggaggacgaggaggccgccgaggccgaggccgaggccgaggaggccgagagagccagacagaacgcccugcuguucgccgaggaggaggacggcgaggccggcgccgaggacaagagaagccaggaggagacccccggccacagaagaaaggaggccgagggcaccgaggagggcggcgaggaggaggacgacgaggagauggacccccagaccaucgacagccugaucgagcugagcaccaagcugcaccugcccgccgacgacguggugagcaucaucgaggagguggaggagaagagaaagagaaagaagaacgccccccccgagcccgugcccccccccagagccgcccccgcccccacccacgugagaagcccccagccccccccccccgcccccgcccccgccagagacgagcugcccgacuggaacgaggugcugccccccugggacagagaggaggacgagguguacccccccggccccuaccaccccuuccccaacuacaucagacccagaacccugcagccccccagcgcccugagaagaagacacuaccaccacgcccugccccccagcagacacuaccccggcagagaggcccaggccagaagagcccaggaggaggccgaggccgaggagagaagacugcaggagcaggaggagcuggagaacuacaucgagcacgugcugcugagaagacccuaa

SEQ ID NO: 25530 - RNA, 777 nt, Artificial Sequence
  VGLL1__Homo_sapiens__NP_057351
auggaggagaugaagaagaccgccaucagacugcccaagggcaagcagaagcccaucaagaccgaguggaacagcagaugcgugcuguucaccuacuuccagggcgacaucagcagcgugguggacgagcacuucagcagagcccugagcaacaucaagagcccccaggagcugacccccagcagccagagcgagggcgugaugcugaagaacgacgacagcaugagccccaaccaguggagauacagcagccccuggaccaagccccagcccgaggugcccgugaccaacagagccgccaacugcaaccugcacgugcccggccccauggccgugaaccaguucagccccagccuggccagaagagccagcgugagacccggcgagcuguggcacuucagcagccuggccggcaccagcagccuggagcccggcuacagccaccccuuccccgccagacaccuggugcccgagccccagcccgacggcaagagagagccccugcugagccugcugcagcaggacagaugccuggccagaccccaggagagcgccgccagagagaacggcaaccccggccagaucgccggcagcaccggccugcuguucaaccugccccccggcagcgugcacuacaagaagcuguacgugagcagaggcagcgccagcaccagccugcccaacgagacccugagcgagcuggagacccccggcaaguacagccugaccccccccaaccacuggggccacccccacagauaccugcagcaccuguaa

SEQ ID NO: 25531 - RNA, 432 nt, Artificial Sequence
  VGLL2__Homo_sapiens__NP_703154
augagcugccuggacgugauguaccagguguacggccccccccagcccuacuucgccgccgccuacacccccuaccaccagaagcuggccuacuacagcaagaugcaggaggcccaggagugcaacgccagccccagcagcagcggcagcggcagcagcagcuucagcagccagacccccgccagcaucaaggaggaggagggcagccccgagaaggagagaccccccgaggccgaguacaucaacagcagaugcgugcuguucaccuacuuccagggcgacaucagcagcgugguggacgagcacuucagcagagcccugagccagcccagcagcuacagccccagcugcaccagcagcaaggcccccagaagcagcggccccuggagagccagaagauacagccugugcggcgccagccugcugagcuaa

SEQ ID NO: 25532 - RNA, 981 nt, Artificial Sequence
  VGLL3__Homo_sapiens__NP_057290
augagcugcgccgaggugauguaccacccccagcccuacggcgccagccaguaccugcccaaccccauggccgccaccaccugccccaccgccuacuaccagcccgccccccagcccggccagcagaagaagcuggccguguucagcaagaugcaggacagccuggaggugacccugcccagcaagcaggaggaggaggacgaggaggaggaggaggaggagaaggaccagcccgccgagauggaguaccugaacagcagaugcgugcuguucaccuacuuccagggcgacaucggcagcgugguggacgagcacuucagcagagcccugggccaggccaucacccugcaccccgagagcgccaucagcaagagcaagaugggccugaccccccuguggagagacagcagcgcccugagcagccagagaaacagcuuccccaccagcuucuggaccagcagcuaccagcccccccccgcccccugccugggcggcgugcaccccgacuuccaggugaccggcccccccggcaccuucagcgccgccgaccccagccccuggcccggccacaaccugcaccagaccggccccgcccccccccccgccgugagcgagagcuggcccuacccccugaccagccaggugagccccagcuacagccacaugcacgacguguacaugagacaccaccacccccacgcccacaugcaccacagacacagacaccaccaccaccaccaccacccccccgccggcagcgcccuggaccccagcuacggcccccugcugaugcccagcgugcacgccgccagaauccccgccccccagugcgacaucaccaagaccgagcccaccaccgugaccagcgccaccagcgccugggccggcgccuuccacggcaccguggacaucgugcccagcgugggcuucgacaccggccugcagcaccaggacaagagcaaggagagccccugguacuaa

SEQ ID NO: 25533 - RNA, 891 nt, Artificial Sequence
  VGLL4__Homo_sapiens__NP_001121691
augcuguucaugaagauggaccugcugaacuaccaguaccuggacaagaugaacaacaacaucggcauccugugcuacgagggcgaggccgcccugagaggcgagcccagaauccagacccugcccguggccagcgcccugagcagccacagaaccggccccccccccaucagccccagcaagagaaaguucagcauggagcccggcgacgaggaccuggacugcgacaacgaccacgugagcaagaugagcagaaucuucaacccccaccugaacaagaccgccaacggcgacugcagaagagaccccagagagagaagcagaagccccaucgagagagccguggcccccaccaugagccugcacggcagccaccuguacaccagccugcccagccugggccuggagcagccccuggcccugaccaagaacagccuggacgccagcagacccgccggccugagccccacccugacccccggcgagagacagcagaacagacccagcgugaucaccugcgccagcgccggcgccagaaacugcaaccugagccacugccccaucgcccacagcggcugcgccgcccccggccccgccagcuacagaagaccccccagcgccgccaccaccugcgaccccgugguggaggagcacuucagaagaagccugggcaagaacuacaaggagcccgagcccgcccccaacagcgugagcaucaccggcagcguggacgaccacuucgccaaggcccugggcgacaccuggcugcagaucaaggccgccaaggacggcgccagcagcagccccgagagcgccagcagaagaggccagcccgccagccccagcgcccacauggugagccacagccacagccccagcguggugagcuaa

SEQ ID NO: 25534 - RNA, 642 nt, Artificial Sequence
  VHL__Homo_sapiens__NP_000542
augcccagaagagccgagaacugggacgaggccgaggugggcgccgaggaggccggcguggaggaguacggccccgaggaggacggcggcgaggagagcggcgccgaggagagcggccccgaggagagcggccccgaggagcugggcgccgaggaggagauggaggccggcagacccagacccgugcugagaagcgugaacagcagagagcccagccaggugaucuucugcaacagaagccccagaguggugcugcccguguggcugaacuucgacggcgagccccagcccuaccccacccugccccccggcaccggcagaagaauccacagcuacagaggccaccuguggcuguucagagacgccggcacccacgacggccugcuggugaaccagaccgagcuguucgugcccagccugaacguggacggccagcccaucuucgccaacaucacccugcccguguacacccugaaggagagaugccugcagguggugagaagccuggugaagcccgagaacuacagaagacuggacaucgugagaagccuguacgaggaccuggaggaccaccccaacgugcagaaggaccuggagagacugacccaggagagaaucgcccaccagagaaugggcgacuaa

SEQ ID NO: 25535 - RNA, 420 nt, Artificial Sequence
  VHLL__Homo_sapiens__NP_001004319
augcccuggagagccggcaacggcgugggccuggaggcccaggccggcacccaggaggccggccccgaggaguacugccaggaggagcugggcgccgaggaggagauggccgccagagccgccuggcccgugcugagaagcgugaacagcagagagcugagcagaaucaucaucugcaaccacagccccagaaucgugcugcccguguggcugaacuacuacggcaagcugcugcccuaccugacccugcugcccggcagagacuucagaauccacaacuucagaagccaccccuggcuguucagagacgccagaacccacgacaagcugcuggugaaccagaccgagcuguucgugcccagcagcaacgugaacggccagcccguguucgccaacaucacccugcagugcauccccuaa

SEQ ID NO: 25536 - RNA, 2484 nt, Artificial Sequence
  VIL1__Homo_sapiens__NP_009058
augaccaagcugagcgcccaggugaagggcagccugaacaucaccacccccggccugcagaucuggagaaucgaggccaugcagauggugcccgugcccagcagcaccuucggcagcuucuucgacggcgacugcuacaucauccuggccauccacaagaccgccagcagccugagcuacgacauccacuacuggaucggccaggacagcagccuggacgagcagggcgccgccgccaucuacaccacccagauggacgacuuccugaagggcagagccgugcagcacagagaggugcagggcaacgagagcgaggccuucagaggcuacuucaagcagggccuggugaucagaaagggcggcguggccagcggcaugaagcacguggagaccaacagcuacgacgugcagagacugcugcacgugaagggcaagagaaacgugguggccggcgagguggagaugagcuggaagagcuucaacagaggcgacguguuccugcuggaccugggcaagcugaucauccaguggaacggccccgagagcaccagaauggagagacugagaggcaugacccuggccaaggagaucagagaccaggagagaggcggcagaaccuacgugggcgugguggacggcgagaacgagcuggccagccccaagcugauggaggugaugaaccacgugcugggcaagagaagagagcugaaggccgccgugcccgacaccgugguggagcccgcccugaaggccgcccugaagcuguaccacgugagcgacagcgagggcaaccugguggugagagagguggccaccagaccccugacccaggaccugcugagccacgaggacugcuacauccuggaccagggcggccugaagaucuacguguggaagggcaagaaggccaacgagcaggagaagaagggcgccaugagccacgcccugaacuucaucaaggccaagcaguacccccccagcacccagguggaggugcagaacgacggcgccgagagcgccguguuccagcagcuguuccagaaguggaccgccagcaacagaaccagcggccugggcaagacccacaccgugggcagcguggccaagguggagcaggugaaguucgacgccaccagcaugcacgugaagccccagguggccgcccagcagaagaugguggacgacggcagcggcgaggugcagguguggagaaucgagaaccuggagcuggugcccguggacagcaaguggcugggccacuucuacggcggcgacugcuaccugcugcuguacaccuaccugaucggcgagaagcagcacuaccugcuguacguguggcagggcagccaggccagccaggacgagaucaccgccagcgccuaccaggccgugauccuggaccagaaguacaacggcgagcccgugcagaucagagugcccaugggcaaggagcccccccaccugaugagcaucuucaagggcagaauggugguguaccagggcggcaccagcagaaccaacaaccuggagaccggccccagcaccagacuguuccaggugcagggcaccggcgccaacaacaccaaggccuucgaggugcccgccagagccaacuuccugaacagcaacgacguguucgugcugaagacccagagcugcugcuaccuguggugcggcaagggcugcagcggcgacgagagagagauggccaagaugguggccgacaccaucagcagaaccgagaagcagguggugguggagggccaggagcccgccaacuucuggauggcccugggcggcaaggcccccuacgccaacaccaagagacugcaggaggagaaccuggugaucacccccagacuguucgagugcagcaacaagaccggcagauuccuggccaccgagauccccgacuucaaccaggacgaccuggaggaggacgacguguuccugcuggacgugugggaccagguguucuucuggaucggcaagcacgccaacgaggaggagaagaaggccgccgccaccaccgcccaggaguaccugaagacccaccccagcggcagagaccccgagacccccaucaucguggugaagcagggccacgagccccccaccuucaccggcugguuccuggccugggaccccuucaaguggagcaacaccaagagcuacgaggaccugaaggccgagcugggcaacagcagagacuggagccagaucaccgccgaggugaccagccccaagguggacguguucaacgccaacagcaaccugagcagcggcccccugcccaucuucccccuggagcagcuggugaacaagcccguggaggagcugcccgagggcguggaccccagcagaaaggaggagcaccugagcaucgaggacuucacccaggccuucggcaugacccccgccgccuucagcgcccugcccagauggaagcagcagaaccugaagaaggagaagggccuguucuaa

SEQ ID NO: 25537 - RNA, 1401 nt, Artificial Sequence
  VIM__Homo_sapiens__XP_011517951
augagcaccagaagcgugagcagcagcagcuacagaagaauguucggcggccccggcaccgccagcagacccagcagcagcagaagcuacgugaccaccagcaccagaaccuacagccugggcagcgcccugagacccagcaccagcagaagccuguacgccagcagccccggcggcguguacgccaccagaagcagcgccgugagacugagaagcagcgugcccggcgugagacugcugcaggacagcguggacuucagccuggccgacgccaucaacaccgaguucaagaacaccagaaccaacgagaagguggagcugcaggagcugaacgacagauucgccaacuacaucgacaaggugagauuccuggagcagcagaacaagauccugcuggccgagcuggagcagcugaagggccagggcaagagcagacugggcgaccuguacgaggaggagaugagagagcugagaagacagguggaccagcugaccaacgacaaggccagaguggagguggagagagacaaccuggccgaggacaucaugagacugagagagaagcugcaggaggagaugcugcagagagaggaggccgagaacacccugcagagcuucagacaggacguggacaacgccagccuggccagacuggaccuggagagaaagguggagagccugcaggaggagaucgccuuccugaagaagcugcacgaggaggagauccaggagcugcaggcccagauccaggagcagcacgugcagaucgacguggacgugagcaagcccgaccugaccgccgcccugagagacgugagacagcaguacgagagcguggccgccaagaaccugcaggaggccgaggagugguacaagagcaaguucgccgaccugagcgaggccgccaacagaaacaacgacgcccugagacaggccaagcaggagagcaccgaguacagaagacaggugcagagccugaccugcgagguggacgcccugaagggcaccaacgagagccuggagagacagaugagagagauggaggagaacuucgccguggaggccgccaacuaccaggacaccaucggcagacugcaggacgagauccagaacaugaaggaggagauggccagacaccugagagaguaccaggaccugcugaacgugaagauggcccuggacaucgagaucgccaccuacagaaagcugcuggagggcgaggagagcagaaucagccugccccugcccaacuucagcagccugaaccugagagagaccaaccuggacagccugccccugguggacacccacagcaagagaacccugcugaucaagaccguggagaccagagacggccaggugaucaacgagaccagccagcaccacgacgaccuggaguaa

SEQ ID NO: 25538 - RNA, 1482 nt, Artificial Sequence
  VIPAS39__Homo_sapiens__NP_001180244
augaacagaaccaagggcgacgaggaggaguacuggaacagcagcaaguucaaggccuucaccuucgacgacgaggacgacgagcugagccagcugaaggagagcaagagagccgugaacagccugagagacuucguggacgacgacgacgacgacgaccuggagagagugagcuggagcggcgagcccgugggcagcaucagcuggagcaucagagagaccgccggcaacagcggcagcacccacgagggcagagagcagcugaagagcagaaacagcuucagcagcuacgcccagcugcccaagcccaccagcaccuacagccugagcagcuucuucagaggcagaaccagacccggcagcuuccagagccugagcgacgcccugagcgacacccccgccaagagcuacgcccccgagcugggcagacccaagggcgaguacagagacuacagcaacgacuggagccccagcgacaccgugagaagacugagaaagggcaaggugugcagccuggagagauucagaagccugcaggacaagcugcagcugcuggaggaggccgugagcaugcacgacggcaacgugaucaccgccgugcugaucuuccugaagagaacccugagcaaggagauccuguucagagagcuggaggugagacagguggcccugagacaccugauccacuuccugaaggagaucggcgaccagaagcugcugcuggaccuguucagauuccuggacagaaccgaggagcuggcccugagccacuacagagagcaccugaacauccaggaccccgacaagagaaaggaguuccugaagaccugcgugggccugcccuucagcgccgaggacagcgcccacauccaggaccacuacacccugcuggagagacagaucaucaucgaggccaacgacagacaccuggagagcgccggccagaccgagaucuucagaaagcaccccagaaaggccagcauccugaacaugccccuggugaccacccuguucuacagcugcuucuaccacuacaccgaggccgagggcaccuucagcagccccgugaaccugaagaagaccuucaagauccccgacaagcaguacgugcugaccgcccuggccgccagagccaagcugagagccuggaacgacguggacgcccuguucaccaccaagaacuggcugggcuacaccaagaagagagcccccaucggcuuccacagagugguggagauccugcacaagaacaacgcccccgugcagauccugcaggaguacgugaaccugguggaggacguggacaccaagcugaaccuggccaccaaguucaagugccacgacguggugaucgacaccuacagagaccugaaggacagacagcagcugcuggccuacagaagcaagguggacaagggcagcgccgaggaggagaagaucgacgcccugcugagcagcagccagaucagauggaagaacuaa

SEQ ID NO: 25539 - RNA, 513 nt, Artificial Sequence
  VIP__Homo_sapiens__NP_003372
auggacaccagaaacaaggcccagcugcuggugcugcugacccugcugagcgugcuguucagccagaccagcgccuggccccuguacagagcccccagcgcccugagacugggcgacagaauccccuucgagggcgccaacgagcccgaccaggugagccugaaggaggacaucgacaugcugcagaacgcccuggccgagaacgacacccccuacuacgacgugagcagaaacgccagacacgccgacggcguguucaccagcgacuucagcaagcugcugggccagcugagcgccaagaaguaccuggagagccugaugggcaagagagugagcagcaacaucagcgaggaccccgugcccgugaagagacacagcgacgccguguucaccgacaacuacaccagacugagaaagcagauggccgugaagaaguaccugaacagcauccugaacggcaagagaagcagcgagggcgagagccccgacuuccccgaggagcuggagaaguaa

SEQ ID NO: 25540 - RNA, 1251 nt, Artificial Sequence
  VIPR1__Homo_sapiens__NP_001238811
augaucgaggugcagcacaagcagugccuggaggaggcccagcuggagaacgagaccaucggcugcagcaagaugugggacaaccugaccugcuggcccgccacccccagaggccaggugguggugcuggccugcccccugaucuucaagcuguucagcagcauccagggcagaaacgugagcagaagcugcaccgacgagggcuggacccaccuggagcccggccccuaccccaucgccugcggccuggacgacaaggccgccagccuggacgagcagcagaccauguucuacggcagcgugaagaccggcuacaccaucggcuacggccugagccuggccacccugcugguggccaccgccauccugagccuguucagaaagcugcacugcaccagaaacuacauccacaugcaccuguucaucagcuucauccugagagccgccgccguguucaucaaggaccuggcccuguucgacagcggcgagagcgaccagugcagcgagggcagcgugggcugcaaggccgccaugguguucuuccaguacugcgugauggccaacuucuucuggcugcugguggagggccuguaccuguacacccugcuggccgugagcuucuucagcgagagaaaguacuucuggggcuacauccugaucggcuggggcgugcccagcaccuucaccaugguguggaccaucgccagaauccacuucgaggacuacggcugcugggacaccaucaacagcagccugugguggaucaucaagggccccauccugaccagcauccuggugaacuucauccuguucaucugcaucaucagaauccugcugcagaagcugagaccccccgacaucagaaagagcgacagcagccccuacagcagacuggccagaagcacccugcugcugaucccccuguucggcgugcacuacaucauguucgccuucuuccccgacaacuucaagcccgaggugaagaugguguucgagcugguggugggcagcuuccagggcuucgugguggccauccuguacugcuuccugaacggcgaggugcaggccgagcugagaagaaaguggagaagauggcaccugcagggcgugcugggcuggaaccccaaguacagacaccccagcggcggcagcaacggcgccaccugcagcacccaggugagcaugcugaccagagugagccccggcgccagaagaagcagcagcuuccaggccgaggugagccugguguaa

SEQ ID NO: 25541 - RNA, 1077 nt, Artificial Sequence
  VIPR2__Homo_sapiens__NP_001291451
augagaacccugcugccccccgcccugcugaccugcuggcugcuggcccccgugaacagcauccaccccgagugcagauuccaccuggagauccaggaggaggagaccaagugcgccgagcugcugagaagccagaccgagaagcacaaggccugcagcggcgugugggacaacaucaccugcuggagacccgccaacgugggcgagaccgugaccgugcccugccccaagguguucagcaacuucuacagcaaggccggcaacaucagcaagaacugcaccagcgacggcuggagcgagaccuuccccgacuucguggacgccugcggcuacagcgaccccgaggacgagagcaaggugggcugcaagcugagccugguguuccugcaguacugcaucauggccaacuucuucuggcugcugguggagggccuguaccugcacacccugcugguggccaugcugccccccagaagaugcuuccuggccuaccugcugaucggcuggggccugcccaccgugugcaucggcgccuggaccgccgccagacuguaccuggaggacaccggcugcugggacaccaacgaccacagcgugcccuggugggugaucagaauccccauccugaucagcaucaucgugaacuucgugcuguucaucagcaucaucagaauccugcugcagaagcugaccagccccgacgugggcggcaacgaccagagccaguacaagagacuggccaagagcacccugcugcugaucccccuguucggcgugcacuacaugguguucgccguguuccccaucagcaucagcagcaaguaccagauccuguucgagcugugccugggcagcuuccagggccuggugguggccgugcuguacugcuuccugaacagcgaggugcagugcgagcugaagagaaaguggagaagcagaugccccacccccagcgccagcagagacuacagagugugcggcagcagcuucagcagaaacggcagcgagggcgcccugcaguuccacagaggcagcagagcccagagcuuccugcagaccgagaccagcgugaucuaa

SEQ ID NO: 25542 - RNA, 2037 nt, Artificial Sequence
  VIT__Homo_sapiens__NP_001171440
augagaaccguggugcugaccaugaaggccagcgugaucgagauguuccuggugcugcuggugaccggcgugcacagcaacaaggagaccgccaagaagaucaagagacccaaguucaccgugccccagaucaacugcgacgugaaggccggcaagaucaucgaccccgaguucaucgugaagugccccgccggcugccaggaccccaaguaccacguguacggcaccgacguguacgccagcuacagcagcgugugcggcgccgccgugcacagcggcgugcuggacaacagcggcggcaagauccuggugagaaagguggccggccagagcggcuacaagggcagcuacagcaacggcgugcagagccugagccugcccagauggagagagagcuucaucgugcuggagagcaagcccaagaagggcgugaccuaccccagcgcccugaccuacagcagcagcaagagccccgccgcccaggccggcgagaccaccaaggccuaccagagaccccccauccccggcaccaccgcccagcccgugacccugaugcagcugcuggccgugaccguggccguggccacccccaccacccugcccagacccagccccagcgccgccagcaccaccagcauccccagaccccagagcgugggccacagaagccaggagauggaccuguggagcaccgccaccuacaccagcagccagaacagacccagagccgaccccggcauccagagacaggaccccagcggcgccgccuuccagaagcccgugggcgccgacgugagccugggccuggugcccaaggaggagcugagcacccagagccuggagcccgugagccugggcgaccccaacugcaagaucgaccugagcuuccugaucgacggcagcaccagcaucggcaagagaagauucagaauccagaagcagcugcuggccgacguggcccaggcccuggacaucggccccgccggcccccugaugggcguggugcaguacggcgacaaccccgccacccacuucaaccugaagacccacaccaacagcagagaccugaagaccgccaucgagaagaucacccagagaggcggccugagcaacgugggcagagccaucagcuucgugaccaagaacuucuucagcaaggccaacggcaacagaagcggcgcccccaacguggugguggugaugguggacggcuggcccaccgacaagguggaggaggccagcagacuggccagagagagcggcaucaacaucuucuucaucaccaucgagggcgccgccgagaacgagaagcaguacgugguggagcccaacuucgccaacaaggccgugugcagaaccaacggcuucuacagccugcacgugcagagcugguucggccugcacaagacccugcagccccuggugaagagagugugcgacaccgacagacuggccugcagcaagaccugccugaacagcgccgacaucggcuucgugaucgacggcagcagcagcgugggcaccggcaacuucagaaccgugcugcaguucgugaccaaccugaccaaggaguucgagaucagcgacaccgacaccagaaucggcgccgugcaguacaccuacgagcagagacuggaguucggcuucgacaaguacagcagcaagcccgacauccugaacgccaucaagagagugggcuacuggagcggcggcaccagcaccggcgccgccaucaacuucgcccuggagcagcuguucaagaagagcaagcccaacaagagaaagcugaugauccugaucaccgacggcagaagcuacgacgacgugagaauccccgccauggccgcccaccugaagggcgugaucaccuacgccaucggcguggccugggccgcccaggaggagcuggaggugaucgccacccaccccgccagagaccacagcuucuucguggacgaguucgacaaccugcaccaguacgugcccagaaucauccagaacaucugcaccgaguucaacagccagcccagaaacuaa

SEQ ID NO: 25543 - RNA, 492 nt, Artificial Sequence
  VKORC1__Homo_sapiens__NP_076869
augggcagcaccuggggcagccccggcugggugagacuggcccugugccugaccggccuggugcugagccuguacgcccugcacgugaaggccgccagagccagagacagagacuacagagcccugugcgacgugggcaccgccaucagcugcagcagaguguucagcagcagauggggcagaggcuucggccugguggagcacgugcugggccaggacagcauccugaaccagagcaacagcaucuucggcugcaucuucuacacccugcagcugcugcugggcugccugagaaccagaugggccagcgugcugaugcugcugagcagccuggugagccuggccggcagcguguaccuggccuggauccuguucuucgugcuguacgacuucugcaucgugugcaucaccaccuacgccaucaacgugagccugauguggcugagcuucagaaaggugcaggagccccagggcaaggccaagagacacuaa

SEQ ID NO: 25544 - RNA, 2538 nt, Artificial Sequence
  VLDLR__Homo_sapiens__NP_001018066
augggcaccagcgcccugugggcccuguggcugcugcuggcccugugcugggcccccagagagagcggcgccaccggcaccggcagaaaggccaagugcgagcccagccaguuccagugcaccaacggcagaugcaucacccugcuguggaagugcgacggcgacgaggacugcguggacggcagcgacgagaagaacugcgugaagaagaccugcgccgagagcgacuucgugugcaacaacggccagugcgugcccagcagauggaagugcgacggcgaccccgacugcgaggacggcagcgacgagagccccgagcagugccacaugagaaccugcagaauccacgagaucagcugcggcgcccacagcacccagugcauccccgugagcuggagaugcgacggcgagaacgacugcgacagcggcgaggacgaggagaacugcggcaacaucaccugcagccccgacgaguucaccugcagcagcggcagaugcaucagcagaaacuucgugugcaacggccaggacgacugcagcgacggcagcgacgagcuggacugcgccccccccaccugcggcgcccacgaguuccagugcagcaccagcagcugcauccccaucagcugggugugcgacgacgacgccgacugcagcgaccagagcgacgagagccuggagcagugcggcagacagcccgugauccacaccaagugccccgccagcgagauccagugcggcagcggcgagugcauccacaagaaguggagaugcgacggcgaccccgacugcaaggacggcagcgacgaggugaacugccccagcagaaccugcagacccgaccaguucgagugcgaggacggcagcugcauccacggcagcagacagugcaacggcaucagagacugcguggacggcagcgacgaggugaacugcaagaacgugaaccagugccugggccccggcaaguucaagugcagaagcggcgagugcaucgacaucagcaaggugugcaaccaggagcaggacugcagagacuggagcgacgagccccugaaggagugccacaucaacgagugccuggugaacaacggcggcugcagccacaucugcaaggaccuggugaucggcuacgagugcgacugcgccgccggcuucgagcugaucgacagaaagaccugcggcgacaucgacgagugccagaaccccggcaucugcagccagaucugcaucaaccugaagggcggcuacaagugcgagugcagcagaggcuaccagauggaccuggccaccggcgugugcaaggccgugggcaaggagcccagccugaucuucaccaacagaagagacaucagaaagaucggccuggagagaaaggaguacauccagcugguggagcagcugagaaacaccguggcccuggacgccgacaucgccgcccagaagcuguucugggccgaccugagccagaaggccaucuucagcgccagcaucgacgacaaggugggcagacacgugaagaugaucgacaacguguacaaccccgccgccaucgccguggacuggguguacaagaccaucuacuggaccgacgccgccagcaagaccaucagcguggccacccuggacggcaccaagagaaaguuccuguucaacagcgaccugagagagcccgccagcaucgccguggacccccugagcggcuucguguacuggagcgacuggggcgagcccgccaagaucgagaaggccggcaugaacggcuucgacagaagaccccuggugaccgccgacauccaguggcccaacggcaucacccuggaccugaucaagagcagacuguacuggcuggacagcaagcugcacaugcugagcagcguggaccugaacggccaggacagaagaaucgugcugaagagccuggaguuccuggcccacccccuggcccugaccaucuucgaggacagaguguacuggaucgacggcgagaacgaggccguguacggcgccaacaaguucaccggcagcgagcuggccacccuggugaacaaccugaacgacgcccaggacaucaucguguaccacgagcuggugcagcccagcggcaagaacuggugcgaggaggacauggagaacggcggcugcgaguaccugugccugcccgccccccagaucaacgaccacagccccaaguacaccugcagcugccccagcggcuacaacguggaggagaacggcagagacugccagagaaucaacgugaccaccgccgugagcgaggugagcgugccccccaagggcaccagcgccgccugggccauccugccccugcugcugcuggugauggccgccgugggcggcuaccugauguggagaaacuggcagcacaagaacaugaagagcaugaacuucgacaaccccguguaccugaagaccaccgaggaggaccugagcaucgacaucggcagacacagcgccagcgugggccacaccuaccccgccaucagcguggugagcaccgacgacgaccuggccuaa

SEQ ID NO: 25545 - RNA, 306 nt, Artificial Sequence
  VMA21__Homo_sapiens__NP_001017980
auggagagacccgacaaggccgcccugaacgcccugcagccccccgaguucagaaacgagagcagccuggccagcacccugaagacccugcuguucuucaccgcccugaugaucaccgugcccaucggccuguacuucaccaccaagagcuacaucuucgagggcgcccugggcaugagcaacagagacagcuacuucuacgccgccaucguggccgugguggccgugcacguggugcuggcccuguucguguacguggccuggaacgagggcagcagacaguggagagagggcaagcaggacuaa

SEQ ID NO: 25546 - RNA, 345 nt, Artificial Sequence
  VMO1__Homo_sapiens__NP_001138411
auggagagaggcgccggcgccaagcugcugccccugcugcugcugcugagagccaccggcuucaccugcgcccagaccgacggcagaaacggcuacaccgccgugaucgaggugaccagcggcggccccuggggcgacugggccuggcccgagaugugccccgacggcuucuucgccagcggcuucagccugaagguggagcccccccagggcauccccggcgacgacaccgcccugaacggcaucagacugcacugcgccagaggcaacgugcugggcaacacccacgugguggagagccagagcggcagauggggcgccggcguggaggacccccugggcuaa

SEQ ID NO: 25547 - RNA, 1221 nt, Artificial Sequence
  VMP1__Homo_sapiens__NP_112200
auggccgagaacggcaagaacugcgaccagagaagaguggccaugaacaaggagcaccacaacggcaacuucaccgaccccagcagcgugaacgagaagaagagaagagagagagaggagagacagaacaucgugcuguggagacagccccugaucacccugcaguacuucagccuggagauccuggugauccugaaggaguggaccagcaagcuguggcacagacagagcaucguggugagcuuccugcugcugcuggccgugcugaucgccaccuacuacguggagggcgugcaccagcaguacgugcagagaaucgagaagcaguuccugcuguacgccuacuggaucggccugggcauccugagcagcgugggccugggcaccggccugcacaccuuccugcuguaccugggcccccacaucgccagcgugacccuggccgccuacgagugcaacagcgugaacuuccccgagccccccuaccccgaccagaucaucugccccgacgaggagggcaccgagggcaccaucagccuguggagcaucaucagcaaggugagaaucgaggccugcauguggggcaucggcaccgccaucggcgagcugccccccuacuucauggccagagccgccagacugagcggcgccgagcccgacgacgaggaguaccaggaguucgaggagaugcuggagcacgccgagagcgcccaggacuucgccagcagagccaagcuggccgugcagaagcuggugcagaaggugggcuucuucggcauccuggccugcgccagcauccccaacccccuguucgaccuggccggcaucaccugcggccacuuccuggugcccuucuggaccuucuucggcgccacccugaucggcaaggccaucaucaagaugcacauccagaagaucuucgugaucaucaccuucagcaagcacaucguggagcagaugguggccuucaucggcgccgugcccggcaucggccccagccugcagaagcccuuccaggaguaccuggaggcccagagacagaagcugcaccacaagagcgagaugggcaccccccagggcgagaacuggcugagcuggauguucgagaagcuggugguggugauggugugcuacuucauccugagcaucaucaacagcauggcccagagcuacgccaagagaauccagcagagacugaacagcgaggagaagaccaaguaa

SEQ ID NO: 25548 - RNA, 1188 nt, Artificial Sequence
  VN1R2__Homo_sapiens__NP_776255
augacccacacccuguaccccacccccuucgcccuguaccccaucaacaucagcgccgccuggcaccugggcccccugcccgugagcugcuucgugagcaacaaguaccagugcagccuggccuucggcgccaccaccggccugagagugcugguggugguggugccccagacccagcugagcuuccugagcagccugugccuggugagccuguuccugcacagccuggugagcgcccacggcgagaagcccaccaagcccgugggccuggaccccacccuguuccaggugguggugggcauccugggcaacuucagccugcuguacuacuacauguuccuguacuucagaggcuacaagcccagaagcaccgaccugauccugagacaccugaccguggccgacagccuggugauccugagcaagagaauccccgagaccauggccaccuucggccugaagcacuucgacaacuacuucggcugcaaguuccugcuguacgcccacagagugggcagaggcgugagcaucggcagcaccugccugcugagcguguuccaggugaucaccaucaaccccagaaacagcagaugggccgagaugaaggugaaggcccccaccuacaucggccugagcaacauccugugcugggccuuccacaugcuggugaacgccaucuuccccaucuacaccaccggcaaguggagcaacaacaacaucaccaagaagggcgaccugggcuacugcagcgccccccugagcgacgaggugaccaagagcguguacgccgcccugaccagcuuccacgacgugcugugccugggccugaugcugugggccagcagcagcaucgugcuggugcuguacagacacaagcagcaggugcagcacaucugcagaaacaaccuguaccccaacagcagccccggcaacagagccauccagagcauccuggcccuggugagcaccuucgcccugugcuacgcccugagcuucaucaccuacguguaccuggcccuguucgacaacagcagcugguggcuggugaacaccgccgcccugaucaucgccugcuuccccaccaucagccccuucgugcugaugugcagagaccccagcagaagcagacugugcagcaucugcugcagaagaaacagaagauucuuccacgacuucagaaagauguaa

SEQ ID NO: 25549 - RNA, 906 nt, Artificial Sequence
  VN1R4__Homo_sapiens__NP_776256
auggccagcagauacguggccgugggcaugauccugagccagaccguggugggcgugcugggcagcuucagcgugcugcugcacuaccugagcuucuacugcaccggcugcagacugagaagcaccgaccugaucgugaagcaccugaucguggccaacuuccuggcccugagaugcaagggcgugccccagaccauggccgccuucggcgugagauacuuccugaacgcccugggcugcaagcugguguucuaccugcacagagugggcagaggcgugagcaucggcaccaccugccugcugagcguguuccaggugaucaccgugagcagcagaaagagcagaugggccaagcugaaggagaaggcccccaagcacgugggcuucagcgugcugcugugcuggaucgugugcaugcuggugaacaucaucuuccccauguacgugaccggcaaguggaacuacaccaacaucaccgugaacgaggaccugggcuacugcagcggcggcggcaacaacaagaucgcccagacccugagagccaugcugcugagcuuccccgacgugcugugccugggccugaugcugugggugagcagcagcauggugugcauccugcacagacacaagcagagagugcagcacaucgacagaagcaaccugagccccagagccagccccgagaacagagccacccagagcauccugauccuggugagcaccuucgugagcagcuacacccugagcugccuguuccaggugugcauggcccugcuggacaaccccaacagccugcuggugaacaccagcgcccugaugagcgugugcuuccccacccugagccccuucgugcugaugagcugcgaccccagcguguacagauucugcuucgccuggaagagauaa

SEQ ID NO: 25550 - RNA, 1542 nt, Artificial Sequence
  VNN1__Homo_sapiens__NP_004657
augaccacccagcugcccgccuacguggccauccugcuguucuacgugagcagagccagcugccaggacaccuucaccgccgccguguacgagcacgccgccauccugcccaacgccacccugacccccgugagcagagaggaggcccuggcccugaugaacagaaaccuggacauccuggagggcgccaucaccagcgccgccgaccagggcgcccacaucaucgugacccccgaggacgccaucuacggcuggaacuucaacagagacagccuguaccccuaccuggaggacauccccgaccccgaggugaacuggauccccugcaacaacagaaacagauucggccagacccccgugcaggagagacugagcugccuggccaagaacaacagcaucuacgugguggccaacaucggcgacaagaagcccugcgacaccagcgacccccagugcccccccgacggcagauaccaguacaacaccgacgugguguucgacagccagggcaagcugguggccagauaccacaagcagaaccuguucaugggcgagaaccaguucaacgugcccaaggagcccgagaucgugaccuucaacaccaccuucggcagcuucggcaucuucaccugcuucgacauccuguuccacgaccccgccgugacccuggugaaggacuuccacguggacaccaucguguuccccaccgccuggaugaacgugcugccccaccugagcgccguggaguuccacagcgccugggccaugggcaugagagugaacuuccuggccagcaacauccacuaccccagcaagaagaugaccggcagcggcaucuacgcccccaacagcagcagagccuuccacuacgacaugaagaccgaggagggcaagcugcugcugagccagcuggacagccaccccagccacagcgccguggugaacuggaccagcuacgccagcagcaucgaggcccugagcagcggcaacaaggaguucaagggcaccguguucuucgacgaguucaccuucgugaagcugaccggcguggccggcaacuacaccgugugccagaaggaccugugcugccaccugagcuacaagaugagcgagaacauccccaacgagguguacgcccugggcgccuucgacggccugcacaccguggagggcagauacuaccugcagaucugcacccugcugaagugcaagaccaccaaccugaacaccugcggcgacagcgccgagaccgccagcaccagauucgagauguucagccugagcggcaccuucggcacccaguacguguuccccgaggugcugcugagcgagaaccagcuggcccccggcgaguuccaggugagcaccgacggcagacuguucagccugaagcccaccagcggccccgugcugaccgugacccuguucggcagacuguacgagaaggacugggccagcaacgccagcagcggccugaccgcccaggccagaaucaucaugcugaucgugaucgcccccaucgugugcagccugagcugguaa

SEQ ID NO: 25551 - RNA, 900 nt, Artificial Sequence
  VNN2__Homo_sapiens__NP_001229279
auggugaccagcagcuuccccaucagcguggccguguucgcccugaucacccugcaggugggcacccaggacagcuucaucgccgccguguacgagcacgccgugauccugcccaacaagaccgagacccccgugagccaggaggacgcccugaaccugaugaacgagaacaucgacauccuggagaccgccaucaagcaggccgccgagcagggcgccagaaucaucgugacccccgaggacgcccuguacggcuggaaguucaccagagagaccguguuccccuaccuggaggacauccccgacccccaggugaacuggauccccugccaggacccccacagauucggccacacccccgugcaggccagacugagcugccuggccaaggacaacagcaucuacgugcuggccaaccugggcgacaagaagcccugcaacagcagagacagcaccugcccccccaacggcuacuuccaguacaacaccaacgugguguacaacaccgagggcaagcugguggccagauaccacaaggugugcaccaugcugaagugcaagaccaccaaccugaccaccugcggcagacccguggagaccgccagcaccagauucgagauguucagccugagcggcaccuucggcaccgaguacguguuccccgaggugcugcugaccgagauccaccugagccccggcaaguucgaggugcugaaggacggcagacuggugaacaagaacggcagcagcggccccauccugaccgugagccuguucggcagaugguacaccaaggacagccuguacagcagcugcggcaccagcaacagcgccaucaccuaccugcugaucuucauccugcugaugaucaucgcccugcagaacaucgugaugcuguaa

SEQ ID NO: 25552 - RNA, 732 nt, Artificial Sequence
  VNN3__Homo_sapiens__NP_001278632
augggcgugaaccugcuggccgccaacacccacaacaccagcaugcacaugaccggcagcggcaucuacgcccccgaggccgugaagguguaccacuacgacauggagaccgagagcggccagcugcugcugagcgagcugaagagcagacccagaagagagcccaccuaccccgccgccguggacuggcacgccuacgccagcagcgugaagcccuucagcagcgagcagagcgacuuccugggcaugaucuacuucgacgaguucaccuucaccaagcugaagagaaacaccggcaacuacaccgccugccagaaggaccugugcugccaccugaccuacaagaugagcgagaagagaaccgacgagaucuacgcccugggcgccuucgacggccugcacaccguggagggccaguacuaccugcagaucugcgcccugcugaagugccagaccaccgaccuggagaccugcggcgagcccgugggcagcgccuucaccaaguucgaggacuucagccugagcggcaccuucggcaccagauacguguucccccagaucauccugagcggcagccagcuggcccccgagagacacuacgagaucagcagagacggcagacugagaagcagaagcggcgccccccugcccgugcuggugauggcccuguacggcagaguguucgagaaggacccccccagacugggccagggcagcggcaaguuccaguaa

SEQ ID NO: 25553 - RNA, 510 nt, Artificial Sequence
  VOPP1__Homo_sapiens__NP_001271212
augcugagcgagacccugggcuaccugagcagcgugcugcugcagugcaccgaggccaagaagcacugcugguacuucgagggccuguaccccaccuacuacaucugcagaagcuacgaggacugcugcggcagcagaugcugcgugagagcccugagcauccagagacugugguacuucugguuccugcugaugaugggcgugcuguucugcugcggcgccggcuucuucaucagaagaagaauguacccccccccccugaucgaggagcccgccuucaacgugagcuacaccagacagccccccaaccccggccccggcgcccagcagcccggcccccccuacuacaccgaccccggcggccccggcaugaaccccgugggcaacagcauggccauggccuuccaggugccccccaacagcccccagggcagcguggccugcccccccccccccgccuacugcaacaccccccccccccccuacgagcagguggugaaggccaaguaa

SEQ ID NO: 25554 - RNA, 4524 nt, Artificial Sequence
  VPRBP__Homo_sapiens__NP_055518
augaccaccgugguggugcacguggacagcaaggccgagcugaccacccugcuggagcagugggagaaggagcacggcagcggccaggacauggugcccauccugaccagaaugagccagcugaucgagaaggagaccgaggaguacagaaagggcgaccccgaccccuucgacgacagacaccccggcagagccgaccccgagugcaugcugggccaccugcugagaauccuguucaagaacgacgacuucaugaacgcccuggugaacgccuacgugaugaccagcagagagcccccccugaacaccgccgccugcagacugcugcuggacaucaugcccggccuggagaccgccgugguguuccaggagaaggagggcaucguggagaaccuguucaagugggccagagaggccgaccagccccugagaaccuacagcaccggccugcugggcggcgccauggagaaccaggacaucgccgccaacuacagagacgagaacagccagcugguggccaucgugcugagaagacugagagagcugcagcugcaggagguggcccugagacaggagaacaagagacccagccccagaaagcugagcagcgagccccugcugccccuggacgaggaggccguggacauggacuacggcgacauggccguggacgugguggacggcgaccaggaggaggccagcggcgacauggagaucagcuuccaccuggacagcggccacaagaccagcagcagagugaacagcaccaccaagcccgaggacggcggccugaagaagaacaagagcgccaagcagggcgacagagagaacuucagaaaggccaagcagaagcugggcuucagcagcagcgaccccgacagaauguucguggagcugagcaacagcagcuggagcgagaugagccccugggugaucggcaccaacuacacccuguaccccaugacccccgccaucgagcagagacugauccugcaguaccugaccccccugggcgaguaccaggagcugcugcccaucuucaugcagcugggcagcagagagcugaugauguucuacaucgaccugaagcagaccaacgacgugcugcugaccuucgaggcccugaagcaccuggccagccugcugcugcacaacaaguucgccaccgaguucguggcccacggcggcgugcagaagcugcuggagauccccagacccagcauggccgccaccggcgugagcaugugccuguacuaccugagcuacaaccaggacgccauggagagagugugcaugcacccccacaacgugcugagcgacguggugaacuacacccuguggcugauggagugcagccacgccagcggcugcugccacgccaccauguucuucagcaucugcuucagcuucagagccgugcuggagcuguucgacagauacgacggccugagaagacuggugaaccugaucagcacccuggagauccugaaccuggaggaccagggcgcccugcugagcgacgacgagaucuucgccagcagacagaccggcaagcacaccugcauggcccugagaaaguacuucgaggcccaccuggccaucaagcuggagcaggugaagcagagccugcagagaaccgagggcggcauccuggugcacccccagccccccuacaaggccugcagcuacacccacgagcagaucguggagaugauggaguuccugaucgaguacggccccgcccagcuguacugggagcccgccgagguguuccugaagcugagcugcgugcagcugcugcugcagcugaucagcaucgccugcaacuggaagaccuacuacgccagaaacgacaccgugagauucgcccuggacgugcuggccauccugaccguggugcccaagauccagcugcagcuggccgagagcguggacgugcuggacgaggccggcagcaccgugagcaccgugggcaucagcaucauccugggcguggccgagggcgaguucuucauccacgacgccgagauccagaagagcgcccugcagaucaucaucaacugcgugugcggccccgacaacagaaucagcagcaucggcaaguucaucagcggcacccccagaagaaagcugccccagaaccccaagagcagcgagcacacccuggccaagauguggaacguggugcagagcaacaacggcaucaaggugcugcugagccugcugagcaucaagaugcccaucaccgacgccgaccagaucagagcccuggccugcaaggcccuggugggccugagcagaagcagcaccgugagacagaucaucagcaagcugccccuguucagcagcugccagauccagcagcugaugaaggagcccgugcugcaggacaagagaagcgaccacgugaaguucugcaaguacgccgccgagcugaucgagagagugagcggcaagccccugcugaucggcaccgacgugagccuggccagacugcagaaggccgacgugguggcccagagcagaaucagcuuccccgagaaggagcugcugcugcugaucagaaaccaccugaucagcaagggccugggcgagaccgccaccgugcugaccaaggaggccgaccugcccaugaccgccgccagccacagcagcgccuucacccccgugaccgccgccgccagccccgugagccugcccagaacccccagaaucgccaacggcaucgccaccagacugggcagccacgccgccgugggcgccagcgcccccagcgcccccaccgcccacccccagcccagacccccccagggcccccuggcccugcccggccccagcuacgccggcaacagcccccugaucggcagaaucagcuucaucagagagagacccagccccugcaacggcagaaagaucagagugcugagacagaagagcgaccacggcgccuacagccagagccccgccaucaagaagcagcuggacagacaccugcccagcccccccacccuggacagcaucaucaccgaguaccugagagagcagcacgccagaugcaagaaccccguggccaccugcccccccuucagccuguucaccccccaccagugccccgagcccaagcagagaagacaggcccccaucaacuucaccagcagacugaacagaagagccagcuuccccaaguacggcggcguggacggcggcugcuucgacagacaccugaucuucagcagauucagacccaucagcguguucagagaggccaacgaggacgagagcggcuucaccugcugcgccuucagcgccagagagagauuccugaugcugggcaccugcaccggccagcugaagcuguacaacguguucagcggccaggaggaggccagcuacaacugccacaacagcgccaucacccaccuggagcccagcagagacggcagccugcugcugaccagcgccaccuggagccagccccugagcgcccuguggggcaugaagagcguguucgacaugaagcacagcuucaccgaggaccacuacguggaguucagcaagcacagccaggacagagugaucggcaccaagggcgacaucgcccacaucuacgacauccagaccggcaacaagcugcugacccuguucaaccccgaccuggccaacaacuacaagagaaacugcgccaccuucaaccccaccgacgaccuggugcugaacgacggcgugcugugggacgugagaagcgcccaggccauccacaaguucgacaaguucaacaugaacaucagcggcguguuccaccccaacggccuggaggugaucaucaacaccgagaucugggaccugagaaccuuccaccugcugcacaccgugcccgcccuggaccagugcagagugguguucaaccacaccggcaccgugauguacggcgccaugcugcaggccgacgacgaggacgaccugauggaggagagaaugaagagccccuucggcagcagcuucagaaccuucaacgccaccgacuacaagcccaucgccaccaucgacgugaagagaaacaucuucgaccugugcaccgacaccaaggacugcuaccuggccgugaucgagaaccagggcagcauggacgcccugaacauggacaccgugugcagacuguacgaggugggcagacagagacuggccgaggacgaggacgaggaggaggaccaggaggaggaggagcaggaggaggaggacgacgacgaggacgacgacgacaccgacgaccuggacgagcuggacaccgaccagcugcuggaggccgagcuggaggaggacgacaacaacgagaacgccggcgaggacggcgacaacgacuucagccccagcgacgaggagcuggccaaccugcuggaggagggcgaggacggcgaggacgaggacagcgacgccgacgaggagguggagcugauccugggcgacaccgacagcagcgacaacagcgaccuggaggacgacaucauccugagccugaacgaguaa

SEQ ID NO: 25555 - RNA, 438 nt, Artificial Sequence
  VPREB1__Homo_sapiens__NP_009059
augagcugggcccccgugcugcugaugcuguucguguacugcaccggcugcggcccccagcccgugcugcaccagccccccgccaugagcagcgcccugggcaccaccaucagacugaccugcacccugagaaacgaccacgacaucggcguguacagcguguacugguaccagcagagacccggccacccccccagauuccugcugagauacuucagccagagcgacaagagccagggcccccaggugccccccagauucagcggcagcaaggacguggccagaaacagaggcuaccugagcaucagcgagcugcagcccgaggacgaggccauguacuacugcgccaugggcgccagaagcagcgagaaggaggagagagagagagagugggaggaggagauggagcccaccgccgccagaaccagagugcccuaa

SEQ ID NO: 25556 - RNA, 372 nt, Artificial Sequence
  VPREB3__Homo_sapiens__NP_037510
auggccugcagaugccugagcuuccugcugaugggcaccuuccugagcgugagccagaccgugcuggcccagcuggacgcccugcugguguuccccggccagguggcccagcugagcugcacccugagcccccagcacgugaccaucagagacuacggcgugagcugguaccagcagagagccggcagcgcccccagauaccugcuguacuacagaagcgaggaggaccaccacagacccgccgacauccccgacagauucagcgccgccaaggacgaggcccacaacgccugcgugcugaccaucagccccgugcagcccgaggacgacgccgacuacuacugcagcgugggcuacggcuucagccccuaa

SEQ ID NO: 25557 - RNA, 1740 nt, Artificial Sequence
  VPS11__Homo_sapiens__XP_011541201
augcuguucaagaagaaccuguucgagauggccaucaaccuggccaagagccagcaccuggacagcgacggccuggcccagaucuucaugcaguacggcgaccaccuguacagcaagggcaaccacgacggcgccgugcagcaguacaucagaaccaucggcaagcuggagcccagcuacgugaucagaaaguuccuggacgcccagagaauccacaaccugaccgccuaccugcagacccugcacagacagagccuggccaacgccgaccacaccacccugcugcugaacugcuacaccaagcugaaggacagcagcaagcuggaggaguucaucaagaagaagagcgagagcgaggugcacuucgacguggagaccgccaucaaggugcugagacaggccggcuacuacagccacgcccuguaccuggccgagaaccacgcccaccacgagugguaccugaagauccagcuggaggacaucaagaacuaccaggaggcccugagauacaucggcaagcugcccuucgagcaggccgagagcaacaugaagagauacggcaagauccugaugcaccacauccccgagcagaccacccagcugcugaagggccugugcaccgacuacagacccagccuggagggcagaagcgacagagaggcccccggcugcagagccaacagcgaggaguucauccccaucuucgccaacaaccccagagagcugaaggccuuccuggagcacaugagcgaggugcagcccgacagcccccagggcaucuacgacacccugcuggagcugagacugcagaacugggcccacgagaaggacccccaggugaaggagaagcugcacgccgaggccaucagccugcugaagagcggcagauucugcgacguguucgacaaggcccuggugcugugccagaugcacgacuuccaggacggcgugcuguaccuguacgagcagggcaagcuguuccagcagaucaugcacuaccacaugcagcacgagcaguacagacaggugaucagcgugugcgagagacacggcgagcaggaccccagccugugggagcaggcccugagcuacuucgccagaaaggaggaggacugcaaggaguacguggccgccgugcugaagcacaucgagaacaagaaccugaugcccccccugcugguggugcagacccuggcccacaacagcaccgccacccugagcgugaucagagacuaccuggugcagaagcugcagaagcagagccagcagaucgcccaggacgagcugagagugagaagauacagagaggagaccaccagaaucagacaggagauccaggagcugaaggccagccccaagaucuuccagaagaccaagugcagcaucugcaacagcgcccuggagcugcccagcgugcacuuccugugcggccacagcuuccaccagcacugcuucgagagcuacagcgagagcgacgccgacugccccaccugccugcccgagaacagaaaggugauggacaugaucagagcccaggagcagaagagagaccugcacgaccaguuccagcaccagcugaagugcagcaacgacagcuucagcgugaucgccgacuacuucggcagaggcguguucaacaagcugacccugcugaccgacccccccaccgccagacugaccagcagccuggaggccggccugcagagagaccugcugaugcacagcagaagaggcaccuaa

SEQ ID NO: 25558 - RNA, 9408 nt, Artificial Sequence
  VPS13A__Homo_sapiens__NP_001018047
augguguucgagagcguggugguggacgugcugaacagauuccugggcgacuacgugguggaccuggacaccagccagcugagccugggcaucuggaagggcgccguggcccugaagaaccugcagaucaaggagaacgcccugagccagcuggacgugcccuucaaggugaaggugggccacaucggcaaccugaagcugaucauccccuggaagaaccuguacacccagcccguggaggccgugcuggaggagaucuaccugcugaucgugcccagcagcagaaucaaguacgacccccugaaggaggagaagcagcugauggaggccaagcagcaggagcugaagagaaucgaggaggccaagcagaaggugguggaccaggagcagcaccugcccgagaagcaggacaccuucgccgagaagcuggugacccagaucaucaagaaccugcaggugaagaucagcagcauccacaucagauacgaggacgacaucaccaacagagacaagccccugagcuucggcaucagccugcagaaccugagcaugcagaccaccgaccaguacugggugcccugccugcacgacgagaccgagaagcuggugagaaagcugaucagacuggacaaccuguucgccuacuggaacgugaagagccagauguucuaccugagcgacuacgacaacagccuggacgaccugaagaacggcaucgugaacgagaacaucgugcccgagggcuacgacuucguguucagacccaucagcgccaacgccaagcuggugaugaacagaagaagcgacuucgacuucagcgcccccaagaucaaccuggagaucgagcugcacaacaucgccaucgaguucaacaagccccaguacuucagcaucauggagcugcuggagagcguggacaugauggcccagaaccugcccuacagaaaguucaagcccgacgugccccugcaccaccacgccagagaguggugggccuacgccauccacggcgugcuggaggugaacgugugccccagacuguggauguggagcuggaagcacaucagaaagcacagacagaaggugaagcaguacaaggagcuguacaagaagaagcugaccagcaagaagccccccggcgagcugcuggugagccuggaggagcuggagaagacccuggacguguucaacaucaccaucgccagacagaccgccgagguggaggugaagaaggccggcuacaagaucuacaaggagggcgugaaggaccccgaggacaacaagggcugguucagcuggcuguggagcuggagcgagcagaacaccaacgagcagcagcccgacgugcagcccgagacccuggaggagaugcugacccccgaggagaaggcccugcuguacgaggccaucggcuacagcgagaccgccguggaccccacccugcugaagaccuucgaggcccugaaguucuucgugcaccugaagagcaugagcaucgugcugagagagaaccaccagaagcccgagcugguggacaucgugaucgaggaguucagcacccugaucgugcagagacccggcgcccaggccaucaaguucgagaccaagaucgacagcuuccacaucaccggccugcccgacaacagcgagaagcccagacugcugagcagccuggacgacgccaugagccuguuccagaucaccuucgagaucaacccccuggacgagaccgugagccagagaugcaucaucgaggccgagccccuggagaucaucuacgacgccagaaccgugaacagcaucguggaguucuucagaccccccaaggaggugcaccuggcccagcugaccgccgccacccugaccaagcuggaggaguucagaagcaagaccgccaccggccugcuguacaucaucgagacccagaaggugcuggaccugaagaucaaccugaaggccagcuacaucaucgugccccaggacggcaucuucagccccaccagcaaccugcugcugcuggaccugggccaccugaaggugaccagcaagagcagaagcgagcugcccgacgugaagcagggcgaggccaaccugaaggagaucauggacagagccuacgacagcuucgacauccagcugaccagcgugcagcugcuguacagcagagugggcgacaacuggagagaggccagaaagcugagcgugagcacccagcacauccuggugcccaugcacuucaaccuggagcugagcaaggccaugguguucauggacgugagaaugcccaaguucaagaucuacggcaagcugccccugaucagccugagaaucagcgacaagaagcugcagggcaucauggagcugaucgagagcauccccaagcccgagcccgugaccgaggugagcgcccccgugaagagcuuccagauccagaccagcaccagccugggcaccagccagaucagccagaagaucaucccccugcuggagcugcccagcgugagcgaggacgacagcgaggaggaguucuucgacgcccccugcagcccccuggaggagccccugcaguuccccaccggcgugaagagcaucagaaccagaaagcugcagaagcaggacugcagcgugaacaugaccaccuucaagaucagauucgaggugcccaaggugcugaucgaguucuaccaccuggugggcgacugcgagcugagcgugguggagauccuggugcugggccugggcgccgagaucgagaucagaaccuacgaccugaaggccaacgccuuccugaaggaguucugccugaagugccccgaguaccuggacgagaacaagaagcccguguaccuggugaccacccuggacaacaccauggaggaccugcugacccuggaguacgugaaggccgagaagaacgugcccgaccugaagagcaccuacaacaacgugcugcagcugaucaaggugaacuucagcagccuggacauccaccugcacaccgaggcccugcugaacaccaucaacuaccugcacaacauccugccccagagcgaggagaagagcgcccccgugagcaccaccgagaccgaggacaagggcgacgugaucaagaagcugggccuggacagcgagaugaucaugagacccagcgagaccgagaucaacgccaagcugagaaacaucaucgugcuggacagcgacaucaccgccaucuacaagaaggccguguacaucaccggcaaggagguguucagcuucaagauggugagcuacauggacgccaccgccggcagcgccuacaccgacaugaacgugguggacauccaggugaaccugaucgugggcugcaucgaggugguguucgugaccaaguuccuguacagcauccuggccuucaucgacaacuuccaggccgccaagcaggcccuggccgaggccaccgugcaggccgccggcauggccgccaccggcgugaaggagcuggcccagagaagcagcagaauggcccuggacaucaacaucaaggcccccgugguggugaucccccagagccccgugagcgagaacguguucguggccgacuucggccugaucaccaugaccaacaccuuccacaugaucaccgagagccagagcagccccccccccgugaucgaccugaucaccaucaagcugagcgagaugagacuguacagaagcagauucaucaacgacgccuaccaggaggugcuggaccugcugcugccccugaaccuggagguggugguggagagaaaccugugcugggagugguaccaggaggugcccugcuucaacgugaacgcccagcugaagcccauggaguucauccugagccaggaggacaucaccaccaucuucaagacccugcacggcaacaucugguacgagaaggacggcagcgccagccccgccgugaccaaggaccaguacagcgccaccagcggcgugaccaccaacgccagccaccacagcggcggcgccaccguggugaccgccgccgugguggaggugcacagcagagcccugcuggugaagaccacccugaacaucagcuucaagaccgacgaccugaccauggugcuguacagccccggccccaagcaggccagcuucaccgacgugagagaccccagccugaagcuggccgaguucaagcuggagaacaucaucagcacccugaagauguacaccgacggcagcaccuucagcagcuucagccugaagaacugcauccuggacgacaagagaccccacgugaagaaggccacccccagaaugaucggccugaccgugggcuucgacaagaaggacaugauggacaucaaguacagaaaggugagagacggcugcgugaccgacgccguguuccaggagauguacaucugcgccagcguggaguuccugcagaccguggccaacguguuccuggaggccuacaccaccggcaccgccguggagaccagcgugcagaccuggaccgccaaggaggaggugcccacccaggagagcgugaagugggagaucaacgugaucaucaagaaccccgagaucguguucguggccgacaugaccaagaacgacgcccccgcccuggugaucaccacccagugcgagaucugcuacaagggcaaccuggagaacagcaccaugaccgccgccaucaaggaccugcaggugagagccugccccuuccugcccgugaagagaaagggcaagaucaccaccgugcugcagcccugcgaccuguucuaccagaccacccagaagggcaccgacccccaggugaucgacaugagcgugaagagccugacccugaaggugagccccgugaucaucaacaccaugaucaccaucaccagcgcccuguacaccaccaaggagaccauccccgaggagaccgccagcagcaccgcccaccugugggagaagaaggacaccaagacccugaagaugugguuccuggaggagagcaacgagaccgagaagaucgcccccaccaccgagcuggugcccaagggcgagaugaucaagaugaacaucgacagcaucuucaucgugcuggaggccggcaucggccacagaaccgugcccaugcugcuggccaagagcagauucagcggcgagggcaagaacuggagcagccugaucaaccugcacugccagcuggagcuggaggugcacuacuacaacgagauguucggcgugugggagccccugcuggagccccuggagaucgaccagaccgaggacuucagacccuggaaccugggcaucaagaugaagaagaaggccaagauggccaucguggagagcgaccccgaggaggagaacuacaaggugcccgaguacaagaccgugaucagcuuccacagcaaggaccagcugaacaucacccugagcaagugcggccuggugaugcugaacaaccuggugaaggccuucaccgaggccgccaccggcagcagcgccgacuucgugaaggaccuggcccccuucaugauccugaacagccugggccugaccaucagcgugagccccagcgacagcuucagcgugcugaacauccccauggccaagagcuacgugcugaagaacggcgagagccugagcauggacuacaucagaaccaaggacaacgaccacuucaacgccaugaccagccugagcagcaagcuguucuucauccugcugacccccgugaaccacagcaccgccgacaagaucccccugaccaaggugggcagaagacuguacaccgugagacacagagagagcggcguggagagaagcaucgugugccagaucgacaccguggagggcagcaagaaggugaccaucagaagccccgugcagaucagaaaccacuucagcgugccccugagcguguacgagggcgacacccugcugggcaccgccagccccgagaacgaguucaacaucccccugggcagcuacagaagcuucaucuuccugaagcccgaggacgagaacuaccagaugugcgagggcaucgacuucgaggagaucaucaagaacgacggcgcccugcugaagaagaagugcagaagcaagaaccccagcaaggagagcuuccugaucaacaucgugcccgagaaggacaaccugaccagccugagcguguacagcgaggacggcugggaccugcccuacaucaugcaccuguggccccccauccugcugagaaaccugcugcccuacaagaucgccuacuacaucgagggcaucgagaacagcguguucacccugagcgagggccacagcgcccagaucugcaccgcccagcugggcaaggccagacugcaccugaagcugcuggacuaccugaaccacgacuggaagagcgaguaccacaucaagcccaaccagcaggacaucagcuucgugagcuucaccugcgugaccgagauggagaagaccgaccuggacaucgccgugcacaugaccuacaacaccggccagaccgugguggccuuccacagccccuacuggauggugaacaagaccggcagaaugcugcaguacaaggccgacggcauccacagaaagcacccccccaacuacaagaagcccgugcuguucagcuuccagcccaaccacuucuucaacaacaacaaggugcagcugauggugaccgacagcgagcugagcaaccaguucagcaucgacaccgugggcagccacggcgccgugaagugcaagggccugaagauggacuaccaggugggcgugaccaucgaccugagcagcuucaacaucaccagaaucgugaccuucacccccuucuacaugaucaagaacaagagcaaguaccacaucagcguggccgaggagggcaacgacaaguggcugagccuggaccuggagcagugcauccccuucuggcccgaguacgccagcagcaagcugcugauccagguggagagaagcgaggacccccccaagagaaucuacuucaacaagcaggagaacugcauccugcugagacuggacaacgagcugggcggcaucaucgccgaggugaaccuggccgagcacagcaccgugaucaccuuccuggacuaccacgacggcgccgccaccuuccugcugaucaaccacaccaagaacgagcuggugcaguacaaccagagcagccugagcgagaucgaggacagccugccccccggcaaggccguguucuacaccugggccgaccccgugggcagcagaagacugaaguggagaugcagaaagagccacggcgaggugacccagaaggacgacaugaugaugcccaucgaccugggcgagaagaccaucuaccuggugagcuucuucgagggccugcagagaaucauccuguucaccgaggaccccagaguguucaaggugaccuacgagagcgagaaggccgagcuggccgagcaggagaucgccguggcccugcaggacgugggcaucagccuggugaacaacuacaccaagcaggagguggccuacaucggcaucaccagcagcgacguggugugggagaccaagcccaagaagaaggccagauggaagcccaugagcgugaagcacaccgagaagcuggagagagaguucaaggaguacaccgagagcagccccagcgaggacaaggugauccagcuggacaccaacgugcccgugagacugacccccaccggccacaacaugaagauccugcagccccacgugaucgcccugagaagaaacuaccugcccgcccugaagguggaguacaacaccagcgcccaccagagcagcuucagaauccagaucuacagaauccagauccagaaccagauccacggcgccguguuccccuucguguucuaccccgugaagccccccaagagcgugaccauggacagcgcccccaagcccuucaccgacgugagcaucgugaugagaagcgccggccacagccagaucagcagaaucaaguacuucaaggugcugauccaggagauggaccugagacuggaccugggcuucaucuacgcccugaccgaccugaugaccgaggccgaggugaccgagaacaccgagguggagcuguuccacaaggacaucgaggccuucaaggaggaguacaagaccgccagccugguggaccagagccaggugagccuguacgaguacuuccacaucagccccaucaagcugcaccugagcgugagccugagcagcggcagagaggaggccaaggacagcaagcagaacggcggccugauccccgugcacagccugaaccugcugcugaagagcaucggcgccacccugaccgacgugcaggacgugguguucaagcuggccuucuucgagcugaacuaccaguuccacaccaccagcgaccugcagagcgaggugaucagacacuacagcaagcaggccaucaagcagauguacgugcugauccugggccuggacgugcugggcaaccccuucggccugaucagagaguucagcgagggcguggaggccuucuucuacgagcccuaccagggcgccauccagggccccgaggaguucguggagggcauggcccugggccugaaggcccuggugggcggcgccgugggcggccuggccggcgccgccagcaagaucaccggcgccauggccaagggcguggccgccaugaccauggacgaggacuaccagcagaagagaagagaggccaugaacaagcagcccgccggcuucagagagggcaucaccagaggcggcaagggccuggugagcggcuucgugagcggcaucaccggcaucgugaccaagcccaucaagggcgcccagaagggcggcgccgccggcuucuucaagggcgugggcaagggccuggugggcgccguggccagacccaccggcggcaucaucgacauggccagcagcaccuuccagggcaucaagagagccaccgagaccagcgagguggagagccugagaccccccagauucuucaacgaggacggcgugaucagacccuacagacugagagacggcaccggcaaccagaugcugcaggugauggagaacggcagauucgccaaguacaaguacuucacccacgugaugaucaacaagaccgacaugcugaugaucaccagaagaggcgugcuguucgugaccaagggcaccuucggccagcugaccugcgaguggcaguacagcuucgacgaguucaccaaggagcccuucaucgugcacggcagaagacugagaaucgaggccaaggagagagugaagagcguguuccacgccagagaguucggcaagaucaucaacuucaagacccccgaggacgccagauggauccugaccaagcugcaggaggccagagagcccagccccagccuguaa

SEQ ID NO: 25559 - RNA, 2592 nt, Artificial Sequence
  VPS13B__Homo_sapiens__NP_056058
augcuggagagcuacgugacccccauccugaugagcuacgugaacagauacaucaagaaccugaagcccagcgaccugcagcugagccuguggggcggcgacguggugcugagcaagcuggagcugaagcuggacgugcuggagcaggagcugaagcugcccuucaccuuccugagcggccacauccacgagcugagaauccacgugcccuggaccaagcugggcagcgagcccguggugaucaccaucaacaccauggagugcauccugaagcugaaggacggcauccaggacgaccacgagagcugcggcagcaacagcaccaacagaagcaccgccgagagcaccaagagcagcaucaagcccagaagaaugcagcaggccgcccccaccgaccccgaccugccccccggcuacgugcagagccugaucagaagaguggugaacaacgugaacaucgugaucaacaaccugauccugaaguacguggaggacgacaucgugcugagcgugaacaucaccagcgccgagugcuacaccgugggcgagcugugggacagagccuucauggacaucagcgccaccgaccuggugcugagaaaggugaucaacuucagcgacugcaccgugugccuggacaagagaaacgccagcggcaagaucgaguucuaccaggacccccugcuguacaagugcagcuucagaaccagacugcacuucaccuacgagaaccugaacagcaagaugcccagcgugaucaagauccacacccugguggagagccugaagcugagcaucaccgaccagcagcugcccauguucaucagaaucaugcagcugggcaucgcccuguacuacggcgagaucggcaacuucaaggagggcgagaucgaggaccugaccugccacaacaaggacaugcugggcaacaucaccggcagcgaggacgagaccagaaucgacaugcaguaccccgcccagcacaagggccaggagcuguacagccagcaggacgaggagcagccccagggcugggugagcugggccuggagcuucgugcccgccaucgugagcuacgacgacggcgaggaggacuucgugggcaacgaccccgccagcaccaugcaccagcagaaggcccagacccugaaggaccccaucgugagcaucggcuucuacugcaccaaggccaccgugaccuucaagcugaccgagaugcagguggagagcagcuacuacagcccccagaaggugaagagcaaggaggugcugugcugggagcaggagggcaccaccguggaggcccugaugaugggcgagcccuucuucgacugccagaucggcuucgugggcugcagagccaugugccugaagggcaucaugggcgugaaggacuucgaggagaacaugaacagaagcgagaccgaggccugcuucuucaucugcggcgacaaccugagcaccaagggcuucaccuaccugaccaacagccuguucgacuacagaagccccgagaacaacggcaccagagccgaguucauccuggacagcacccaccacaaggagaccuacaccgagaucgccggcaugcagagauucggcgccuucuacauggacuaccuguacaccauggagaacaccagcggcaagggcagcaccaaccagcaggacuucagcagcggcaagagcgaggaccugggcaccgugcaggagaagagcaccaagagccuggugaucggcccccuggacuucagacuggacagcagcgccgugcacagaauccugaagaugaucgugugcgcccuggagcacgaguacgagcccuacagcagacugaagagcgacaucaaggacgagaacgagaccauccugaaccccgaggagguggcccugcuggaggaguacauccccaccagacacaccagcgugacccugcugaagugcaccugcaccaucagcauggccgaguucaaccugcuggaccaccugcugcccgugaucaugggcgagaagaacagcagcaacuucaugaacaccaccaacuuccagagccugagaccccugcccagcaucagaauccugguggacaagaucaaccuggagcacagcgugcccauguacgccgagcagcuggugcacguggugagcagccugacccagcccagcgacaaccugcugcacuacugcuacgugcacugcuaccugaagaucuucggcuuccaggccggccugaccagccuggacugcagcggcagcuacugccugcccgugcccgugauccccagcuucagcaccgcccuguacggcaagcugcugaagcugcccaccugcuggaccaagagaagccagaucgccaucaccgagggcaucuucgagcugcccaaccugaccauccaggccaccagagcccagacccugcugcugcaggccaucuaccagagcuggagccaccugggcaacgugagcagcagcgccgugaucgaggcccugaucaacgagaucuuccugagcaucgagaucggcagcugcuacguggcccagguggaccuggagcugcuggccagcaacgacccccccaccagcaccagcuaa

SEQ ID NO: 25560 - RNA, 10887 nt, Artificial Sequence
  VPS13C__Homo_sapiens__NP_001018098
auggugcuggagagcgugguggccgaccugcugaacagauuccugggcgacuacguggagaaccugaacaagagccagcugaagcugggcaucuggggcggcaacguggcccuggacaaccugcagaucaaggagaacgcccugagcgagcuggacgugcccuucaaggugaaggccggccagaucgacaagcugacccugaagauccccuggaagaaccuguacggcgaggccgugguggccacccuggagggccuguaccugcugguggugcccggcgccagcaucaaguacgacgccgugaaggaggagaagagccugcaggacgugaagcagaaggagcugagcagaaucgaggaggcccugcagaaggccgccgagaagggcacccacagcggcgaguucaucuacggccuggagaacuucguguacaaggacaucaagcccggcagaaagagaaagaagcacaagaagcacuucaagaagcccuucaagggccuggacagaagcaaggacaagcccaaggaggccaagaaggacaccuucguggagaagcuggccacccaggugaucaagaacgugcaggugaagaucaccgacauccacaucaaguacgaggacgacgugaccgaccccaagagaccccugagcuucggcgugacccugggcgagcugagccugcugaccgccaacgagcacuggacccccugcauccugaacgaggccgacaagaucaucuacaagcugaucagacuggacagccugagcgccuacuggaacgugaacugcagcaugagcuaccagagaagcagagagcagauccuggaccagcugaagaacgagauccugaccagcggcaacaucccccccaacuaccaguacaucuuccagcccaucagcgccagcgccaagcuguacaugaaccccuacgccgagagcgagcugaagacccccaagcuggacugcaacaucgagauccagaacaucgccaucgagcugaccaagccccaguaccugagcaugaucgaccugcuggagagcguggacuacauggugagaaacgcccccuacagaaaguacaagcccuaccugccccugcacaccaacggcagaagaugguggaaguacgccaucgacagcgugcuggaggugcacaucagaagauacacccagauguggagcuggagcaacaucaagaagcacagacagcugcugaagagcuacaagaucgccuacaagaacaagcugacccagagcaaggugagcgaggagauccagaaggagauccaggaccuggagaagacccuggacguguucaacaucauccuggccagacagcaggcccagguggaggugaucagaagcggccagaagcugagaaagaagagcgccgacaccggcgagaagagaggcggcugguucagcggccuguggggcaagaaggagagcaagaagaaggacgaggagagccugauccccgagaccaucgacgaccugaugacccccgaggagaaggacaagcuguucaccgccaucggcuacagcgagagcacccacaaccugacccugcccaagcaguacguggcccacaucaugacccugaagcuggugagcaccagcgugaccaucagagagaacaagaacauccccgagauccugaagauccagaucaucggccugggcacccaggugagccagagacccggcgcccaggcccugaagguggaggccaagcuggagcacugguacaucaccggccugagacagcaggacaucgugcccagccugguggccagcaucggcgacaccaccagcagccugcugaagaucaaguucgagaccaaccccgaggacagccccgccgaccagacccugaucgugcagagccagcccguggaggugaucuacgacgccaagaccgugaacgccgugguggaguucuuccagagcaacaagggccuggaccuggagcagaucaccagcgccacccugaugaagcuggaggagaucaaggagagaaccgccaccggccugacccacaucaucgagaccagaaaggugcuggaccugagaaucaaccugaagcccagcuaccugguggugccccagaccggcuuccaccacgagaagagcgaccugcugauccuggacuucggcaccuuccagcugaacagcaaggaccagggccugcagaagaccaccaacagcagccuggaggagaucauggacaaggccuacgacaaguucgacguggagaucaagaacgugcagcugcuguucgccagagccgaggagaccuggaagaagugcagauuccagcaccccagcaccaugcacauccugcagcccauggacauccacguggagcuggccaaggccaugguggagaaggacaucagaauggccagauucaaggugagcggcggccugccccugaugcacgugagaaucagcgaccagaagaugaaggacgugcuguaccugaugaacagcaucccccugccccagaagagcagcgcccagagccccgagagacaggugagcagcauccccaucaucagcggcggcaccaagggccugcugggcaccagccugcugcuggacaccguggagagcgagagcgacgacgaguacuucgacgccgaggacggcgagccccagaccugcaagagcaugaagggcagcgagcugaagaaggccgccgaggugcccaacgaggagcugaucaaccugcugcugaaguucgagaucaaggaggugauccuggaguucaccaagcagcagaaggaggaggacaccauccugguguucaacgugacccagcugggcaccgaggccaccaugagaaccuucgaccugaccguggugagcuaccugaagaagaucagccuggacuaccacgagaucgagggcagcaagagaaagccccugcaccugaucagcagcagcgacaagcccggccuggaccugcugaagguggaguacaucaaggccgacaagaacggccccagcuuccagaccgccuucggcaagaccgagcagaccgugaagguggccuucagcagccugaaccugcugcugcagacccaggcccugguggccagcaucaacuaccugaccaccaucauccccagcgacgaccagagcaucagcguggccaaggaggugcagaucagcaccgagaagcagcagaagaacagcacccugcccaaggccaucgugagcagcagagacagcgacaucaucgacuucagacuguucgccaagcugaacgccuucugcgugaucgugugcaacgagaagaacaacaucgccgagaucaagauccagggccuggacagcagccugagccugcagagcagaaagcagagccuguucgccagacuggagaacaucaucgugaccgacguggaccccaagaccgugcacaagaaggccgugagcaucaugggcaacgagguguucagauucaaccuggaccuguaccccgacgccaccgagggcgaccuguacaccgacaugagcaagguggacggcgugcugagccugaacgugggcugcauccagaucguguaccugcacaaguuccugaugagccugcugaacuuccugaacaacuuccagaccgccaaggagagccugagcgccgccaccgcccaggccgccgagagagccgccaccagcgugaaggaccuggcccagagaagcuucagagugagcaucaacaucgaccugaaggcccccgugaucgugaucccccagagcagcaucagcaccaacgccguggugguggaccugggccugaucagagugcacaaccaguucagccuggugagcgacgaggacuaccugaacccccccgugaucgacagaauggacgugcagcugaccaagcugacccuguacagaaccgugauccagcccggcaucuaccaccccgacauccagcugcugcaccccaucaaccuggaguuccuggugaacagaaaccuggccgccagcugguaccacaaggugcccgugguggagaucaagggccaccuggacagcaugaacgugagccugaaccaggaggaccugaaccugcuguucagaauccugaccgagaaccugugcgagggcaccgaggaccuggacaaggugaagcccagagugcaggagaccggcgagaucaaggagccccuggagaucagcaucagccaggacgugcacgacagcaagaacacccugaccaccggcguggaggagaucagaagcguggacaucaucaacaugcugcugaacuucgagaucaaggaggugguggugacccugaugaagaagagcgagaagaagggcagaccccugcacgagcugaacgugcugcagcugggcauggaggccaaggugaagaccuacgacaugaccgccaaggccuaccugaagaagaucagcaugcagugcuucgacuucaccgacagcaagggcgagccccugcacaucaucaacagcagcaacgugaccgacgagccccugcugaagaugcugcugaccaaggccgacagcgacggccccgaguucaagaccauccacgacagcaccaagcagagacugaaggugagcuucgccagccuggaccuggugcugcaccuggaggcccugcugagcuucauggacuuccugagcagcgccgcccccuucagcgagcccagcagcagcgagaaggagagcgagcugaagccccuggugggcgagagcagaagcaucgccgugaaggccgugagcagcaacaucagccagaaggacguguucgaccugaagaucaccgccgagcugaacgccuucaacguguucgugugcgaccagaagugcaacaucgccgacaucaagauccacggcauggacgccagcaucagcgugaagcccaagcagaccgacguguucgccagacugaaggacaucaucgugaugaacguggaccugcagagcauccacaagaaggccgugagcauccugggcgacgagguguucagauuccagcugacccuguaccccgacgccaccgagggcgaggccuacgccgacaugagcaagguggacggcaagcugagcuucaaggugggcugcauccagaucguguacgugcacaaguucuucaugagccugcugaacuuccugaacaacuuccagaccgccaaggaggcccugagcaccgccaccgugcaggccgccgagagagccgccagcagcaugaaggaccuggcccagaagagcuucagacugcugauggacaucaaccugaaggcccccgugaucaucaucccccagagcagcgugagccccaacgccgugaucgccgaccugggccugaucagaguggagaacaaguucagccuggugcccauggagcacuacagccugccccccgugaucgacaagaugaacaucgagcugacccagcugaagcugagcagaaccauccugcaggccagccugccccagaacgacaucgagauccugaagcccgugaacaugcugcugagcauccagagaaaccuggccgccgccugguacgugcagauccccggcauggagaucaagggcaagcugaagcccaugcagguggcccugagcgaggacgaccugaccgugcugaugaagauccugcuggagaaccugggcgaggccagcagccagcccagccccacccagagcgugcaggagaccgugagagugagaaagguggacgugagcagcgugcccgaccaccugaaggagcaggaggacuggaccgacagcaagcugagcaugaaccagaucgugagccugcaguucgacuuccacuucgagagccugagcaucauccuguacaacaacgacaucaaccaggagagcggcguggccuuccacaacgacagcuuccagcugggcgagcugagacugcaccugauggccagcagcggcaagauguucaaggacggcagcaugaacgugagcgugaagcugaagaccugcacccuggacgaccugagagagggcaucgagagagccaccagcagaaugaucgacagaaagaacgaccaggacaacaacagcagcaugaucgacaucagcuacaagcaggacaagaacggcagccagaucgacgccgugcuggacaagcuguacgugugcgccagcguggaguuccugaugaccguggccgacuucuucaucaaggccgugccccagagccccgagaacguggccaaggagacccagauccugcccagacagaccgccaccggcaaggugaagaucgagaaggacgacagcgugagacccaacaugacccugaaggccaugaucaccgaccccgaggugguguucguggccagccugaccaaggccgacgcccccgcccugaccgccagcuuccagugcaaccugagccugagcaccagcaagcuggagcagaugauggaggccagcgugagagaccugaaggugcuggccugccccuuccugagagagaagagaggcaagaacaucaccaccgugcugcagcccugcagccuguucauggagaagugcaccugggccagcggcaagcagaacaucaacaucauggugaaggaguucaucaucaagaucagccccaucauccugaacaccgugcugaccaucauggccgcccugagccccaagaccaaggaggacggcagcaaggacaccagcaaggagauggagaaccuguggggcaucaagagcaucaacgacuacaacaccugguuccugggcguggacaccgccaccgagaucaccgagagcuucaagggcaucgagcacagccugaucgaggagaacugcggcguggugguggagagcauccaggugacccuggagugcggccugggccacagaaccgugccccugcugcuggccgagagcaaguucagcggcaacaucaagaacuggaccagccugauggccgccguggccgacgugacccugcaggugcacuacuacaacgagauccacgccgugugggagccccugaucgagagaguggagggcaagagacaguggaaccugagacuggacgugaagaagaaccccgugcaggacaagagccugcugcccggcgacgacuucauccccgagccccagauggccauccacaucagcagcggcaacaccaugaacaucaccaucagcaagagcugccugaacguguucaacaaccuggccaagggcuucagcgagggcaccgccagcaccuucgacuacagccugaaggacagagcccccuucaccgugaagaacgccgugggcgugcccaucaaggugaagcccaacugcaaccugagagugaugggcuuccccgagaagagcgacaucuucgacguggacgccggccagaaccuggagcuggaguacgccagcauggugcccagcagccagggcaaccugagcauccugagcagacaggagagcagcuucuucacccugaccaucgugccccacggcuacaccgagguggccaacauccccguggccagacccggcagaagacuguacaacgugagaaaccccaacgccagccacagcgacagcgugcuggugcagaucgacgccaccgagggcaacaaggugaucacccugagaagcccccugcagaucaagaaccacuucagcaucgccuucaucaucuacaaguucgugaagaacgugaagcugcuggagagaaucggcaucgccagacccgaggaggaguuccacgugccccuggacagcuacagaugccagcuguucauccagcccgccggcauccuggagcaccaguacaaggagagcaccaccuacaucagcuggaaggaggagcugcacagaagcagagaggugagaugcaugcugcagugccccagcguggaggugagcuuccugccccugaucgugaacaccguggcccugcccgacgagcugagcuacaucugcacccacggcgaggacugggacguggccuacaucauccaccuguaccccagccugacccugagaaaccugcugcccuacagccugagauaccugcuggagggcaccgccgagacccacgagcuggccgagggcagcaccgccgacgugcugcacagcagaaucagcggcgagaucauggagcuggugcuggugaaguaccagggcaagaacuggaacggccacuucagaaucagagacacccugcccgaguucuuccccgugugcuucagcagcgacagcaccgaggugaccaccguggaccugagcgugcacgugagaagaaucggcagcagaauggugcugagcguguucagccccuacuggcugaucaacaagaccaccagagugcugcaguacagaagcgaggacauccacgugaagcaccccgccgacuucagagacaucauccuguucagcuucaagaagaagaacaucuucaccaagaacaaggugcagcugaagaucagcaccagcgccuggagcagcagcuucagccuggacaccgugggcagcuacggcugcgugaagugccccgccaacaacauggaguaccuggugggcgugagcaucaagaugagcagcuucaaccugagcagaaucgugacccugacccccuucugcaccaucgccaacaagagcagccuggagcuggaggugggcgagaucgccagcgacggcagcaugcccaccaacaaguggaacuacaucgccagcagcgagugccugcccuucuggcccgagagccugagcggcaagcugugcgugagaguggugggcugcgagggcagcagcaagcccuucuucuacaacagacaggacaacggcacccugcugagccuggaggaccugaacggcggcauccugguggacgugaacaccgccgagcacagcaccgugaucaccuucagcgacuaccacgagggcagcgcccccgcccugaucaugaaccacacccccugggacauccugaccuacaagcagagcggcagccccgaggagauggugcugcugcccagacaggccagacuguucgccugggccgaccccaccggcaccagaaagcugaccuggaccuacgccgccaacgugggcgagcacgaccugcugaaggacggcugcggccaguuccccuacgacgccaacauccagauccacugggugagcuuccuggacggcagacagagagugcugcuguucaccgacgacguggcccuggugagcaaggcccugcaggccgaggagauggagcaggccgacuacgagaucacccugagccugcacagccugggccugagccuggugaacaacgagagcaagcaggaggugagcuacaucggcaucaccagcagcggcguggugugggaggugaagcccaagcagaaguggaagcccuucagccagaagcagaucauccugcuggagcagagcuaccagaagcaccagaucagcagagaccacggcuggaucaagcuggacaacaacuucgaggugaacuucgacaaggaccccauggagaugagacugcccaucagaagccccaucaagagagacuuccugagcggcauccagaucgaguucaagcagagcagccaccagagaagccugagagccagacuguacuggcugcagguggacaaccagcugcccggcgccauguuccccgugguguuccaccccguggccccccccaagagcaucgcccuggacagcgagcccaagcccuucaucgacgugagcgugaucaccagauucaacgaguacagcaaggugcugcaguucaaguacuucauggugcugauccaggagauggcccugaagaucgaccagggcuuccugggcgccaucaucgcccuguucacccccaccaccgaccccgaggccgagagaagaagaaccaagcugauccagcaggacaucgacgcccugaacgccgagcugauggagaccagcaugaccgacaugagcauccugagcuucuucgagcacuuccacaucagccccgugaagcugcaccugagccugagccugggcagcggcggcgaggagagcgacaaggagaagcaggagauguucgccgugcacagcgugaaccugcugcugaagagcaucggcgccacccugaccgacguggacgaccugaucuucaagcuggccuacuacgagaucagauaccaguucuacaagagagaccagcugaucuggagcguggugagacacuacagcgagcaguuccugaagcagauguacgugcuggugcugggccuggacgugcugggcaaccccuucggccugaucagaggccugagcgagggcguggaggcccuguucuacgagcccuuccagggcgccgugcagggccccgaggaguucgccgagggccuggugaucggcgugagaagccuguucggccacaccgugggcggcgccgccggcguggugagcagaaucaccggcagcgugggcaagggccuggccgccaucaccauggacaaggaguaccagcagaagagaagagaggagcugagcagacagcccagagacuucggcgacagccuggccagaggcggcaagggcuuccugagaggcguggugggcggcgugaccggcaucaucaccaagcccguggagggcgccaagaaggagggcgccgccggcuucuucaagggcaucggcaagggccuggugggcgccguggccagacccaccggcggcaucguggacauggccagcagcaccuuccagggcauccagagagccgccgagagcaccgaggaggugagcagccugagaccccccagacugauccacgaggacggcaucaucagacccuacgacagacaggagagcgagggcagcgaccugcuggagcaggagcuggagauccaggaguaa

SEQ ID NO: 25561 - RNA, 756 nt, Artificial Sequence
  VPS26A__Homo_sapiens__NP_001030337
augagcuuccugggcggcuucuucggccccaucugcgagaucgacaucgugcugaacgacggcgagaccagaaagauggccgagaugaagaccgaggacggcaagguggagaagcacuaccuguucuacgacggcgagagcgugagcggcaaggugaaccuggccuucaagcagcccggcaagagacuggagcaccagggcaucagaaucgaguucgugggccagaucgagcuguucaacgacaagagcaacacccacgaguucgugaaccuggugaaggagcuggcccugcccggcgagcugacccagagcagaagcuacgacuucgaguucaugcagguggagaagcccuacgagagcuacaucggcgccaacgugagacugagauacuuccugaaggugaccaucgugagaagacugaccgaccuggugaaggaguacgaccugaucgugcaccagcuggccaccuaccccgacgugaacaacagcaucaagauggaggugggcaucgaggacugccugcacaucgaguucgaguacaacaagagcaaguaccaccugaaggacgugaucgugggcaagaucuacuuccugcuggugagaaucaagauccagcacauggagcugcagcugaucaagaaggagaucaccggcaucggccccagcaccaccaccgagaccgagaccaucgccaaguacgagaucauggacggcgcccccgugaagggcgacaacuucauggagaagagcagcuaa

SEQ ID NO: 25562 - RNA, 666 nt, Artificial Sequence
  VPS28__Homo_sapiens__NP_057292
auguuccacggcauccccgccacccccggcaucggcgcccccggcaacaagcccgagcuguacgaggaggugaagcuguacaagaacgccagagagagagagaaguacgacaacauggccgagcuguucgccguggugaagaccaugcaggcccuggagaaggccuacaucaaggacugcgugagccccagcgaguacaccgccgccugcagcagacugcuggugcaguacaaggccgccuucagacaggugcagggcagcgagaucagcagcaucgacgaguucugcagaaaguucagacuggacugcccccuggccauggagagaaucaaggaggacagacccaucaccaucaaggacgacaagggcaaccugaacagaugcaucgccgacguggugagccuguucaucaccgugauggacaagcugagacuggagaucagagccauggacgagauccagcccgaccugagagagcugauggagaccaugcacagaaugagccaccugccccccgacuucgagggcagacagaccgugagccaguggcugcagacccugagcggcaugagcgccagcgacgagcuggacgacagccaggugagacagaugcuguucgaccuggagagcgccuacaacgccuucaacagauuccugcacgccuaa

SEQ ID NO: 25563 - RNA, 1791 nt, Artificial Sequence
  VPS33A__Homo_sapiens__NP_075067
auggccgcccaccugagcuacggcagagugaaccugaacgugcugagagaggccgugagaagagagcugagagaguuccuggacaagugcgccggcagcaaggccaucgugugggacgaguaccugaccggccccuucggccugaucgcccaguacagccugcugaaggagcacgagguggagaagauguucacccugaagggcaacagacugcccgccgccgacgugaagaacaucaucuucuucgugagacccagacuggagcugauggacaucaucgccgagaacgugcugagcgaggacagaagaggccccaccagagacuuccacauccuguucgugcccagaagaagccugcugugcgagcagagacugaaggaccugggcgugcugggcagcuucauccacagagaggaguacagccuggaccugauccccuucgacggcgaccugcugagcauggagagcgagggcgccuucaaggagugcuaccuggagggcgaccagaccagccuguaccacgccgccaagggccugaugacccugcaggcccuguacggcaccaucccccagaucuucggcaagggcgagugcgccagacagguggccaacaugaugaucagaaugaagagagaguucaccggcagccagaacagcaucuuccccguguucgacaaccugcugcugcuggacagaaacguggaccugcugaccccccuggccacccagcugaccuacgagggccugaucgacgagaucuacggcauccagaacagcuacgugaagcugccccccgagaaguucgcccccaagaagcagggcgacggcggcaaggaccugcccaccgaggccaagaagcugcagcugaacagcgccgaggagcuguacgccgagaucagagacaagaacuucaacgccgugggcagcgugcugagcaagaaggccaagaucaucagcgccgccuucgaggagagacacaacgccaagaccgugggcgagaucaagcaguucgugagccagcugccccacaugcaggccgccagaggcagccuggccaaccacaccagcaucgccgagcugaucaaggacgugaccaccagcgaggacuucuucgacaagcugaccguggagcaggaguucaugagcggcaucgacaccgacaaggugaacaacuacaucgaggacugcaucgcccagaagcacagccugaucaaggugcugagacuggugugccugcagagcgugugcaacagcggccugaagcagaaggugcuggacuacuacaagagagagauccugcagaccuacggcuacgagcacauccugacccugcacaaccuggagaaggccggccugcugaagccccagaccggcggcagaaacaacuaccccaccaucagaaagacccugagacuguggauggacgacgugaacgagcagaaccccaccgacaucagcuacguguacagcggcuacgccccccugagcgugagacuggcccagcugcugagcagacccggcuggagaagcaucgaggaggugcugagaauccugcccggcccccacuucgaggagagacagccccugcccaccggccugcagaagaagagacagcccggcgagaacagagugacccugaucuucuuccugggcggcgugaccuucgccgagaucgccgcccugagauuccugagccagcuggaggacggcggcaccgaguacgugaucgccaccaccaagcugaugaacggcaccagcuggaucgaggcccugauggagaagcccuucuaa

SEQ ID NO: 25564 - RNA, 1854 nt, Artificial Sequence
  VPS33B__Homo_sapiens__NP_061138
auggccuucccccacagacccgacgcccccgagcugcccgacuucagcaugcugaagagacuggccagagaccagcugaucuaccugcuggagcagcugcccggcaagaaggaccuguucaucgaggccgaccugaugagcccccuggacagaaucgccaacgugagcauccugaagcagcacgagguggacaagcuguacaagguggagaacaagcccgcccugagcagcaacgagcagcugugcuuccuggugagacccagaaucaagaacaugagauacaucgccagccuggugaacgccgacaagcuggccggcagaaccagaaaguacaaggugaucuucagcccccagaaguucuacgccugcgagauggugcuggaggaggagggcaucuacggcgacgugagcugcgacgagugggccuucagccugcugccccuggacguggaccugcugagcauggagcugcccgaguucuucagagacuacuuccuggagggcgaccagagauggaucaacaccguggcccaggcccugcaccugcugagcacccuguacggccccuuccccaacugcuacggcaucggcagaugcgccaagauggccuacgagcuguggagaaaccuggaggaggaggaggacggcgagaccaagggcagaagacccgagaucggccacaucuuccugcuggacagagacguggacuucgugaccgcccugugcagccaggugguguacgagggccugguggacgacaccuucagaaucaagugcggcagcguggacuucggccccgaggugaccagcagcgacaagagccugaaggugcugcugaacgccgaggacaagguguucaacgagaucagaaacgagcacuucagcaacguguucggcuuccugagccagaaggccagaaaccugcaggcccaguacgacagaagaagaggcauggacaucaagcagaugaagaacuucgugagccaggagcugaagggccugaagcaggagcacagacugcugagccugcacaucggcgccugcgagagcaucaugaagaagaagaccaagcaggacuuccaggagcugaucaagaccgagcacgcccugcuggagggcuucaacaucagagagagcaccagcuacaucgaggagcacaucgacagacaggugagccccaucgagagccugagacugaugugccugcugagcaucaccgagaacggccugauccccaaggacuacagaagccugaagacccaguaccugcagagcuacggccccgagcaccugcugaccuucagcaaccugagaagagccggccugcugaccgagcaggcccccggcgacacccugaccgccguggagagcaaggugagcaagcuggugaccgacaaggccgccggcaagaucaccgacgccuucagcagccuggccaagagaagcaacuucagagccaucagcaagaagcugaaccugauccccagaguggacggcgaguacgaccugaaggugcccagagacauggccuacguguucggcggcgccuacgugccccugagcugcagaaucaucgagcaggugcuggagagaagaagcuggcagggccuggacgagguggugagacugcugaacugcagcgacuucgccuucaccgacaugaccaaggaggacaaggccagcagcgagagccugagacugauccuggugguguuccugggcggcugcaccuucagcgagaucagcgcccugagauuccugggcagagagaagggcuacagauucaucuuccugaccaccgccgugaccaacagcgccagacugauggaggccaugagcgaggugaaggccuaa

SEQ ID NO: 25565 - RNA, 2391 nt, Artificial Sequence
  VPS35__Homo_sapiens__NP_060676
augcccaccacccagcagagcccccaggacgagcaggagaagcugcuggacgaggccauccaggccgugaaggugcagagcuuccagaugaagagaugccuggacaagaacaagcugauggacgcccugaagcacgccagcaacaugcugggcgagcugagaaccagcaugcugagccccaagagcuacuacgagcuguacauggccaucagcgacgagcugcacuaccuggagguguaccugaccgacgaguucgccaagggcagaaagguggccgaccuguacgagcuggugcaguacgccggcaacaucauccccagacuguaccugcugaucaccgugggcgugguguacgugaagagcuucccccagagcagaaaggacauccugaaggaccugguggagaugugcagaggcgugcagcacccccugagaggccuguuccugagaaacuaccugcugcagugcaccagaaacauccugcccgacgagggcgagcccaccgacgaggagaccaccggcgacaucagcgacagcauggacuucgugcugcugaacuucgccgagaugaacaagcugugggugagaaugcagcaccagggccacagcagagacagagagaagagagagagagagagacaggagcugagaauccuggugggcaccaaccuggugagacugagccagcuggagggcgugaacguggagagauacaagcagaucgugcugaccggcauccuggagcagguggugaacugcagagacgcccuggcccaggaguaccugauggagugcaucauccagguguuccccgacgaguuccaccugcagacccugaaccccuuccugagagccugcgccgagcugcaccagaacgugaacgugaagaacaucaucaucgcccugaucgacagacuggcccuguucgcccacagagaggacggccccggcauccccgccgacaucaagcuguucgacaucuucagccagcagguggccaccgugauccagagcagacaggacaugcccagcgaggacguggugagccugcaggugagccugaucaaccuggccaugaagugcuaccccgacagaguggacuacguggacaaggugcuggagaccaccguggagaucuucaacaagcugaaccuggagcacaucgccaccagcagcgccgugagcaaggagcugaccagacugcugaagauccccguggacaccuacaacaacauccugaccgugcugaagcugaagcacuuccacccccuguucgaguacuucgacuacgagagcagaaagagcaugagcugcuacgugcugagcaacgugcuggacuacaacaccgagaucgugagccaggaccagguggacagcaucaugaaccuggugagcacccugauccaggaccagcccgaccagcccguggaggaccccgaccccgaggacuucgccgacgagcagagccuggugggcagauucauccaccugcugagaagcgaggaccccgaccagcaguaccugauccugaacaccgccagaaagcacuucggcgccggcggcaaccagagaaucagauucacccugcccccccugguguucgccgccuaccagcuggccuucagauacaaggagaacagcaagguggacgacaagugggagaagaagugccagaagaucuucagcuucgcccaccagaccaucagcgcccugaucaaggccgagcuggccgagcugccccugagacuguuccugcagggcgcccuggccgccggcgagaucggcuucgagaaccacgagaccguggccuacgaguucaugagccaggccuucagccuguacgaggacgagaucagcgacagcaaggcccagcuggccgccaucacccugaucaucggcaccuucgagagaaugaagugcuucagcgaggagaaccacgagccccugagaacccagugcgcccuggccgccagcaagcugcugaagaagcccgaccagggcagagccgugagcaccugcgcccaccuguucuggagcggcagaaacaccgacaagaacggcgaggagcugcacggcggcaagagagugauggagugccugaagaaggcccugaagaucgccaaccagugcauggaccccagccugcaggugcagcuguucaucgagauccugaacagauacaucuacuucuacgagaaggagaacgacgccgugaccauccaggugcugaaccagcugauccagaagaucagagaggaccugcccaaccuggagagcagcgaggagaccgagcagaucaacaagcacuuccacaacacccuggagcaccugagacugagaagagagagccccgagagcgagggccccaucuacgagggccugauccuguaa

SEQ ID NO: 25566 - RNA, 1161 nt, Artificial Sequence
  VPS36__Homo_sapiens__NP_057159
auggacagauucguguggaccagcggccugcuggagaucaacgagacccuggugauccagcagagaggcgugagaaucuacgacggcgaggagaagaucaaguucgacgccggcacccugcugcugagcacccacagacugaucuggagagaccagaagaaccacgagugcugcauggccauccugcugagccagaucguguucaucgaggagcaggccgccggcaucggcaagagcgccaagaucguggugcaccugcaccccgccccccccaacaaggagcccggccccuuccagagcagcaagaacagcuacaucaagcugagcuucaaggagcacggccagaucgaguucuacagaagacugagcgaggagaugacccagagaagaugggagaacaugcccgugagccagagccugcagaccaacagaggcccccagcccggcagaaucagagccgugggcaucgugggcaucgagagaaagcuggaggagaagagaaaggagaccgacaagaacaucagcgaggccuucgaggaccugagcaagcugaugaucaaggccaaggagaugguggagcugagcaagagcaucgccaacaagaucaaggacaagcagggcgacaucaccgaggacgagaccaucagauucaagagcuaccugcugagcaugggcaucgccaaccccgugaccagagagaccuacggcagcggcacccaguaccacaugcagcuggccaagcagcuggccggcauccugcaggugccccuggaggagagaggcggcaucaugagccugaccgagguguacugccuggugaacagagccagaggcauggagcugcugagccccgaggaccuggugaacgccugcaagaugcuggaggcccugaagcugccccugagacugagaguguucgacagcggcgugauggugaucgagcugcagagccacaaggaggaggagaugguggccagcgcccuggagaccgugagcgagaagggcagccugaccagcgaggaguucgccaagcuggugggcaugagcgugcugcuggccaaggagagacugcugcuggccgagaagaugggccaccugugcagagacgacagcguggagggccugagauucuaccccaaccuguucaugacccagagcuaa

SEQ ID NO: 25567 - RNA, 1119 nt, Artificial Sequence
  VPS37A__Homo_sapiens__NP_001138624
augagcuggcuguucccccugaccaagagcgccagcagcagcgccgccggcagccccggcggccugaccagccugcagcagcagaagcagagacugaucgagagccugagaaacagccacagcagacugcugcccccccaguucccccaggagaagcccgugaucagcguguacccccccaucagacaccaccugauggacaagcagggcguguacgugaccagcccccuggugaacaacuucaccaugcacagcgaccugggcaagaucauccagagccugcuggacgaguucuggaagaacccccccgugcuggcccccaccagcaccgccuuccccuaccuguacagcaaccccagcggcaugagccccuacgccagccagggcuuccccuuccugccccccuaccccccccaggaggccaacagaagcaucaccagccugagcguggccgacaccgugagcagcagcaccaccagccacaccaccgccaagcccgccgcccccagcuucggcgugcugagcaaccugccccugcccauccccaccguggacgccagcauccccaccagccagaacggcuucggcuacaagaugcccgacgugcccgacgccuuccccgagcugagcgagcugagcgugagccagcugaccgacaugaacgagcaggaggaggugcugcuggagcaguuccugacccugccccagcugaagcagaucaucaccgacaaggacgaccuggugaagagcaucgaggagcuggccagaaagaaccugcugcuggagcccagccuggaggccaagagacagaccgugcuggacaaguacgagcugcugacccagaugaagagcaccuucgagaagaagaugcagagacagcacgagcugagcgagagcugcagcgccagcgcccugcaggccagacugaagguggccgcccacgaggccgaggaggagagcgacaacaucgccgaggacuuccuggagggcaagauggagaucgacgacuuccugagcagcuucauggagaagagaaccaucugccacugcagaagagccaaggaggagaagcugcagcaggccaucgccaugcacagccaguuccacgccccccuguaa

SEQ ID NO: 25568 - RNA, 858 nt, Artificial Sequence
  VPS37B__Homo_sapiens__NP_078943
auggccggcgccggcagcgaggccagauucgccggccugagccuggugcagcugaacgagcugcuggaggacgagggccagcugaccgagauggugcagaagauggaggagacccagaacgugcagcugaacaaggagaugacccuggccagcaacagaagccuggccgagggcaaccugcuguaccagccccagcuggacacccugaaggccagacugacccagaaguaccaggagcugcaggugcuguucgaggccuaccagaucaagaagaccaagcuggacagacagagcagcagcgccagccuggagacccugcuggcccugcugcaggccgagggcgccaagaucgaggaggacaccgagaacauggccgagaaguuccuggacggcgagcugccccuggacagcuucaucgacguguaccagagcaagagaaagcuggcccacaugagaagagugaagaucgagaagcugcaggagauggugcugaagggccagagacugccccaggcccuggccccccugccccccagacugcccgagcuggcccccaccgccccccugcccuaccccgcccccgaggccagcggcccccccgccguggcccccagaagaaucccccccccccccccccccgugcccgccggcagacuggccacccccuucaccgccgccaugagcagcggccaggccgugcccuaccccggccugcagugccccccccugccccccagagugggccugcccacccagcagggcuucagcagccaguucgugagccccuacccccccccccugccccagagacccccccccagacugcccccccaccagcccggcuucauccugcaguaa

SEQ ID NO: 25569 - RNA, 1068 nt, Artificial Sequence
  VPS37C__Homo_sapiens__NP_060436
auggagacccugaaggacaagacccugcaggagcuggaggagcugcagaacgacagcgaggccaucgaccagcuggcccuggagagccccgaggugcaggaccugcagcuggagagagagauggcccuggccaccaacagaagccuggccgagagaaaccuggaguuccagggcccccuggagaucagcagaagcaaccugagcgacagauaccaggagcugagaaagcugguggagagaugccaggagcagaaggccaagcuggagaaguucagcagcgcccugcagcccggcacccugcuggaccugcugcagguggagggcaugaagaucgaggaggagagcgaggccauggccgagaaguuccuggagggcgaggugccccuggagaccuuccuggagaacuucagcagcaugagaaugcugagccaccugagaagagugagaguggagaagcugcaggagguggugagaaagcccagagccagccaggagcuggccggcgacgcccccccccccagaccccccccccccgugagacccgugccccagggcaccccccccgugguggaggagcagccccagcccccccuggccaugccccccuacccccugcccuacagccccagccccagccugcccgugggccccaccgcccacggcgcccugccccccgcccccuuccccguggugagccagcccagcuucuacagcggcccccugggccccaccuaccccgccgcccagcugggccccagaggcgccgccggcuacagcuggagcccccagagaagcaugccccccagacccggcuaccccggcacccccaugggcgccagcggccccggcuacccccugagaggcggcagagcccccagccccggcuacccccagcagagccccuaccccgccaccggcggcaagccccccuaccccauccagccccagcugcccagcuuccccggccagccccagcccagcgugccccugcagccccccuacccccccggccccgccccccccuacggcuucccccccccccccggccccgccuggcccggcuacuaa

SEQ ID NO: 25570 - RNA, 2661 nt, Artificial Sequence
  VPS39__Homo_sapiens__NP_001288067
augcacgacgccuucgagcccgugcccauccuggagaagcugccccugcagaucgacugccuggccgccugggaggaguggcugcuggugggcaccaagcagggccaccugcugcuguacagaaucagaaaggacguggugcccgccgacguggccagccccgagagcggcagcugcaacagauucgaggugacccuggagaagagcaacaagaacuucagcaagaagauccagcagauccacguggugagccaguucaagauccuggugagccugcuggagaacaacaucuacgugcacgaccugcugaccuuccagcagaucaccaccgugagcaaggccaagggcgccagccuguucaccugcgaccugcagcacaccgagaccggcgaggaggugcugagaaugugcguggccgugaagaagaagcugcagcuguacuucuggaaggacagagaguuccacgagcugcagggcgacuucagcgugcccgacgugcccaagagcauggccuggugcgagaacagcaucugcgugggcuucaagagagacuacuaccugaucagaguggacggcaagggcagcaucaaggagcuguuccccaccggcaagcagcuggagccccugguggccccccuggccgacggcaagguggccgugggccaggacgaccugaccguggugcugaacgaggagggcaucugcacccagaagugcgcccugaacuggaccgacauccccguggccauggagcaccagccccccuacaucaucgccgugcugcccagauacguggagaucagaaccuucgagcccagacugcuggugcagagcaucgagcugcagagacccagauucaucaccagcggcggcagcaacaucaucuacguggccagcaaccacuucguguggagacugauccccgugcccauggccacccagauccagcagcugcugcaggacaagcaguucgagcuggcccugcagcuggccgagaugaaggacgacagcgacagcgagaagcagcagcagauccaccacaucaagaaccuguacgccuucaaccuguucugccagaagagauucgacgagagcaugcagguguucgccaagcugggcaccgaccccacccacgugaugggccuguaccccgaccugcugcccaccgacuacagaaagcagcugcaguaccccaacccccugcccgugcugagcggcgccgagcuggagaaggcccaccuggcccugaucgacuaccugacccagaagagaagccagcuggugaagaagcugaacgacagcgaccaccagagcagcaccagcccccugauggagggcacccccaccaucaagagcaagaagaagcugcugcagaucaucgacaccacccugcugaagugcuaccugcacaccaacguggcccugguggccccccugcugagacuggagaacaaccacugccacaucgaggagagcgagcacgugcugaagaaggcccacaaguacagcgagcugaucauccuguacgagaagaagggccugcacgagaaggcccugcaggugcugguggaccagagcaagaaggccaacagcccccugaagggccacgagagaaccgugcaguaccugcagcaccugggcaccgagaaccugcaccugaucuucagcuacagcgugugggugcugagagacuuccccgaggacggccugaagaucuucaccgaggaccugcccgagguggagagccugcccagagacagagugcugggcuuccugaucgagaacuucaagggccuggccauccccuaccuggagcacaucauccacgugugggaggagaccggcagcagauuccacaacugccugauccagcuguacugcgagaaggugcagggccugaugaaggaguaccugcugagcuuccccgccggcaagacccccgugcccgccggcgaggaggagggcgagcugggcgaguacagacagaagcugcugauguuccuggagaucagcagcuacuacgaccccggcagacugaucugcgacuuccccuucgacggccugcuggaggagagagcccugcugcugggcagaaugggcaagcacgagcaggcccuguucaucuacgugcacauccugaaggacaccagaauggccgaggaguacugccacaagcacuacgacagaaacaaggacggcaacaaggacguguaccugagccugcugagaauguaccugagcccccccagcauccacugccugggccccaucaagcuggagcugcuggagcccaaggccaaccugcaggccgcccugcaggugcuggagcugcaccacagcaagcuggacaccaccaaggcccugaaccugcugcccgccaacacccagaucaacgacaucagaaucuuccuggagaaggugcuggaggagaacgcccagaagaagagauucaaccaggugcugaagaaccugcugcacgccgaguuccugagagugcaggaggagagaauccugcaccagcaggugaagugcaucaucaccgaggagaaggugugcauggugugcaagaagaagaucggcaacagcgccuucgccagauaccccaacggcgugguggugcacuacuucugcagcaaggaggugaaccccgccgacaccuaa

SEQ ID NO: 25571 - RNA, 2565 nt, Artificial Sequence
  VPS41__Homo_sapiens__NP_055211
auggccgaggccgaggagcaggagaccggcagccuggaggagagcaccgacgagagcgaggaggaggagagcgaggaggagcccaagcugaaguacgagagacugagcaacggcgugaccgagauccugcagaaggacgccgccagcugcaugaccgugcacgacaaguuccuggcccugggcacccacuacggcaagguguaccugcuggacgugcagggcaacaucacccagaaguucgacgugagccccgugaagaucaaccagaucagccuggacgagagcggcgagcacaugggcgugugcagcgaggacggcaaggugcagguguucggccuguacagcggcgaggaguuccacgagaccuucgacugccccaucaagaucaucgccgugcacccccacuucgugagaagcagcugcaagcaguucgugaccggcggcaagaagcugcugcuguucgagagaagcuggaugaacagauggaagagcgccgugcugcacgagggcgagggcaacaucagaagcgugaaguggagaggccaccugaucgccugggccaacaacaugggcgugaagaucuucgacaucaucagcaagcagagaaucaccaacgugcccagagacgacaucagccugagacccgacauguaccccugcagccugugcuggaaggacaacgugacccugaucaucggcuggggcaccagcgugaaggugugcagcgugaaggagagacacgccagcgagaugagagaccugcccagcagauacguggagaucgugagccaguucgagaccgaguucuacaucagcggccuggccccccugugcgaccagcugguggugcugagcuacgugaaggagaucagcgagaagaccgagagagaguacugcgccagacccagacuggacaucauccagccccugagcgagaccugcgaggagaucagcagcgacgcccugaccgugagaggcuuccaggagaacgagugcagagacuaccaccuggaguacagcgagggcgagagccuguucuacaucgugagccccagagacguggugguggccaaggagagagaccaggacgaccacaucgacuggcugcuggagaagaagaaguacgaggaggcccugauggccgccgagaucagccagaagaacaucaagagacacaagauccuggacaucggccuggccuacaucaaccaccugguggagagaggcgacuacgacaucgccgccagaaagugccagaagauccugggcaagaacgccgcccugugggaguacgagguguacaaguucaaggagaucggccagcugaaggccaucagccccuaccugcccagaggcgaccccgugcugaagccccugaucuacgagaugauccugcacgaguuccuggagagcgacuacgagggcuucgccacccugaucagagaguggcccggcgaccuguacaacaacagcgugaucgugcaggccgugagagaccaccugaagaaggacagccagaacaagacccugcugaagacccuggccgagcuguacaccuacgacaagaacuacggcaacgcccuggagaucuaccugacccugagacacaaggacguguuccagcugauccacaagcacaaccuguucagcagcaucaaggacaagaucgugcugcugauggacuucgacagcgagaaggccguggacaugcugcuggacaacgaggacaagaucagcaucaagaaggugguggaggagcuggaggacagacccgagcugcagcacguguaccugcacaagcuguucaagagagaccaccacaagggccagagauaccacgagaagcagaucagccuguacgccgaguacgacagacccaaccugcugcccuuccugagagacagcacccacugcccccuggagaaggcccuggagaucugccagcagagaaacuucguggaggagaccguguaccugcugagcagaaugggcaacagcagaagcgcccugaagaugaucauggaggagcugcacgacguggacaaggccaucgaguucgccaaggagcaggacgacggcgagcugugggaggaccugauccuguacagcaucgacaagccccccuucaucaccggccugcugaacaacaucggcacccacguggaccccauccugcugauccacagaaucaaggagggcauggagauccccaaccugagagacagccuggugaagauccugcaggacuacaaccugcagauccugcugagagagggcugcaagaagauccugguggccgacagccugagccugcugaagaagaugcacagaacccagaugaagggcgugcugguggacgaggagaacaucugcgagagcugccugagccccauccugcccagcgacgccgccaagcccuucagcguggugguguuccacugcagacacauguuccacaaggagugccugcccaugcccagcaugaacagcgccgcccaguucugcaacaucugcagcgccaagaacagaggccccggcagcgccauccuggagaugaagaaguaa

SEQ ID NO: 25572 - RNA, 1314 nt, Artificial Sequence
  VPS4A__Homo_sapiens__NP_037377
augaccaccagcacccugcagaaggccaucgaccuggugaccaaggccaccgaggaggacaaggccaagaacuacgaggaggcccugagacuguaccagcacgccguggaguacuuccugcacgccaucaaguacgaggcccacagcgacaaggccaaggagagcaucagagccaagugcgugcaguaccuggacagagccgagaagcugaaggacuaccugagaagcaaggagaagcacggcaagaagcccgugaaggagaaccagagcgagggcaagggcagcgacagcgacagcgagggcgacaaccccgagaagaagaagcugcaggagcagcugaugggcgccguggugauggagaagcccaacaucagauggaacgacguggccggccuggagggcgccaaggaggcccugaaggaggccgugauccugcccaucaaguucccccaccuguucaccggcaagagaacccccuggagaggcauccugcuguucggcccccccggcaccggcaagagcuaccuggccaaggccguggccaccgaggccaacaacagcaccuucuucagcgugagcagcagcgaccugaugagcaaguggcugggcgagagcgagaagcuggugaagaaccuguucgagcuggccagacagcacaagcccagcaucaucuucaucgacgagguggacagccugugcggcagcagaaacgagaacgagagcgaggccgccagaagaaucaagaccgaguuccuggugcagaugcagggcgugggcaacaacaacgacggcacccuggugcugggcgccaccaacauccccugggugcuggacagcgccaucagaagaagauucgagaagagaaucuacaucccccugcccgaggaggccgccagagcccagauguucagacugcaccugggcagcaccccccacaaccugaccgacgccaacauccacgagcuggccagaaagaccgagggcuacagcggcgccgacaucagcaucaucgugagagacagccugaugcagcccgugagaaaggugcagagcgccacccacuucaagaaggugugcggccccagcagaaccaaccccagcaugaugaucgacgaccugcugacccccugcagccccggcgaccccggcgccauggagaugaccuggauggacgugcccggcgacaagcugcuggagcccguggugugcaugagcgacaugcugagaagccuggccaccaccagacccaccgugaacgccgacgaccugcugaaggugaagaaguucagcgaggacuucggccaggagagcuaa

SEQ ID NO: 25573 - RNA, 1335 nt, Artificial Sequence
  VPS4B__Homo_sapiens__NP_004860
augagcagcaccagccccaaccugcagaaggccaucgaccuggccagcaaggccgcccaggaggacaaggccggcaacuacgaggaggcccugcagcuguaccagcacgccgugcaguacuuccugcacguggugaaguacgaggcccagggcgacaaggccaagcagagcaucagagccaagugcaccgaguaccuggacagagccgagaagcugaaggaguaccugaagaacaaggagaagaaggcccagaagcccgugaaggagggccagcccagccccgccgacgagaagggcaacgacagcgacggcgagggcgagagcgacgaccccgagaagaagaagcugcagaaccagcugcagggcgccaucgugaucgagagacccaacgugaaguggagcgacguggccggccuggagggcgccaaggaggcccugaaggaggccgugauccugcccaucaaguucccccaccuguucaccggcaagagaacccccuggagaggcauccugcuguucggcccccccggcaccggcaagagcuaccuggccaaggccguggccaccgaggccaacaacagcaccuucuucagcaucagcagcagcgaccuggugagcaaguggcugggcgagagcgagaagcuggugaagaaccuguuccagcuggccagagagaacaagcccagcaucaucuucaucgacgagaucgacagccugugcggcagcagaagcgagaacgagagcgaggccgccagaagaaucaagaccgaguuccuggugcagaugcagggcgugggcguggacaacgacggcauccuggugcugggcgccaccaacauccccugggugcuggacagcgccaucagaagaagauucgagaagagaaucuacaucccccugcccgagccccacgccagagccgccauguucaagcugcaccugggcaccacccagaacagccugaccgaggccgacuucagagagcugggcagaaagaccgacggcuacagcggcgccgacaucagcaucaucgugagagacgcccugaugcagcccgugagaaaggugcagagcgccacccacuucaagaaggugagaggccccagcagagccgaccccaaccaccugguggacgaccugcugacccccugcagccccggcgaccccggcgccaucgagaugaccuggauggacgugcccggcgacaagcugcuggagcccguggugagcaugagcgacaugcugagaagccugagcaacaccaagcccaccgugaacgagcacgaccugcugaagcugaagaaguucaccgaggacuucggccaggagggcuaa

SEQ ID NO: 25574 - RNA, 2349 nt, Artificial Sequence
  VPS51__Homo_sapiens__NP_037397
auggccgccgccgccgccgccggccccagccccggcagcggccccggcgacagccccgagggccccgagggcgaggcccccgagagaagaagaaaggcccacggcaugcugaagcuguacuacggccugagcgagggcgaggccgccggcagacccgccggccccgacccccuggaccccaccgaccugaacggcgcccacuucgaccccgagguguaccuggacaagcugagaagagagugcccccuggcccagcugauggacagcgagaccgacauggugagacagaucagagcccuggacagcgacaugcagacccugguguacgagaacuacaacaaguucaucagcgccaccgacaccaucagaaagaugaagaacgacuucagaaagauggaggacgagauggacagacuggccaccaacauggccgugaucaccgacuucagcgccagaaucagcgccacccugcaggacagacacgagagaaucaccaagcuggccggcgugcacgcccugcugagaaagcugcaguuccuguucgagcugcccagcagacugaccaagugcguggagcugggcgccuacggccaggccgugagauaccagggcagagcccaggccgugcugcagcaguaccagcaccugcccagcuucagagccauccaggacgacugccaggugaucaccgccagacuggcccagcagcugagacagagauucagagagggcggcagcggcgcccccgagcaggccgagugcguggagcugcugcuggcccugggcgagcccgccgaggagcugugcgaggaguuccuggcccacgccagaggcagacuggagaaggagcugagaaaccuggaggccgagcugggccccagcccccccgcccccgacgugcuggaguucaccgaccacggcggcagcggcuucgugggcggccugugccagguggccgccgccuaccaggagcuguucgccgcccagggccccgccggcgccgagaagcuggccgccuucgccagacagcugggcagcagauacuucgcccugguggagagaagacuggcccaggagcagggcggcggcgacaacagccugcuggugagagcccuggacagauuccacagaagacugagagcccccggcgcccugcuggccgccgccggccuggccgacgccgccaccgagaucguggagagaguggccagagagagacugggccaccaccugcagggccugagagccgccuuccugggcugccugaccgacgugagacaggcccuggccgcccccagaguggccggcaaggagggccccggccuggccgagcugcuggccaacguggccagcagcauccugagccacaucaaggccagccuggccgccgugcaccuguucaccgccaaggaggugagcuucagcaacaagcccuacuucagaggcgaguucugcagccagggcgugagagagggccugaucgugggcuucgugcacagcaugugccagaccgcccagagcuucugcgacagccccggcgagaagggcggcgccaccccccccgcccugcugcugcugcugagcagacugugccuggacuacgagaccgccaccaucagcuacauccugacccugaccgacgagcaguuccuggugcaggaccaguuccccgugacccccgugagcacccugugcgccgaggccagagagaccgccagaagacugcugacccacuacgugaaggugcagggccuggugaucagccagaugcugagaaagagcguggagaccagagacuggcugagcacccuggagcccagaaacgugagagccgugaugaagagagugguggaggacaccaccgccaucgacgugcaggugggccugcuguacgaggagggcgugagaaaggcccagagcagcgacagcagcaagagaaccuucagcguguacagcagcagcagacagcagggcagauacgcccccagcuacacccccagcgcccccauggacaccaaccugcugagcaacauccagaagcuguucagcgagagaaucgacguguucagccccguggaguucaacaaggugagcgugcugaccggcaucaucaagaucagccugaagacccugcuggagugcgugagacugagaaccuucggcagauucggccugcagcaggugcagguggacugccacuuccugcagcuguaccuguggagauucguggccgacgaggagcuggugcaccugcugcuggacgaggugguggccagcgccgcccugagaugccccgaccccgugcccauggagcccagcgugguggaggugaucugcgagagaggcuaa

SEQ ID NO: 25575 - RNA, 1605 nt, Artificial Sequence
  VPS52__Homo_sapiens__NP_001276105
auggagcagaugcugggcgccuuccagagcgaccugagcagcaucagcagcgagaucagaacccugcaggagcagagcggcgccaugaacaucagacugagaaacagacaggccgugagaggcaagcugggcgagcugguggacggccugguggugcccagcgcccuggugaccgccauccuggaggcccccgugaccgagcccagauuccuggagcagcugcaggagcuggacgccaaggccgccgccgugagagagcaggaggccagaggcaccgccgccugcgccgacgugagaggcgugcuggacagacugagagugaaggccgugaccaagaucagagaguucauccugcagaagaucuacagcuucagaaagcccaugaccaacuaccagaucccccagaccgcccugcugaaguacagauucuucuaccaguuccugcugggcaacgagagagccaccgccaaggagaucagagacgaguacguggagacccugagcaagaucuaccugagcuacuacagaagcuaccugggcagacugaugaaggugcaguaccccuucgaggcccuguucagaagccagcacuacgcccugcuggacaacagcugcagagaguaccuguucaucugcgaguucuucguggugagcggccccgccgcccacgaccuguuccacgccgugaugggcagaacccugagcaugacccugaagcaccuggacagcuaccuggccgacugcuacgacgccaucgccguguuccugugcauccacaucgugcugagauucagaaacaucgccgccaagagagacgugcccgcccuggacagauacugggagcaggugcuggcccugcuguggcccagauucgagcugauccuggagaugaacgugcagagcgugagaagcaccgacccccagagacugggcggccuggacaccagaccccacuacaucaccagaagauacgccgaguucagcagcgcccuggugagcaucaaccagaccauccccaacgagagaaccaugcagcugcugggccagcugcagguggagguggagaacuucgugcugagaguggccgccgaguucagcagcagaaaggagcagcugguguuccugaucaacaacuacgacaugaugcugggcgugcugauggagagagccgccgacgacagcaaggagguggagagcuuccagcagcugcugaacgccagaacccaggaguucaucgaggagcugcugagcccccccuucggcggccugguggccuucgugaaggaggccgaggcccugaucgagagaggccaggccgagagacugagaggcgaggaggccagagugacccagcugaucagaggcuucggcagcagcuggaagagcagcguggagagccugagccaggacgugaugagaagcuucaccaacuucagaaacggcaccagcaucauccagggcgcccugacccagcugauccagcuguaccacagauuccacagagugcugagccagccccagcugagagcccugcccgccagagccgagcugaucaacauccaccaccugaugguggagcugaagaagcacaagcccaacuucuaa

SEQ ID NO: 25576 - RNA, 2499 nt, Artificial Sequence
  VPS53__Homo_sapiens__NP_001121631
augauggaggaggaggagcuggaguucguggaggagcuggaggccgugcugcagcugacccccgaggugcagcuggccaucgagcagguguuccccagccaggacccccuggacagagccgacuucaacgccguggaguacaucaacacccuguuccccaccgagcagagccuggccaacaucgacgagguggugaacaagaucagacugaagaucagaagacuggacgacaacaucagaaccguggugagaggccagaccaacgugggccaggacggcagacaggcccuggaggaggcccagaaggccauccagcagcuguucggcaagaucaaggacaucaaggacaaggccgagaagagcgagcagauggugaaggagaucaccagagacaucaagcagcuggaccacgccaagagacaccugaccaccagcaucaccacccugaaccaccugcacaugcuggccggcggcguggacagccuggaggccaugaccagaagaagacaguacggcgagguggccaaccugcugcagggcgugaugaacgugcuggagcacuuccacaaguacaugggcaucccccagaucagacagcugagcgagagagugaaggccgcccagaccgagcugggccagcagauccuggccgacuucgaggaggccuuccccagccagggcaccaagagacccggcggccccagcaacgugcugagagacgccugccugguggccaacauccuggaccccagaaucaagcaggagaucaucaagaaguucaucaagcagcaccugagcgaguaccuggugcuguuccaggagaaccaggacguggccuggcuggacaagaucgacagaagauacgccuggaucaagagacagcugguggacuacgaggagaaguacggcagaauguuccccagagaguggugcauggccgagagaaucgccguggaguucugccacgugaccagagccgagcuggccaagaucaugagaaccagagccaaggagaucgaggugaagcugcugcuguucgccauccagagaaccaccaacuucgagggcuuccuggccaagagauucagcggcugcacccugaccgacggcacccugaagaagcuggagagccccccccccagcaccaaccccuuccuggaggacgagcccacccccgagauggaggagcuggccaccgagaagggcgaccuggaccagcccaagaagcccaaggcccccgacaaccccuuccacggcaucgugagcaagugcuucgagccccaccuguacguguacaucgagagccaggacaagaaccugggcgagcugaucgacagauucguggccgacuucaaggcccagggcccccccaagcccaacaccgacgagggcggcgccgugcugcccagcugcgccgaccuguucguguacuacaagaagugcauggugcagugcagccagcugagcaccggcgagcccaugaucgcccugaccaccaucuuccagaaguaccugagagaguacgccuggaagauccugagcggcaaccugcccaagaccaccaccagcagcggcggccugaccaucagcagccugcugaaggagaaggagggcagcgagguggccaaguucacccuggaggagcugugccugaucugcaacauccugagcaccgccgaguacugccuggccaccacccagcagcuggaggagaagcugaaggagaagguggacgugagccugaucgagagaaucaaccugaccggcgagauggacaccuucagcaccgugaucagcagcagcauccagcugcuggugcaggaccuggacgccgccugcgaccccgcccugaccgccaugagcaagaugcaguggcagaacguggagcacgugggcgaccagagccccuacgugaccagcgugauccugcacaucaagcagaacgugcccaucaucagagacaaccuggccagcaccagaaaguacuucacccaguucugcgugaaguucgccaacagcuucauccccaaguucaucacccaccuguucaagugcaagcccaucagcauggugggcgccgagcagcugcugcuggacacccacagccugaagauggugcugcuggaccugcccagcaucagcagccagguggugagaaaggcccccgccagcuacaccaagaucguggugaagggcaugaccagagccgagaugauccugaagguggugauggccccccacgagccccuggugguguucguggacaacuacaucaagcugcugaccgacugcaacaccgagaccuuccagaagauccuggacaugaagggccugaagagaagcgagcagagcagcaugcuggagcugcugagacagagacugcccgccccccccagcggcgccgagagcagcggcagccugagccugaccgcccccacccccgagcaggagagcagcagaaucagaaagcuggagaagcugaucaagaagagacuguaa

SEQ ID NO: 25577 - RNA, 2898 nt, Artificial Sequence
  VPS54__Homo_sapiens__NP_001005739
auggccagcagccacagcagcagccccgugccccagggcagcagcagcgacguguucuucaagaucgagguggaccccagcaagcacaucagacccgugcccagccugcccgacgugugccccaaggagcccaccgugaccgaccagcacagauggaccguguaccacagcaaggugaaccugcccgccgcccugaacgaccccagacuggccaagagagagagcgacuucuucaccaagaccuggggccuggacuucguggacaccgaggugauccccagcuucuaccugccccagaucagcaaggagcacuucaccguguaccagcaggagaucagccagagagagaagauccacgagagaugcaagaacaucugcccccccaaggacaccuucgagagaacccugcugcacacccacgacaagagcagaaccgaccuggagcaggugcccaagaucuucaugaagcccgacuucgcccuggacgacagccugaccuucaacagcgugcugcccuggagccacuucaacaccgccggcggcaagggcaacagagacgccgccagcagcaagcugcugcaggagaagcugagccacuaccuggacaucguggaggugaacaucgcccaccagaucagccugagaagcgaggccuucuuccacgccaugaccagccagcacgagcugcaggacuaccugagaaagaccagccaggccgugaagaugcugagagacaagaucgcccagaucgacaaggugaugugcgagggcagccugcacauccugagacuggcccugaccagaaacaacugcgugaagguguacaacaagcugaagcugauggccaccgugcaccagacccagcccaccgugcaggugcugcugagcaccagcgaguucgugggcgcccuggaccugaucgccaccacccaggaggugcugcagcaggagcugcagggcauccacagcuucagacaccugggcagccagcugugcgagcuggagaagcugaucgacaagaugaugaucgccgaguucagcaccuacagccacagcgaccugaacagaccccuggaggacgacugccaggugcuggaggaggagagacugaucagccugguguucggccugcugaagcagagaaagcugaacuuccuggagaucuacggcgagaagauggugaucaccgccaagaacaucaucaagcagugcgugaucaacaaggugagccagaccgaggagaucgacaccgacgugguggugaagcuggccgaccagaugagaaugcugaacuucccccagugguucgaccugcugaaggacaucuucagcaaguucaccaucuuccugcagagagugaaggccacccugaacaucauccacagcguggugcugagcgugcuggacaagaaccagagaaccagagagcuggaggagaucagccagcagaagaacgccgccaaggacaacagccuggacaccgagguggccuaccugauccacgagggcauguucaucagcgacgccuucggcgagggcgagcugacccccaucgccguggacaccaccagccagagaaacgccagccccaacagcgagcccugcagcagcgacagcgugagcgagcccgagugcaccaccgacagcagcagcagcaaggagcacaccagcagcagcgccauccccggcggcguggacaucauggugagcgaggacaugaagcugaccgacagcgagcugggcaagcuggccaacaacauccaggagcugcuguacagcgccagcgacaucugccacgacagagccgugaaguuccugaugagcagagccaaggacggcuuccuggagaagcugaacagcauggaguucaucacccugagcagacugauggagaccuucauccuggacaccgagcagaucugcggcagaaagagcaccagccugcugggcgcccugcagagccaggccaucaaguucgugaacagauuccacgaggagagaaagaccaagcugagccugcugcuggacaacgagagauggaagcaggccgacgugcccgccgaguuccaggaccugguggacagccugagcgacggcaagaucgcccugcccgagaagaagagcggcgccaccgaggagagaaagcccgccgaggugcugaucguggagggccagcaguacgccguggugggcaccgugcugcugcugaucagaaucauccuggaguacugccagugcguggacaacauccccagcgugaccaccgacaugcugaccagacugagcgaccugcugaaguacuucaacagcagaagcugccagcuggugcugggcgccggcgcccugcagguggugggccugaagaccaucaccaccaagaaccuggcccugagcagcagaugccugcagcugaucgugcacuacauccccgugaucagagcccacuucgaggccagacugccccccaagcaguacagcaugcugagacacuucgaccacaucaccaaggacuaccacgaccacaucgccgagaucagcgccaagcugguggccaucauggacagccuguucgacaagcugcugagcaaguacgaggugaaggcccccgugcccagcgccugcuucagaaacaucugcaagcagaugaccaagaugcacgaggccaucuucgaccugcugcccgaggagcagacccagaugcuguuccugagaaucaacgccagcuacaagcugcaccugaagaagcagcugagccaccugaacgugaucaacgacggcggcccccagaacggccuggugaccgccgacguggccuucuacaccggcaaccugcaggcccugaagggccugaaggaccuggaccugaacauggccgagaucugggagcagaagagauaa

SEQ ID NO: 25578 - RNA, 1128 nt, Artificial Sequence
  VPS72__Homo_sapiens__NP_001258016
augagccuggccggcggcagagcccccagaaagaccgccggcaacagacugagcggccugcuggaggccgaggaggaggacgaguucuaccagaccaccuacggcggcuucaccgaggagagcggcgacgacgaguaccagggcgaccagagcgacaccgaggacgagguggacagcgacuucgacaucgacgagggcgacgagcccagcagcgacggcgaggccgaggagcccagaagaaagagaagaguggugaccaaggccuacaaggagccccugaagagccugagacccagaaaggugaacacccccgccggcagcagccagaaggccagagaggagaaggcccugcugccccuggagcugcaggacgacggcagcgacagcagaaagagcaugagacagagcaccgccgagcacaccagacagaccuuccugagagugcaggagagacagggccagagcagaagaagaaagggcccccacugcgagagaccccugacccaggaggagcugcugagagaggccaagaucaccgaggagcugaaccugagaagccuggagaccuacgagagacuggaggccgacaagaagaagcaggugcacaagaagagaaagugccccggccccaucaucaccuaccacagcgugaccgugccccuggugggcgagcccggccccaaggaggagaacguggacaucgagggcagccugugcuucagccugagcuucgugcugagacuggaccccgcccccagcgugagcgcccugaccccccacgccggcaccggccccgugaacccccccgccagaugcagcagaaccuucaucaccuucagcgacgacgccaccuucgaggagugguucccccagggcagaccccccaaggugcccgugagagaggugugccccgugacccacagacccgcccuguacagagaccccgugaccgacauccccuacgccaccgccagagccuucaagaucaucagagaggccuacaagaaguacaucaccgcccacggccugccccccaccgccagcgcccugggccccggcccccccccccccgagccccugcccggcagcggccccagagcccugagacagaagaucgugaucaaguaa

SEQ ID NO: 25579 - RNA, 4287 nt, Artificial Sequence
  VPS8__Homo_sapiens__NP_001009921
auggagaacgagcccgaccacgagaacguggagcagagccugugcgccaagaccagcgaggaggagcugaacaagagcuucaaccuggaggccagccugagcaaguucagcuacaucgacauggacaaggagcuggaguucaagaacgaccugaucgacgacaaggaguucgacaucccccagguggacaccccccccacccuggagagcauccugaacgagaccgacgacgaggacgagagcuucauccuggaggaccccacccugcugaacaucgacaccaucgacagccacagcuacgacaccagcagcguggccagcagcgacagcggcgacagaaccaaccugaagagaaagaagaagcugcccgacagcuucagccugcacggcagcgugaugagacacagccugcugaagggcaucagcgcccagaucgugagcgccgccgacaagguggacgccggccugcccaccgccaucgccgugagcagccugaucgccgugggcaccagccacggccuggcccugaucuucggcaaggaccagaaccaggcccugagacugugccugggcagcaccagcgugggcggccaguacggcgccaucagcgcccugagcaucaacaacgacugcagcagacugcugugcggcuucgccaagggccagaucaccaugugggaccuggccagcggcaagcugcugagaagcaucaccgacgcccacccccccggcaccgccauccugcacaucaaguucaccgacgaccccacccuggccaucugcaacgacagcggcggcagcguguucgagcugaccuucaagagagugaugggcgugagaaccugcgagagcagaugccuguucagcggcagcaagggcgaggugugcugcaucgagccccugcacagcaagcccgagcugaaggaccaccccaucacccaguucagccugcuggccauggccagccugaccaagauccuggugaucggccugaagcccagccugaagguguggaugaccuuccccuacggcagaauggaccccagcagcgugccccugcuggccuggcacuucguggccgugcagaacuacgugaaccccaugcuggccuucugcagaggcgacguggugcacuuccugcuggugaagagagacgagagcggcgccauccacgugaccaagcagaagcaccugcaccuguacuacgaccugaucaacuucaccuggaucaacagcagaaccguggugcugcuggacagcguggagaagcugcacgugaucgacagacagacccaggaggagcuggagaccguggagaucagcgaggugcagcugguguacaacagcagccacuucaagagccuggccaccggcggcaacgugagccaggcccuggcccuggugggcgagaaggccugcuaccagagcaucagcagcuacggcggccagaucuucuaccugggcaccaagagcguguacgugaugaugcugagaagcuggagagagagaguggaccaccugcugaagcaggacugccugaccgaggcccuggcccuggccuggagcuuccacgagggcaaggccaaggccguggugggccugagcggcgacgccagcaagagaaaggccaucguggccgacagaaugguggagauccuguuccacuacgccgacagagcccugaagaagugccccgaccagggcaagauccaggugauggagcagcacuuccaggacauggugcccgugaucguggacuacugccugcugcugcagagaaaggaccugcuguucagccagauguacgacaagcugagcgagaacagcguggccaagggcguguuccuggagugccuggagcccuacauccugagcgacaagcuggugggcaucaccccccaggugaugaaggaccugaucgugcacuuccaggacaagaagcugauggagaacguggaggcccugaucgugcacauggacaucaccagccuggacauccagcagguggugcugaugugcugggagaacagacuguacgacgccaugaucuacguguacaacagaggcaugaacgaguucaucagccccauggagaagcuguucagagugaucgcccccccccugaacgccggcaagacccugaccgacgagcagguggugaugggcaacaagcugcugguguacaucagcugcugccuggccggcagagccuacccccugggcgacauccccgaggaccuggugccccuggugaagaaccagguguucgaguuccugaucagacugcacagcgccgaggccagccccgaggaggagaucuaccccuacaucagaacccugcugcacuucgacaccagagaguuccugaacgugcuggcccugaccuucgaggacuucaagaacgacaagcaggccguggaguaccagcagagaaucguggacauccugcugaaggugaugguggagaacagcgacuucacccccagccaggugggcugccuguucaccuuccuggccagacagcuggccaagcccgacaacacccuguucgugaacagaacccuguucgaccaggugcuggaguuccugugcagccccgacgacgacagcagacacagcgagagacagcaggugcugcuggagcugcugcaggccggcggcaucgugcaguucgaggagagcagacugaucagaauggccgagaaggccgaguucuaccagaucugcgaguucauguacgagagagagcaccaguacgacaagaucaucgacugcuaccugagagacccccugagagaggaggagguguucaacuacauccacaacauccugagcauccccggccacagcgccgaggagaagcagagcguguggcagaaggccauggaccacaucgaggagcuggugagccugaagcccugcaaggccgccgagcugguggccacccacuucagcggccacaucgagaccgugaucaagaagcugcagaaccaggugcugcuguucaaguuccugagaagccugcuggaccccagagagggcauccacgugaaccaggagcugcugcagaucagccccugcaucaccgagcaguucaucgagcugcugugccaguucaaccccacccaggugaucgagacccugcaggugcuggagugcuacagacuggaggagaccauccagaucacccagaaguaccagcugcacgaggugaccgccuaccugcuggagaagaagggcgacauccacggcgccuuccugaucaugcuggagagacugcagagcaagcugcaggaggugacccaccagggcgagaacaccaaggaggaccccagccugaaggacguggaggacaccaugguggagaccaucgcccugugccagagaaacagccacaaccugaaccagcagcagagagaggcccugugguucccccugcuggaggccaugauggccccccagaagcugagcagcagcgccaucccccaccugcacagcgaggcccugaagagccugaccaugcaggugcugaacagcauggccgccuucaucgcccugcccagcauccugcagagaauccugcaggaccccguguacggcaagggcaagcugggcgagauccagggccugauccugggcaugcuggacaccuucaacuacgagcagacccugcuggagaccaccaccagccugcugaaccaggaccugcacuggagccugugcaaccugagagccagcgugaccagaggccugaaccccaagcaggacuacugcagcaucugccugcagcaguacaagagaagacaggagauggccgacgagaucaucguguucagcugcggccaccuguaccacagcuucugccugcagaacaaggagugcaccguggaguucgagggccagaccagauggaccugcuacaagugcagcagcagcaacaaggugggcaagcugagcgagaacagcagcgagaucaagaagggcagaaucacccccagccaggugaagaugagccccagcuaccaccagagcaagggcgaccccaccgccaagaagggcaccagcgagcccgugcuggacccccagcagauccaggccuucgaccagcugugcagacuguacagaggcagcagcagacuggcccugcugaccgagcugagccagaacagaagcagcgagagcuacagacccuucagcggcagccagagcgcccccgccuucaacagcaucuuccagaacgagaacuuccagcugcagcugauccccccccccgugaccgaggacuaa

SEQ ID NO: 25580 - RNA, 1191 nt, Artificial Sequence
  VRK1__Homo_sapiens__NP_003375
augcccagagugaaggccgcccaggccggcagacagagcagcgccaagagacaccuggccgagcaguucgccgugggcgagaucaucaccgacauggccaagaaggaguggaaggugggccugcccaucggccagggcggcuucggcugcaucuaccuggccgacaugaacagcagcgagagcgugggcagcgacgcccccugcguggugaagguggagcccagcgacaacggcccccuguucaccgagcugaaguucuaccagagagccgccaagcccgagcagauccagaaguggaucagaaccagaaagcugaaguaccugggcgugcccaaguacuggggcagcggccugcacgacaagaacggcaagagcuacagauucaugaucauggacagauucggcagcgaccugcagaagaucuacgaggccaacgccaagagauucagcagaaagaccgugcugcagcugagccugagaauccuggacauccuggaguacauccacgagcacgaguacgugcacggcgacaucaaggccagcaaccugcugcugaacuacaagaaccccgaccagguguaccugguggacuacggccuggccuacagauacugccccgagggcgugcacaaggaguacaaggaggaccccaagagaugccacgacggcaccaucgaguucaccagcaucgacgcccacaacggcguggcccccagcagaagaggcgaccuggagauccugggcuacugcaugauccaguggcugaccggccaccugcccugggaggacaaccugaaggaccccaaguacgugagagacagcaagaucagauacagagagaacaucgccagccugauggacaagugcuuccccgagaagaacaagcccggcgagaucgccaaguacauggagaccgugaagcugcuggacuacaccgagaagccccuguacgagaaccugagagacauccugcugcagggccugaaggccaucggcagcaaggacgacggcaagcuggaccugagcgugguggagaacggcggccugaaggccaagaccaucaccaagaagagaaagaaggagaucgaggagagcaaggagcccggcguggaggacaccgaguggagcaacacccagaccgaggaggccauccagaccagaagcagaaccagaaagagagugcagaaguaa

SEQ ID NO: 25581 - RNA, 1527 nt, Artificial Sequence
  VRK2__Homo_sapiens__NP_001123953
augccccccaagagaaacgagaaguacaagcugcccauccccuuccccgagggcaaggugcuggacgacauggagggcaaccagugggugcugggcaagaagaucggcagcggcggcuucggccugaucuaccuggccuuccccaccaacaagcccgagaaggacgccagacacguggugaagguggaguaccaggagaacggcccccuguucagcgagcugaaguucuaccagagaguggccaagaaggacugcaucaagaaguggaucgagagaaagcagcuggacuaccugggcaucccccuguucuacggcagcggccugaccgaguucaagggcagaagcuacagauucauggugauggagagacugggcaucgaccugcagaagaucagcggccagaacggcaccuucaagaagagcaccgugcugcagcugggcaucagaaugcuggacgugcuggaguacauccacgagaacgaguacgugcacggcgacaucaaggccgccaaccugcugcugggcuacaagaaccccgaccagguguaccuggccgacuacggccugagcuacagauacugccccaacggcaaccacaagcaguaccaggagaaccccagaaagggccacaacggcaccaucgaguucaccagccuggacgcccacaagggcguggcccugagcagaagaagcgacguggagauccugggcuacugcaugcugagauggcugugcggcaagcugcccugggagcagaaccugaaggaccccguggccgugcagaccgccaagaccaaccugcuggacgagcugccccagagcgugcugaagugggcccccagcggcagcagcugcugcgagaucgcccaguuccuggugugcgcccacagccuggccuacgacgagaagcccaacuaccaggcccugaagaagauccugaacccccacggcaucccccugggcccccuggacuucagcaccaagggccagagcaucaacgugcacacccccaacagccagaagguggacagccagaaggccgccaccaagcaggugaacaaggcccacaacagacugaucgagaagaaggugcacagcgagagaagcgccgagagcugcgccaccuggaaggugcagaaggaggagaagcugaucggccugaugaacaacgaggccgcccaggagagcaccagaagaagacagaaguaccaggagagccaggagccccugaacgaggugaacagcuucccccagaagaucagcuacacccaguuccccaacagcuucuacgagccccaccaggacuucaccagccccgacaucuucaagaagagcagaagccccagcugguacaaguacaccagcaccgugagcaccggcaucaccgaccuggagagcagcaccggccuguggcccaccaucagccaguucacccugagcgaggagaccaacgccgacguguacuacuacagaaucaucauccccgugcugcugaugcugguguuccuggcccuguucuuccuguaa

SEQ ID NO: 25582 - RNA, 1623 nt, Artificial Sequence
  VSIG10__Homo_sapiens__NP_061959
auggccgccggcggcagcgcccccgagcccagagugcuggugugccugggcgcccugcuggccggcuggguggccgugggccuggaggccguggugaucggcgaggugcacgagaacgugacccugcacugcggcaacaucagcggccugagaggccaggugaccugguacagaaacaacagcgagcccguguuccugcugagcagcaacagcagccugagacccgccgagcccagauucagccugguggacgccaccagccugcacaucgagagccugagccugggcgacgagggcaucuacaccugccaggagauccugaacgugacccagugguuccagguguggcugcagguggccagcggccccuaccagaucgaggugcacaucguggccaccggcacccugcccaacggcacccuguacgccgccagaggcagccagguggacuucagcugcaacagcagcagcagacccccccccgugguggaguggugguuccaggcccugaacagcagcagcgagagcuucggccacaaccugaccgugaacuucuucagccugcugcugaucagccccaaccugcagggcaacuacaccugccuggcccugaaccagcugagcaagagacacagaaaggugaccaccgagcugcugguguacuaccccccccccagcgccccccagugcugggcccagauggccagcggcagcuucaugcugcagcugaccugcagaugggacggcggcuaccccgaccccgacuuccuguggaucgaggagcccggcggcgugaucgugggcaagagcaagcugggcguggagaugcugagcgagagccagcugagcgacggcaagaaguucaagugcgugaccagccacaucgugggccccgagagcggcgccagcugcauggugcagaucagaggccccagccugcugagcgagcccaugaagaccugcuucaccggcggcaacgugacccugaccugccaggugagcggcgccuacccccccgccaagauccuguggcugagaaaccugacccagcccgaggugaucauccagcccagcagcagacaccugaucacccaggacggccagaacagcacccugaccauccacaacugcagccaggaccuggacgagggcuacuacaucugcagagccgacagccccgugggcgugagagagauggagaucuggcugagcgugaaggagccccugaacaucggcggcaucgugggcaccaucgugagccugcugcugcugggccuggccaucaucagcggccugcugcugcacuacagccccguguucugcuggaaggugggcaacaccagcagaggccagaacauggacgacgugauggugcugguggacagcgaggaggaggaggaggaggaggaggaggaggaggaggacgccgccgugggcgagcaggagggcgccagagagagagaggagcugcccaaggagauccccaagcaggaccacauccacagagugaccgcccuggugaacggcaacaucgagcagaugggcaacggcuuccaggaccugcaggacgacagcagcgaggagcagagcgacaucgugcaggaggaggacagacccguguaa

SEQ ID NO: 25583 - RNA, 1272 nt, Artificial Sequence
  VSIG1__Homo_sapiens__NP_001164024
augguguucgccuucuggaagguguuccugauccugagcugccuggccggccaggugagcguggugcaggugaccauccccgacggcuucgugaacgugaccgugggcagcaacgugacccugaucugcaucuacaccaccaccguggccagcagagagcagcugagcauccaguggagcuucuuccacaagaaggagauggagcccaucagccacagcagcugccugagcaccgagggcauggaggagaaggccgugagccagugccugaagaugacccacgccagagacgccagaggcagaugcagcuggaccagcgagaucuacuucagccagggcggccaggccguggccaucggccaguucaaggacagaaucaccggcagcaacgaccccggcaacgccagcaucaccaucagccacaugcagcccgccgacagcggcaucuacaucugcgacgugaacaacccccccgacuuccugggccagaaccagggcauccugaacgugagcgugcuggugaagcccagcaagccccugugcagcgugcagggcagacccgagaccggccacaccaucagccugagcugccugagcgcccugggcacccccagccccguguacuacuggcacaagcuggagggcagagacaucgugcccgugaaggagaacuucaaccccaccaccggcauccuggugaucggcaaccugaccaacuucgagcagggcuacuaccagugcaccgccaucaacagacugggcaacagcagcugcgagaucgaccugaccagcagccaccccgaggugggcaucaucgugggcgcccugaucggcagccuggugggcgccgccaucaucaucagcguggugugcuucgccagaaacaaggccaaggccaaggccaaggagagaaacagcaagaccaucgccgagcuggagcccaugaccaagaucaaccccagaggcgagagcgaggccaugcccagagaggacgccacccagcuggaggugacccugcccagcagcauccacgagaccggccccgacaccauccaggagcccgacuacgagcccaagcccacccaggagcccgcccccgagcccgcccccggcagcgagcccauggccgugcccgaccuggacaucgagcuggagcuggagcccgagacccagagcgagcuggagcccgagcccgagcccgagcccgagagcgagcccggcguggugguggagccccugagcgaggacgagaagggcguggugaaggccuaa

SEQ ID NO: 25584 - RNA, 984 nt, Artificial Sequence
  VSIG2__Homo_sapiens__NP_055127
auggccgagcugcccggccccuuccugugcggcgcccugcugggcuuccugugccugagcggccuggccguggaggugaaggugcccaccgagccccugagcaccccccugggcaagaccgccgagcugaccugcaccuacagcaccagcgugggcgacagcuucgcccuggaguggagcuucgugcagcccggcaagcccaucagcgagagccaccccauccuguacuucaccaacggccaccuguaccccaccggcagcaagagcaagagagugagccugcugcagaacccccccaccgugggcguggccacccugaagcugaccgacgugcaccccagcgacaccggcaccuaccugugccaggugaacaacccccccgacuucuacaccaacggccugggccugaucaaccugaccgugcuggugccccccagcaacccccugugcagccagagcggccagaccagcgugggcggcagcaccgcccugagaugcagcagcagcgagggcgcccccaagcccguguacaacugggugagacugggcaccuuccccacccccagccccggcagcauggugcaggacgaggugagcggccagcugauccugaccaaccugagccugaccagcagcggcaccuacagaugcguggccaccaaccagaugggcagcgccagcugcgagcugacccugagcgugaccgagcccagccagggcagaguggccggcgcccugaucggcgugcugcugggcgugcugcugcugagcguggccgccuucugccuggugagauuccagaaggagagaggcaagaagcccaaggagaccuacggcggcagcgaccugagagaggacgccaucgcccccggcaucagcgagcacaccugcaugagagccgacagcagcaagggcuuccuggagagacccagcagcgccagcaccgugaccaccaccaagagcaagcugcccauggugguguaa

SEQ ID NO: 25585 - RNA, 918 nt, Artificial Sequence
  VSIG4__Homo_sapiens__NP_001093901
augggcauccugcugggccugcugcugcugggccaccugaccguggacaccuacggcagacccauccuggaggugcccgagagcgugaccggccccuggaagggcgacgugaaccugcccugcaccuacgacccccugcagggcuacacccaggugcuggugaaguggcuggugcagagaggcagcgaccccgugaccaucuuccugagagacagcagcggcgaccacauccagcaggccaaguaccagggcagacugcacgugagccacaaggugcccggcgacgugagccugcagcugagcacccuggagauggacgacagaagccacuacaccugcgaggugaccuggcagacccccgacggcaaccagguggugagagacaagaucaccgagcugagagugcagaagcacagcagcaagcugcugaagaccaagaccgaggcccccaccaccaugaccuacccccugaaggccaccagcaccgugaagcagagcugggacuggaccaccgacauggacggcuaccugggcgagaccagcgccggccccggcaagagccugcccguguucgccaucauccugaucaucagccugugcugcauggugguguucaccauggccuacaucaugcugugcagaaagaccagccagcaggagcacguguacgaggccgccagagcccacgccagagaggccaacgacagcggcgagaccaugagaguggccaucuucgccagcggcugcagcagcgacgagcccaccagccagaaccugggcaacaacuacagcgacgagcccugcaucggccaggaguaccagaucaucgcccagaucaacggcaacuacgccagacugcuggacaccgugccccuggacuacgaguuccuggccaccgagggcaagagcgugugcuaa

SEQ ID NO: 25586 - RNA, 576 nt, Artificial Sequence
  VSNL1__Homo_sapiens__NP_003376
augggcaagcagaacagcaagcuggcccccgaggugauggaggaccuggugaagagcaccgaguucaacgagcacgagcugaagcagugguacaagggcuuccugaaggacugccccagcggcagacugaaccuggaggaguuccagcagcuguacgugaaguucuuccccuacggcgacgccagcaaguucgcccagcacgccuucagaaccuucgacaagaacggcgacggcaccaucgacuucagagaguucaucugcgcccugagcaucaccagcagaggcagcuucgagcagaagcugaacugggccuucaacauguacgaccuggacggcgacggcaagaucaccagaguggagaugcuggagaucaucgaggccaucuacaagauggugggcaccgugaucaugaugaagaugaacgaggacggccugacccccgagcagagaguggacaagaucuucagcaagauggacaagaacaaggacgaccagaucacccuggacgaguucaaggaggccgccaagagcgaccccagcaucgugcugcugcugcagugcgacauccagaaguaa

SEQ ID NO: 25587 - RNA, 447 nt, Artificial Sequence
  VSTM1__Homo_sapiens__NP_001275720
augagaaagagaaugggccccaccagacugcccagacuggagugcagcggcgccaucaccgcccacugcagccuggaccugcccggccccgacaagcacgacgagcuggaggcccccagcaugaagaccgacaccagaaccaucuucguggccaucuucagcugcaucagcauccugcugcuguuccugagcguguucaucaucuacagaugcagccagcacagcagcagcagcgaggagagcaccaagagaaccagccacagcaagcugcccgagcaggaggccgccgaggccgaccugagcaacauggagagagugagccugagcaccgccgacccccagggcgugaccuacgccgagcugagcaccagcgcccugagcgaggccgccagcgacaccacccaggagccccccggcagccacgaguacgccgcccugaagguguaa

SEQ ID NO: 25588 - RNA, 711 nt, Artificial Sequence
  VSX1__Homo_sapiens__NP_001243200
augaccggcagagacagccugagcgacggcagaaccagcagcagagcccuggugcccggcggcagccccagaggcagcagacccagaggcuucgccaucaccgaccugcugggccuggaggccgagcugcccgcccccgccggccccggccagggcagcggcugcgagggccccgccguggcccccugccccggccccggccuggacggcagcagccuggccagaggcgcccugccccugggccugggccugcugugcggcuucggcacccagccccccgccgccgccagagcccccugccugcugcuggccgacgugcccuuccugccccccagaggccccgagcccgccgccccccuggcccccagcagacccccccccgcccugggcagacagaagagaagcgacagcgugagcaccagcgacgaggacagccagagcgaggacagaaacgaccugaaggccagccccacccugggcaagagaaagaagagaagacacagaaccguguucaccgcccaccagcuggaggagcuggagaaggccuucagcgaggcccacuaccccgacguguacgccagagagaugcuggccgugaagaccgagcugcccgaggacagaauccagugcaagcugcugcugcuggaggcccccgugcacuggacccugcaggagacccacagacugcccagacccagaggcggcgccuaa

SEQ ID NO: 25589 - RNA, 1086 nt, Artificial Sequence
  VSX2__Homo_sapiens__NP_878314
augaccggcaaggccggcgaggcccugagcaagcccaagagcgagaccguggccaagagcaccagcggcggcgcccccgccagaugcaccggcuucggcauccaggagauccugggccugaacaaggagccccccagcagccaccccagagccgcccuggacggccuggcccccggccaccugcuggccgccagaagcgugcugagccccgccggcgugggcggcaugggccugcugggccccggcggccugcccggcuucuacacccagcccaccuuccuggaggugcugagcgacccccagagcgugcaccugcagccccugggcagagccagcggcccccuggacaccagccagaccgccagcagcgacagcgaggacgugagcagcagcgacagaaagaugagcaagagcgcccugaaccagaccaagaagagaaagaagagaagacacagaaccaucuucaccagcuaccagcuggaggagcuggagaaggccuucaacgaggcccacuaccccgacguguacgccagagagaugcuggccaugaagaccgagcugcccgaggacagaauccaggugugguuccagaacagaagagccaaguggagaaagagagagaagugcuggggcagaagcagcgugauggccgaguacggccuguacggcgccauggugagacacagcaucccccugcccgagagcauccugaagagcgccaaggacggcaucauggacagcugcgcccccuggcugcugggcaugcacaagaagagccuggaggccgccgccgagagcggcagaaagcccgagggcgagagacaggcccugcccaagcuggacaagauggagcaggacgagagaggccccgacgcccaggccgccaucagccaggaggagcugagagagaacagcaucgccgugcugagagccaaggcccaggagcacagcaccaaggugcugggcaccgugagcggccccgacagccuggccagaagcaccgagaagcccgaggaggaggaggccauggacgaggacagacccgccgagagacugagccccccccagcuggaggacauggccuaa

SEQ ID NO: 25590 - RNA, 843 nt, Artificial Sequence
  VTA1__Homo_sapiens__NP_001273300
auggccgcccuggccccccugcccccccugcccgcccaguucaagagcauccagcaccaccugagaaccgcccaggagcacgacaagagagaccccgugguggccuacuacugcagacuguacgccaugcagaccggcaugaagaucgacagcaagacccccgagugcagaaaguuccugagcaagcugauggaccagcuggaggcccugaagaagcagcugggcgacaacgaggccaucacccaggagaucgugggcugcgcccaccuggagaacuacgcccugaagauguuccuguacgccgacaacgaggacagagccggcagauuccacaagaacaugaucaagagcuucuacaccgccagccugcugaucgacgugaucaccguguucggcgagcugaccgacgagaacgugaagcacagaaaguacgccagauggaaggccaccuacauccacaacugccugaagaacggcgagaccccccaggccggccccgugggcaucgaggaggacaacgacaucgaggagaacgaggacgccggcgccgccagccugcccacccagcccacccagcccagcagcagcagcaccuacgaccccagcaacaugcccagcggcaacuacaccggcauccagaucccccccggcgcccacgcccccgccaacacccccgccgaggugccccacagcaccggcgacgugagacugacccccgaggacuucgccagagcccagaaguacugcaaguacgccggcagcgcccugcaguacgaggacgugagcaccgccgugcagaaccugcagaaggcccugaagcugcugaccaccggcagagaguaa

SEQ ID NO: 25591 - RNA, 900 nt, Artificial Sequence
  VTCN1__Homo_sapiens__XP_011540445
augggcagcgugaugcugcugaaggagagcugcggcaacguguucuucagcgccgugagaaucagaagaagcagaaagcacagcaucaucagcaucaucaucauccuggccggcgccaucgcccugaucaucggcuucggcaucagcggcagacacagcaucaccgugaccaccguggccagcgccggcaacaucggcgaggacggcauccugagcugcaccuucgagcccgacaucaagcugagcgacaucgugauccaguggcugaaggagggcgugcugggccuggugcacgaguucaaggagggcaaggacgagcugagcgagcaggacgagauguucagaggcagaaccgccguguucgccgaccaggugaucgugggcaacgccagccugagacugaagaacgugcagcugaccgacgccggcaccuacaagugcuacaucaucaccagcaagggcaagggcaacgccaaccuggaguacaagaccggcgccuucagcaugcccgaggugaacguggacuacaacgccagcagcgagacccugagaugcgaggcccccagaugguucccccagcccaccguggugugggccagccagguggaccagggcgccaacuucagcgaggugagcaacaccagcuucgagcugaacagcgagaacgugaccaugaagguggugagcgugcuguacaacgugaccaucaacaacaccuacagcugcaugaucgagaacgacaucgccaaggccaccggcgacaucaaggugaccgagagcgagaucaagagaagaagccaccugcagcugcugaacagcaaggccagccugugcgugagcagcuucuucgccaucagcugggcccugcugccccugagccccuaccugaugcugaaguaa

SEQ ID NO: 25592 - RNA, 654 nt, Artificial Sequence
  VTI1A__Homo_sapiens__NP_660207
augagcagcgacuucgagggcuacgagcaggacuucgccgugcugaccgccgagaucaccagcaagaucgccagagugcccagacugccccccgacgagaagaagcagaugguggccaacguggagaagcagcuggaggaggccaaggagcugcuggagcagauggaccuggaggugagagagauccccccccagagcagaggcauguacagcaacagaaugagaagcuacaagcaggagaugggcaagcuggagaccgacuucaagagaagcagaaucgccuacagcgacgaggugagaaacgagcugcugggcgacgacggcaacagcagcgagaaccagagagcccaccugcuggacaacaccgagagacuggagagaagcagcagaagacuggaggccggcuaccagaucgccguggagaccgagcagaucggccaggagaugcuggagaaccugagccacgacagagagaagauccagagagccagagagagacugagagagaccgacgccaaccugggcaagagcagcagaauccugaccggcaugcugagaagaaucauccagaacagaauccugcuggugauccugggcaucaucguggugaucaccauccugauggccaucaccuucagcgugagaagacacuaa

SEQ ID NO: 25593 - RNA, 699 nt, Artificial Sequence
  VTI1B__Homo_sapiens__NP_006361
auggccagcagcgccgccagcagcgagcacuucgagaagcugcacgagaucuucagaggccugcacgaggaccugcagggcgugcccgagagacugcugggcaccgccggcaccgaggagaagaagaagcugaucagagacuucgacgagaagcagcaggaggccaacgagacccuggccgagauggaggaggagcugagauacgccccccugagcuucagaaaccccaugaugagcaagcugagaaacuacagaaaggaccuggccaagcugcacagagaggugagaagcaccccccugaccgccacccccggcggcagaggcgacaugaaguacggcaucuacgccguggagaacgagcacaugaacagacugcagagccagagagccaugcugcugcagggcaccgagagccugaacagagccacccagagcaucgagagaagccacagaaucgccaccgagaccgaccagaucggcagcgagaucaucgaggagcugggcgagcagagagaccagcuggagagaaccaagagcagacuggugaacaccagcgagaaccugagcaagagcagaaagauccugagaagcaugagcagaaaggugaccaccaacaagcugcugcugagcaucaucauccugcuggagcuggccauccugggcggccugguguacuacaaguucuucagaagccacuaa

SEQ ID NO: 25594 - RNA, 1437 nt, Artificial Sequence
  VTN__Homo_sapiens__NP_000629
auggccccccugagaccccugcugauccuggcccugcuggccuggguggcccuggccgaccaggagagcugcaagggcagaugcaccgagggcuucaacguggacaagaagugccagugcgacgagcugugcagcuacuaccagagcugcugcaccgacuacaccgccgagugcaagccccaggugaccagaggcgacguguucaccaugcccgaggacgaguacaccguguacgacgacggcgaggagaagaacaacgccaccgugcacgagcaggugggcggccccagccugaccagcgaccugcaggcccagagcaagggcaaccccgagcagacccccgugcugaagcccgaggaggaggcccccgcccccgaggugggcgccagcaagcccgagggcaucgacagcagacccgagacccugcaccccggcagaccccagccccccgccgaggaggagcugugcagcggcaagcccuucgacgccuucaccgaccugaagaacggcagccuguucgccuucagaggccaguacugcuacgagcuggacgagaaggccgugagacccggcuaccccaagcugaucagagacguguggggcaucgagggccccaucgacgccgccuucaccagaaucaacugccagggcaagaccuaccuguucaagggcagccaguacuggagauucgaggacggcgugcuggaccccgacuaccccagaaacaucagcgacggcuucgacggcauccccgacaacguggacgccgcccuggcccugcccgcccacagcuacagcggcagagagagaguguacuucuucaagggcaagcaguacugggaguaccaguuccagcaccagcccagccaggaggagugcgagggcagcagccugagcgccguguucgagcacuucgccaugaugcagagagacagcugggaggacaucuucgagcugcuguucuggggcagaaccagcgccggcaccagacagccccaguucaucagcagagacuggcacggcgugcccggccagguggacgccgccauggccggcagaaucuacaucagcggcauggcccccagacccagccuggccaagaagcagagauucagacacagaaacagaaagggcuacagaagccagagaggccacagcagaggcagaaaccagaacagcagaagacccagcagagccaccuggcugagccuguucagcagcgaggagagcaaccugggcgccaacaacuacgacgacuacagaauggacuggcuggugcccgccaccugcgagcccauccagagcguguucuucuucagcggcgacaaguacuacagagugaaccugagaaccagaagaguggacaccguggacccccccuaccccagaagcaucgcccaguacuggcugggcugccccgcccccggccaccuguaa

SEQ ID NO: 25595 - RNA, 2268 nt, Artificial Sequence
  VWA2__Homo_sapiens__NP_001258975
augccccccuuccugcugcuggaggccgugugcguguuccuguucagcagagugccccccagccugccccugcaggaggugcacgugagcaaggagaccaucggcaagaucagcgccgccagcaagaugauguggugcagcgccgccguggacaucauguuccugcuggacggcagcaacagcgugggcaagggcagcuucgagagaagcaagcacuucgccaucaccgugugcgacggccuggacaucagccccgagagagugagagugggcgccuuccaguucagcagcaccccccaccuggaguucccccuggacagcuucagcacccagcaggaggugaaggccagaaucaagagaaugguguucaagggcggcagaaccgagaccgagcuggcccugaaguaccugcugcacagaggccugcccggcggcagaaacgccagcgugccccagauccugaucaucgugaccgacggcaagagccagggcgacguggcccugcccagcaagcagcugaaggagagaggcgugaccguguucgccgugggcgugagauuccccagaugggaggagcugcacgcccuggccagcgagcccagaggccagcacgugcugcuggccgagcagguggaggacgccaccaacggccuguucagcacccugagcagcagcgccaucugcagcagcgccacccccgacugcagaguggaggcccaccccugcgagcacagaacccuggagauggugagagaguucgccggcaacgcccccugcuggagaggcagcagaagaacccuggccgugcuggccgcccacugccccuucuacagcuggaagagaguguuccugacccaccccgccaccugcuacagaaccaccugccccggccccugcgacagccagcccugccagaacggcggcaccugcgugcccgagggccuggacggcuaccagugccugugcccccuggccuucggcggcgaggccaacugcgcccugaagcugagccuggagugcagaguggaccugcuguuccugcuggacagcagcgccggcaccacccuggacggcuuccugagagccaagguguucgugaagagauucgugagagccgugcugagcgaggacagcagagccagagugggcguggccaccuacagcagagagcugcugguggccgugcccgugggcgaguaccaggacgugcccgaccugguguggagccuggacggcauccccuucagaggcggccccacccugaccggcagcgcccugagacaggccgccgagagaggcuucggcagcgccaccagaaccggccaggacagacccagaagagugguggugcugcugaccgagagccacagcgaggacgagguggccggccccgccagacacgccagagccagagagcugcugcugcugggcgugggcagcgaggccgugagagccgagcuggaggagaucaccggcagccccaagcacgugaugguguacagcgacccccaggaccuguucaaccagauccccgagcugcagggcaagcugugcagcagacagagacccggcugcagaacccaggcccuggaccugguguucaugcuggacaccagcgccagcgugggccccgagaacuucgcccagaugcagagcuucgugagaagcugcgcccugcaguucgaggugaaccccgacgugacccaggugggccuggugguguacggcagccaggugcagaccgccuucggccuggacaccaagcccaccagagccgccaugcugagagccaucagccaggcccccuaccugggcggcgugggcagcgccggcaccgcccugcugcacaucuacgacaaggugaugaccgugcagagaggcgccagacccggcgugcccaaggccgugguggugcugaccggcggcagaggcgccgaggacgccgccgugcccgcccagaagcugagaaacaacggcaucagcgugcugguggugggcgugggccccgugcugagcgagggccugagaagacuggccggccccagagacagccugauccacguggccgccuacgccgaccugagauaccaccaggacgugcugaucgaguggcugugcggcgaggccaagcagcccgugaaccugugcaagcccagccccugcaugaacgagggcagcugcgugcugcagaacggcagcuacagaugcaagugcagagacggcugggagggcccccacugcgagaacagauuccugagaagacccuaa

SEQ ID NO: 25596 - RNA, 3555 nt, Artificial Sequence
  VWA3A__Homo_sapiens__NP_775886
augaagaaguacagaaagaucagcaucggcugcuucgccauggccacccagaccagccacguguuccacggccaggagaacauguuccuggagaaccacugcaucagaagaaacaccggcagagacagcaagaagccccugaagcagaagaacaugaacggccugggccagaacagcgacaacggccugcuggugacccacgugaaccagacccaggaccugcugagacugcagggcagcgagacccagagcagcgacugggaggacagcgaggacuggcugagcgcccacagccugaagugccagaagcugacccuggccgaccugaucagccagggcaccgaggugcuggaggagggcaccaacguggugcagaagaucugcuucagcacccagaucaucagacacuucgagagcaagcugagcgacaccaucgagguguaccaggagagaauccaguggcugaccgagaacagcaagaaggccuucggccugaucaagggcgccagagugagcauccugaucgacgugagcgccaucagcagcggcccccagaaggaggaguuccagaaggaccugaugagccugaucgacgagcagcugagccacaaggagaagcuguucgugcugagcuucggcaccaacgccggcagccuguggcccgaccccauggaggugagcgccagcacccugcaggagcugaagcugugggugaagacccugcagcccgacggcggcagcaaccugcugcaggcccugaagaagaucuucacccugaagggccuggacagccugguggccaucaugagaagcugccccgaccagcccagcgagauccugagcgacuacauccagcagagcaccaugggcagagaccugaucauccacuucaucaccuacagaugcgacgaccagaugccccccgccgugcugaagaaccuggccgaggccgugagaggcuacuaccacugcuacagccccaagauggagcacuacaccagcagagacauggacgagcugcuggccgagauccagaaggcccagagccugcugagccacgugcaggcccugcagcacagcagccccugcgaggcccugaccugcaccauggaggagaucagcaccgagaucaccaacggcccccugaucagccugcugcccaagccccccaagcacgacgccccccugaccaucgaguuccccaaccuggacaagaccagcgccgaguggcugaaggugaacggccugaaggccaagaagcugagccuguaccaggugcuggcccccaacgccuucagccccguggaggaguucgugcccauccugcagaagaccgugagcagcaccauccacgagaaggccaugauccaguucgaguggcacgacggcaccgugaagaacauccacguggacccccccuuccuguacaaguaccagcagcagcugagcagagccaugagaauguacgagagaagaaucgaguggcugagccuggccagcagaagaaucuggggcaccgugugcgagaagagagugguggugcugcuggacaucagcgccaccaacagcauguacaucauccacauccagcacagccugagacugcugcuggaggagcagcugagcaacaaggacugcuucaaccugaucgccuucggcagcaccaucgagagcuggagacccgagauggugcccgugagccacaacaaccugcagagcgccuggagaugggcccugaaccugagaugcagaggcagcagaaacgugcugagcgcccugagaaaggccguggagguggacuucaaggacaaggacaagcaccagagccagggcaucuaccuguucaccggcggcauccccgaccaggacaugcccacccugagcgccuacauggccgaggccugcggcggcugcgaccugcagcugaacgugugccuguucuacgugggcgagcccaagauggacaccaccccccccgccagauacgccagccacaccgacaccgccgccgccuacaaggaggugaccagagccgccggcggcagauuccacugguucggcgacaccggcaucuacgagagcgacgacaucaacagcaucaugagcgagauggagaaggcccugaacuacagccagaagugcgccuuccugauggccagccugaagaaccacagcggcaaggugcugggcagcagcgcccugcccaaggagaagcccaagacccugcagcugagaagccagcccaagaagcugugcccccccagacccaccgugccccugggcgccagaaugagcaucaaggacgaccccgacagagagaagagccccccccugaagagccugaaguggagaccccugagcagcagagugggcaucagccccgccgccgcccagcccaccaaggagggcaugauggagcugagaagaaagaccaagagcagagaggccgagaccagccugcugcuguucuacaccgagaagggcaacgacgugggcagcguguacaagaaguacccccagggcagaggccugagaagaaccagcagcagcaucgaccugcccagaaaggacaccgugugcagcagccaggaguggguggccaaguacggccugaagaagcugaagcuggagaucagcagaugcaugggccccaacugcacccaccagaagagcggccagagaagcgccagcgccaagcacugcagcaucuuccccagcguggagauccacggcguggugagacacauccaguggacccccagagagauggagguguacaucagacaccuggagaaggugcugagaagauacgugcagagacugcaguggcugcugagcggcagcagaagacuguucggcaccgugcuggagagcaaggugugcauccugcuggacaccagcggcagcaugggccccuaccugcagcaggugaagaccgagcuggugcugcugaucugggagcagcugagaaagugcugcgacagcuucaaccugcugagcuucgccgagagcuuccagagcuggcaggacacccugguggagaccaccgacgccgccugccacgaggccaugcagugggugacccaccugcaggcccagggcagcaccagcauccugcaggcccugcugaaggccuucagcuuccacgaccuggagggccuguaccugcugaccgacggcaagcccgacaccagcugcagccuggugcugaacgaggugcagaagcugagagagaagagagacgugaaggugcacaccaucagccugaacugcagcgacagagccgccguggaguuccugagaaagcuggccagcuucaccggcggcagauaccacugccccgugggcgaggacacccugagcaagauccacagccugcugaccaagggcuucaucaacgagaaggaccccacccugccccccuucgagggcgacgaccugagaauccuggcccaggagaucaccaaggccagaagcuuccuguggcaggcccagagcuucagaagccagcugcagaagaagaacgacgccgagcccaaggugacccugagcuaa

SEQ ID NO: 25597 - RNA, 3885 nt, Artificial Sequence
  VWA3B__Homo_sapiens__NP_659429
auggagaagagcggccccagcagcaccaucagcgagcagcagcugcagagacaggagggcuggaucaacaccaagaccgaccuggccgagcagagccugaucagcagcgagaaguggcugcagcugcacggccugaagagcaacaagcugacccugaagcagauccugagccagaucggcuucccccacugcgaggacuacguggccagccugggcagacccguggccagcagauacgccgacggccuguucccccagcuguacagagccgaggacggcagaguguacaaccugaccgccaagagcgagcugaucuaccaguucguggagcaccugacccaggccguggagagcuacaagcagagaauggacuggcugaccagcaagagcagacagaucuucggcgugauccuggagcagugcgugaccaucgugcuggacuucggcggcauccuggagggcgagcuggaccugugcagagaggcccugaccauggugcugcaggagcagguggcccacaucaccgaguucaacaucaucagagugagccaggagcccgugaaguggcaggagaacgccacccccgugaccgagcagagcaucgccaccgccaucagcuggguggagaagcugaccguggagcugaccgugagcgaggccggcagacuggacgcccugcuggaggccggcagagacaagaccaucgagagcaucuacuacuucguggugggcgacgugcccgaggagagcaaggagcugcugcugcagagagcccuggagauccccugccccguguacaccgugagcuucaacgccagaggcgagggcaccaucgccuuccugaaggaccugagcgccaagacccacagcagauuccacgccuucgccgagagaaccgagugcguggaguuccccgccuucagcaccaaggacggcgacaacgugaugaccuggaacagcagaaagcugaagggcaagcugccccccggcgccggcgugagagaggacguguuccugguguggcaggagauggaggaggccugcagcacccuggcccagauccagagacugguggccgagccccccaagcccgacguggccaccguggacugcgagagcgagaccaccagcguggagaucgccagcaaccccgaggacaccugggacagcaagaccuggcugcagaaguacggccugaaggcccagaagcugagccuguacgacgugcuggccgacugcagcuucagacacgccgacggcgugguggacaucaaggccaagcccgagaacgagagcgugcagaccagcgccgagaccaacaagaagaccgugcacgccaaguacugcagcagauucgugcacgcccccuggaaggacggcagccuggugcacgugaacaucaccaaggagaagugcaagugguacagcgagagaauccacaccgcccuggccagaaucagaagaagaaucaaguggcugcaggacggcagccagagccuguucggcagacugcacaacgacugcaucuacauccugaucgacaccagccacagcaugaagagcaagcuggaccuggugaaggacaagaucauccaguucauccaggagcagcugaaguacaagagcaaguucaacuucgugaaguucgacggccaggccguggccuggagagagcagcuggccgaggugaacgaggacaaccuggagcaggcccagagcuggaucagagacaucaagaucggcagcagcaccaacacccugagcgcccugaagaccgccuucgccgacaaggagacccaggccaucuaccugcugaccgacggcagacccgaccagccccccgagaccgugaucgaccaggugaagagauuccaggagauccccaucuacaccaucagcuucaacuacaacgacgagaucgccaacagauuccugaaggagguggccgcccugaccggcggcgaguuccacuucuacaacuucggcugcaaggaccccaccccccccgaggccgugcagaacgaggaccugacccugcuggugaaggagauggagcagggccacagcgaccuggagaagaugcaggaccuguacagcgagagccugaucauggacuggugguacaacgccgagaaggacggcgacagcaagcaccagaaggagaucugcagcaugaucagcacccccgagaagugcgccaagccccagagcgacguggacagcacccagaccagcagccugaacaugcugaagggccccuggggccugagcgaccagaaggugcagaagaagaaggugcugcacgccgagagcaccaagaccagccugcugagaagccagaugagcagccugagaagcagcgccugcagcgagagaaaggacggccugagcaacgccagcagcagaagaaccgcccugagcgacaaggagaugagcauccugcuggccgaggaguggcuggacgacaagagcagcgagaaggugaccagagagggcagccagguguacgaccacgacagcagcgacgugagcagcgagaacuggcugaagaccuacggccugguggccaagaagcugacccugauggacgcccugagcguggccgccgugccccacagcagcaccuacgugcccgugcuggacaagcacguggugagcaagguguucgacgagguguucccccuggcccacgugugcaacgacaccaacaagaugacccugaucaacccccagggcgccaagcugaacaucuacaagagaaagguggagcaggccauccagagcuacgagaagagacugaacaagaucguguggagagcccugagccaggaggagaaggagaagcuggacgccaacaagcccauccaguaccuggagaacaagaccgugcugaaccaggcccuggagagacugaacuggcccaucagccugaaggagcugagcaugcuggagagcgagauccuggccggcaagauguacauccagcaggccauggagcugcaggaggccgccaagaagaacuacgccaacaaggcccccggcgagcagcagaagcugcagggcaaccccaccaagaagaccaagagcaagagacccgacccccugaagggccagaaggugaucgccagaugcgacgagaacggcuucuacuuccccggcguggugaagaagugcgugagcagaacccaggcccuggugggcuucagcuacggcgacaccaagguggugagcaccagcuucaucacccccgugggcggcgccaugcccugcccccugcugcaggugggcgacuacguguucgccaagaucgugauccccaagggcuucgacuucuacgugcccgccaucgugaucgcccugcccaacaagcacguggccaccgagaaguucuacaccgugcugaagugcaacaacagaagagaguucugccccagaagcgcccugaucaagaucagccagaacaaguacgcccugagcugcagccacaucaagagcccccccauccccgaggaccccgagguggaggacguggaggccagaaacagcgccuuccuguucuggccccugaaggaggccgacacccaggacagcagagagcccagaagagagaagcccagaagaaagaagagacccgccaagcagccccugcagcaggccgcccccagcgacagcgacggcagcagccacggcaucagcagccacggcagcugccagggcacccaccccgagcccagaaccgcccaccugcacuuccccgccgccggcagacugggccugagcagccacgccaucaucgccacccccccccccagagccgcccugcccugcacccugcaggccacccacagcagcaagggccugagaagcgugcccgagacccuguaa

SEQ ID NO: 25598 - RNA, 2361 nt, Artificial Sequence
  VWA5A__Homo_sapiens__NP_055437
auggugcacuucugcggccugcugacccugcacagagagcccgugccccugaagagcaucagcgugagcgugaacaucuacgaguucguggccggcgugagcgccacccugaacuacgagaacgaggagaaggugccccuggaggccuucuucguguuccccauggacgaggacagcgccguguacagcuucgaggcccugguggacggcaagaagaucguggccgagcugcaggacaagaugaaggccagaaccaacuacgagaaggccaucagccagggccaccaggccuuccugcuggagggcgacagcagcagcagagacguguucagcugcaacgugggcaaccugcagcccggcagcaaggccgccgugacccugaaguacgugcaggagcugccccuggaggccgacggcgcccugagauucgugcugcccgccgugcugaaccccagauaccaguucagcggcagcagcaaggacagcugccugaacgugaagacccccaucgugcccguggaggaccugcccuacacccugagcaugguggccaccaucgacagccagcacggcaucgagaaggugcagagcaacugcccccugagccccaccgaguaccugggcgaggacaagaccagcgcccaggugagccuggccgccggccacaaguucgacagagacguggagcugcugaucuacuacaacgaggugcacacccccagcguggugcuggagaugggcaugcccaacaugaagcccggccaccugaugggcgaccccagcgccauggugagcuucuaccccaacauccccgaggaccagcccagcaacaccugcggcgaguucaucuuccugauggacagaagcggcagcaugcagagccccaugagcagccaggacaccagccagcugagaauccaggccgccaaggagacccugauccugcugcugaagagccugcccaucggcugcuacuucaacaucuacggcuucggcagcagcuacgaggccugcuuccccgagagcgugaaguacacccagcagaccauggaggaggcccugggcagagugaagcugaugcaggccgaccugggcggcaccgagauccuggccccccugcagaacaucuacagaggccccagcauccccggccacccccugcagcuguucguguucaccgacggcgaggugaccgacaccuucagcgugaucaaggaggugagaaucaacagacagaagcacagaugcuucagcuucggcaucggcgagggcaccagcaccagccugaucaagggcaucgccagagccagcggcggcaccagcgaguucaucaccggcaaggacagaaugcagagcaaggcccugagaacccugaagagaagccugcagcccgugguggaggacgugagccugagcuggcaccugccccccggccugagcgccaagaugcugagccccgagcagaccgugaucuucagaggccagagacugaucagcuacgcccagcugaccggcagaaugcccgccgccgagaccaccggcgaggugugccugaaguacacccugcagggcaagaccuucgaggacaaggugaccuucccccugcagcccaagcccgacgugaaccugaccauccacagacuggccgccaagagccugcugcagaccaaggacaugggccugagagagacccccgccagcgacaagaaggacgcccugaaccugagccuggagagcggcgugaucagcagcuucaccgccuucaucgccaucaacaaggagcugaacaagcccgugcagggcccccuggcccacagagacgugcccagacccauccugcugggcgccagcgccccccugaagaucaagugccagagcggcuucagaaaggcccugcacagcgacagaccccccagcgccagccagcccagaggcgagcugaugugcuacaaggccaagaccuuccagauggacgacuacagccugugcggccugaucagccacaaggaccagcacagccccggcuucggcgagaaccaccuggugcagcugaucuaccaccagaacgccaacggcagcugggaccugaacgaggaccuggccaagauccugggcaugagccuggaggagaucauggccgcccagcccgccgagcugguggacagcagcggcugggccaccauccuggccgugaucuggcugcacagcaacggcaaggaccugaagugcgagugggagcugcuggagagaaaggccguggccuggaugagagcccacgccggcagcaccaugcccagcguggugaaggccgccaucaccuuccugaagagcagcguggaccccgccaucuucgccuucuaa

SEQ ID NO: 25599 - RNA, 3648 nt, Artificial Sequence
  VWA5B1__Homo_sapiens__XP_011538989
augcccggccugcugaacuggaucaccggcgccgcccugccccugaccgccagcgacgugaccagcugcgugagcggcuacgcccugggccugaccgccagccugaccuacggcaaccuggaggcccagcccuuccagggccuguucguguacccccuggacgagugcaccaccgugaucggcuucgaggccgugaucgccgacagaguggugaccgugcagaucaaggacaaggccaagcuggagagcggccacuucgacgccagccacgugagaagccccaccgugaccggcaacauccugcaggacggcgugagcaucgccccccacagcugcacccccggcaaggugacccuggacgaggaccuggagagaauccuguucguggccaaccugggcaccaucgcccccauggagaacgugaccaucuucaucagcaccagcagcgagcugcccacccugcccagcggcgccgugagagugcugcugcccgccgugugcgcccccaccgugccccaguucugcaccaagagcaccggcaccagcaaccagcaggcccagggcaaggacagacacugcuucggcgccugggcccccggcagcuggaacaagcugugccuggccacccugcugaacaccgaggugagcaaccccauggaguacgaguucaacuuccagcuggagaucagaggccccugccugcuggccggcguggagagccccacccacgagaucagagccgacgccgcccccagcgccagaagcgccaagagcaucaucaucacccuggccaacaagcacaccuucgacagacccguggagauccugauccaccccagcgagccccacaugccccacgugcugaucgagaagggcgacaugacccugggcgaguucgaccagcaccugaagggcagaaccgacuucaucaagggcaugaagaagaagagcagagccgagagaaagaccgagaucaucagaaagagacugcacaaggacaucccccaccacagcgugaucaugcugaacuucugccccgaccugcagagcgugcagcccugccugagaaaggcccacggcgaguucaucuuccugaucgacagaagcagcagcaugagcggcaucagcaugcacagagugaaggacgccaugcugguggcccugaagagccugaugcccgccugccuguucaacaucaucggcuucggcagcaccuucaagagccuguuccccagcagccagaccuacagcgaggacagccuggccauggccugcgacgacauccagagaaugaaggccgacaugggcggcaccaacauccugagcccccugaagugggugaucagacagcccgugcacagaggccaccccagacugcuguucgugaucaccgacggcgccgugaacaacaccggcaaggugcuggagcuggugagaaaccacgccuucagcaccagaugcuacagcuucggcaucggccccaacgugugccacagacuggugaagggccuggccagcgugagcgagggcagcgccgagcugcugauggagggcgagagacugcagcccaagauggugaagagccugaagaaggccauggcccccgugcugagcgacgugaccguggaguggaucuuccccgagaccaccgaggugcuggugagccccgugagcgccagcagccuguuccccggcgagagacuggugggcuacggcaucgugugcgacgccagccugcacaucagcaaccccagaagcgacaagagaagaagauacagcaugcugcacagccaggagagcggcagcagcguguucuaccacagccaggacgacggccccggccuggagggcggcgacugcgccaagaacagcggcgcccccuucauccugggccaggccaagaacgccagacuggccagcggcgacagcaccaccaagcacgaccugaaccugagccagagaagaagagccuacagcaccaaccagaucaccaaccacaagccccugcccagagccaccauggccagcgaccccaugcccgccgccaagagauacccccugagaaaggccagacugcaggaccugaccaaccagaccagccuggacgugcagagauggcagaucgaccugcagccccugcugaacagcggccaggaccugaaccagggccccaagcugagaggccccggcgccagaagacccagccugcugccccagggcugccagcccuuccugcccuggggccaggagacccaggccuggagccccgugagagagagaaccagcgacagcagaagccccggcgaccuggagcccagccaccaccccagcgccuucgagaccgagaccagcagcgacugggacccccccgccgagagccaggagagagccagccccagcagacccgccacccccgcccccgugcugggcaaggcccuggugaagggccugcacgacagccagagacugcagugggaggugagcuucgagcugggcacccccggccccgagagaggcggcgcccaggacgccgaccuguggagcgagaccuuccaccaccuggccgccagagccaucaucagagacuucgagcagcuggccgagagagagggcgagaucgagcagggcagcaacagaagauaccaggugagcgcccugcacaccagcaaggccugcaacaucaucagcaaguacaccgccuucgugcccguggacgugagcaagagcagauaccugcccaccgugguggaguaccccaacagcggcgccgcccugagaaugcugggcagcagagcccuggcccagcaguggagaggcaccagcagcggcuucggcagaccccagaccaugcugggcgaggacagcgcccccggcaacgacauggaggccagccccaccgcccuguucagcgaggccagaagccccggcagagagaagcacggcgccagcgagggcccccagagaagccuggccaccaacacccugagcagcaugaaggccagcgagaaccuguucggcagcuggcugaaccugaacaagagcagacugcugaccagagccgccaagggcuuccugagcaagccccugaucaaggccguggagagcaccagcggcaaccagagcuucgacuacaucccccuggugagccugcagcuggccagcggcgccuuccugcugaacgaggccuucugcgaggccacccacauccccauggagaagcugaaguggaccagccccuucaccugccacagagugagccugaccaccagacccagcgagagcaagacccccagcccccagcugugcaccagcagcccccccagacaccccagcugcgacagcuucagccuggagccccuggccaagggcaagcugggccuggagcccagagccgugguggagcacaccggcaagcugugggccaccguggugggccuggccuggcuggagcacagcagcgccagcuacuucaccgagugggagcugguggccgccaaggccaacagcuggcuggagcagcaggaggugcccgagggcagaacccagggcacccugaaggccgccgccagacagcuguucgugcugcugagacacugggacgagaaccuggaguucaacaugcugugcuacaaccccaacuacguguaa

SEQ ID NO: 25600 - RNA, 2676 nt, Artificial Sequence
  VWA7__Homo_sapiens__NP_079534
augcugcccaccgaggugccccagagccaccccggccccagcgcccugcugcugcugcagcugcugcugccccccaccagcgccuucuuccccaacaucuggagccugcuggccgcccccggcagcaucacccaccaggaccugaccgaggaggccgcccugaacgugacccugcagcuguuccuggagcagcccccccccggcagacccccccugagacuggaggacuuccugggcagaacccugcuggccgacgaccuguucgccgccuacuucggccccggcagcagcagaagauucagagccgcccugggcgaggugagcagagccaacgccgcccaggacuuccugcccaccagcagaaacgaccccgaccugcacuucgacgccgagagacugggccagggcagagccagacuggugggcgcccugagagagaccgugguggccgccagagcccuggaccacacccuggccagacagagacugggcgccgcccugcacgcccugcaggacuucuacagccacagcaacuggguggagcugggcgagcagcagccccacccccaccugcuguggcccagacaggagcugcagaaccuggcccagguggccgaccccaccugcagcgacugcgaggagcugagcugccccagaaacuggcugggcuucacccugcugaccagcggcuacuucggcacccacccccccaagccccccggcaagugcagccacggcggccacuucgacagaagcagcagccagccccccagaggcggcaucaacaaggacagcaccagccccggcuucagcccccaccacaugcugcaccugcaggccgccaagcuggcccugcuggccagcauccaggccuucagccugcugagaagcagacugggcgacagagacuucagcagacugcuggacaucacccccgccagcagccugagcuucgugcuggacaccaccggcagcaugggcgaggagaucaacgccgccaagauccaggccagacaccugguggagcagagaagaggcagccccauggagcccgugcacuacgugcuggugcccuuccacgaccccggcuucggccccguguucaccaccagcgaccccgacagcuucuggcagcagcugaacgagauccacgcccugggcggcggcgacgagcccgagaugugccugagcgcccugcagcuggcccugcugcacacccccccccugagcgacaucuucguguucaccgacgccagccccaaggacgccuuccugaccaaccagguggagagccugacccaggagagaagaugcagagugaccuuccuggugaccgaggacaccagcagagugcagggcagagccagaagagagauccugagcccccugagauucgagcccuacaaggccguggcccuggccagcggcggcgaggugaucuucaccaaggaccagcacaucagagacguggccgccaucgugggcgagagcauggccgcccuggugacccugccccuggacccccccgugguggugcccggccagccccugguguucagcguggacggccugcugcagaagaucaccgugagaauccacggcgacaucagcagcuucuggaucaagaaccccgccggcgugagccagggccaggaggagggcggcggcccccugggccacaccagaagauucggccaguucuggauggugaccauggacgaccccccccagaccggcaccugggagauccaggugaccgccgaggacacccccggcgugagagugcaggcccagaccagccuggacuuccuguuccacuucggcauccccauggaggacggcccccaccccggccuguacccccugacccagcccguggccggccugcagacccagcugcugguggaggugaccggccugggcagcagagccaaccccggcgacccccagccccacuucagccacgugauccugagaggcgugcccgagggcgccgagcugggccaggugccccuggagcccgugggcccccccgagagaggccugcuggccgccagccugagccccacccugcugagcacccccagacccuucagccuggagcugaucggccaggacgccgccggcagaagacugcacagagccgccccccagcccagcaccguggugcccgugcugcuggagcugagcggccccagcggcuuccuggcccccggcagcaaggugccccugagccugagaaucgccagcuucagcggcccccaggaccuggaccugagaaccuucgugaaccccagcuucagccugaccagcaaccugagcagagcccaccuggagcugaacgagagcgccuggggcagacuguggcuggaggugcccgacagcgccgcccccgacagcguggugauggugaccgugaccgccggcggcagagaggccaaccccgugccccccacccacgccuuccugagacugcuggugagcgcccccgccccccaggacagacacaccacccccaccggcagcagcgaccccauccugaccaccgccacccccgccuucagccccuucacccuggugacccagggcagagccggcgccggccuggccgccggcagccccugguggggcaccgugggcggcgugcugcugcugcugggccuggccagcugguaa

SEQ ID NO: 25601 - RNA, 3120 nt, Artificial Sequence
  VWA8__Homo_sapiens__NP_001009814
augcagagcagacugcugcugcugggcgcccccggcggccacggcggccccgccagcagaagaaugagacugcugcugagacagguggugcagagaagacccggcggcgacagacagagacccgaggugagacugcugcacgccggcagcggcgccgacaccggcgacaccgugaacaucggcgacgugagcuacaagcugaagauccccaagaaccccgagcuggugccccagaacuacaucagcgacagccuggcccagagcguggugcagcaccugagauggaucaugcagaaggaccugcugggccaggacguguuccugaucggcccccccggcccccugagaagaagcaucgccaugcaguaccuggagcugaccaagagagagguggaguacaucgcccugagcagagacaccaccgagaccgaccugaagcagagaagagagaucagagccggcaccgccuucuacaucgaccagugcgccgugagagccgccaccgagggcagaacccugauccuggagggccuggagaaggccgagagaaacgugcugcccgugcugaacaaccugcuggagaacagagagaugcagcuggaggacggcagauuccugaugagcgccgagagauacgacaagcugcugagagaccacaccaagaaggagcuggacagcuggaagaucgugagagugagcgagaacuucagagugaucgcccugggccugcccgugcccagauacagcggcaacccccuggaccccccccugagaagcagauuccaggccagagacaucuacuaccugcccuucaaggaccagcugaagcugcuguacagcaucggcgccaacgugagcgccgagaaggugagccagcugcugagcuucgccaccacccugugcagccaggagagcagcacccugggccugcccgacuucccccuggacagccuggccgccgccgugcagauccuggacagcuuccccaugaugcccaucaagcacgccauccaguggcuguaccccuacagcauccugcugggccacgagggcaagauggccguggagggcgugcugaagagauucgagcugcaggacagcggcagcagccugcugcccaaggagaucgugaagguggagaagaugauggagaaccacgugagccaggccagcgugaccaucagaaucgccgacaaggaggugaccaucaaggugcccgccggcaccagacugcugagccagcccugcgccagcgacagauucauccagacccugagccacaagcagcugcaggccgagaugaugcagagccacauggugaaggacaucugccugaucggcggcaagggcugcggcaagaccgugaucgccaagaacuucgccgacacccugggcuacaacaucgagcccaucaugcuguaccaggacaugaccgccagagaccugcugcagcagagauacacccugcccaacggcgacaccgccuggagaagcagcccccuggugaacgccgcccuggagggcaagcuggugcugcuggacggcauccacagagugaacgccggcacccuggccgugcugcagagacugauccacgacagagagcugagccuguacgacggcagcagacugcugagagaggacagauacaugagacugaaggaggagcugcagcugagcgacgagcagcugcagaagagaagcaucuuccccauccaccccagcuucagaaucaucgcccuggccgagccccccgugaucggcagcaccgcccaccaguggcugggccccgaguuccugaccauguucuucuuccacuacaugaagccccuggugaagagcgaggagauccaggugaucaaggagaaggugcccaacgugccccaggaggcccuggacaagcugcugagcuucacccacaagcugagagagacccaggaccccaccgcccagagccuggccgccagccugagcaccagacagcugcugagaaucagcagaagacugagccaguaccccaacgagaaccugcacagcgccgugaccaaggccugccugagcagauuccugcccagccuggccagaagcgcccuggagaagaaccuggccgacgccaccaucgagaucaacaccgacgacaaccuggagcccgagcugaaggacuacaagugcgaggugaccagcggcacccugagaaucggcgccgugagcgcccccaucuacaacgcccacgagaagaugaaggugcccgacgugcuguucuacgacaacauccagcacgugaucgugauggaggacaugcugaaggacuuccugcugggcgagcaccugcugcuggugggcaaccagggcgugggcaagaacaagaucguggacagauuccugcaccugcugaacagacccagagaguacauccagcugcacagagacaccaccgugcagacccugacccugcagcccagcgugaaggacggccugaucguguacgaggacagcccccuggugaaggccgugaagcugggccacauccuggugguggacgaggccgacaaggcccccaccaacgugaccugcauccugaagacccugguggagaacggcgagaugauccuggccgacggcagaagaaucguggccaacagcgccaacgugaacggcagagagaacgugguggugauccaccccgacuucagaaugaucgugcuggccaacagacccggcuuccccuuccugggcaacgacuucuucggcacccugggcgacaucuucagcugccacgccguggacaaccccaagccccacagcgagcuggagaugcugagacaguacggccccaacgugcccgagcccauccugcagaagcugguggccgccuucggcgagcugagaagccuggccgaccagggcaucaucaacuaccccuacagcaccagagagguggugaacaucgugaagcaccugcagaaguuccccaccgagggccugagcagcguggugagaaacguguucgacuucgacagcuacaacaacgacaugagagagauccugaucaacacccugcacaaguacggcauccccaucggcgccaagcccaccagcgugcagcuggccaaggaguaa

SEQ ID NO: 25602 - RNA, 2868 nt, Artificial Sequence
  VWCE__Homo_sapiens__NP_689931
augugggccggccugcugcugagagccgccugcguggcccugcugcugcccggcgcccccgccagaggcuacaccggcagaaagccccccggccacuucgccgccgagagaagaagacugggcccccacgugugccugagcggcuucggcagcggcugcugccccggcugggcccccagcaugggcggcggccacugcacccugccccugugcagcuucggcugcggcagcggcaucugcaucgcccccaacgugugcagcugccaggacggcgagcagggcgccaccugccccgagacccacggccccugcggcgaguacggcugcgaccugaccugcaaccacggcggcugccaggagguggccagagugugccccgugggcuucagcaugaccgagaccgccgugggcaucagaugcaccgacaucgacgagugcgugaccagcagcugcgagggccacugcgugaacaccgagggcggcuucgugugcgagugcggccccggcaugcagcugagcgccgacagacacagcugccaggacaccgacgagugccugggcacccccugccagcagagaugcaagaacagcaucggcagcuacaagugcagcugcagaaccggcuuccaccugcacggcaacagacacagcugcguggacgugaacgagugcagaagaccccuggagagaagagugugccaccacagcugccacaacaccgugggcagcuuccugugcaccugcagacccggcuucagacugagagccgacagagugagcugcgaggccuuccccaaggccgugcuggcccccagcgccauccugcagcccagacagcaccccagcaagaugcugcugcugcugcccgaggccggcagacccgcccugagccccggccacagcccccccagcggcgcccccggcccccccgccggcgugagaaccaccagacugcccagccccacccccagacugcccaccagcagccccagcgcccccguguggcugcugagcacccugcuggccacccccgugcccaccgccagccugcugggcaaccugagaccccccagccugcugcagggcgaggugaugggcacccccagcagccccagaggccccgagagccccagacuggccgccggccccagccccugcuggcaccugggcgccaugcacgagagcagaagcagauggaccgagcccggcugcagccagugcuggugcgaggacggcaaggugaccugcgagaaggugagaugcgaggccgccugcagccaccccauccccagcagagacggcggcugcugccccagcugcaccggcugcuuccacagcggcguggugagagccgagggcgacguguucagcccccccaacgagaacugcaccgugugcgugugccuggccggcaacgugagcugcaucagccccgagugccccagcggccccugccagacccccccccagaccgacugcugcaccugcgugcccgugagaugcuacuuccacggcagaugguacgccgacggcgccguguucagcggcggcggcgacgagugcaccaccugcgugugccagaacggcgagguggagugcagcuucaugcccugccccgagcuggccugccccagagaggaguggagacugggccccggccagugcugcuucaccugccaggagcccacccccagcaccggcugcagccuggacgacaacggcguggaguuccccaucggccagaucuggagccccggcgaccccugcgagcugugcaucugccaggccgacggcagcgugagcugcaagagaaccgacugcguggacagcugcccccaccccaucagaauccccggccagugcugccccgacugcagcgccggcugcaccuacaccggcagaaucuucuacaacaacgagaccuuccccagcgugcuggaccccugccugagcugcaucugccugcugggcagcguggccugcagccccguggacugccccaucaccugcaccuaccccuuccaccccgacggcgagugcugccccgugugcagagacugcaacuacgagggcagaaagguggccaacggccagguguucacccuggacgacgagcccugcaccagaugcaccugccagcugggcgaggugagcugcgagaaggugcccugccagagagccugcgccgaccccgcccugcugcccggcgacugcugcagcagcugccccgacagccugagcccccuggaggagaagcagggccugagcccccacggcaacguggccuucagcaaggccggcagaagccugcacggcgacaccgaggcccccgugaacugcagcagcugccccggcccccccaccgccagccccagcagacccgugcugcaccugcugcagcugcugcugagaaccaaccugaugaagacccagacccugcccaccagccccgccggcgcccacggcccccacagccuggcccugggccugaccgccaccuuccccggcgagcccggcgccagccccagacugagccccggccccagcaccccccccggcgcccccacccugccccuggccagccccggcgccccccagcccccccccgugacccccgagagaagcuucagcgccagcggcgcccagaucgugagcagauggcccccccugcccggcacccugcugaccgaggccagcgcccugagcaugauggaccccagccccagcaagacccccaucacccugcugggccccagagugcugagccccaccaccagcagacugagcaccgcccuggccgccaccacccaccccggcccccagcagccccccgugggcgccagcagaggcgaggagagcaccauguaa

SEQ ID NO: 25603 - RNA, 4773 nt, Artificial Sequence
  VWDE__Homo_sapiens__NP_001129396
augcccggcggcgccugcgugcuggugaucgcccugauguuccuggccuggggcgaggcccaggagugcagccccggcggccaccaguuccugagaagccccuacagaagcgugagauucgacagcuggcaccugcagcagagcgccgugcaggaccugaucugcgaccacagccugagccccggcugguacagauuccugauccuggacagacccgccgagaugcccaccaagugcguggagaugaaccacugcggcacccaggcccccaucuggcugagccugagagacagcgagacccugcccagccccggcgagaucaagcagcugaccgccugcgccaccuggcaguuccuguucagcaccaccaaggacugcugccuguuccagauccccgugagcgugagaaacugcggcaacuucagcguguaccugcugcagcccacccagggcugcaugggcuacugcgccgaggccaucagcgacgccagacugcaccccugcggcagcgacgagaccgagaccggcggcgacugcgugagacagcuggccgccagccugccccccccccccgccggcagacccgaggugcugguggagcugaucgagagcagacuguucugcagaugcagcuucgacgugcccgccaccaagaacagcgugggcuuccacaucgccuggagcagacugagcagccaggaggugaaggaggagcugacccaggagaccaccgugcaggccuucagccugcuggagcuggacggcaucaaccugagacugggcgacagaaucuucugcagcgccagcguguucuuccuggagaacccccacgugcagagcguggccaucgagagccaggaguucuucgccggcuucaagcugcagcccgagcugagcaccaucagcgaggacggcaaggaguacuaccugagaaucgagagcaccgugcccaucaucugcagcgaguucagcgagcuggaccaggagugcaagaucagccugaagcugaagaccaucggccagggcagagagcaccugggccugaaccuggcccugagcagcugccacguggaccugcugcagaccagcagcugcgccaacggcaccugcagccacaccuucguguacuacaccgccgugaccgacuucagcagagacggcgacagagugagcaacaucguggugcagcccaucgugaacgaggacuuccuguggaacaacuacauccccgacagcauccagaucaaggugaaggacgugcccaccgccuacugcuacaccuucaccgacccccacaucaucaccuucgacggcagaguguacgacaacuucaagaccggcaccuucgugcuguacaagagcaugagcagagacuucgaggugcacgugagacagugggacugcagaagccugcacuaccccgugagcugcaacugcggcuucguggcccaggagggcggcgacaucgugaccuucgacaugugcaacggccagcugagagagagccagcccuaccuguucaucaagagccaggacgugaccagaaacaucaagaucagcgagagcuaccugggcagaaaggugaccaucugguucagcagcggcgccuucaucagagccgaccugggcgaguggggcaugagccugaccaucagagcccccagcguggacuacagaaacacccugggccugugcggcaccuucgacgagaaccccgagaacgacuuccacgacaagaacggcaugcagaucgaccagaacuucaacaacuacguggccuucaucaacgaguggagaauccugcccggcaagagcaugagcgacacccugcccgugagcaugaccagccccggcaagcccagcuacugcagcugcagccuggacaccgccgccuaccccagcagcgaggaccuggacagcgugagcagaagcgagaucgcccugggcugcaaggaccugaaccacgugagccugagcagccugauccccgagcuggacgugaccagcgaguacaucaacagcgacacccuggugagagagaucaacaagcacaccagccccgaggaguacaaccugaaccuguuccugcaggagaagaagcacaucaaccugaccaagcugggccugaacgugcagaagcaccccggcaacgagaaggaggacagccugcaguaccuggccaacaagaaguacacccagggcagaggcagccacagccaggagaugagauacaacagacagaacagauggaagagacagaacuuccacgaguuccccccccuguucgccuuccccagccugagccagaccgaccuggaggagcugaccuacuucuuccccgaggaccacgccgaggacgugcagcaggaguucuuccccagcuggcccacccccagcggccugaccgaguacagcacccugacccugugccaggagacccuggccaacagcagcaucggcagacugugccuggccuuccugggcaagagacuggacagcgugaucgagaugugcgugaaggacgugcugcugaaggacgaccugagcugggccgaggccggcguggcccugcuggagaacgagugcgagaagagaaucguggaggagggcaaguacaacaccgaggaguacggcaccagcaucgaggacauccugagcgugcugaagugccccaaccugugcagcggcaacggccagugcauggaguggggcugcgccugcagccccagcuucagcagcuacgacugcagcgacagcuacgacaaggcccccgagaucaccgagcugggcaacgccggcuucugcgacgugcagaaguacaacugcaugauggugagaguguucggcaagggcuucaaggagcugcccagcaucaagugcgaggugaccaagcugcaguacaacagcagcgaguggaugcccggcgagcccaucuacacccagaccguguuccacaacagcagagccguggacugccagcugcccaccgacgugcagcaguucgacaccauggaccuggugggcggcaagcccaccggcaaguggcagcugaaggugagcaacgacggcuacaaguucagcaaccccaagaucaccgugaucuacgacggcgccugccaggugugcggccuguacaagaacgacagcugcaccaucaaggagaacgugugcaucaucgacggccugugcuacguggagggcgacaagaaccccaccagccccugccugaucugcagacccaagaucagcagauucaccuggagcuuccuggagaacaaccagccccccgugauccaggcccugcaggacaagcugcagaccuucuacggcgagaacuucgaguaccaguucguggccuucgaccccgagggcagcgacauccacuucacccuggacagcggccccgagggcgccagcgugagcagcgccggccuguucauguggaagaccgaccugcugaccacccagcagaucaccgugagacugaacgacgacugcgacgccgagaccagagugaccaucgaggugaccgugaagagcugcgacugccugaacggcggcagcugcgugagcgacagaaacuucagccccggcagcggcguguaccugugcgugugccugcccggcuuccacggcagccugugcgagguggacaucagcggcugccagagcaaccccugcggccugggcagcuacaucagcggcuuccacagcuacagcugcgacugcccccccgagcugaagguggagacccaguucgugaaccaguucaccacccagaccguggugcugaccagaagcgacaagagcgugaacaaggaggaggacgacaagaacgcccagggcagaaagagacacgugaagcccaccagcggcaacgccuucaccaucugcaaguaccccugcggcaagagcagagagugcguggcccccaacaucugcaagugcaagcccggcuacaucggcagcaacugccagaccgcccugugcgaccccgacugcaagaaccacggcaagugcaucaagcccaacaucugccagugccugcccggccacggcggcgccaccugcgacgaggagcacugcaacccccccugccagcacggcggcaccugccuggccggcaaccugugcaccugccccuacggcuucgugggccccagaugcgagaccauggugugcaacagacacugcgagaacggcggccagugccugacccccgacaucugccagugcaagcccggcugguacggccccaccugcagcaccgcccugugcgaccccgugugccugaacggcggcagcugcaacaagcccaacaccugccugugccccaacggcuucuucggcgagcacugccagaacgccuucugccacccccccugcaagaacggcggccacugcaugagaaacaacgugugcgugugcagagagggcuacaccggcagaagauuccagaagagcaucugcgaccccaccugcaugaacggcggcaagugcgugggccccagcaccugcagcugccccagcggcuggagcggcaagagaugcaacacccccaucugccugcagaagugcaagaacggcggcgagugcaucgcccccagcaucugccacugccccagcagcugggagggcgugagaugccagauccccaucugcaaccccaagugccuguacggcggcagaugcaucuuccccaacgugugcagcugcagaaccgaguacagcggcgugaagugcgagaagaagauccagaucagaagacacuaa

SEQ ID NO: 25604 - RNA, 8442 nt, Artificial Sequence
  VWF__Homo_sapiens__NP_000543
augauccccgccagauucgccggcgugcugcuggcccuggcccugauccugcccggcacccugugcgccgagggcaccagaggcagaagcagcaccgccagaugcagccuguucggcagcgacuucgugaacaccuucgacggcagcauguacagcuucgccggcuacugcagcuaccugcuggccggcggcugccagaagagaagcuucagcaucaucggcgacuuccagaacggcaagagagugagccugagcguguaccugggcgaguucuucgacauccaccuguucgugaacggcaccgugacccagggcgaccagagagugagcaugcccuacgccagcaagggccuguaccuggagaccgaggccggcuacuacaagcugagcggcgaggccuacggcuucguggccagaaucgacggcagcggcaacuuccaggugcugcugagcgacagauacuucaacaagaccugcggccugugcggcaacuucaacaucuucgccgaggacgacuucaugacccaggagggcacccugaccagcgaccccuacgacuucgccaacagcugggcccugagcagcggcgagcaguggugcgagagagccagcccccccagcagcagcugcaacaucagcagcggcgagaugcagaagggccugugggagcagugccagcugcugaagagcaccagcguguucgccagaugccacccccugguggaccccgagcccuucguggcccugugcgagaagacccugugcgagugcgccggcggccuggagugcgccugccccgcccugcuggaguacgccagaaccugcgcccaggagggcauggugcuguacggcuggaccgaccacagcgccugcagccccgugugccccgccggcauggaguacagacagugcgugagccccugcgccagaaccugccagagccugcacaucaacgagaugugccaggagagaugcguggacggcugcagcugccccgagggccagcugcuggacgagggccugugcguggagagcaccgagugccccugcgugcacagcggcaagagauacccccccggcaccagccugagcagagacugcaacaccugcaucugcagaaacagccaguggaucugcagcaacgaggagugccccggcgagugccuggugaccggccagagccacuucaagagcuucgacaacagauacuucaccuucagcggcaucugccaguaccugcuggccagagacugccaggaccacagcuucagcaucgugaucgagaccgugcagugcgccgacgacagagacgccgugugcaccagaagcgugaccgugagacugcccggccugcacaacagccuggugaagcugaagcacggcgccggcguggccauggacggccaggacgugcagcugccccugcugaagggcgaccugagaauccagcacaccgugaccgccagcgugagacugagcuacggcgaggaccugcagauggacugggacggcagaggcagacugcuggugaagcugagccccguguacgccggcaagaccugcggccugugcggcaacuacaacggcaaccagggcgacgacuuccugacccccagcggccuggccgagcccagaguggaggacuucggcaacgccuggaagcugcacggcgacugccaggaccugcagaagcagcacagcgaccccugcgcccugaaccccagaaugaccagauucagcgaggaggccugcgccgugcugaccagccccaccuucgaggccugccacagagccgugagcccccugcccuaccugagaaacugcagauacgacgugugcagcugcagcgacggcagagagugccugugcggcgcccuggccagcuacgccgccgccugcgccggcagaggcgugagaguggccuggagagagcccggcagaugcgagcugaacugccccaagggccagguguaccugcagugcggcacccccugcaaccugaccugcagaagccugagcuaccccgacgaggagugcaacgaggccugccuggagggcugcuucugcccccccggccuguacauggacgagagaggcgacugcgugcccaaggcccagugccccugcuacuacgacggcgagaucuuccagcccgaggacaucuucagcgaccaccacaccaugugcuacugcgaggacggcuucaugcacugcaccaugagcggcgugcccggcagccugcugcccgacgccgugcugagcagcccccugagccacagaagcaagagaagccugagcugcagaccccccauggugaagcuggugugccccgccgacaaccugagagccgagggccuggagugcaccaagaccugccagaacuacgaccuggagugcaugagcaugggcugcgugagcggcugccugugcccccccggcauggugagacacgagaacagaugcguggcccuggagagaugccccugcuuccaccagggcaaggaguacgcccccggcgagaccgugaagaucggcugcaacaccugcgugugcagagacagaaaguggaacugcaccgaccacgugugcgacgccaccugcagcaccaucggcauggcccacuaccugaccuucgacggccugaaguaccuguuccccggcgagugccaguacgugcuggugcaggacuacugcggcagcaaccccggcaccuucagaauccuggugggcaacaagggcugcagccaccccagcgugaagugcaagaagagagugaccauccugguggagggcggcgagaucgagcuguucgacggcgaggugaacgugaagagacccaugaaggacgagacccacuucgaggugguggagagcggcagauacaucauccugcugcugggcaaggcccugagcguggugugggacagacaccugagcaucagcguggugcugaagcagaccuaccaggagaaggugugcggccugugcggcaacuucgacggcauccagaacaacgaccugaccagcagcaaccugcagguggaggaggaccccguggacuucggcaacagcuggaaggugagcagccagugcgccgacaccagaaaggugccccuggacagcagccccgccaccugccacaacaacaucaugaagcagaccaugguggacagcagcugcagaauccugaccagcgacguguuccaggacugcaacaagcugguggaccccgagcccuaccuggacgugugcaucuacgacaccugcagcugcgagagcaucggcgacugcgccugcuucugcgacaccaucgccgccuacgcccacgugugcgcccagcacggcaagguggugaccuggagaaccgccacccugugcccccagagcugcgaggagagaaaccugagagagaacggcuacgagugcgaguggagauacaacagcugcgcccccgccugccaggugaccugccagcaccccgagccccuggccugccccgugcagugcguggagggcugccacgcccacugcccccccggcaagauccuggacgagcugcugcagaccugcguggaccccgaggacugccccgugugcgagguggccggcagaagauucgccagcggcaagaaggugacccugaaccccagcgaccccgagcacugccagaucugccacugcgacguggugaaccugaccugcgaggccugccaggagcccggcggccugguggugccccccaccgacgcccccgugagccccaccacccuguacguggaggacaucagcgagcccccccugcacgacuucuacugcagcagacugcuggaccugguguuccugcuggacggcagcagcagacugagcgaggccgaguucgaggugcugaaggccuucgugguggacaugauggagagacugagaaucagccagaagugggugagaguggccgugguggaguaccacgacggcagccacgccuacaucggccugaaggacagaaagagacccagcgagcugagaagaaucgccagccaggugaaguacgccggcagccagguggccagcaccagcgaggugcugaaguacacccuguuccagaucuucagcaagaucgacagacccgaggccagcagaaucacccugcugcugauggccagccaggagccccagagaaugagcagaaacuucgugagauacgugcagggccugaagaagaagaaggugaucgugauccccgugggcaucggcccccacgccaaccugaagcagaucagacugaucgagaagcaggcccccgagaacaaggccuucgugcugagcagcguggacgagcuggagcagcagagagacgagaucgugagcuaccugugcgaccuggcccccgaggcccccccccccacccugccccccgacauggcccaggugaccgugggccccggccugcugggcgugagcacccugggccccaagagaaacagcauggugcuggacguggccuucgugcuggagggcagcgacaagaucggcgaggccgacuucaacagaagcaaggaguucauggaggaggugauccagagaauggacgugggccaggacagcauccacgugaccgugcugcaguacagcuacauggugaccguggaguaccccuucagcgaggcccagagcaagggcgacauccugcagagagugagagagaucagauaccagggcggcaacagaaccaacaccggccuggcccugagauaccugagcgaccacagcuuccuggugagccagggcgacagagagcaggcccccaaccugguguacauggugaccggcaaccccgccagcgacgagaucaagagacugcccggcgacauccagguggugcccaucggcgugggccccaacgccaacgugcaggagcuggagagaaucggcuggcccaacgcccccauccugauccaggacuucgagacccugcccagagaggcccccgaccuggugcugcagagaugcugcagcggcgagggccugcagauccccacccugagccccgcccccgacugcagccagccccuggacgugauccugcugcuggacggcagcagcagcuuccccgccagcuacuucgacgagaugaagagcuucgccaaggccuucaucagcaaggccaacaucggccccagacugacccaggugagcgugcugcaguacggcagcaucaccaccaucgacgugcccuggaacguggugcccgagaaggcccaccugcugagccugguggacgugaugcagagagagggcggccccagccagaucggcgacgcccugggcuucgccgugagauaccugaccagcgagaugcacggcgccagacccggcgccagcaaggccguggugauccuggugaccgacgugagcguggacagcguggacgccgccgccgacgccgccagaagcaacagagugaccguguuccccaucggcaucggcgacagauacgacgccgcccagcugagaauccuggccggccccgccggcgacagcaacguggugaagcugcagagaaucgaggaccugcccaccauggugacccugggcaacagcuuccugcacaagcugugcagcggcuucgugagaaucugcauggacgaggacggcaacgagaagagacccggcgacguguggacccugcccgaccagugccacaccgugaccugccagcccgacggccagacccugcugaagagccacagagugaacugcgacagaggccugagacccagcugccccaacagccagagccccgugaagguggaggagaccugcggcugcagauggaccugccccugcgugugcaccggcagcagcaccagacacaucgugaccuucgacggccagaacuucaagcugaccggcagcugcagcuacgugcuguuccagaacaaggagcaggaccuggaggugauccugcacaacggcgccugcagccccggcgccagacagggcugcaugaagagcaucgaggugaagcacagcgcccugagcguggagcugcacagcgacauggaggugaccgugaacggcagacuggugagcgugcccuacgugggcggcaacauggaggugaacguguacggcgccaucaugcacgaggugagauucaaccaccugggccacaucuucaccuucaccccccagaacaacgaguuccagcugcagcugagccccaagaccuucgccagcaagaccuacggccugugcggcaucugcgacgagaacggcgccaacgacuucaugcugagagacggcaccgugaccaccgacuggaagacccuggugcaggaguggaccgugcagagacccggccagaccugccagcccauccuggaggagcagugccuggugcccgacagcagccacugccaggugcugcugcugccccuguucgccgagugccacaaggugcuggcccccgccaccuucuacgccaucugccagcaggacagcugccaccaggagcaggugugcgaggugaucgccagcuacgcccaccugugcagaaccaacggcgugugcguggacuggagaacccccgacuucugcgccaugagcugcccccccagccugguguacaaccacugcgagcacggcugccccagacacugcgacggcaacgugagcagcugcggcgaccaccccagcgagggcugcuucugcccccccgacaaggugaugcuggagggcagcugcgugcccgaggaggccugcacccagugcaucggcgaggacggcgugcagcaccaguuccuggaggccugggugcccgaccaccagcccugccagaucugcaccugccugagcggcagaaaggugaacugcaccacccagcccugccccaccgccaaggcccccaccugcggccugugcgagguggccagacugagacagaacgccgaccagugcugccccgaguacgagugcgugugcgaccccgugagcugcgaccugccccccgugccccacugcgagagaggccugcagcccacccugaccaaccccggcgagugcagacccaacuucaccugcgccugcagaaaggaggagugcaagagagugagcccccccagcugccccccccacagacugcccacccugagaaagacccagugcugcgacgaguacgagugcgccugcaacugcgugaacagcaccgugagcugcccccugggcuaccuggccagcaccgccaccaacgacugcggcugcaccaccaccaccugccugcccgacaaggugugcgugcacagaagcaccaucuaccccgugggccaguucugggaggagggcugcgacgugugcaccugcaccgacauggaggacgccgugaugggccugagaguggcccagugcagccagaagcccugcgaggacagcugcagaagcggcuucaccuacgugcugcacgagggcgagugcugcggcagaugccugcccagcgccugcgagguggugaccggcagccccagaggcgacagccagagcagcuggaagagcgugggcagccagugggccagccccgagaaccccugccugaucaacgagugcgugagagugaaggaggagguguucauccagcagagaaacgugagcugcccccagcuggaggugcccgugugccccagcggcuuccagcugagcugcaagaccagcgccugcugccccagcugcagaugcgagagaauggaggccugcaugcugaacggcaccgugaucggccccggcaagaccgugaugaucgacgugugcaccaccugcagaugcauggugcaggugggcgugaucagcggcuucaagcuggagugcagaaagaccaccugcaaccccugcccccugggcuacaaggaggagaacaacaccggcgagugcugcggcagaugccugcccaccgccugcaccauccagcugagaggcggccagaucaugacccugaagagagacgagacccugcaggacggcugcgacacccacuucugcaaggugaacgagagaggcgaguacuucugggagaagagagugaccggcugcccccccuucgacgagcacaagugccuggccgagggcggcaagaucaugaagauccccggcaccugcugcgacaccugcgaggagcccgagugcaacgacaucaccgccagacugcaguacgugaaggugggcagcugcaagagcgagguggagguggacauccacuacugccagggcaagugcgccagcaaggccauguacagcaucgacaucaacgacgugcaggaccagugcagcugcugcagccccaccagaaccgagcccaugcagguggcccugcacugcaccaacggcagcgugguguaccacgaggugcugaacgccauggagugcaagugcagccccagaaagugcagcaaguaa

SEQ ID NO: 25605 - RNA, 3573 nt, Artificial Sequence
  WAPAL__Homo_sapiens__NP_055860
augaccagcagauucggcaagaccuacagcagaaagggcggcaacggcagcagcaaguucgacgagguguucagcaacaagagaaccacccugagcaccaaguggggcgagaccaccuucauggccaagcugggccagaagagacccaacuucaagcccgacauccaggagauccccaagaagcccaagguggaggaggagagcaccggcgaccccuucggcuucgacagcgacgacgagagccugcccgugagcagcaagaaccuggcccaggugaagugcagcagcuacagcgagagcagcgaggccgcccagcuggaggaggugaccagcgugcuggaggccaacagcaagaucagccacguggugguggaggacaccguggugagcgacaagugcuucccccuggaggacacccugcugggcaaggagaagagcaccaacagaaucguggaggacgacgccagcaucagcagcugcaacaagcugaucaccagcgacaagguggagaacuuccacgaggagcacgagaagaacagccaccacauccacaagaacgccgacgacagcaccaagaagcccaacgccgagaccaccguggccagcgagaucaaggagaccaacgacaccuggaacagccaguucggcaagagacccgagagccccagcgagaucagccccaucaagggcagcgugagaaccggccuguucgagugggacaacgacuucgaggacaucagaagcgaggacugcauccugagccuggacagcgacccccugcuggagaugaaggacgacgacuucaagaacagacuggagaaccugaacgaggccaucgaggaggacaucgugcagagcgugcugagacccaccaacugcagaaccuacugcagagccaacaagaccaagagcagccagggcgccagcaacuucgacaagcugauggacggcaccagccaggcccuggccaaggccaacagcgagagcagcaaggacggccugaaccaggccaagaagggcggcgugagcugcggcaccagcuucagaggcaccgugggcagaaccagagacuacaccgugcugcaccccagcugccugagcgugugcaacgugaccauccaggacaccauggagagaagcauggacgaguucaccgccagcacccccgccgaccugggcgaggccggcagacugagaaagaaggccgacaucgccaccagcaagaccaccaccagauucagacccagcaacaccaagagcaagaaggacgugaagcuggaguucuucggcuucgaggaccacgagaccggcggcgacgagggcggcagcggcagcagcaacuacaagaucaaguacuucggcuucgacgaccugagcgagagcgaggacgacgaggacgacgacugccagguggagagaaagaccagcaagaagagaaccaagaccgcccccagccccagccugcagcccccccccgagagcaacgacaacagccaggacagccagagcggcaccaacaacgccgagaaccuggacuucaccgaggaccugcccggcgugcccgagagcgugaagaagcccaucaacaagcagggcgacaagagcaaggagaacaccagaaagaucuucagcggccccaagagaagccccaccaaggccguguacaacgccagacacuggaaccaccccgacagcgaggagcugcccggcccccccguggugaagccccagagcgugaccgugagacugagcagcaaggagcccaaccagaaggacgacggcguguucaaggcccccgccccccccagcaaggugaucaagaccgugaccauccccacccagcccuaccaggacaucgugaccgcccugaagugcagaagagaggacaaggagcuguacaccguggugcagcacgugaagcacuucaacgacgugguggaguucggcgagaaccaggaguucaccgacgacaucgaguaccugcugagcggccugaagagcacccagccccugaacaccagaugccugagcgugaucagccuggccaccaagugcgccaugcccagcuucagaaugcaccugagagcccacggcaugguggccaugguguucaagacccuggacgacagccagcaccaccagaaccugagccugugcaccgccgcccugauguacauccugagcagagacagacugaacauggaccuggacagagccagccuggaccugaugaucagacugcuggagcuggagcaggacgccagcagcgccaagcugcugaacgagaaggacaugaacaagaucaaggagaagaucagaagacugugcgagaccgugcacaacaagcaccuggaccuggagaacaucaccaccggccaccuggccauggagacccugcugagccugaccagcaagagagccggcgacugguucaaggaggagcugagacugcugggcggccuggaccacaucguggacaaggugaaggagugcguggaccaccugagcagagacgaggacgaggagaagcugguggccagccuguggggcgccgagagaugccugagagugcuggagagcgugaccgugcacaaccccgagaaccagagcuaccugaucgccuacaaggacagccagcugaucgugagcagcgccaaggcccugcagcacugcgaggagcugauccagcaguacaacagagccgaggacagcaucugccuggccgacagcaagccccugccccaccagaacgugaccaaccacgugggcaaggccguggaggacugcaugagagccaucaucggcgugcugcugaaccugaccaacgacaacgaguggggcagcaccaagaccggcgagcaggacggccugaucggcaccgcccugaacugcgugcugcaggugcccaaguaccugccccaggagcagagauucgacaucagagugcugggccugggccugcugaucaaccugguggaguacagcgccagaaacagacacugccuggugaacauggagaccagcugcagcuucgacagcagcaucugcagcggcgagggcgacgacagccugagaaucggcggccaggugcacgccgugcaggcccuggugcagcuguuccuggagagagagagagccgcccagcuggccgagagcaagaccgacgagcugaucaaggacgcccccaccacccagcacgacaagagcggcgaguggcaggagaccagcggcgagauccagugggugagcaccgagaagaccgacggcaccgaggagaagcacaagaaggaggaggaggacgaggagcuggaccugaacaaggcccugcagcacgccggcaagcacauggaggacugcaucguggccagcuacaccgcccugcugcugggcugccugugccaggagagccccaucaacgugaccaccgugagagaguaccugcccgagggcgacuucagcaucaugaccgagaugcugaagaaguuccugagcuucaugaaccugaccugcgccgugggcaccaccggccagaagagcaucagcagagugaucgaguaccuggagcacugcuaa

SEQ ID NO: 25606 - RNA, 1014 nt, Artificial Sequence
  WARS2__Homo_sapiens__XP_011538796
augaugguggccuggaccaccaaggacagcaagaagagaguguucagcggcauccagcccaccggcauccugcaccugggcaacuaccugggcgccaucgagagcugggugagacugcaggacgaguacgacagcgugcuguacagcaucguggaccugcacagcaucaccgugccccaggaccccgccgugcugagacagagcauccuggacaugaccgccgugcugcuggccugcggcaucaaccccgagaagagcauccuguuccagcagagccaggugagcgagcacacccagcugagcuggauccugagcugcauggugagacugcccagacugcagcaccugcaccaguggaaggccaagaccaccaagcagaagcacgacggcaccgugggccugcugaccuaccccgugcugcaggccgccgacauccugcuguacaagagcacccacgugcccgugggcgaggaccaggugcagcacauggagcuggugcaggaccuggcccagggcuucaacaagaaguacggcgaguucuuccccgugcccgagagcauccugaccagcaugaagaaggugaagagccugagagaccccagcgccaagaugagcaagagcgaccccgacaagcuggccaccgugagaaucaccgacagccccgaggagaucgugcagaaguucagaaaggccgugaccgacuucaccagcgaggugaccuacgaccccgccggcagagccggcgugagcaacaucguggccgugcacgccgccgugaccggccugagcguggaggagguggugagaagaagcgccggcaugaacaccgccagauacaagcuggccguggccgacgccgugaucgagaaguucgcccccaucaagagagagaucgagaagcugaagcuggacaaggaccaccuggagaaggugcugcagaucggcagcgccaaggccaaggagcuggccuacaccgugugccaggaggugaagaagcuggugggcuuccuguaa

SEQ ID NO: 25607 - RNA, 1416 nt, Artificial Sequence
  WARS__Homo_sapiens__XP_006720312
augcccaacagcgagcccgccagccugcuggagcuguucaacagcaucgccacccagggcgagcuggugagaagccugaaggccggcaacgccagcaaggacgagaucgacagcgccgugaagaugcuggugagccugaagaugagcuacaaggccgccgccggcgaggacuacaaggccgacugcccccccggcaaccccgcccccaccagcaaccacggccccgacgccaccgaggccgaggaggacuucguggaccccuggaccgugcagaccagcagcgccaagggcaucgacuacgacaagcugaucgugagauucggcagcagcaagaucgacaaggagcugaucaacagaaucgagagagccaccggccagagaccccaccacuuccugagaagaggcaucuucuucagccacagagacaugaaccaggugcuggacgccuacgagaacaagaagcccuucuaccuguacaccggcagaggccccagcagcgaggccaugcacgugggccaccugauccccuucaucuucaccaaguggcugcaggacguguucaacgugccccuggugauccagaugaccgacgacgagaaguaccuguggaaggaccugacccuggaccaggccuacagcuacgccguggagaacgccaaggacaucaucgccugcggcuucgacaucaacaagaccuucaucuucagcgaccuggacuacaugggcaugagcagcggcuucuacaagaacguggugaagauccagaagcacgugaccuucaaccaggugaagggcaucuucggcuucaccgacagcgacugcaucggcaagaucagcuuccccgccauccaggccgcccccagcuucagcaacagcuucccccagaucuucagagacagaaccgacauccagugccugauccccugcgccaucgaccaggaccccuacuucagaaugaccagagacguggcccccagaaucggcuaccccaagcccgcccugcugcacagcaccuucuuccccgcccugcagggcgcccagaccaagaugagcgccagcgaccccaacagcagcaucuuccugaccgacaccgccaagcagaucaagaccaaggugaacaagcacgccuucagcggcggcagagacaccaucgaggagcacagacaguucggcggcaacugcgacguggacgugagcuucauguaccugaccuucuuccuggaggacgacgacaagcuggagcagaucagaaaggacuacaccagcggcgccaugcugaccggcgagcugaagaaggcccugaucgaggugcugcagccccugaucgccgagcaccaggccagaagaaaggaggugaccgacgagaucgugaaggaguucaugacccccagaaagcugagcuucgacuuccaguaa

SEQ ID NO: 25608 - RNA, 1680 nt, Artificial Sequence
  WASF1__Homo_sapiens__NP_001020106
augccccuggugaagagaaacaucgaccccagacaccugugccacaccgcccugcccagaggcaucaagaacgagcuggagugcgugaccaacaucagccuggccaacaucaucagacagcugagcagccugagcaaguacgccgaggacaucuucggcgagcuguucaacgaggcccacagcuucagcuucagagugaacagccugcaggagagaguggacagacugagcgugagcgugacccagcuggaccccaaggaggaggagcugagccugcaggacaucaccaugagaaaggccuucagaagcagcaccauccaggaccagcagcuguucgacagaaagacccugcccaucccccugcaggagaccuacgacgugugcgagcagccccccccccugaacauccugacccccuacagagacgacggcaaggagggccugaaguucuacaccaaccccagcuacuucuucgaccuguggaaggagaagaugcugcaggacaccgaggacaagagaaaggagaagagaaagcagaagcagaagaaccuggacagaccccacgagcccgagaaggugcccagagccccccacgacagaagaagagaguggcagaagcuggcccagggccccgagcuggccgaggacgacgccaaccugcugcacaagcacaucgagguggccaacggccccgccagccacuucgagaccagaccccagaccuacguggaccacauggacggcagcuacagccugagcgcccugcccuucagccagaugagcgagcugcugaccagagccgaggagagagugcuggugagaccccacgagccccccccccccccccccaugcacggcgccggcgacgccaagcccauccccaccugcaucagcagcgccaccggccugaucgagaacagaccccagagccccgccaccggcagaacccccguguucgugagccccaccccccccccccccccccccccccugcccagcgcccugagcaccagcagccugagagccagcaugaccagcaccccccccccccccgugcccccccccccccccccccccgccaccgcccugcaggcccccgccgugccccccccccccgccccccugcagaucgcccccggcgugcugcaccccgcccccccccccaucgcccccccccuggugcagcccagcccccccguggccagagccgcccccgugugcgagaccgugcccgugcacccccugccccagggcgaggugcagggccugcccccccccccccccccccccccccugcccccccccggcaucagacccagcagccccgugaccgugaccgcccuggcccacccccccagcggccugcaccccacccccagcaccgcccccggcccccacgugccccugaugccccccagcccccccagccaggugauccccgccagcgagcccaagagacaccccagcacccugcccgugaucagcgacgccagaagcgugcugcuggaggccaucagaaagggcauccagcugagaaagguggaggagcagagagagcaggaggccaagcacgagagaaucgagaacgacguggccaccauccugagcagaagaaucgccguggaguacagcgacagcgaggacgacagcgaguucgacgagguggacuggcuggaguaa

SEQ ID NO: 25609 - RNA, 1500 nt, Artificial Sequence
  WASF3__Homo_sapiens__NP_001278894
augccccuggugaagagaaacaucgagcccagacaccugugcagaggcgcccugcccgagggcaucaccagcgagcuggagugcgugaccaacagcacccuggccgccaucaucagacagcugagcagccugagcaagcacgccgaggacaucuucggcgagcuguucaacgaggccaacaacuucuacaucagagccaacagccugcaggacagaaucgacagacuggccgugaaggugacccagcuggacagcaccguggaggaggugagccugcaggacaucaacaugaagaaggccuucaagagcagcaccgugcaggaccagcagguggugagcaagaacagcauccccaaccccguggccgacaucuacaaccagagcgacaagccccccccccugaacauccugacccccuacagagacgacaagaaggacggccugaaguucuacaccgaccccagcuacuucuucgaccuguggaaggagaagaugcugcaggacaccgaggacaagagaaaggagaagagaagacagaagagagagaagcacaagcugaaccccaacagaaaccagcaggugaacgugagaaaggugagaaccagaaaggaggagugggagagaagaaagaugggcaucgaguucaugagcgacgccaagaagcuggagcaggccggcagcgccaaggaggacagagugcccagcggcagccacgccagcgacgugaccgacuacagcuaccccgccacccccaaccacagccugcacccccagcccgugacccccagcuacgccgccggcgacgugcccccccacggccccgccagccaggccgccgagcacgaguacagaccccccagcgccagcgccagacacauggcccugaacagaccccagcagccccccccccccccccccccccaggcccccgagggcagccaggccagcgcccccauggcccccgccgacuacggcaugcugcccgcccagaucaucgaguacuacaaccccagcggcccccccccccccccccccccccccgugauccccagcgcccagaccgccuucgugagcccccugcagaugcccaugcagccccccuuccccgccagcgccagcagcacccacgccgcccccccccacccccccagcaccggccugcuggugaccgccccccccccccccggcccccccccccccccccccggcccccccggccccggcagcagccugagcagcagccccaugcacggcccccccguggccgaggccaagagacaggagcccgcccagccccccaucagcgacgccagaagcgaccugcuggccgccaucagaaugggcauccagcugaagaaggugcaggagcagagagagcaggaggccaagagagagcccgugggcaacgacguggccaccauccugagcagaagaaucgccguggaguacagcgacagcgacgacgacagcgaguucgacgagaacgacuggagcgacuaa

SEQ ID NO: 25610 - RNA, 1440 nt, Artificial Sequence
  WASH1__Homo_sapiens__XP_011515960
augggcgccgugugcaccagcggcgccagaagcgagagaaccaugacccccgugagaaugcagcacagccuggccggccagaccuacgccgugcccuucauccagcccgaccugagaagagaggaggccgugcagcagauggccgacgcccugcaguaccugcagaaggugagcggcgacaucuucagcagaaucagccagcagguggagcagagcagaagccaggugcaggccaucggcgagaaggugagccuggcccaggccaagaucgagaagaucaagggcagcaagaaggccaucaagguguucagcagcgccaaguaccccgcccccggcagacugcaggaguacggcagcaucuucaccggcgcccaggaccccggccugcagagaagacccagacacagaauccagagcaagcacagaccccuggacgagagagcccugcaggagaagcugaaggacuuccccgugugcgugagcaccaagcccgagcccgaggacgacgccgaggagggccugggcggccugcccagcaacaucagcagcgugagcagccugcugcuguucaacaccaccgagaaccuguacaagaaguacguguuccuggacccccuggccggcgccgugaccaagacccacgugaugcugggcgccgagaccgaggagaagcuguucgacgccccccugagcaucagcaagagagagcagcuggagcagcaggugcccgagaacuacuucuacgugcccgaccugggccaggugcccgagauccacgugcccagcuaccugcccgaccugcccggcaucgccaacgaccugauguacagcgccgaccugggccccggcaucgcccccagcgcccccggcaccauccccgagcugcccaccuuccacaccgagguggccgagccccugaagguggaccugcaggacggcgugcugaccccccccccccccccccccccccccccccccgcccccgaggugcuggccagcgcccccccccugccccccagcaccgccgcccccgugggccagggcgccagacaggacgacagcagcagcagcgccagccccagcgugcagggcgcccccagagaggugguggaccccagcggcggcugggccacccugcuggagagcaucagacaggccggcggcaucggcaaggccaagcugagaagcaugaaggagagaaagcuggagaagcagcagcagaaggagcaggagcaggugagagccaccagccagggcggccaccugaugagcgaccuguucaacaagcuggugaugagaagaaagggcaucagcggcaagggccccggcgccggcgagggccccggcggcgccuucgugagagugagcgacagcauccccccccugccccccccccagcagccccaggccgaggaggacgaggacgacugggagagcuaa

SEQ ID NO: 25611 - RNA, 1509 nt, Artificial Sequence
  WAS__Homo_sapiens__NP_000368
augagcggcggccccaugggcggcagacccggcggcagaggcgcccccgccgugcagcagaacauccccagcacccugcugcaggaccacgagaaccagagacuguucgagaugcugggcagaaagugccugacccuggccaccgccguggugcagcuguaccuggcccugccccccggcgccgagcacuggaccaaggagcacugcggcgccgugugcuucgugaaggacaacccccagaagagcuacuucaucagacuguacggccugcaggccggcagacugcugugggagcaggagcuguacagccagcugguguacagcacccccacccccuucuuccacaccuucgccggcgacgacugccaggccggccugaacuucgccgacgaggacgaggcccaggccuucagagcccuggugcaggagaagauccagaagagaaaccagagacagagcggcgacagaagacagcugccccccccccccacccccgccaacgaggagagaagaggcggccugcccccccugccccugcaccccggcggcgaccagggcggcccccccgugggcccccugagccugggccuggccaccguggacauccagaaccccgacaucaccagcagcagauacagaggccugcccgcccccggccccagccccgccgacaagaagagaagcggcaagaagaagaucagcaaggccgacaucggcgcccccagcggcuucaagcacgugagccacgugggcugggacccccagaacggcuucgacgugaacaaccuggaccccgaccugagaagccuguucagcagagccggcaucagcgaggcccagcugaccgacgccgagaccagcaagcugaucuacgacuucaucgaggaccagggcggccuggaggccgugagacaggagaugagaagacaggagccccugccccccccccccccccccagcagaggcggcaaccagcugcccagaccccccaucgugggcggcaacaagggcagaagcggcccccugccccccgugccccugggcaucgccccccccccccccacccccagaggcccccccccccccggcagaggcggccccccccccccccccccccccgccaccggcagaagcggcccccugcccccccccccccccggcgccggcggcccccccaugcccccccccccccccccccccccccccccccccagcagcggcaacggccccgccccccccccccugccccccgcccuggugcccgccggcggccuggcccccggcggcggcagaggcgcccugcuggaccagaucagacagggcauccagcugaacaagacccccggcgcccccgagagcagcgcccugcagccccccccccagagcagcgagggccuggugggcgcccugaugcacgugaugcagaagagaagcagagccauccacagcagcgacgagggcgaggaccaggccggcgacgaggacgaggacgacgagugggacgacuaa

SEQ ID NO: 25612 - RNA, 1518 nt, Artificial Sequence
  WASL__Homo_sapiens__NP_003932
augagcagcgugcagcagcagccccccccccccagaagagugaccaacgugggcagccugcugcugaccccccaggagaacgagagccuguucaccuuccugggcaagaagugcgugaccaugagcagcgccguggugcagcuguacgccgccgacagaaacugcauguggagcaagaagugcagcggcguggccugccuggugaaggacaacccccagagaagcuacuuccugagaaucuucgacaucaaggacggcaagcugcugugggagcaggagcuguacaacaacuucguguacaacagccccagaggcuacuuccacaccuucgccggcgacaccugccagguggcccugaacuucgccaacgaggaggaggccaagaaguucagaaaggccgugaccgaccugcugggcagaagacagagaaagagcgagaagagaagagacccccccaacggccccaaccugcccauggccaccguggacaucaagaaccccgagaucaccaccaacagauucuacggcccccaggugaacaacaucagccacaccaaggagaagaagaagggcaaggccaagaagaagagacugaccaaggccgacaucggcacccccagcaacuuccagcacaucggccacgugggcugggaccccaacaccggcuucgaccugaacaaccuggaccccgagcugaagaaccuguucgacaugugcggcaucagcgaggcccagcugaaggacagagagaccagcaaggugaucuacgacuucaucgagaagaccggcggcguggaggccgugaagaacgagcugagaagacaggccccccccccccccccccccagcagaggcggccccccccccccccccccccccccccacaacagcggccccccccccccccccgccagaggcagaggcgcccccccccccccccccagcagagcccccaccgccgccccccccccccccccccccagcagacccagcguggccgugcccccccccccccccaacagaauguaccccccccccccccccgcccugcccagcagcgcccccagcggcccccccccccccccccccagcgugcugggcgugggccccguggcccccccccccccccccccccccccccccccccccggccccccccccccccccggccugcccagcgacggcgaccaccaggugcccaccaccgccggcaacaaggccgcccugcuggaccagaucagagagggcgcccagcugaagaagguggagcagaacagcagacccgugagcugcagcggcagagacgcccugcuggaccagaucagacagggcauccagcugaagagcguggccgacggccaggagagcaccccccccacccccgcccccaccagcggcaucgugggcgcccugauggaggugaugcagaagagaagcaaggccauccacagcagcgacgaggacgaggacgaggacgacgaggaggacuucgaggacgacgacgagugggaggacuaa

SEQ ID NO: 25613 - RNA, 1092 nt, Artificial Sequence
  WBP1L__Homo_sapiens__NP_001077382
auggagagaagaagacugcugggcggcauggcccugcugcugcugcaggcccugcccagcccccugagcgccagagccgagcccccccaggacaaggaggccugcgugggcaccaacaaccagagcuacaucugcgacaccggccacugcugcggccagagccagugcugcaacuacuacuacgagcuguggugguucuggcugguguggaccaucaucaucauccugagcugcugcugcgugugccaccacagaagagccaagcacagacugcaggcccagcagagacagcacgagaucaaccugaucgccuacagagaggcccacaacuacagcgcccugcccuucuacuucagauuccugcccaacuaccugcugccccccuacgaggagguggugaacagaccccccaccccccccccccccuacagcgccuuccagcugcagcagcagcagcugcugcccccccagugcggccccgccggcggcagcccccccggcaucgaccccaccagaggcagccagggcgcccagagcagcccccugagcgagcccagcagaagcagcaccagaccccccagcaucgccgaccccgaccccagcgaccugcccguggacagagccgccaccaaggcccccggcauggagcccagcggcagcguggccggccugggcgagcuggaccccggcgccuuccuggacaaggacgccgagugcagagaggagcugcugaaggacgacagcagcgagcacggcgcccccgacagcaaggagaagacccccggcagacacagaagauucaccggcgacagcggcaucgaggugugcgugugcaacagaggccaccacgacgacgaccugaaggaguucaacacccugaucgacgacgcccuggacggcccccuggacuucugcgacagcugccacgugagaccccccggcgacgaggaggagggccugugccagagcagcgaggagcaggccagagagcccggccacccccaccugcccagaccccccgccugccugcugcugaacaccaucaacgagcaggacagccccaacagccagagcagcagcagccccagcuaa

SEQ ID NO: 25614 - RNA, 786 nt, Artificial Sequence
  WBP2__Homo_sapiens__NP_036610
auggcccugaacaagaaccacagcgagggcggcggcgugaucgugaacaacaccgagagcauccugaugagcuacgaccacguggagcugaccuucaacgacaugaagaacgugcccgaggccuucaagggcaccaagaagggcaccguguaccugacccccuacagagugaucuuccugagcaagggcaaggacgccaugcagagcuucaugaugcccuucuaccugaugaaggacugcgagaucaagcagcccguguucggcgccaacuacaucaagggcaccgugaaggccgaggccggcggcggcugggagggcagcgccagcuacaagcugaccuucaccgccggcggcgccaucgaguucggccagagaaugcugcagguggccagccaggccagcagaggcgaggugcccagcggcgccuacggcuacagcuacaugcccagcggcgccuacguguaccccccccccguggccaacggcauguaccccugcccccccggcuaccccuaccccccccccccccccgaguucuaccccggcccccccaugauggacggcgccaugggcuacgugcagcccccccccccccccuaccccggccccauggagccccccgugagcggccccgacgugcccagcacccccgccgccgaggccaaggccgccgaggccgccgccagcgccuacuacaaccccggcaacccccacaacguguacaugcccaccagccagcccccccccccccccuacuacccccccgaggacaagaagacccaguaa

SEQ ID NO: 25615 - RNA, 1797 nt, Artificial Sequence
  WBSCR17__Homo_sapiens__NP_071924
auggccagccugagaagagugaaggugcugcuggugcugaaccugaucgccguggccggcuucgugcuguuccuggccaagugcagacccaucgccgugagaagcggcgacgccuuccacgagaucagacccagagccgagguggccaaccugagcgcccacagcgccagccccauccaggacgccgugcugaagagacugagccugcuggaggacaucguguacagacagcugaacggccugagcaagagccugggccugaucgagggcuacggcggcagaggcaagggcggccugcccgccacccugagccccgccgaggaggagaaggccaagggcccccacgagaaguacggcuacaacagcuaccugagcgagaagaucagccuggacagaagcauccccgacuacagacccaccaagugcaaggagcugaaguacagcaaggaccugccccagaucagcaucaucuucaucuucgugaacgaggcccugagcgugauccugagaagcgugcacagcgccgugaaccacacccccacccaccugcugaaggagaucauccugguggacgacaacagcgacgaggaggagcugaaggugccccuggaggaguacgugcacaagagauaccccggccuggugaagguggugagaaaccagaagagagagggccugaucagagccagaaucgagggcuggaagguggccaccggccaggugaccggcuucuucgacgcccacguggaguucaccgccggcugggccgagcccgugcugagcagaauccaggagaacagaaagagagugauccugcccagcaucgacaacaucaagcaggacaacuucgaggugcagagauacgagaacagcgcccacggcuacagcugggagcuguggugcauguacaucagcccccccaaggacuggugggacgccggcgaccccagccugcccaucagaacccccgccaugaucggcugcagcuucguggugaacagaaaguucuucggcgagaucggccugcuggaccccggcauggacguguacggcggcgagaacaucgagcugggcaucaagguguggcugugcggcggcagcauggaggugcugcccugcagcagaguggcccacaucgagagaaagaagaagcccuacaacagcaacaucggcuucuacaccaagagaaacgcccugagaguggccgagguguggauggacgacuacaagagccacguguacaucgccuggaaccugccccuggagaaccccggcaucgacaucggcgacgugagcgagagaagagcccugagaaagagccugaagugcaagaacuuccagugguaccuggaccacguguaccccgagaugagaagauacaacaacaccguggccuacggcgagcugagaaacaacaaggccaaggacgugugccuggaccagggcccccuggagaaccacaccgccauccuguaccccugccacggcuggggcccccagcuggccagauacaccaaggagggcuuccugcaccugggcgcccugggcaccaccacccugcugcccgacaccagaugccugguggacaacagcaagagcagacugccccagcugcuggacugcgacaaggugaagagcagccuguacaagagauggaacuucauccagaacggcgccaucaugaacaagggcaccggcagaugccuggagguggagaacagaggccuggccggcaucgaccugauccugagaagcugcaccggccagagauggaccaucaagaacagcaucaaguaa

SEQ ID NO: 25616 - RNA, 897 nt, Artificial Sequence
  WBSCR22__Homo_sapiens__NP_001189489
auggccagcagaggcagaagacccgagcacggcggcccccccgagcuguucuacgacgagaccgaggccagaaaguacgugagaaacagcagaaugaucgacauccagaccagaauggccggcagagcccuggagcugcuguaccugcccgagaacaagcccugcuaccugcuggacaucggcugcggcaccggccugagcggcagcuaccugagcgacgagggccacuacugggugggccuggacaucagccccgccaugcuggacgaggccguggacagagagaucgagggcgaccugcugcugggcgacaugggccagggcauccccuucaagcccggcaccuucgacggcugcaucagcaucagcgccgugcaguggcugugcaacgccaacaagaagagcgagaaccccgccaagagacuguacugcuucuucgccagccuguucagcgugcuggugagaggcagcagagccgugcugcagcuguaccccgagaacagcgagcagcuggagcugaucaccacccaggccaccaaggccggcuucagcggcggcauggugguggacuaccccaacagcgccaaggccaagaaguucuaccugugccuguucagcggccccagcaccuucauccccgagggccugagcgagaaccaggacgagguggagcccagagagagcguguucaccaacgagagagagggcggcgccuucgagagaagaggcaucagaggccaccagaccagaagauucccccugagaaugagcagaagaggcauggugagaaagagcagagccugggugcuggagaagaaggagagacacagaagacagggcagagaggugagacccgacacccaguacaccggcagaaagagaaagcccagauucuaa

SEQ ID NO: 25617 - RNA, 1203 nt, Artificial Sequence
  WDFY2__Homo_sapiens__NP_443182
auggccgccgagauccagcccaagccccugaccagaaagcccauccugcugcagagaauggagggcagccaggagguggugaacauggccgugaucgugcccaaggaggagggcgugaucagcgugagcgaggacagaaccgugagaguguggcugaagagagacagcggccaguacuggcccagcguguaccacgccaugcccagccccugcagcugcaugagcuucaaccccgagaccagaagacugagcaucggccuggacaacggcaccaucagcgaguucauccugagcgaggacuacaacaagaugacccccgugaagaacuaccaggcccaccagagcagagugaccaugauccuguucgugcuggagcuggagugggugcugagcaccggccaggacaagcaguucgccuggcacugcagcgagagcggccagagacugggcggcuacagaaccagcgccguggccagcggccugcaguucgacguggagaccagacacguguucaucggcgaccacagcggccaggugaccauccugaagcuggagcaggagaacugcacccuggugaccaccuucagaggccacaccggcggcgugaccgcccugugcugggaccccgugcagagagugcuguucagcggcagcagcgaccacagcgugaucaugugggacaucggcggcagaaagggcaccgccaucgagcugcagggccacaacgacagagugcaggcccugagcuacgcccagcacaccagacagcugaucagcugcggcggcgacggcggcaucgugguguggaacauggacguggagagacaggagacccccgaguggcuggacagcgacagcugccagaagugcgaccagcccuucuucuggaacuucaagcagaugugggacagcaagaagaucggccugagacagcaccacugcagaaagugcggcaaggccgugugcggcaagugcagcagcaagagaagcagcaucccccugaugggcuucgaguucgaggugagagugugcgacagcugccacgaggccaucaccgacgaggagagagcccccaccgccaccuuccacgacagcaagcacaacaucgugcacgugcacuucgacgccaccagaggcuggcugcugaccagcggcaccgacaaggugaucaagcugugggacaugacccccguggugagcuaa

SEQ ID NO: 25618 - RNA, 9555 nt, Artificial Sequence
  WDFY4__Homo_sapiens__NP_065996
auggaggccgaggaccugagcaaggccgaggacagaaacgaggaccccggcagcaagaacgagggccagcuggccgccgugcagcccgacgugccccacggcggccagagcagcagccccaccgcccugugggacaugcuggagagaaaguuccuggaguaccagcagcugacccacaagagccccaucgagagacagaagagccugcugagccugcugccccuguuccugaaggccugggagcacagcgugggcaucaucugcuuccccagccugcagagacuggccgaggacgugagcgaccagcuggcccagcagcugcagaaggcccuggugggcaagcccgccgagcaggccagacuggccgccggccagcugcugugguggaagggcgacguggaccaggacggcuaccugcugcugaagagcguguacgugcugaccggcaccgacagcgagacccugggcagaguggccgagagcggccugcccgcccugcugcugcagugccuguaccuguucuucguguucccccuggacaaggacgagcugcuggagagcgaccugcaggugcagaagauguucgugcagaugcugcugaacaucugcagcgacagccagggccuggagggccugcugagcggcagcgagcugcagagccugcugaucgccaccaccugccugagagagcacagcugcugcuucuggaaggagcccaccuucugcgugcugagagccaucagcaaggcccagaaccugagcaucauccaguaccugcaggccaccgacugcgugagacugagccugcagaaccugagcagacugaccgacacccugcccgcccccgaggugagcgaggccgugagccugauccugggcuucgugaaggacagcuaccccgugagcagcgcccuguuccuggaguucgagaacagcgagggcuacccccugcugcugaaggugcugcugagauacgacggccugacccagagcgagguggacccccaccuggaggagcugcugggccuggugguguggcugaccaccugcggcagaagcgagcugaagguguucgacagcaucaccuacccccagcuggagggcuucaaguuccaccacgaggccagcggcgugaccgugaagaaccugcaggccuuccaggugcugcagaacguguuccacaaggccagcgacagcgugcugugcauccaggugcugagcgugaucagaaccaugugggccuggaacgccagaaacuucuuccugcuggaguggacccugcagcccaucagccaguucguggagaucaugccccugaagcccgcccccgugcaggagcacuucuuccagcugcuggaggcccugguguucgagcugcacuacgugccccacgagauccugagaaaggugcagcaccugaucaaggagagccccggccccagcugcacccugauggcccugcagagcauccugagcaucgccggcggcgacccccuguucaccgacaucuucagagacagcggccugcugggccugcugcuggcccagcugagaaagcaggccaagaucaugagaaagagcggcaacaaggugagcacccccggcgugcaggaccccgagagagagcugaccugcgugaugcugagaaucguggugacccugcugaagggcagcgugagaaacgccguggugcugaaggaccacggcauggugcccuucaucaagaucuuccuggacgacgagugcuacagagaggccagccugagcauccuggagcagcugagcgccaucaacgccgaggaguacaugagcaucaucgugggcgcccugugcagcagcacccagggcgagcugcagcugaagcuggaccugcugaagagccugcugagaauccuggugacccccaagggcagagccgccuucagagugagcagcggcuucaacggccugcugagccugcugagcgaccuggagggcagccugcaggagcccccccugcaggccuggggcgccgugagccccagacagacccuggagcuggugcuguacacccugugcgccgugagcgccgcccugcacugggaccccgugaacggcuacuucuucagaagaaacggccuguucgagaagcuggccgaggaccugugccugcugggcugcuucggcgcccuggaggaggagggcaaccugcugagaagcuggguggacaccaaggccagacccuucgccgaccugcugggcaccgccuucagcagcagcggcagccugccccccagaauccagagcugccugcagauccugggcuuccuggacagcauggccagcggcacccugcaccugagaggcgaccugaaggagagccugagaaccaagcagggccccgugguggacgugcagaagggcgagaccggcagcgacccccagagaaacuucaagcaguggcccgaccuggaggagagaauggacgagggcgacgccgccaucaugcaccccggcguggugugcaucauggugagacugcugcccagacuguaccacgaggaccacccccagcugagcgaggagauccagugcagccuggccagccacauccagagccuggugaagagcgagaagaacagacaggugaugugcgaggccggccugcugggcacccugauggccagcugccacagagcccuggugaccagcggcagcccccugcacagcagacugaucagaaucuucgagaagcuggccagccaggccaucgagcccgacgugcugagacaguuccugggccugggcauccccagcagccugagcgccaccaccaagauccuggacagcagccacacccacagaggcaaccccggcugcagcggcagccagaccgcccagggccuggccgagggccccuggcccgccgcccccgacgccggccugcaccccggcgugacccaggccccccagccccugggcgagagccaggacagcaccaccgcccugcagaccgcccugagccugaucagcaugaccagccccagaaaccugcagccccagagagccgcccuggcccccagcuucguggaguucgacaugagcguggagggcuacggcugccuguucauccccacccugagcaccgugaugggcaccagcaccgaguacagcgugagcggcggcaucggcaccggcgccaccagacccuuccccccccccggcggccugaccuucagcugcugguuccugaucagcagacacggcgccgccaccgagggccacccccugagauuccugacccuggugagacaccuggccagaaccgagcagcccuucgugugcuucagcgugagccugugccccgacgaccugagccugguggugagcaccgaggagaaggaguuccagccccuggacgugauggagcccgaggacgacagcgagcccagcgccggcugccagcugcaggugagaugcggccagcugcuggccugcggccaguggcaccaccuggccgugguggugaccaaggagaugaagagacacugcaccgugagcaccugccuggacggccaggugaucggcagcgccaagaugcuguacauccaggcccugcccggccccuuccugagcauggaccccagcgccuucguggacguguacggcuacaucgccacccccagaguguggaagcagaagagcagccugaucuggagacugggccccaccuaccuguucgaggaggccaucagcauggagacccuggaggugaucaacaagcugggccccagauacugcggcaacuuccaggccgugcacgugcagggcgaggaccuggacagcgaggccacccccuucguggccgaggagagagugagcuucggccugcacaucgccagcagcagcaucaccagcguggccgacaucagaaacgccuacaacgagguggacagcagacugaucgccaaggagaugaacaucagcagcagagacaacgccaugcccguguuccugcugagaaacugcgccggccaccugagcggcagccugagaaccaucggcgccguggccgugggccagcugggcgugagaguguuccacagcagccccgccgccagcagccuggacuucaucggcggccccgccauccugcugggccugaucagccuggccaccgacgaccacaccauguacgccgccgugaaggugcugcacagcgugcugaccagcaacgccaugugcgacuuccugaugcagcacaucugcggcuaccagaucauggccuuccugcugagaaagaaggccagccugcugaaccacagaaucuuccagcugauccugagcguggccggcaccguggagcugggcuucagaagcagcgccaucaccaacaccggcguguuccagcacauccugugcaacuucgagcuguggaugaacaccgccgacaaccuggagcugagccuguucagccaccugcuggagauccugcagagccccagagagggccccagaaacgccgaggccgcccaccaggcccagcugauccccaagcugaucuuccuguucaacgagcccagccugauccccagcaagaucagcaccaucaucggcauccuggccugccagcugagaggccacuucagcacccaggaccugcugagaaucggccuguucgugguguacacccugaagcccagcagcgugaacgagagacagaucugcauggacggcgcccuggaccccagccugcccgccggcagccagaccagcggcaagaccaucuggcugagaaaccagcugcuggagaugcugcugagcgugaucagcagcccccagcugcaccugagcagcgagagcaaggaggagauguuccugaagcugggccccgacugguuccugcugcugcugcagggccaccugcacgccagcaccaccgugcuggcccugaagcugcugcuguacuuccuggccagccccagccugagaaccagauucagagacggccugugcgccggcagcuggguggagagaagcaccgagggcguggacaucgugauggacaaccugaagagccagagcccccugcccgagcagagccccugccugcugcccggcuucagagugcugaacgacuuccuggcccaccacgugcacauccccgagguguaccugaucgugagcaccuucuuccugcagaccccccugaccgagcugauggacggccccaaggacagccuggacgccaugcugcaguggcugcugcagagacaccaccaggaggaggugcugcaggccggccugugcaccgagggcgcccugcugcugcuggagaugcugaaggccaccaugagccagccccuggccggcagcgaggacggcgccugggcccagaccuuccccgccagcgugcugcaguuccugagccuggugcacagaaccuacccccaggaccccgccuggagagcccccgaguuccugcagacccuggccaucgccgccuucccccugggcgcccagaagggcgugggcgccgagagcaccagaaacaccagcagccccgaggccgccgccgagggcgacagcaccguggagggccugcaggcccccaccaaggcccaccccgccagaagaaagcugagagaguucacccagcugcugcugagagagcugcugcugggcgccagcagccccaagcaguggcugccccuggaggugcugcuggaggccagccccgaccacgccaccagccagcagaagagagacuuccagagcgaggugcugcugagcgccauggagcuguuccacaugaccagcggcggcgacgccgccauguucagagacggcaaggagccccagcccagcgccgaggccgccgccgcccccagccuggccaacaucagcugcuucacccagaagcugguggagaagcuguacagcggcauguucagcgccgaccccagacacauccugcuguucauccuggagcacaucaugguggugaucgagaccgccagcagccagagagacaccgugcugagcacccuguacagcagccugaacaaggugauccuguacugccugagcaagccccagcagagccugagcgagugccugggccugcugagcauccugggcuuccugcaggagcacugggacgugguguucgccaccuacaacagcaacaucagcuuccugcugugccugaugcacugccugcugcugcugaacgagagaagcuaccccgagggcuucggccuggagcccaagcccagaaugagcaccuaccaccagguguuccugagccccaacgaggacgugaaggagaagagagaggaccugcccagccugagcgacgugcagcacaacauccagaagaccgugcagacccuguggcagcagcugguggcccagagacagcagacccuggaggacgccuucaagaucgaccugagcgugaagcccggcgagagagaggugaagaucgaggaggugaccccccugugggaggagaccaugcugaaggccuggcagcacuaccuggccagcgagaagaagagccuggccagcagaagcaacguggcccaccacagcaaggugacccuguggagcggcagccugagcagcgccaugaagcugaugcccggcagacaggccaaggaccccgagugcaagaccgaggacuucgugagcugcaucgagaacuacagaagaagaggccaggagcuguacgccagccuguacaaggaccacgugcagagaagaaagugcggcaacaucaaggccgccaacgccugggccagaauccaggagcagcuguucggcgagcugggccuguggagccagggcgaggagaccaagcccugcagccccugggagcuggacuggagagagggccccgccagaaugagaaagagaaucaagagacugagcccccuggaggcccugagcagcggcagacacaaggagagccaggacaagaacgaccacaucagccagaccaacgccgagaaccaggacgagcugacccugagagaggccgagggcgagcccgacgaggugggcguggacugcacccagcugaccuucuuccccgcccugcacgagagccugcacagcgaggacuuccuggagcugugcagagagagacaggugauccugcaggagcugcuggacaaggagaaggugacccagaaguucagccuggugaucgugcagggccaccuggugagcgagggcgugcugcuguucggccaccagcacuucuacaucugcgagaacuucacccugagccccaccggcgacguguacugcaccagacacugccugagcaacaucagcgaccccuucaucuucaaccugugcagcaaggacagaagcaccgaccacuacagcugccagugccacagcuacgccgacaugagagagcugagacaggccagauuccugcugcaggacaucgcccuggagaucuucuuccacaacggcuacagcaaguuccugguguucuacaacaacgacagaagcaaggccuucaagagcuucugcagcuuccagcccagccugaagggcaaggccaccagcgaggacacccugagccugagaagauaccccggcagcgacagaaucaugcugcagaaguggcagaagagagacaucagcaacuucgaguaccugauguaccugaacaccgccgccggcagaaccugcaacgacuacaugcaguaccccguguuccccugggugcuggccgacuacaccagcgagacccugaaccuggccaaccccaagaucuucagagaccugagcaagcccaugggcgcccagaccaaggagagaaagcugaaguucauccagagauucaaggagguggagaagaccgagggcgacaugaccgugcagugccacuacuacacccacuacagcagcgccaucaucguggccagcuaccuggugagaaugccccccuucacccaggccuucugcgcccugcagggcggcagcuucgacguggccgacagaauguuccacagcgugaagagcaccugggagagcgccagcagagagaacaugagcgacgugagagagcugacccccgaguucuucuaccugcccgaguuccugaccaacugcaacggcguggaguucggcugcaugcaggacggcaccgugcugggcgacgugcagcugccccccugggccgacggcgaccccagaaaguucaucagccugcacagaaaggcccuggagagcgacuucgugagcgccaaccugcaccacuggaucgaccugaucuucggcuacaagcagcagggccccgccgccguggacgccgugaacaucuuccaccccuacuucuacggcgacagaauggaccugagcagcaucaccgacccccugaucaagagcaccauccugggcuucgugagcaacuucggccaggugcccaagcagcuguucaccaagccccaccccgccagaaccgccgccggcaagccccugcccggcaaggacgugagcacccccgugagccugcccggccacccccagcccuucuucuacagccugcagagccugagacccagccaggugaccgugaaggacauguaccuguucagccugggcagcgagagccccaagggcgccaucggccacaucgugagcaccgagaagaccauccuggccguggagagaaacaaggugcugcugcccccccuguggaacagaaccuucagcuggggcuucgacgacuucagcugcugccugggcagcuacggcagcgacaaggugcugaugaccuucgagaaccuggccgccuggggcagaugccugugcgccgugugccccagccccaccaccaucgugaccagcggcaccagcaccguggugugcgugugggagcugagcaugaccaagggcagacccagaggccugagacugagacaggcccuguacggccacacccaggccgugaccugccuggccgccagcgugaccuucagccugcuggugagcggcagccaggacugcaccugcauccugugggaccuggaccaccugacccacgugaccagacugcccgcccacagagagggcaucagcgccaucaccaucagcgacgugagcggcaccaucgugagcugcgccggcgcccaccugagccuguggaacgugaacggccagccccuggccagcaucaccaccgccuggggccccgagggcgccaucaccugcugcugccugauggagggccccgccugggacaccagccagaucaucaucaccggcagccaggacggcauggugagaguguggaagaccgaggacgugaagaugagcgugcccggcagacccgccggcgaggagccccccgcccagccccccagccccagaggccacaagugggagaagaaccuggcccugagcagagagcuggacgugagcaucgcccugaccggcaagcccagcaagaccagccccgccgugaccgcccuggccgugagcagaaaccacaccaagcugcuggugggcgacgagagaggcagaaucuucugcuggagcgccgacggcuaa

SEQ ID NO: 25619 - RNA, 3021 nt, Artificial Sequence
  WDHD1__Homo_sapiens__NP_001008397
auggacagcagccagcagaagaccuucagaggccacgacgcccccgugcugagccugagcuucgaccccaaggacaucuuccuggccagcgccagcugcgacggcagcgugagaguguggcagaucagcgaccagaccugcgccaucagcuggccccugcugcagaagugcaacgacgugaucaacgccaagagcaucugcagacuggccuggcagcccaagagcggcaagcugcuggccauccccguggagaagagcgugaagcuguacagaagagagagcuggagccaccaguucgaccugagcgacaacuucaucagccagacccugaacaucgugaccuggagccccugcggccaguaccuggccgccggcagcaucaacggccugaucaucguguggaacguggagaccaaggacugcauggagagagugaagcacgagaagggcuacgccaucugcggccuggccuggcaccccaccugcggcagaaucagcuacaccgacgccgagggcaaccugggccugcuggagaacgugugcgaccccagcggcaagaccagcagcagcaaggugagcagcagaguggagaaggacuacaacgaccuguucgacggcgacgacaugagcaacgccggcgacuuccugaacgacaacgccguggagauccccagcuucagcaagggcaucaucaacgacgacgaggacgacgaggaccugaugauggccagcggcagacccagacagagaagccacauccuggaggacgacgagaacagcguggacaucagcaugcugaagaccggcagcagccugcugaaggaggaggaggaggacggccaggagggcagcauccacaaccugccccuggugaccagccagagacccuucuacgacggccccaugcccacccccagacagaagcccuuccagagcggcagcaccccccugcaccugacccacagauucaugguguggaacagcaucggcaucaucagaugcuacaacgacgagcaggacaacgccaucgacguggaguuccacgacaccagcauccaccacgccacccaccugagcaacacccugaacuacaccaucgccgaccugagccacgaggccauccugcuggccugcgagagcaccgacgagcuggccagcaagcugcacugccugcacuucagcagcugggacagcagcaaggaguggaucaucgaccugccccagaacgaggacaucgaggccaucugccugggccagggcugggccgccgccgccaccagcgcccugcugcugagacuguucaccaucggcggcgugcagaaggagguguucagccuggccggccccguggugagcauggccggccacggcgagcagcuguucaucguguaccacagaggcaccggcuucgacggcgaccagugccugggcgugcagcugcuggagcugggcaagaagaagaagcagauccugcacggcgacccccugccccugaccagaaagagcuaccuggccuggaucggcuucagcgccgagggcacccccugcuacguggacagcgagggcaucgugagaaugcugaacagaggccugggcaacaccuggacccccaucugcaacaccagagagcacugcaagggcaagagcgaccacuacuggguggugggcauccacgagaacccccagcagcugagaugcauccccugcaagggcagcagauucccccccacccugcccagacccgccguggccauccugagcuucaagcugcccuacugccagaucgccaccgagaagggccagauggaggagcaguucuggagaagcgugaucuuccacaaccaccuggacuaccuggccaagaacggcuacgaguacgaggagagcaccaagaaccaggccaccaaggagcagcaggagcugcugaugaagaugcuggcccugagcugcaagcuggagagagaguucagaugcguggagcuggccgaccugaugacccagaacgccgugaaccuggccaucaaguacgccagcagaagcagaaagcugauccuggcccagaagcugagcgagcuggccguggagaaggccgccgagcugaccgccacccagguggaggaggaggaggaggaggaggacuucagaaagaagcugaacgccggcuacagcaacaccgccaccgaguggagccagcccagauucagaaaccagguggaggaggacgccgaggacagcggcgaggccgacgacgaggagaagcccgagauccacaagcccggccagaacagcuucagcaagagcaccaacagcagcgacgugagcgccaagagcggcgccgugaccuucagcagccagggcagagugaaccccuucaaggugagcgccagcagcaaggagcccgccaugagcaugaacagcgccagaagcaccaacauccuggacaacaugggcaagagcagcaagaagagcaccgcccugagcagaaccaccaacaacgagaagagccccaucaucaagccccugauccccaagcccaagcccaagcaggccagcgccgccagcuacuuccagaagagaaacagccagaccaacaagaccgaggaggugaaggaggagaaccugaagaacgugcugagcgagacccccgccaucugccccccccagaacaccgagaaccagagacccaagaccggcuuccagauguggcuggaggagaacagaagcaacauccugagcgacaaccccgacuucagcgacgaggccgacaucaucaaggagggcaugaucagauucagagugcugagcaccgaggagagaaaggugugggccaacaaggccaagggcgagaccgccagcgagggcaccgaggccaagaagagaaagagagugguggacgagagcgacgagaccgagaaccaggaggagaaggccaaggagaaccugaaccugagcaagaagcagaagccccuggacuucagcaccaaccagaagcugagcgccuucgccuucaagcaggaguaa

SEQ ID NO: 25620 - RNA, 2241 nt, Artificial Sequence
  WDPCP__Homo_sapiens__NP_056994
augagaagagaguucugcugggacgccuacagcaaggccgccggcagcagagccagcagcccccugcccagacaggacagagacagcuucugccaccagaugagcuucugccugaccgagcugcaccuguggagccugaagaacacccugcacaucgccgacagagacaucggcaucuaccaguacuacgacaagaaggacccccccgccaccgagcacggcaaccuggagaagaagcagaagcuggccgagagcagagacuaccccuggacccugaagaacagaagacccgagaagcugagagacagccugaaggagcuggaggagcugaugcagaacagcagaugcgugcugagcaaguggaagaacaaguacgugugccagcugcuguucggcagcggcgugcuggugagccugagccugagcggcccccagcuggagaagguggugaucgacagaagccuggugggcaagcugaucagcgacaccaucagcgacgcccugcugaccgacagcuucaucauccugagcuuccuggcccagaacaagcugugcuucauccaguucaccaagaagauggagagcagcgacgugaacaagagacuggagaagcugagcgcccuggacuacaagaucuucuacuacgagauccccggccccaucaacaagaccaccgagagacaccuggccaucaacugcgugcacgacagaguggugugcugguggccccuggugaacgacgacgccuggcccugggcccccaucagcagcgagaaggacagagccaaccugcugcugcugggcuacgcccagggcagacuggaggugcugagcagcgugagaaccgagugggacccccuggacgugagauucggcaccaagcagcccuaccagguguucaccguggagcacagcgugagcguggacaaggagcccauggccgacagcugcaucuacgagugcaucagaaacaagauccagugcgugagcgugaccagaaucccccugaagagcaaggccaucagcugcugcagaaacgugaccgaggacaagcugauccugggcugcgaggacagcagccugauccuguacgagacccacagaagagugacccugcuggcccagaccgagcugcugcccagccugaucagcugccaccccagcggcgccauccugcuggugggcagcaaccagggcgagcugcagaucuucgacauggcccugagccccaucaacauccagcugcuggccgaggacagacugcccagagagacccugcaguucagcaagcuguucgacgccagcagcagccuggugcagaugcaguggaucgccccccagguggugagccagaagggcgagggcagcgacaucuacgaccugcuguuccugagauucgagagaggcccccugggcgugcugcuguucaagcugggcguguucaccagaggccagcugggccugaucgacaucaucuuccaguacauccacugcgacgagaucuacgaggccaucaacauccugagcagcaugaacugggacacccugggccaccagugcuucaucagcaugagcgccaucgugaaccaccugcugagacagaagcugacccccgagagagaggcccagcuggagaccagccugggcaccuucuacgcccccaccagaccccugcuggacagcaccauccuggaguacagagaccagaucagcaaguacgccagaagauucuuccaccaccugcugagauaccagagauucgagaaggccuuccugcuggccguggacgugggcgccagagaccuguucauggacauccacuaccuggcccuggacaagggcgagcuggcccuggccgagguggccagaaagagagccagcgacaucgacgccgagagcaucaccagcggcguggagcugcugggcccccuggacagaggcgacaugcugaacgaggccuucaucggccugagccuggccccccagggcgaggacagcuuccccgacaaccugccccccagcugccccacccacagacacauccugcagcagagaauccugaacggcagcagcaacagacagaucaucgacagaagaaacgagcuggagaaggacaucugcagcggcuuccugaugaccaacaccugcaacgccgaggacggcgagcugagagaggacggcagagagcaggagaucagagacggcggcagccugaagaugauccacuucggccugguguaa

SEQ ID NO: 25621 - RNA, 3675 nt, Artificial Sequence
  WDR11__Homo_sapiens__NP_060587
augcugcccuacaccgugaacuucaaggugagcgccagaacccugaccggcgcccugaacgcccacaacaaggccgccguggacuggggcuggcagggccugaucgccuacggcugccacagccuggugguggugaucgacagcaucaccgcccagacccugcaggugcuggagaagcacaaggccgacguggugaaggugaagugggccagagagaacuaccaccacaacaucggcagccccuacugccugagacuggccagcgccgacgugaacggcaagaucaucgugugggacguggccgccggcguggcccagugcgagauccaggagcacgccaagcccauccaggacgugcaguggcuguggaaccaggacgccagcagagaccugcugcuggccauccacccccccaacuacaucgugcuguggaacgccgacaccggcaccaagcuguggaagaagagcuacgccgacaacauccugagcuucagcuucgaccccuucgaccccagccaccugacccugcugaccagcgagggcaucguguucaucagcgacuucagccccagcaagccccccagcggccccggcaagaagguguacaucagcagcccccacagcagccccgcccacaacaagcuggccaccgccaccggcgccaagaaggcccugaacaaggugaagauccugaucacccaggagaagcccagcgccgaguucaucacccugaacgacugccugcagcuggccuaccugcccagcaagagaaaccacaugcugcugcuguaccccagagagauccugauccuggaccuggaggugaaccagaccgugggcgugaucgccaucgagagaaccggcgugcccuuccugcaggugauccccugcuuccagagagacggccuguucugccugcacgagaacggcugcaucacccugagagugagaagaagcuacaacaacaucuucaccaccagcaacgaggagcccgaccccgaccccgugcaggagcugaccuacgaccugagaagccagugcgacgccaucagagugaccaagaccgugagacccuucagcauggugugcugccccgugaacgagaacgccgccgcccugguggugagcgacggcagagugaugaucugggagcugaagagcgccgugugcaacagaaacagcagaaacagcagcagcggcgugagcccccuguacagccccgugagcuucugcggcauccccgugggcgugcugcagaacaagcugcccgaccugagccuggacaacaugaucggccagagcgccaucgccggcgaggagcaccccagaggcagcauccugagagaggugcaccugaaguuccugcugaccggccugcugagcggccugcccgccccccaguucgccaucagaaugugccccccccugaccaccaagaacaucaagauguaccagccccugcuggccgugggcaccagcaacggcagcgugcugguguaccaccugaccagcggccugcugcacaaggagcugagcauccacagcugcgaggugaagggcaucgaguggaccagccugaccagcuuccugagcuucgccaccagcacccccaacaacaugggccuggugagaaacgagcugcagcugguggaccugcccaccggcagaagcaucgccuucagaggcgagagaggcaacgacgagagcgccaucgagaugaucaaggugagccaccugaagcaguaccuggccgugguguucagagacaagccccuggagcugugggacgugagaaccugcacccugcugagagagaugagcaagaacuuccccaccaucaccgcccuggaguggagccccagccacaaccugaagagccugagaaagaagcagcuggccaccagagaggccauggccagacagaccguggugagcgacaccgagcugagcaucguggagagcagcgugaucagccugcugcaggaggccgagagcaagagcgagcugagccagaacaucagcgccagagagcacuucguguucaccgacaucgacggccagguguaccaccugaccguggagggcaacagcgugaaggacagcgccagaaucccccccgacggcagcaugggcagcaucaccugcaucgccuggaagggcgacacccuggugcugggcgacauggacggcaaccugaacuucugggaccugaagggcagagugagcagaggcauccccacccacagaagcugggugagaaagaucagauucgcccccggcaagggcaaccagaagcugaucgccauguacaacgacggcgccgaggugugggacaccaaggaggugcagauggugagcagccugagaagcggcagaaacgugaccuucagaauccuggacguggacuggugcaccagcgacaaggugauccuggccagcgacgacggcugcaucagagugcuggagaugagcaugaagagcgccugcuucagaauggacgagcaggagcugaccgagcccguguggugccccuaccugcuggugcccagagccagccuggcccugaaggccuuccugcugcaccagcccuggaacggccaguacagccuggacaucagccacguggacuaccccgagaacgaggagaucaagaaccugcugcaggagcagcugaacagccugagcaacgacaucaagaagcugcugcuggaccccgaguucacccugcugcagagaugccugcuggugagcagacuguacggcgacgagagcgagcugcacuucuggaccguggccgcccacuaccugcacagccugagccaggagaagagcgccagcaccaccgcccccaaggaggccgcccccagagacaagcugagcaacccccuggacaucugcuacgacgugcugugcgagaacgccuacuuccagaaguuccagcuggagagagugaaccugcaggaggugaagagaagcaccuacgaccacaccagaaagugcaccgaccagcugcugcugcugggccagaccgacagagccgugcagcugcugcuggagaccagcgccgacaaccagcacuacuacugcgacagccugaaggccugccuggugaccaccgugaccagcagcggccccagccagagcaccaucaagcugguggccaccaacaugaucgccaacggcaagcuggccgagggcgugcagcugcugugccugaucgacaaggccgccgacgccugcagauaccugcagaccuacggcgaguggaacagagccgccuggcuggccaaggugagacugaaccccgaggagugcgccgacgugcugagaagauggguggaccaccugugcagcccccaggugaaccagaagagcaaggcccugcuggugcugcugagccugggcugcuucuucagcguggccgagacccugcacagcaugagauacuucgacagagccgcccuguucguggaggccugccugaaguacggcgccuucgaggugaccgaggacaccgagaagcugaucaccgccaucuacgccgacuacgccagaagccugaagaaccugggcuucaagcagggcgccgugcuguucgccagcaaggccggcgccgccggcaaggaccugcugaacgagcuggagagccccaaggaggagcccaucgaggaguaa

SEQ ID NO: 25622 - RNA, 1272 nt, Artificial Sequence
  WDR12__Homo_sapiens__NP_060726
auggcccagcugcagaccagauucuacaccgacaacaagaaguacgccguggacgacgugcccuucagcauccccgccgccagcgagaucgccgaccugagcaacaucaucaacaagcugcugaaggacaagaacgaguuccacaagcacguggaguucgacuuccugaucaagggccaguuccugagaaugccccuggacaagcacauggagauggagaacaucagcagcgaggaggugguggagaucgaguacguggagaaguacaccgccccccagcccgagcagugcauguuccacgacgacuggaucagcagcaucaagggcgccgaggaguggauccugaccggcagcuacgacaagaccagcagaaucuggagccuggagggcaagagcaucaugaccaucgugggccacaccgacguggugaaggacguggccugggugaagaaggacagccugagcugccugcugcugagcgccagcauggaccagaccauccugcugugggaguggaacguggagagaaacaaggugaaggcccugcacugcugcagaggccacgccggcagcguggacagcaucgccguggacggcagcggcaccaaguucugcagcggcagcugggacaagaugcugaagaucuggagcaccgugcccaccgacgaggaggacgagauggaggagagcaccaacagacccagaaagaagcagaagaccgagcagcugggccugaccagaacccccaucgugacccugagcggccacauggaggccgugagcagcgugcuguggagcgacgccgaggagaucugcagcgccagcugggaccacaccaucagagugugggacguggagagcggcagccugaagagcacccugaccggcaacaagguguucaacugcaucagcuacagcccccugugcaagagacuggccagcggcagcaccgacagacacaucagacugugggaccccagaaccaaggacggcagccuggugagccugagccugaccagccacaccggcugggugaccagcgugaaguggagccccacccacgagcagcagcugaucagcggcagccuggacaacaucgugaagcugugggacaccagaagcugcaaggccccccuguacgaccuggccgcccacgaggacaaggugcugagcguggacuggaccgacaccggccugcugcugagcggcggcgccgacaacaagcuguacagcuacagauacagccccaccaccagccacgugggcgccuaa

SEQ ID NO: 25623 - RNA, 3969 nt, Artificial Sequence
  WDR17__Homo_sapiens__NP_733828
auggccuggaugaccuacaucagcaacugguucgagcaggacgacugguacgagggccugcagagagccaacaugagccaggugagacaggugggccugcuggccgccggcugccagcccuggaacaaggacgugugcgccgccagcggcgacagauucgccuacugcgccacccuggccaucuacaucuaccagcuggaccacagauacaacgaguucaagcugcacgccaucaugagcgagcacaagaagaccaucaccgccaucagcuggugcccccacaaccccgaccuguucgccagcggcagcaccgacaaccuggugaucaucuggaacguggccgagcagaaggugaucgccaagcuggacagcaccaagggcauccccgccagccugagcuggugcuggaacgccgaggacgugguggccuucgugagccacagaggcccccuguucaucuggaccaucagcggccccgacagcggcgugaucgugcacaaggacgcccacagcuuccugagcgacaucugcauguucagauggcacacccaccagaagggcaaggugguguucggccacaucgacggcagccugagcaucuuccaccccggcaacaagaaccagaagcacgugcugagacccgagagccuggagggcaccgacgaggaggaccccgugaccgcccuggagugggacccccugagcaccgacuaccugcugguggugaaccugcacuacggcaucagacugguggacagcgagagccugagcugcaucaccaccuucaaccugcccagcgccgccgccagcgugcagugccuggccugggugcccagcgcccccggcauguucaucaccggcgacagccaggugggcgugcugagaaucuggaacgugagcagaaccacccccaucgacaaccugaagcugaagaagaccggcuuccacugccugcacgugcugaacagcccccccagaaagaaguucagcgugcagagccccaccaagaaccacuacaccagcagcaccagcgaggccgugcccccccccacccugacccagaaccaggccuucagccugccccccggccacgccgugugcugcuuccuggacggcggcgugggccuguacgacaugggcgccaagaagugggacuuccugagagaccugggccacguggagaccaucuucgacugcaaguucaagcccgacgaccccaaccugcuggccaccgccagcuucgacggcaccaucaaggugugggacaucaacacccugaccgccguguacaccagccccggcaacgagggcgugaucuacagccugagcugggcccccggcggccugaacugcaucgccggcggcaccagcagaaacggcgccuucaucuggaacgugcagaagggcaagaucauccagagauucaacgagcacggcaccaacggcaucuucugcaucgccuggagccacaaggacagcaagagaaucgccaccugcagcagcgacggcuucugcaucaucagaaccaucgacggcaaggugcugcacaaguacaagcaccccgccgccguguucggcugcgacuggagccagaacaacaaggacaugaucgccaccggcugcgaggacaccaacgugagaguguacuacguggccaccagcagcgaccagccccugaagguguucagcggccacaccgccaagguguuccacgugaaguggagcccccugagagagggcauccugugcagcggcagcgacgacggcaccgugagaaucugggacuacacccaggacgccugcaucaacauccugaacggccacaccgcccccgugagaggccugauguggaacaccgagauccccuaccugcugaucagcggcagcugggacuacaccaucaaggugugggacaccagagagggcaccugcguggacaccguguacgaccacggcgccgacguguacggccugaccugccaccccagcagacccuucaccauggccagcugcagcagagacagcaccgugagacuguggagccugaccgcccuggugacccccgugcagaucaacauccuggccgacagaagcugggaggagaucaucggcaacaccgacuacgccaucgagcccggcacccccccccugcugugcggcaaggugagcagagacaucagacaggagaucgagaagcugaccgccaacagccaggugaagaagcugagaugguucagcgagugccugagcccccccggcggcagcgacaaccuguggaaccugguggccgugaucaagggccaggacgacagccugcugccccagaacuacugcaagggcaucaugcaccugaagcaccugaucaaguucagaaccagcgaggcccaggagcugaccaccgugaagaugagcaaguucggcggcggcaucggcgugcccgccaaggaggagagacugaaggaggccgccgagauccaccugagacugggccagauccagagauacugcgagcugaugguggagcugggcgagugggacaaggcccugagcaucgcccccggcgugagcgugaaguacuggaagaagcugaugcagagaagagccgaccagcugauccaggaggacaaggacgacgugauccccuacugcaucgccaucggcgacgugaagaagcuggugcacuucuucaugagcagaggccagcugaaggaggcccugcugguggcccaggccgccugcgagggcaacaugcagccccugcacgugagcgugcccaagggcgccagcuacagcgacgacaucuacaaggaggacuucaacgagcugcugcacaaggugagcaaggagcuggccgagugguacuuccaggacggcagagccgugcuggccgccugcugccaccuggccaucgacaacaucgagcuggccauggccuaccugaucagaggcaacgagcuggagcuggccgugugcgugggcaccgugcugggcgagagcgccgcccccgccacccacuacgcccuggagcugcuggccagaaagugcaugaugaucagcgugugcuuccccugcgugggcuacagcgugcccuucugcuacgugaacagaaaccuggccgccgaccugcugcugaugauccccgacaacgagcugcaccugaucaagcugugcgccuucuaccccggcugcaccgaggagaucaacgaccugcacgacaagugcaagcugcccaccguggaggagugcaugcagcuggccgagaccgccagagccgacgacaacaucuucgagaccgugaaguacuaccugcugagccaggagcccgagaaggcccugcccaucggcaucagcuucgugaaggaguacaucagcagcagcgacuggacccuggacaccaucuaccccgugcuggaccugcugagcuacaucagaaccgagaagcugcugcugcacaccugcaccgaggccagaaacgagcugcugauccugugcggcuacaucggcgcccugcuggccaucagaagacaguaccagagcaucgugcccgcccuguacgaguacaccagccagcugcugaagagaagagaggugagcgugccccugaagaucgaguaccugagcgaggagcuggacgccuggagagccugcacccagagcaccaacagaagccuggaggacagccccuacaccccccccagcgacagccagagaaugaucuacgccacccugcugaagagacugaaggaggagagccugaagggcaucaucggccccgacuacgugaccggcagcaaccugcccagccacagcgacauccacaucagcugccugaccggccugaagauccagggccccguguucuuccuggaggacggcaagagcgccaucagccugaacgacgcccugaugugggccaaggugaaccccuucagcccccugggcaccggcaucagacugaaccccuucuaa

SEQ ID NO: 25624 - RNA, 4029 nt, Artificial Sequence
  WDR19__Homo_sapiens__NP_079408
augaagagaaucuucagccugcuggagaagaccuggcugggcgcccccauccaguucgccuggcagaagaccagcggcaacuaccuggccgugaccggcgccgacuacaucgugaagaucuucgacagacacggccagaagagaagcgagaucaaccugcccggcaacugcguggccauggacugggacaaggacggcgacgugcuggccgugaucgccgagaagagcagcugcaucuaccugugggacgccaacaccaacaagaccagccagcuggacaacggcaugagagaccagaugagcuuccugcuguggagcaaggugggcagcuuccuggccgugggcaccgugaagggcaaccugcugaucuacaaccaccagaccagcagaaagauccccgugcugggcaagcacaccaagagaaucaccugcggcugcuggaacgccgagaaccugcuggcccugggcggcgaggacaagaugaucaccgugagcaaccaggagggcgacaccaucagacagacccaggugagaagcgagcccagcaacaugcaguucuuccugaugaagauggacgacagaaccagcgccgccgagagcaugaucagcguggugcugggcaagaagacccuguucuuccugaaccugaacgagcccgacaaccccgccgaccuggaguuccagcaggacuucggcaacaucgugugcuacaacugguacggcgacggcagaaucaugaucggcuucagcugcggccacuucguggugaucagcacccacaccggcgagcugggccaggagaucuuccaggccagaaaccacaaggacaaccugaccagcaucgccgugagccagacccugaacaagguggccaccugcggcgacaacugcaucaagauccaggaccugguggaccugaaggacauguacgugauccugaaccuggacgaggagaacaagggccugggcacccugagcuggaccgacgacggccagcugcuggcccugagcacccagagaggcagccugcacguguuccugaccaagcugcccauccugggcgacgccugcagcaccagaaucgccuaccugaccagccugcuggaggugaccguggccaaccccguggagggcgagcugcccaucaccgugagcguggacguggagcccaacuucguggccgugggccuguaccaccuggccgugggcaugaacaacagagccugguucuacgugcugggcgagaacgccgugaagaagcugaaggacauggaguaccugggcaccguggccagcaucugccugcacagcgacuacgccgccgcccuguucgagggcaaggugcagcugcaccugaucgagagcgagauccuggacgcccaggaggagagagagaccagacuguuccccgccguggacgacaagugcagaauccugugccacgcccugaccagcgacuuccugaucuacggcaccgacaccggcguggugcaguacuucuacaucgaggacuggcaguucgugaacgacuacagacaccccgugagcgugaagaagaucuuccccgaccccaacggcaccagacugguguucaucgacgagaagagcgacggcuucguguacugccccgugaacgacgccaccuacgagauccccgacuucagccccaccaucaagggcgugcugugggagaacuggcccauggacaagggcguguucaucgccuacgacgacgacaagguguacaccuacguguuccacaaggacaccauccagggcgccaaggugauccuggccggcagcaccaaggugcccuucgcccacaagccccugcugcuguacaacggcgagcugaccugccagacccagagcggcaaggugaacaacaucuaccugagcacccacggcuuccugagcaaccugaaggacaccggccccgacgagcugagacccaugcuggcccagaaccugaugcugaagagauucagcgacgccugggagaugugcagaauccugaacgacgaggccgccuggaacgagcuggccagagccugccugcaccacauggagguggaguucgccaucagaguguacagaagaaucggcaacgugggcaucgugaugagccuggagcagaucaagggcaucgaggacuacaaccugcuggccggccaccuggccauguucaccaacgacuacaaccuggcccaggaccuguaccuggccagcagcugccccaucgccgcccuggagaugagaagagaccugcagcacugggacagcgcccugcagcuggccaagcaccuggcccccgaccagauccccuucaucagcaaggaguacgccauccagcuggaguucgccggcgacuacgugaacgcccuggcccacuacgagaagggcaucaccggcgacaacaaggagcacgacgaggccugccuggccggcguggcccagaugagcaucagaaugggcgacaucagaagaggcgugaaccaggcccugaagcaccccagcagagugcugaagagagacugcggcgccauccuggagaacaugaagcaguucagcgaggccgcccagcuguacgagaagggccuguacuacgacaaggccgccagcguguacaucagaagcaagaacugggccaaggugggcgaccugcugccccacgugagcagccccaagauccaccugcaguacgccaaggccaaggaggccgacggcagauacaaggaggccgugguggccuacgagaacgccaagcaguggcagagcgugaucagaaucuaccuggaccaccugaacaaccccgagaaggccgugaacaucgugagagagacccagagccuggacggcgccaagaugguggccagauucuuccugcagcugggcgacuacggcagcgccauccaguuccuggugaugagcaagugcaacaacgaggccuucacccuggcccagcagcacaacaagauggagaucuacgccgacaucaucggcagcgaggacaccaccaacgaggacuaccagagcaucgcccuguacuucgagggcgagaagagauaccugcaggccggcaaguucuuccugcugugcggccaguacagcagagcccugaagcacuuccugaagugccccagcagcgaggacaacguggccaucgagauggccaucgagaccgugggccaggccaaggacgagcugcugaccaaccagcugaucgaccaccugcugggcgagaacgacggcaugcccaaggacgccaaguaccuguucagacuguacauggcccugaagcaguacagagaggccgcccagaccgccaucaucaucgccagagaggagcagagcgccggcaacuacagaaacgcccacgacgugcuguucagcauguacgccgagcugaagagccagaagaucaagauccccagcgagauggccaccaaccugaugauccugcacagcuacauccuggugaagauccacgugaagaacggcgaccacaugaagggcgccagaaugcugaucagaguggccaacaacaucagcaaguuccccagccacaucgugcccauccugaccagcaccgugaucgagugccacagagccggccugaagaacagcgccuucagcuucgccgccaugcugaugagacccgaguacagaagcaagaucgacgccaaguacaagaagaagaucgagggcauggugagaagacccgacaucagcgagaucgaggaggccaccacccccugccccuucugcaaguuccugcugcccgagugcgagcugcugugccccggcugcaagaacagcauccccuacugcaucgccaccggcagacacaugcugaaggacgacuggaccgugugcccccacugcgacuuccccgcccuguacagcgagcugaagaucaugcugaacaccgagagcaccugccccaugugcagcgagagacugaacgccgcccagcugaagaagaucagcgacugcacccaguaccugagaaccgaggaggagcuguaa

SEQ ID NO: 25625 - RNA, 1401 nt, Artificial Sequence
  WDR1__Homo_sapiens__NP_005103
augcccuacgagaucaagaagguguucgccagccugccccagguggagagaggcgugagcaagaucaucggcggcgaccccaagggcaacaacuuccuguacaccaacggcaagugcgugauccugagaaacaucgacgaccacagcagauucgugaacugcgugagauucagccccgacggcaacagauucgccaccgccagcgccgacggccagaucuacaucuacgacggcaagaccggcgagaaggugugcgcccugggcggcagcaaggcccacgacggcggcaucuacgccaucagcuggagccccgacagcacccaccugcugagcgccagcggcgacaagaccagcaagaucugggacgugagcgugaacagcguggugagcaccuuccccaugggcagcaccgugcuggaccagcagcugggcugccuguggcagaaggaccaccugcugagcgugagccugagcggcuacaucaacuaccuggacagaaacaaccccagcaagccccugcacgugaucaagggccacagcaagagcauccagugccugaccgugcacaagaacggcggcaagagcuacaucuacagcggcagccacgacggccacaucaacuacugggacagcgagaccggcgagaacgacagcuucgccggcaagggccacaccaaccaggugagcagaaugaccguggacgagagcggccagcugaucagcugcagcauggacgacaccgugagauacaccagccugaugcugagagacuacagcggccagggcguggugaagcuggacgugcagcccaagugcguggccgugggccccggcggcuacgccgugguggugugcaucggccagaucgugcugcugaaggaccagagaaagugcuucagcaucgacaaccccggcuacgagcccgaggugguggccgugcaccccggcggcgacaccguggccaucggcggcguggacggcaacgugagacuguacagcauccugggcaccacccugaaggacgagggcaagcugcuggaggccaagggccccgugaccgacguggccuacagccacgacggcgccuuccuggccgugugcgacgccagcaagguggugaccguguucagcguggccgacggcuacagcgagaacaacguguucuacggccaccacgccaagaucgugugccuggccuggagccccgacaacgagcacuucgccagcggcggcauggacaugaugguguacguguggacccugagcgaccccgagaccagagugaagauccaggacgcccacagacugcaccacgugagcagccuggccuggcuggacgagcacacccuggugaccaccagccacgacgccagcgugaaggaguggaccaucaccuacuaa

SEQ ID NO: 25626 - RNA, 588 nt, Artificial Sequence
  WDR20__Homo_sapiens__NP_001229344
auggccaccgagggcggcggcaaggagaugaacgagaucaagacccaguucaccaccagagagggccuguacaagcugcugccccacagcgaguacagcagacccaacagagugcccuucaacagccagggcagcaaccccgugagagugagcuucgugaaccugaacgaccagagcggcaacggcgacagacugugcuucaacgugggcagagagcuguacuucuacaucuacaagggcgugagaaaggccgccgaccugagcaagcccaucgacaagagaaucuacaagggcacccagcccaccugccacgacuucaaccaccugaccgccaccgccgagagcgugagccugcuggugggcuucagcgccggccaggugcagcugaucgaccccaucaagaaggagaccagcaagcuguucaacgaggagaacagcugccagcaccuguggaagguggacuggaacgaggagagacagaacgagggcagcaagaccagcgaggaggcccuggugaccgugcagcccgccgagcacuucugcagacaggaggacagaaugcagggcgugcugcaggaccagaacuaa

SEQ ID NO: 25627 - RNA, 1938 nt, Artificial Sequence
  WDR26__Homo_sapiens__NP_001108585
augcaggccaacggcgccggcggcggcggcggcggcggcggcggcggcggcggcggcggcggcggcggcggcggccagggccagacccccgagcuggccugccugagcgcccagaacggcgagagcagccccagcagcagcagcagcgccggcgaccuggcccacgccaacggccugcugcccagcgcccccagcgccgccagcaacaacagcaacagccugaacgugaacaacggcgugcccggcggcgccgccgccgccagcagcgccaccguggccgccgccagcgccaccaccgccgccagcagcagccuggccacccccgagcugggcagcagccugaagaagaagaagagacugagccagagcgacgaggacgugaucagacugaucggccagcaccugaacggccugggccugaaccagaccguggaccugcugaugcaggagagcggcugcagacuggagcaccccagcgccaccaaguucagaaaccacgugauggagggcgacugggacaaggccgagaacgaccugaacgagcugaagccccuggugcacagcccccacgccaucgugagaaugaaguuccugcugcugcagcagaaguaccuggaguaccuggaggacggcaaggugcuggaggcccugcaggugcugagaugcgagcugaccccccugaaguacaacaccgagagaauccacgugcugagcggcuaccugaugugcagccacgccgaggaccugagagccaaggccgagugggagggcaagggcaccgccagcagaagcaagcugcuggacaagcugcagaccuaccugccccccagcgugaugcugccccccagaagacugcagacccugcugagacaggccguggagcugcagagagacagaugccuguaccacaacaccaagcuggacaacaaccuggacagcgugagccugcugaucgaccacgugugcagcagaagacaguuccccugcuacacccagcagauccugaccgagcacugcaacgaggugugguucugcaaguucagcaacgacggcaccaagcuggccaccggcagcaaggacaccaccgugaucaucuggcagguggaccccgacacccaccugcugaagcugcugaagacccuggagggccacgccuacggcgugagcuacaucgccuggagccccgacgacaacuaccugguggccugcggccccgacgacugcagcgagcuguggcuguggaacgugcagaccggcgagcugagaaccaagaugagccagagccacgaggacagccugaccagcguggccuggaaccccgacggcaagagauucgugaccggcggccagagaggccaguucuaccagugcgaccuggacggcaaccugcuggacagcugggagggcgugagagugcagugccuguggugccugagcgacggcaagaccgugcuggccagcgacacccaccagagaaucagaggcuacaacuucgaggaccugaccgacagaaacaucgugcaggaggaccaccccaucaugagcuucaccaucagcaagaacggcagacuggcccugcugaacguggccacccagggcgugcaccugugggaccugcaggacagagugcuggugagaaaguaccagggcgugacccagggcuucuacaccauccacagcugcuucggcggccacaacgaggacuucaucgccagcggcagcgaggaccacaagguguacaucuggcacaagagaagcgagcugcccaucgccgagcugaccggccacaccagaaccgugaacugcgugagcuggaacccccagauccccagcaugauggccagcgccagcgacgacggcaccgugagaaucuggggccccgcccccuucaucgaccaccagaacaucgaggaggagugcagcagcauggacagcuaa

SEQ ID NO: 25628 - RNA, 1104 nt, Artificial Sequence
  WDR31__Homo_sapiens__NP_001012361
augcugcugcugagaugccagcugaagcaggcccccccccagaaggugagcuucagauucugcguggugaugggcaagcagcagagcaagcugaagcacagcaccuacaaguacggcagacccgacgagaucaucgaggagagaauccagaccaaggccuuccaggaguacagccccgcccacauggacaccgugagcgugguggccgcccugaacagcgaccugugcgugagcggcggcaaggacaagaccgugguggccuacaacuggaagaccggcaacguggugaagagauucaagggccacgagcacgagaucaccaagguggccugcauccccaagagcagccaguucuucagcgccagcagagacagaauggugaugaugugggaccugcacggcagcagccagcccagacagcagcugugcggccacgccaugguggugaccggccuggccgugagccccgacagcagccagcugugcaccggcagcagagacaacacccugcugcugugggacguggugaccggccagagcguggagagagccagcgugagcagaaacguggugacccaccugugcugggugcccagagagcccuacauccugcagaccagcgaggacaagacccugagacugugggacagcagaggccugcagguggcccacauguuccccgccaagcagcacauccagaccuacugcgaggugagcguggacggccacaagugcaucagcugcagcaacggcuucggcggcgagggcugcgaggccacccugugggaccugagacagaccagaaacagaaucugcgaguacaagggccacuuccagaccguggccagcugcguguuccugcccagagcccuggcccugaugccccugaucgccaccagcagccacgacugcaaggugaagaucuggaaccaggacaccggcgccugccuguucacccugagccuggacggcagcggcccccugaccagccuggccgugggcgacgccaucagccugcugugcgccagcuucaacagaggcauccaccugcugagaauggaccacagccagggccuggagcugcaggagguggccgccuucuaa

SEQ ID NO: 25629 - RNA, 1611 nt, Artificial Sequence
  WDR34__Homo_sapiens__NP_443076
auggccaccagagcccagcccggcccccugagccaggccggcagcgccggcguggccgcccuggccaccgugggcguggccagcggccccggccccggcagacccggcccccugcaggacgagacccugggcguggccagcgugcccagccaguggagagccgugcagggcaucagaugggagaccaagagcugccagaccgccagcaucgccaccgccagcgccagcgcccaggccagaaaccacguggacgcccaggugcagaccgaggcccccgugcccgugagcgugcagccccccagccaguacgacauccccagacuggccgccuuccugagaagaguggaggccauggugaucagagagcugaacaagaacuggcagagccacgccuucgacggcuucgaggugaacuggaccgagcagcagcagauggugagcugccuguacacccugggcuacccccccgcccaggcccagggccugcacgugaccagcaucagcuggaacagcaccggcagcgugguggccugcgccuacggcagacuggaccacggcgacuggagcacccugaagagcuucgugugcgccuggaaccuggacagaagagaccugagaccccagcagcccagcgccgugguggaggugcccagcgccgugcugugccuggccuuccaccccacccagcccagccacguggccggcggccuguacagcggcgaggugcuggugugggaccugagcagacuggaggacccccugcuguggagaaccggccugaccgacgacacccacaccgaccccgugagccaggugguguggcugcccgagcccggccacagccacagauuccaggugcugagcguggccaccgacggcaaggugcugcuguggcagggcaucggcgugggccagcugcagcugaccgagggcuucgcccuggugaugcagcagcugcccagaagcaccaagcugaagaagcaccccagaggcgagaccgaggugggcgccaccgccguggccuucagcagcuucgaccccagacuguucauccugggcaccgagggcggcuucccccugaagugcagccuggccgccggcgaggccgcccugaccagaaugcccagcagcgugccccugagagcccccgcccaguucaccuucagcccccacggcggccccaucuacagcgugagcugcagccccuuccacagaaaccuguuccugagcgccggcaccgacggccacgugcaccuguacagcaugcugcaggcccccccccugaccagccugcagcugagccugaaguaccuguucgccgugagauggagccccgugagaccccugguguucgccgccgccagcggcaagggcgacgugcagcuguucgaccugcagaagagcagccagaagcccaccgugcugaucaagcagacccaggacgagagccccguguacugccuggaguucaacagccagcagacccagcugcuggccgccggcgacgcccagggcaccgugaagguguggcagcugagcaccgaguucaccgagcagggccccagagaggccgaggaccuggacugccuggccgccgagguggccgccuaa

SEQ ID NO: 25630 - RNA, 3546 nt, Artificial Sequence
  WDR35__Homo_sapiens__NP_001006658
auguucuucuaccugagcaagaagaucagcauccccaacaacgugaagcugcagugcgugagcuggaacaaggagcagggcuucaucgccugcggcggcgaggacggccugcugaaggugcugaagcuggagacccagaccgacgacgccaagcugagaggccuggccgcccccagcaaccugagcaugaaccagacccuggagggccacagcggcagcgugcagguggugaccuggaacgagcaguaccagaagcugaccaccagcgacgagaacggccugaucaucguguggaugcuguacaagggcagcuggaucgaggagaugaucaacaacagaaacaagagcguggugagaagcaugagcuggaacgccgacggccagaagaucugcaucguguacgaggacggcgccgugaucgugggcagcguggacggcaacagaaucuggggcaaggaccugaagggcauccagcugagccacgugaccuggagcgccgacagcaaggugcugcuguucggcauggccaacggcgagauccacaucuacgacaaccagggcaacuucaugaucaagaugaagcugagcugccuggugaacgugaccggcgccaucagcaucgccggcauccacugguaccacggcaccgagggcuacguggagcccgacugccccugccuggccgugugcuucgacaacggcagaugccagaucaugagacacgagaacgaccagaaccccgugcugaucgacaccggcauguacguggugggcauccaguggaaccacaugggcagcgugcuggccguggccggcuuccagaaggccgccaugcaggacaaggacgugaacaucgugcaguucuacacccccuucggcgagcaccugggcacccugaaggugcccggcaaggagaucagcgcccugagcugggagggcggcggccugaagaucgcccuggccguggacagcuucaucuacuucgccaacaucagacccaacuacaaguggggcuacugcagcaacaccgugguguacgccuacaccagacccgacagacccgaguacugcgugguguucugggacaccaagaacaacgagaaguacgugaaguacgugaagggccugaucagcaucaccaccugcggcgacuucugcauccuggccaccaaggccgacgagaaccacccccaggaggagaacgagauggagaccuucggcgccaccuucgugcuggugcugugcaacagcaucggcaccccccuggaccccaaguacaucgacaucgugccccuguucguggccaugaccaagacccacgugaucgccgccagcaaggaggccuucuacaccuggcaguacagaguggccaagaagcugaccgcccuggagaucaaccagaucaccagaagcagaaaggagggcagagagagaaucuaccacguggacgacacccccagcggcagcauggacggcgugcuggacuacagcaagaccauccagggcaccagagaccccaucugcgccaucaccgccagcgacaagauccugaucgugggcagagagagcggcaccauccagagauacagccugcccaacgugggccugauccagaaguacagccugaacugcagagccuaccagcugagccugaacugcaacagcagcagacuggccaucaucgacaucagcggcgugcugaccuucuucgaccuggacgccagagugaccgacagcaccggccagcagguggugggcgagcugcugaagcuggagagaagagacgugugggacaugaagugggccaaggacaaccccgaccuguucgccaugauggagaagaccagaauguacguguucagaaaccuggaccccgaggagcccauccagaccagcggcuacaucugcaacuucgaggaccuggagaucaagagcgugcugcuggacgagauccugaaggaccccgagcaccccaacaaggacuaccugaucaacuucgagaucagaagccugagagacagcagagcccugaucgagaaggugggcaucaaggacgccagccaguucaucgaggacaacccccaccccagacuguggagacugcuggccgaggccgcccugcagaagcuggaccuguacaccgccgagcaggccuucgugagaugcaaggacuaccagggcaucaaguucgugaagagacugggcaagcugcugagcgagagcaugaagcaggccgagguggugggcuacuucggcagauucgaggaggccgagagaaccuaccuggagauggacagaagagaccuggccaucggccugagacugaagcugggcgacugguucagagugcugcagcugcugaagaccggcagcggcgacgccgacgacagccugcuggagcaggccaacaacgccaucggcgacuacuucgccgacagacagaaguggcugaacgccgugcaguacuacgugcagggcagaaaccaggagagacuggccgagugcuacuacaugcuggaggacuacgagggccuggagaaccuggccaucagccugcccgagaaccacaagcugcugcccgagaucgcccagauguucgugagagugggcaugugcgagcaggccgugaccgccuuccugaagugcagccagcccaaggccgccguggacaccugcgugcaccugaaccaguggaacaaggccguggagcuggccaagaaccacagcaugaaggagaucggcagccugcuggccagauacgccagccaccugcuggagaagaacaagacccuggacgccaucgagcuguacagaaaggccaacuacuucuucgacgccgccaagcugauguucaagaucgccgacgaggaggccaagaagggcagcaagccccugagagugaagaagcuguacgugcugagcgcccugcugaucgagcaguaccacgagcagaugaagaacgcccagagaggcaaggugaagggcaagagcagcgaggccaccagcgcccuggccggccugcuggaggaggaggugcugagcaccaccgacagauucaccgacaacgccuggagaggcgccgaggccuaccacuucuucauccuggcccagagacagcuguacgagggcugcguggacaccgcccugaagaccgcccugcaccugaaggacuacgaggacaucaucccccccguggagaucuacagccugcuggcccugugcgccugcgccagcagagccuucggcaccugcagcaaggccuucaucaagcugaagagccuggagacccugagcagcgagcagaagcagcaguacgaggaccuggcccuggagaucuucaccaagcacaccagcaaggacaacagaaagcccgagcuggacagccugauggagggcggcgagggcaagcugcccaccugcguggccaccggcagccccaucaccgaguaccaguucuggaugugcagcgugugcaagcacggcgugcuggcccaggagaucagccacuacagcuucugcccccugugccacagccccgugggcuaa

SEQ ID NO: 25631 - RNA, 2856 nt, Artificial Sequence
  WDR36__Homo_sapiens__NP_644810
augugcugcaccgagggcagccugagaaagagagacagccagagagcccccgaggccgugcugugccugcagcuguggcagagaaccgugccccuggacacccugaagggccugggcaccugcuuccccagcggccccgagcugagaggcgccggcaucgccgccgccauggagagagccagcgagagaagaaccgccagcgcccuguucgccggcuucagagcccugggccuguucagcaacgacaucccccacguggugagauucagcgcccugaagagaagauucuacgugaccaccugcgugggcaagagcuuccacaccuacgacgugcagaagcugagccugguggccgugagcaacagcgugccccaggacaucugcugcauggccgccgacggcagacugguguucgccgccuacggcaacguguucagcgccuucgccagaaacaaggagaucgugcacaccuucaagggccacaaggccgagauccacuuccugcagcccuucggcgaccacaucaucagcguggacaccgacggcauccugaucaucuggcacaucuacagcgaggaggaguaccugcagcugaccuucgacaagagcguguucaagaucagcgccauccugcaccccagcaccuaccugaacaagauccugcugggcagcgagcagggcagccugcagcuguggaacgugaagagcaacaagcugcuguacaccuuccccggcuggaaggugggcgugaccgcccugcagcaggcccccgccguggacgugguggccaucggccugaugagcggccaggugaucauccacaacaucaaguucaacgagacccugaugaaguucagacaggacuggggccccaucaccagcaucagcuucagaaccgacggccaccccgugauggccgccggcagccccugcggccacaucggccugugggaccuggaggacaagaagcugaucaaccagaugagaaacgcccacagcaccgccaucgccggccugaccuuccugcacagagagccccugcuggugaccaacggcgccgacaacgcccugagaaucuggaucuucgacggccccaccggcgagggcagacugcugagauucagaaugggccacagcgccccccugaccaacaucagauacuacggccagaacggccagcagauccugagcgccagccaggacggcacccugcagagcuucagcaccgugcacgagaaguucaacaagagccugggccacggccugaucaacaagaagagagugaagagaaagggccugcagaacaccaugagcgugagacugccccccaucaccaaguucgccgccgaggaggccagagagagcgacugggacggcaucaucgccugccaccagggcaagcugagcugcagcaccuggaacuaccagaagagcaccaucggcgccuacuuccugaagcccaaggagcugaagaaggacgacaucaccgccaccgccguggacaucaccagcugcggcaacuucgccgugaucggccugagcagcggcaccguggacguguacaacaugcagagcggcauccacagaggcagcuucggcaaggaccaggcccacaagggcagcgugagaggcguggccguggacggccugaaccagcugaccgugaccaccggcagcgagggccugcugaaguucuggaacuucaagaacaagauccugauccacagcgugagccugagcagcagccccaacaucaugcugcugcacagagacagcggcauccugggccuggcccuggacgacuucagcaucagcgugcuggacaucgagaccagaaagaucgugagagaguucagcggccaccagggccagaucaacgacauggccuucagccccgacggcagauggcugaucagcgccgccauggacugcagcaucagaaccugggaccugcccagcggcugccugaucgacugcuuccugcuggacagcgccccccugaacgugagcaugagccccaccggcgacuuccuggccaccagccacguggaccaccugggcaucuaccuguggagcaacaucagccuguacagcguggugagccugagaccccugcccgccgacuacgugcccagcaucgugaugcugcccggcaccugccagacccaggacguggaggugagcgaggagaccguggagcccagcgacgagcugaucgaguacgacagccccgagcagcugaacgagcagcuggugacccugagccugcugcccgagagcagauggaagaaccugcugaaccuggacgugaucaagaagaagaacaagcccaaggagccccccaaggugcccaagagcgcccccuucuucauccccaccauccccggccuggugcccagauacgccgcccccgagcagaacaacgacccccagcagagcaagguggugaaccugggcgugcuggcccagaagagcgacuucugccugaagcuggaggagggccuggugaacaacaaguacgacaccgcccugaaccugcugaaggagagcggccccagcggcaucgagaccgagcugagaagccugagccccgacugcggcggcagcaucgaggugaugcagagcuuccugaagaugaucggcaugaugcuggacagaaagagagacuucgagcuggcccaggccuaccuggcccuguuccugaagcugcaccugaagaugcugcccagcgagcccgugcugcuggaggagaucaccaaccugagcagccagguggaggagaacuggacccaccugcagagccuguucaaccagagcaugugcauccugaacuaccugaagagcgcccugcuguaa

SEQ ID NO: 25632 - RNA, 1485 nt, Artificial Sequence
  WDR37__Homo_sapiens__NP_054742
augcccaccgagagcgccagcugcagcaccgccagacagaccaagcagaagagaaagagccacagccugagcaucagaagaaccaacagcagcgagcaggagagaaccggccugcccagagacaugcuggagggccaggacagcaagcugcccagcagcgugagaagcacccugcuggagcuguucggccagaucgagagagaguucgagaaccuguacaucgagaaccuggagcugagaagagagaucgacacccugaacgagagacuggccgccgagggccaggccaucgacggcgccgagcugagcaagggccagcugaagaccaaggccagccacagcaccagccagcugagccagaagcugaagaccaccuacaaggccagcaccagcaagaucgugagcagcuucaagaccaccaccagcagagccgccugccagcuggugaaggaguacaucggccacagagacggcaucugggacgugagcguggccaagacccagcccguggugcugggcaccgccagcgccgaccacaccgcccugcuguggagcaucgagaccggcaagugccuggugaaguacgccggccacgugggcagcgugaacagcaucaaguuccaccccagcgagcagcuggcccugaccgccagcggcgaccagaccgcccacaucuggagauacgccgugcagcugcccaccccccagcccguggccgacaccagcaucagcggcgaggacgagguggagugcagcgacaaggacgagcccgaccuggacggcgacgugagcagcgacugccccaccaucagagugccccugaccagccugaagagccaccagggcguggugaucgccagcgacuggcuggugggcggcaagcaggccgugaccgccagcugggacagaaccgccaaccuguacgacguggagaccagcgagcuggugcacagccugaccggccacgaccaggagcugacccacugcugcacccaccccacccagagacugguggugaccagcagcagagacaccaccuucagacugugggacuucagagaccccagcauccacagcgugaacguguuccagggccacaccgacaccgugaccagcgccguguucaccgugggcgacaacguggugagcggcagcgacgacagaaccgugaaggugugggaccugaagaacaugagaagccccaucgccaccaucagaaccgacagcgccaucaacagaaucaacgugugcgugggccagaagaucaucgcccugccccacgacaacagacaggugagacuguucgacaugagcggcgugagacuggccagacugcccagaagcagcagacagggccacagaagaauggugugcugcagcgccuggagcgaggaccaccccgugugcaaccuguucaccugcggcuucgacagacaggccaucggcuggaacaucaacauccccgcccugcugcaggagaaguaa

SEQ ID NO: 25633 - RNA, 2034 nt, Artificial Sequence
  WDR43__Homo_sapiens__NP_055946
auggccgccggcggcggcggcagcugcgacccccuggcccccgccggcgugcccugcgccuucagcccccacagccaggccuacuucgcccuggccagcaccgacggccaccugagagugugggagaccgccaacaacagacugcaccaggaguacgugcccagcgcccaccugagcggcaccugcaccugccuggccugggcccccgccagacugcaggccaaggagagcccccagagaaagaagagaaagagcgaggccgugggcaugagcaaccagaccgaccugcuggcccugggcaccgccgugggcagcauccugcuguacagcaccgugaagggcgagcugcacagcaagcugaucagcggcggccacgacaacagagugaacugcauccaguggcaccaggacagcggcugccuguacagcugcagcgacgacaagcacaucguggaguggaacgugcagaccugcaaggugaagugcaaguggaagggcgacaacagcagcgugagcagccugugcaucagccccgacggcaagaugcugcugagcgccggcagaaccaucaagcugugggugcuggagaccaaggagguguacagacacuucaccggccacgccacccccgugagcagccugauguucaccaccaucagaccccccaacgagagccagcccuucgacggcaucaccggccuguacuuccugagcggcgccgugcacgacagacugcugaacguguggcaggugagaagcgagaacaaggagaagagcgccgugaugagcuucaccgugaccgacgagcccguguacaucgaccugacccugagcgagaacaaggaggagcccgugaagcuggccguggugugcagagacggccaggugcaccuguucgagcacauccugaacggcuacugcaagaagccccugaccagcaacugcaccauccagaucgccacccccggcaagggcaagaagagcacccccaagcccauccccauccuggccgccggcuucugcagcgacaagaugagccugcugcugguguacggcagcugguuccagcccaccaucgagagaguggcccugaacagcagagagccccacaugugccuggugagagacaucagcaacugcugggcccccaagguggagaccgccaucaccaaggugagaacccccgugaugaacagcgaggccaaggugcuggugcccggcauccccggccaccacgccgccaucaagcccgcccccccccagaccgagcagguggagagcaagagaaagagcggcggcaacgaggugagcaucgaggagagacugggcgccauggacaucgacacccacaagaagggcaaggaggaccugcagaccaacagcuuccccgugcugcugacccagggccuggagagcaacgacuucgagaugcugaacaaggugcugcagaccagaaacgugaaccugaucaagaagaccgugcugagaaugccccugcacaccaucaucccccugcugcaggagcugaccaagagacugcagggccaccccaacagcgccgugcugauggugcaguggcugaagugcgugcugaccgugcacgccagcuaccugagcacccugcccgaccuggugccccagcugggcacccuguaccagcugauggagagcagagugaagaccuuccagaagcugagccaccugcacggcaagcugauccugcugaucacccaggugaccgccagcgagaagaccaagggcgccaccagccccggccagaaggccaagcugguguacgaggaggagagcagcgaggaggagagcgacgacgagaucgccgacaaggacagcgaggacaacugggacgaggacgaggaggagagcgagagcgagaaggacgaggacguggaggaggaggacgaggacgccgagggcaaggacgaggagaacggcgaggacagagacaccgccagcgagaaggagcugaacggcgacagcgaccuggaccccgagaacgagagcgaggaggaguaa

SEQ ID NO: 25634 - RNA, 1035 nt, Artificial Sequence
  WDR45B__Homo_sapiens__NP_062559
augaaccugcugcccugcaacccccacggcaacggccugcuguacgccggcuucaaccaggaccacggcugcuucgccugcggcauggagaacggcuucagaguguacaacaccgacccccugaaggagaaggagaagcaggaguuccuggagggcggcgugggccacguggagaugcuguucagaugcaacuaccuggcccuggugggcggcggcaagaagcccaaguacccccccaacaaggugaugaucugggacgaccugaagaagaagaccgugaucgagaucgaguucagcaccgaggugaaggccgugaagcugagaagagacagaaucgugguggugcuggacagcaugaucaagguguucaccuucacccacaacccccaccagcugcacguguucgagaccugcuacaaccccaagggccugugcgugcugugccccaacagcaacaacagccugcuggccuuccccggcacccacaccggccacgugcagcugguggaccuggccagcaccgagaagccccccguggacauccccgcccacgagggcgugcugagcugcaucgcccugaaccugcagggcaccagaaucgccaccgccagcgagaagggcacccugaucagaaucuucgacaccagcagcggccaccugauccaggagcugagaagaggcagccaggccgccaacaucuacugcaucaacuucaaccaggacgccagccugaucugcgugagcagcgaccacggcaccgugcacaucuucgccgccgaggaccccaagagaaacaagcagagcagccuggccagcgccagcuuccugcccaaguacuucagcagcaaguggagcuucagcaaguuccaggugcccagcggcagccccugcaucugcgccuucggcaccgagcccaacgccgugaucgccaucugcgccgacggcagcuacuacaaguuccuguucaaccccaagggcgagugcaucagagacguguacgcccaguuccuggagaugaccgacgacaagcuguaa

SEQ ID NO: 25635 - RNA, 1083 nt, Artificial Sequence
  WDR45__Homo_sapiens__NP_001025067
augacccagcagccccugagaggcgugaccagccugagauucaaccaggaccagagcugcuucugcugcgccauggagaccggcgugagaaucuacaacguggagccccugauggagaagggccaccuggaccacgagcaggugggcagcaugggccugguggagaugcugcacagaagcaaccugcuggcccuggugggcggcggcagcagccccaaguucagcgagaucagcgugcugaucugggacgacgccagagagggcaaggacagcaaggagaagcuggugcuggaguucaccuucaccaagcccgugcugagcgugagaaugagacacgacaagaucgugaucgugcugaagaacagaaucuacguguacagcuuccccgacaaccccagaaagcuguucgaguucgacaccagagacaaccccaagggccugugcgaccugugccccagccuggagaagcagcugcugguguuccccggccacaagugcggcagccugcagcugguggaccuggccagcaccaagcccggcaccagcagcgcccccuucaccaucaacgcccaccagagcgacaucgccugcgugagccugaaccagcccggcaccgugguggccagcgccagccagaagggcacccugaucagacuguucgacacccagagcaaggagaagcugguggagcugagaagaggcaccgaccccgccacccuguacugcaucaacuucagccacgacagcagcuuccugugcgccagcagcgacaagggcaccgugcacaucuucgcccugaaggacaccagacugaacagaagaagcgcccuggccagagugggcaaggugggccccaugaucggccaguacguggacagccaguggagccuggccagcuucaccgugcccgccgagagcgccugcaucugcgccuucggcagaaacaccagcaagaacgugaacagcgugaucgccaucugcguggacggcaccuuccacaaguacguguucacccccgacggcaacugcaacagagaggccuucgacguguaccuggacaucugcgacgacgacgacuucuaa

SEQ ID NO: 25636 - RNA, 1833 nt, Artificial Sequence
  WDR46__Homo_sapiens__NP_005443
auggagaccgcccccaagcccggcaaggacgugccccccaagaaggacaagcugcagaccaagagaaagaagcccagaagauacugggaggaggagaccgugcccaccaccgccggcgccagccccggcccccccagaaacaagaagaacagagagcugagaccccagagacccaagaacgccuacauccugaagaagagcagaaucagcaagaagccccaggugcccaagaagcccagagaguggaagaaccccgagagccagagaggccugagcggcacccaggaccccuuccccggccccgcccccgugcccguggagguggugcagaaguucugcagaaucgacaagagcagaaagcugccccacagcaaggccaagaccagaagcagacuggagguggccgaggccgaggaggaggagaccagcaucaaggccgccagaagcgagcugcugcuggccgaggagcccggcuuccuggagggcgaggacggcgaggacaccgccaagaucugccaggccgacaucguggaggccguggacaucgccagcgccgccaagcacuucgaccugaaccugagacaguucggccccuacagacugaacuacagcagaaccggcagacaccuggccuucggcggcagaagaggccacguggccgcccuggacugggugaccaagaagcugaugugcgagaucaacgugauggaggccgugagagacaucagauuccugcacagcgaggcccugcuggccguggcccagaacagauggcugcacaucuacgacaaccagggcaucgagcugcacugcaucagaagaugcgacagagugaccagacuggaguuccugcccuuccacuuccugcuggccaccgccagcgagaccggcuuccugaccuaccuggacgugagcgugggcaagaucguggccgcccugaacgccagagccggcagacuggacgugaugagccagaaccccuacaacgccgugauccaccugggccacagcaacggcaccgugagccuguggagccccgccaugaaggagccccuggccaagauccugugccacagaggcggcgugagagccguggccguggacagcaccggcaccuacauggccaccagcggccuggaccaccagcugaagaucuucgaccugagaggcaccuaccagccccugagcaccagaacccugccccacggcgccggccaccuggccuucagccagagaggccugcugguggccggcaugggcgacguggugaacaucugggccggccagggcaaggccagcccccccagccuggagcagcccuaccugacccacagacugagcggccccgugcacggccugcaguucugccccuucgaggacgugcugggcgugggccacaccggcggcaucaccagcaugcuggugcccggcgccggcgagcccaacuucgacggccuggagagcaaccccuacagaagcagaaagcagagacaggagugggaggugaaggcccugcuggagaaggugcccgccgagcugaucugccuggaccccagagcccuggccgagguggacgugaucagccuggagcagggcaagaaggagcagaucgagagacugggcuacgacccccaggccaaggcccccuuccagcccaagcccaagcagaagggcagaagcagcaccgccagccuggugaagagaaagagaaaggugauggacgaggagcacagagacaaggugagacagagccugcagcagcagcaccacaaggaggccaaggccaagcccaccggcgccagacccagcgcccuggacagauucgugagauaa

SEQ ID NO: 25637 - RNA, 1788 nt, Artificial Sequence
  WDR48__Homo_sapiens__NP_001290331
auggagugccagagcgcccaggugaucagcgccagcagcgacaccaccgugaagguguggaacgcccacaagggcuucugcaugagcacccugagaacccacaaggacuacgugaaggcccuggccuacgccaaggacaaggagcugguggccagcgccggccuggacagacagaucuuccugugggacgugaacacccugaccgcccugaccgccagcaacaacaccgugaccaccagcagccugagcggcaacaaggacagcaucuacagccuggccaugaaccagcugggcaccaucaucgugagcggcagcaccgagaaggugcugagagugugggaccccagaaccugcgccaagcugaugaagcugaagggccacaccgacaacgugaaggcccugcugcugaacagagacggcacccagugccugagcggcagcagcgacggcaccaucagacuguggagccugggccagcagagaugcaucgccaccuacagagugcacgacgagggcgugugggcccugcaggugaacgacgccuucacccacguguacagcggcggcagagacagaaagaucuacugcaccgaccugagaaaccccgacaucagagugcugaucugcgaggagaaggcccccgugcugaagauggagcuggacagaagcgccgaccccccccccgccaucuggguggccaccaccaagagcaccgugaacaaguggacccugaagggcauccacaacuucagagccagcggcgacuacgacaacgacugcaccaaccccaucaccccccugugcacccagcccgaccaggugaucaagggcggcgccagcaucauccagugccacauccugaacgacaagagacacauccugaccaaggacaccaacaacaacguggccuacugggacgugcugaaggccugcaagguggaggaccugggcaagguggacuucgaggacgagaucaagaagagauucaagaugguguacgugcccaacugguucagcguggaccugaagaccggcaugcugaccaucacccuggacgagagcgacugcuucgccgccugggugagcgccaaggacgccggcuucagcagccccgacggcagcgaccccaagcugaaccugggcggccugcugcugcaggcccugcuggaguacuggcccagaacccacgugaaccccauggacgaggaggagaacgaggugaaccacgugaacggcgagcaggagaacagagugcagaagggcaacggcuacuuccaggugcccccccacacccccgugaucuucggcgaggccggcggcagaacccuguucagacugcugugcagagacagcggcggcgagaccgagagcaugcugcugaacgagaccgugccccagugggugaucgacaucaccguggacaagaacaugcccaaguucaacaagauccccuucuaccugcagccccacgccagcagcggcgccaagacccugaagaaggacagacugagcgccagcgacaugcugcaggugagaaaggugauggagcacguguacgagaagaucaucaaccuggacaacgagagccagaccaccagcagcagcaacaacgagaagcccggcgagcaggagaaggaggaggacaucgccgugcuggccgaggagaagaucgagcugcugugccaggaccaggugcuggaccccaacauggaccugagaaccgugaagcacuucaucuggaagagcggcggcgaccugacccugcacuacagacagaagagcaccuaa

SEQ ID NO: 25638 - RNA, 2094 nt, Artificial Sequence
  WDR49__Homo_sapiens__NP_849146
auggccuggagagagaagagcaagaagagacugaacaugaccagcuucaacaucgcccagggcauccacgccuucgacuaccacagcagacugaaccugaucgccaccgccggcaucaacaacaaggugugccuguggaaccccuacguggugagcaagcccgugggcgugcuguggggccacagcgccagcgugaucgccgugcaguucuucguggagagaaagcagcuguucagcuucagcaaggacaaggugcugagacugugggacauccagcaccagcugagcauccagagaaucgccugcagcuuccccaagagccaggacuucagaugccuguuccacuucgacgaggcccacggcagacuguucaucagcuucaacaaccagcuggcccugcuggccaugaagagcgaggccagcaagagagugaagagccacgagaaggccgugaccugcgugcuguacaacagcauccugaagcaggugaucagcagcgacaccggcagcaccgugagcuucuggaugaucgacaccggccagaagaucaagcaguucaccggcugccacggcaacgccgagaucagcaccauggcccuggacgccaacgagaccagacugcugaccggcagcaccgacggcaccgugaagaucugggacuucaacggcuacugccaccacacccugaacgugggccaggacggcgccguggacaucagccagauccugauccugaagaagaagauccuggugaccggcugggagagagccaucaccguguucagaccccagaacuucaaccaguucuucauccagcccgaggaguggaagggcggcauccagcaccacgacgacauccugugcgccgccuuccugcccccccagacccuggugaccggcagcuacgacggcgagaucgugcuguggaacaacagcaccgagaacgcccaccacgugcugcaccccgacuaccagagacugcugaagagcaagcuggacaccaagccccagaagcugcugagcgccggcagaagccagcccagccaccccauggccgaccacagcaccaccggcgugagaaacuucgagaucgacaccgagggcaagaacgccgugaugagacugugcuuccugaaggccagaaagaacaccgccgugaccggcggcgccaaccuggugagcugcggcggcagcggcuacgugagauucugggacaucuacaagaagcagcugcuggccgaguuccuggcccacagcggcgugggcagcaucaucaugagcaccgacaagaugaacagauaccugaccaccggcgaccuggacggcuggcugaagaucuggaacaucgaggaguacugccugaacagcagcaagaacaagaucaccaaggcccccacccugaucagaagcuuccagccccacgaggacagaaucagcagccuggagaugugcgagcccggcggccagcugcugaucaucagcagcagcgccgacugcagcaucugcgugaccggcgugugcaacgcccccguguggaucuucggccaggccaagcacuggcacaucgagaacugccuguuccugcccaagagagacaccaaccugguggagagcgagauccagaaggagaucagccuguucagcaaggaggagagcugccuggaccccaccgagcacagccugcugaacaagaagaacaaggacgacagcaccuacaacgugagacccagcgaggacaucaaccuggacaucaaguacaaggagagaagcaccugcaugaaggagacccagaagcccuacuacggcgaggugaucaagaagagcuucagcaccuucagaagccugaacaucggcgcccuggaggagcugcccgaggugaacaagcccgccuuccugcuggaccccgagaaguacuucagaaaggagcccgaggaggagagaccccagauccuggaggcccccagccuguucaagacccugaaggccguguucgacgagaagaaccuguuccccaaggagauccugcaccacgagagaaaggccaagcagcugugccaggagaagagcugcgaggugaagaagaacaagaaguaa

SEQ ID NO: 25639 - RNA, 1239 nt, Artificial Sequence
  WDR4__Homo_sapiens__NP_387510
auggccggcagcgugggccuggcccugugcggccagacccugguggugagaggcggcagcagauuccuggccaccagcaucgccagcagcgacgacgacagccuguucaucuacgacugcagcgccgccgagaagaagagccaggagaacaagggcgaggacgccccccuggaccagggcagcggcgccauccuggccagcaccuucagcaagagcggcagcuacuucgcccugaccgacgacagcaagagacugauccuguucagaaccaagcccuggcagugccugagcgugagaaccguggccagaagaugcaccgcccugaccuucaucgccagcgaggagaaggugcugguggccgacaagagcggcgacguguacagcuucagcgugcuggagccccacggcugcggcagacuggagcugggccaccugagcaugcugcuggacguggccgugagccccgacgacagauucauccugaccgccgacagagacgagaagaucagagugagcugggccgccgccccccacagcaucgagagcuucugccugggccacaccgaguucgugagcagaaucagcguggugcccacccagcccggccugcugcugagcagcagcggcgacggcacccugagacugugggaguacagaagcggcagacagcugcacugcugccaccuggccagccugcaggagcugguggacccccaggccccccagaaguucgccgccagcagaaucgccuucuggugccaggagaacugcguggcccugcugugcgacggcacccccgugguguacaucuuccagcuggacgccagaagacagcagcugguguacagacagcagcuggccuuccagcaccaggugugggacguggccuucgaggagacccagggccugugggugcugcaggacugccaggaggccccccuggugcuguacagacccgugggcgaccaguggcagagcgugcccgagagcaccgugcugaagaaggugagcggcgugcugagaggcaacugggccaugcuggagggcagcgccggcgccgacgccagcuucagcagccuguacaaggccaccuucgacaacgugaccagcuaccugaagaagaaggaggagagacugcagcagcagcuggagaagaagcagagaagaagaagccccccccccggccccgacggccacgccaagaagaugagacccggcgaggccacccugagcugcuaa

SEQ ID NO: 25640 - RNA, 1152 nt, Artificial Sequence
  WDR55__Homo_sapiens__XP_005268526
auggacagaaccugcgaggagagacccgccgaggacggcagcgacgaggaggaccccgacagcauggaggcccccaccagaaucagagacacccccgaggacaucgugcuggaggcccccgccagcggccuggccuuccaccccgccagagaccugcuggccgccggcgacguggacggcgacguguucguguucagcuacagcugccaggagggcgagaccaaggagcuguggagcagcggccaccaccugaaggccugcagagccguggccuucagcgaggacggccagaagcugaucaccgugagcaaggacaaggccauccacgugcuggacguggagcagggccagcuggagagaagagugagcaaggcccacggcgcccccaucaacagccugcugcugguggacgagaacgugcuggccaccggcgacgacaccggcggcaucugccugugggaccagagaaaggagggcccccugauggacaugagacagcacgaggaguacaucgccgacauggcccuggaccccgccaagaagcugcugcugaccgccagcggcgacggcugccugggcaucuucaacaucaagagaagaagauucgagcugcugagcgagccccagagcggcgaccugaccagcgugacccugaugaaguggggcaagaagguggccugcggcagcagcgagggcaccaucuaccuguucaacuggaacggcuucggcgccaccagcgacagauucgcccugagagccgagagcaucgacugcauggugcccgugaccgagagccugcugugcaccggcagcaccgacggcgugaucagagccgugaacauccugcccaacagaguggugggcagcgugggccagcacaccggcgagcccguggaggagcuggcccugagccacugcggcagauuccuggccagcagcggccacgaccagagacugaaguucugggacauggcccagcugagagccguggugguggacgacuacagaagaagaaagaagaagggcggcccccugagagcccugagcagcaagaccuggagcaccgacgacuucuucgccggccugagagaggagggcgaggacagcauggcccaggaggagaaggaggagaccggcgacgacagcgacuaa

SEQ ID NO: 25641 - RNA, 1005 nt, Artificial Sequence
  WDR5__Homo_sapiens__XP_005272220
auggccaccgaggagaagaagcccgagaccgaggccgccagagcccagcccacccccagcagcagcgccacccagagcaagcccacccccgugaagcccaacuacgcccugaaguucacccuggccggccacaccaaggccgugagcagcgugaaguucagccccaacggcgaguggcuggccagcagcagcgccgacaagcugaucaagaucuggggcgccuacgacggcaaguucgagaagaccaucagcggccacaagcugggcaucagcgacguggccuggagcagcgacagcaaccugcuggugagcgccagcgacgacaagacccugaagaucugggacgugagcagcggcaagugccugaagacccugaagggccacagcaacuacguguucugcugcaacuucaacccccagagcaaccugaucgugagcggcagcuucgacgagagcgugagaaucugggacgugaagaccggcaagugccugaagacccugcccgcccacagcgaccccgugagcgccgugcacuucaacagagacggcagccugaucgugagcagcagcuacgacggccugugcagaaucugggacaccgccagcggccagugccugaagacccugaucgacgacgacaacccccccgugagcuucgugaaguucagccccaacggcaaguacauccuggccgccacccuggacaacacccugaagcugugggacuacagcaagggcaagugccugaagaccuacaccggccacaagaacgagaaguacugcaucuucgccaacuucagcgugaccggcggcaaguggaucgugagcggcagcgaggacaaccugguguacaucuggaaccugcagaccaaggagaucgugcagaagcugcagggccacaccgacguggugaucagcaccgccugccaccccaccgagaacaucaucgccagcgccgcccuggagaacgacaagaccaucaagcuguggaagagcgacugcuaa

SEQ ID NO: 25642 - RNA, 3201 nt, Artificial Sequence
  WDR60__Homo_sapiens__NP_060521
auggagcccggcaagagaagaaccaaggacgacaccuggaaggccgacgaccugagaaagcaccugugggccauccagagcggcggcagcaaggaggagagaaagcacagagagaagaagcugagaaaggagagcgagauggaccugcccgagcacaaggagcccagaugcagagaccccgaccaggacgccagaagcagagacagaguggccgaggugcacaccgccaaggagagccccagaggcgagagagacagagacagacagagagagagaagaagagacgccaaggacagagagaaggagaagcugaaggagaagcacagagaggccgagaagagccacagcagaggcaaggacagagagaaggagaaggacagaagagccagaaaggaggagcugagacagaccguggcccaccacaaccugcugggccaggagaccagagacagacagcugcuggagagagccgagagaaagggcagaagcgugagcaaggugagaagcgaggagaaggacgaggacagcgagagaggcgacgaggacagagagagaagauacagagagagaaagcugcaguacggcgacagcaaggacaacccccugaaguacuggcuguacaaggaggagggcgagagaagacacagaaagcccagagagcccgacagagacaacaagcacagagagaagagcagcaccagagagaagagagagaaguacagcaaggagaagagcaacagcuucagcgacaagggcgaggagagacacaaggagaagagacacaaggagggcuuccacuucgacgacgagagacaccagagcaacguggacagaaaggagaagagcgccaaggacgagcccagaaagagagagagccagaacggcgagcacagaaacagaggcgccagcagcaagagagacggcaccagcagccagcacgccgagaaccuggugagaaaccacggcaaggacaaggacagcagaagaaagcacggccacgaggagggcagcagcgugugguggaagcuggaccagagacccggcggcgaggagaccguggagaucgagaaggaggagaccgaccuggagaacgccagagccgacgccuacaccgccagcugcgaggacgacuucgaggacuacgaggacgacuucgaggugugcgacggcgacgacgacgagagcagcaacgagcccgagagcagagagaagcuggaggagcugccccuggcccagaagaaggagauccaggagauccagagagccaucaacgccgagaacgagagaaucggcgagcugagccugaagcuguuccagaagagaggcagaaccgaguucgagaaggagcccagaaccgacaccaacagcagccccagcagagccagcgugugcggcaucuucguggacuucgccagcgccagccacagacagaagagcagaacccaggcccugaagcagaagaugagaagcaccaagcugcugagacugaucgaccuggacuucagcuucaccuucagccugcuggaccugccccccgugaacgaguacgacauguacaucagaaacuucggcaagaagaacaccaagcaggccuacgugcagugcaacgaggacaacguggagagagacauccagaccgaggagaucgagaccagagagguguggacccagcaccccggcgagagcaccguggugagcggcggcagcgagcagagagacaccagcgacgccguggugaugcccaagaucgacacccccagacugugcagcuuccugagagccgccugccaggugauggccgugcugcuggaggaggacagacuggccgccgagcccagcuggaaccugagagcccaggacagagcccuguacuucagcgacagcagcagccagcugaacaccagccugcccuuccugcagaacagaaaggugagcagccugcacaccagcagagugcagagacagaugguggugagcgugcacgaccugcccgagaagagcuucgugccccugcuggacagcaaguacgugcugugcgugugggacaucuggcagcccagcggcccccagaaggugcugaucugcgagagccaggugaccugcugcugccugagcccccugaaggccuuccugcuguucgccggcaccgcccacggcagcgugguggugugggaccugagagaggacagcagacugcacuacagcgugacccugagcgacggcuucuggaccuucagaaccgccaccuucagcaccgacggcauccugaccagcgugaaccacagaagcccccugcaggccguggagcccaucagcaccagcgugcacaagaagcagagcuucgugcugagccccuucagcacccaggaggagaugagcggccugagcuuccacaucgccagccuggacgagagcggcgugcugaacguguggguggugguggagcugcccaaggccgacaucgccggcagcaucagcgaccugggccugaugcccggcggcagagugaagcuggugcacagcgcccugauccagcugggcgacagccugagccacaagggcaacgaguucuggggcaccacccagacccugaacgugaaguuccugcccagcgaccccaaccacuucaucaucggcaccgacaugggccugaucagccacggcaccagacaggaccugagaguggcccccaagcuguucaagccccagcagcacggcaucagacccgugaaggugaacgugaucgacuucagccccuucggcgagcccaucuuccuggccggcugcagcgacggcagcaucagacugcaccagcugagcagcgccuucccccugcugcagugggacagcagcaccgacagccacgccgugaccggccugcaguggagccccaccagacccgccguguuccuggugcaggacgacaccagcaacaucuacaucugggaccugcugcagagcgaccugggccccguggccaagcagcaggugagccccaacagacugguggccauggccgccgugggcgagcccgagaaggccggcggcagcuuccuggcccuggugcuggccagagccagcggcagcaucgacauccagcaccugaagagaagaugggccgcccccgagguggacgagugcaacagacugagacugcugcugcaggaggcccuguggcccgagggcaagcugcacaaguaa

SEQ ID NO: 25643 - RNA, 4572 nt, Artificial Sequence
  WDR62__Homo_sapiens__NP_001077430
auggccgccgugggcagcggcggcuacgccagaaacgacgccggcgagaagcugcccagcgugauggccggcgugcccgccagaagaggccagagcagccccccccccgccccccccaucugccugagaagaagaaccagacugagcaccgccagcgaggagaccgugcagaacagagugagccuggagaaggugcugggcaucaccgcccagaacagcagcggccugaccugcgaccccggcaccggccacguggccuaccuggccggcugcgugguggugauccuggaccccaaggagaacaagcagcagcacaucuucaacaccgccagaaagagccugagcgcccuggccuucagccccgacggcaaguacaucgugaccggcgagaacggccacagacccgccgugagaaucugggacguggaggagaagaaccagguggccgagaugcugggccacaaguacggcguggccugcguggccuucagccccaacaugaagcacaucgugagcaugggcuaccagcacgacauggugcugaacgugugggacuggaagaaggacaucgugguggccagcaacaaggugagcugcagagugaucgcccugagcuucagcgaggacagcagcuacuucgugaccgugggcaacagacacgugagauucugguuccuggaggugagcaccgagaccaaggugaccagcaccgugccccuggugggcagaagcggcauccugggcgagcugcacaacaacaucuucugcggcguggccugcggcagaggcagaauggccggcagcaccuucugcgugagcuacagcggccugcugugccaguucaacgagaagagagugcuggagaaguggaucaaccugaaggugagccugagcagcugccugugcgugagccaggagcugaucuucugcggcugcaccgacggcaucgugagaaucuuccaggcccacagccugcacuaccuggccaaccugcccaagccccacuaccugggcguggacguggcccagggccuggagcccagcuuccuguuccacagaaaggccgaggccguguaccccgacaccguggcccugaccuucgaccccauccaccaguggcugagcugcguguacaaggaccacagcaucuacaucugggacgugaaggacaucaacagagugggcaagguguggagcgagcuguuccacagcagcuacguguggaacguggagguguaccccgaguucgaggaccagagagccugccugcccagcggcagcuuccugaccugcagcagcgacaacaccaucagauucuggaaccuggacagcagccccgacagccacuggcagaagaacaucuucagcaacacccugcugaaggugguguacguggagaacgacauccagcaccugcaggacaugagccacuuccccgacagaggcagcgagaacggcacccccauggacgugaaggccggcgugagagugaugcaggugagccccgacggccagcaccuggccagcggcgacagaagcggcaaccugagaauccacgagcugcacuucauggacgagcuggugaagguggaggcccacgacgccgaggugcugugccuggaguacagcaagcccgagaccggccugacccugcuggccagcgccagcagagacagacugauccacgugcugaacguggagaagaacuacaaccuggagcagacccuggacgaccacagcagcagcaucaccgccaucaaguucgccggcaacagagacauccagaugaucagcugcggcgccgacaagagcaucuacuucagaagcgcccagcagggcagcgacggccugcacuucgugagaacccaccacguggccgagaagaccacccuguacgacauggacaucgacaucacccagaaguacguggccguggccugccaggacagaaacgugagaguguacaacaccgugaacggcaagcagaagaagugcuacaagggcagccagggcgacgagggcagccugcugaaggugcacguggaccccagcggcaccuuccuggccaccagcugcagcgacaagagcaucagcgugaucgacuucuacagcggcgagugcaucgccaagauguucggccacagcgagaucaucaccagcaugaaguucaccuacgacugccaccaccugaucaccgugagcggcgacagcugcguguucaucuggcaccugggccccgagaucaccaacugcaugaagcagcaccugcuggagaucgaccacagacagcagcagcagcacaccaacgacaagaagagaagcggccaccccagacaggacaccuacgugagcacccccagcgagauccacagccugagccccggcgagcagaccgaggacgaccuggaggaggagugcgagcccgaggagaugcugaagacccccagcaaggacagccuggaccccgaccccagaugccugcugaccaacggcaagcugccccugugggccaagagacugcugggcgacgacgacguggccgacggccuggccuuccacgccaagagaagcuaccagccccacggcagaugggccgagagagccggccaggagccccugaagaccauccuggacgcccaggaccuggacugcuacuucacccccaugaagcccgagagccuggagaacagcauccuggacagccuggagccccagagccuggccagccugcugagcgagagcgagagcccccaggaggccggcagaggccaccccagcuuccugccccagcagaaggagagcagcgaggccagcgagcugauccuguacagccuggaggccgaggugaccgugaccggcaccgacagccaguacugcagaaaggagguggaggccggccccggcgaccagcagggcgacagcuaccugagagugagcagcgacagccccaaggaccagagcccccccgaggacagcggcgagagcgaggccgaccuggagugcagcuucgccgccauccacagccccgcccccccccccgaccccgcccccagauucgccaccagccugccccacuuccccggcugcgccggccccaccgaggacgagcugagccugcccgagggccccagcgugcccagcagcagccugccccagacccccgagcaggagaaguuccugagacaccacuucgagacccugaccgagagccccugcagagagcuguuccccgccgcccugggcgacguggaggccagcgaggccgaggaccacuucuucaaccccagacugagcaucagcacccaguuccugagcagccugcagaaggccagcagauucacccacaccuucccccccagagccacccagugccuggugaagagccccgaggugaagcugauggacagaggcggcagccagcccagagccggcaccggcuacgccagccccgacagaacccacgugcuggccgccggcaaggccgaggagacccuggaggccuggagaccccccccccccugccugaccagccuggccagcugcgugcccgccagcagcgugcugcccaccgacagaaaccugcccacccccaccagcgcccccacccccggccuggcccagggcgugcacgcccccagcaccugcagcuacauggaggccaccgccagcagcagagccagaaucagcagaagcaucagccugggcgacagcgagggccccaucguggccacccuggcccagccccugagaagacccagcagcgugggcgagcuggccagccugggccaggagcugcaggccaucaccaccgccaccacccccagccuggacagcgagggccaggagcccgcccugagaagcuggggcaaccacgaggccagagccaaccugagacugacccugagcagcgccugcgacggccugcugcagccccccguggacacccagcccggcgugaccgugcccgccgugagcuuccccgcccccagccccguggaggagagcgcccugagacugcacggcagcgccuucagacccagccugcccgcccccgagagccccggccugcccgcccaccccagcaacccccagcugcccgaggccagacccggcauccccggcggcaccgccagccugcuggagcccaccagcggcgcccugggccugcugcagggcagccccgccagauggagcgagcccugggugcccguggaggcccugccccccagcccccuggagcugagcagagugggcaacauccugcacagacugcagaccaccuuccaggaggcccuggaccuguacagagugcuggugagcagcggccagguggacaccggccagcagcaggccagaaccgagcuggugagcaccuuccuguggauccacagccagcuggaggccgagugccuggugggcaccagcguggcccccgcccaggcccugcccagccccggcccccccagcccccccacccuguacccccuggccagccccgaccugcaggcccugcuggagcacuacagcgagcugcuggugcaggccgugagaagaaaggccagaggccacuaa

SEQ ID NO: 25644 - RNA, 3246 nt, Artificial Sequence
  WDR64__Homo_sapiens__NP_653226
auggacaucagaaaggagaagagacugaacauggcccugcagaugagcaacuucaagaaggcccugaacagauucgagaagcugguggagcagaccgccgcccagaagagagacgagagagccggccuguucauccacaaggaggacgccaucggcuacgacaaguucuacgccagcgugcagaagcuguucggccccgacgugaagaaccaggacgugaagagauucuacagaaagcugugcaacaacaccgacgccagcgccgacuggugcgagaucuucggcuacuucagcagcgaggaggaccccaucgccagccagcuggacgaggagaaccugguguucuucgugagcagaaagagaagaauccugaucagcggcagcagaagaagagacgugaucaagagcaucgugaagaucccccaccuggaccugcugaucaccgccacccagaagggccugaucaccguguucaacaaccaggacaccagcuggaucaccggcugcgacuaccugcugcagcugaagagaaucguggccaccaccgagagaaccaucaucgugugggacuacaaggcccagggcagcagccaggagaacuacuucgugaucaagcccauggaccacugccugcugugcgugugcguggugccccugcccgaccaccugugcagagacgacauccugcugggcgacgacggcggcuucgugaacagauucaccgugaacagcgacgacuucggcaucaagcaggccaagagcaagagaaagcugcagaaccaggugcuggacagcaagaacuucaagagcgugaagagaaagcugcacaacgacugggugaugaagaucagauacaucagcgcccugaacugcuucggcagcugcagccuggacagcaaccacagccuggugcuggagagccugaagagacuggaggacaaccugcccgugagagaguucagcaugcccagaggcgccaacaccuucugcuacugcgugaaggccaacgugaucgugaccggcggcgacgacaaggugaucagacuguggcaccccaacaucagcaccaagcccgugggcaagcuggugggccacauguucagcaucgccgagaucgugaccaacgagaaggaccagcacguggugagccugagcagcgccaagguguucagagugugggacauccagacccugagccugcugcagguguuccacgacagccagggcggccccggcgacaugcagaucuacagcaugaucuacgacgccaaccacggcaugcugaucaccggcagcagcgugauggacauguacccccugaccagaaugauccaggacaccaagcaggugccccacacccacgagagagagaucaacgugaugcuguacaacaaguacuuccaccaggugcugaccaucugcagcgagagcaucaucagagugugggagcuggagaccggccugcagguguaccagauccuggagccccacggcuucaacaccgaggugaccagcgccgccguggacgagagcggcuuccuguucgccaccggcgccuacaacggcaccgugagaaucugggacuucggcagcggccaggagaugaaggugcugcccgagggcaaggacuggaaggaggacgagcacugccugagaagacugaucuuccugaaggcccaggagaagcaccagcagcuggugcuggcccuggagagaaacggcaccaucaagaugauccagggcaaggaggacgacaucuaccugauggugaucugggagcugcccgacguggugcccuuccugcaggacggcaagcacgccgugcaccugagaaugagcaccagagacagaaacauggccauccccuuccccgacguggagcugaucguggagagaaacuucagccagcccaccgacaaccccaccauggaccugcugagagugaacugcaucgaccugcugcagguggagggcuacaaccugaucgccgccggcacccugaacggcgugaucauccuguggaacuucgugaccagcaccgugaagaagguguacagacccgaggacugcuucaccgugaaccccgaccugcaccccaagcacuucaagaucaacgacauccuguuccuguucagaacccccgagugcgccagaagaagcagccaggacagcaucugcagcagcagccagugcgagagcagcaagggcccccagagcagcaagggcagcaagcagagcauccacgacagcgaggugaagggcgagcagaccgacgugauggugggcaagcagcagcccauggacaagaagcaccccggcaucgccaaccugcccgaggcccagccccccauccuggugaccgcccacgaggacggccaccugagacuguggacccuggagggcagacugcugaaggacaugcugcccuucaccaagcacagcgccaucagccugaccagccuguacaccgacagcugcaccagaauccugcuggccggcaacguggagggccacgugauccugugcaacaucagcagcuuccuggaccccccccacgacgagaagaaguucaagcagcugcugagcuggagagcccacagccuggagaucauccaggugaucuacguggaggagaagcagguggugcugaccgccagcaucgacggcagcgugagacuguggcacgcccugaacggccacuacugcggcuacuucggccagagaagacuguucgagcugagccagaccagagacuucauccugcccugcgacgugaccgaguaccccaucgagaucaaggaggagagcaaguucaccgagaagcagaaguacgaguacccccugaucuucgacagagagaaguggagaaagaugagcagcgugagccugcuguucaagagaaccccccccaaggccuucgagguggagcaggacuucaaguucuucaagagccugagcagccccaagaucagaagauacccccuggagggcuucgugaccgagaacagagaggccggcaucguguucggcagccugcccaucuacagcaucagcagccccaccagccugagauuccugccccugaucggcguggaggcccagaaggacagcagcgacggcaucaccggcaagaagaagggcggccacgugcagagagagaaggcccccagaagaagaagccugaagaagaaccuggugccccagaucaaccuggccagcagcuucuuccccgccauccccaaguaa

SEQ ID NO: 25645 - RNA, 2826 nt, Artificial Sequence
  WDR66__Homo_sapiens__NP_001171474
augagcgacgccgccgaggcccccagagaggccaccggcgagaacggcgagaccgagaugaaggaggaggaggagcccaaccccaacuacaaggagguggaggacccccagcaggagagcaaggacgacaccaucgccuggagagagagccaggaggaggagagaaagaccggcgaggaggagggcgaggaggagggcaaggaggacaagaagaucgugauggaggagaccgaggagaaggccggcgaggugcaggagaaggaggccagcggcauccaggaggagaccaccguggagccccaggaggugaccgccagcaugaucagacuggagacccagaucaccgacagccagagcaucaccagcggcaucuuccccaagacccagagaggcagcaagagcaagcugagccugcagcuggaggacgccgagaccgacgagcugcugagagaccugagcacccagaucgaguuccuggaccuggaccagaucagccccgaggagcagcagaucagcagccccgagagacagcccagcggcgagcuggaggagaagaccgacagaaugccccaggacgagcugggccaggagagaagagaccuggagcccgagaacagagaggagggccaggagagaagagugagcgacauccagagcaaggccggcaucagcagagagagccuggugagcagcaccaccgaggacauccuguuccagaaggacaagagcacccccguguacccccugaccaugaccuggagcuucggcuggaacagcagccugcccguguacuacaucagagaggagagacagagagugcugcuguacgugugcgcccacaccgccaucaucuacaacguguucagaaacaaccaguaccaccugcagggccacgccaacaucaucagcugccugugcgugagcgaggacagaagauggaucgccaccgccgacaagggccccgacugccuggugaucaucugggacagcuucaccggcauccccgugcacaccaucuucgacagcugccccgagggcaacggcaucauggccauggccaugacccacgacgccaaguaccuggccaccaucagcgacgccgaggugcagaaggugugcaucuggaaguggacccuggccguggagacccccgccugcacccuggagcugcccaccgaguacggcgugcagaacuacgugaccuucaaccccaccaacaacaaggagcuggugagcaacagcaagaccagagccaucuacuacgccugguacgaggagagagacacccuggcccacagcgccccccugcugaccgagaagaccuucaacaagcuggugggcaaguucagccagagcaucuuccaccugaaccugacccagauccugagcgccaccauggagggcaagcugguggugugggacauccacagaccccccagcagcgccagcaccuuccugggcuuccccuacaucaagcccugcaagcuggugcaccugcagaaggagggcaucaccgugcugaccaccaucgacagcuacaucgugaccggcgacaucaagggcaacaucaaguucuacgaccacacccugagcaucgugaacugguacagccaccugaagcugggcgccaucagaacccugagcuucagcaagacccccgccaccccccccaccgagaagagcaacuacccccccgacugcacccugaagggcgaccuguucgugcugagaaacuucaucaucggcaccagcgacgccgccguguaccaccugaccaccgacggcaccaagcuggagaagcuguucguggagcccaaggacgccaucugcgccaucagcugccaccccuaccagccccugaucgccaucggcagcaucugcggcaugaucaagguguggaacuacgagaacaagcaguaccuguucagcagaguguucgagaagggccugggcgugcagagccugaccuacaaccccgagggcgcccugcugggcgccggcuucaccgagggcaccguguacauccuggacgccaugagccuggagaacgagagccccgagcccuucaaguacagcagaaccagcgugacccacaucagcuucagccacgacagccaguacauggccaccgccgacagaagcuucaccguggccguguacaugcugguggugagaaacggccagagagugugggaguaccuggccagacugagaagccacagaaagagcaucagaagccugcuguucggcguguaccuggacagcaacgagcccagacugcugagccugggcaccgacagacugcugaucgaguacgaccugcugagaagcuacaaggaccaccuggaggugcuggacauccaccacaccgaccagggcugcuaccccaccugcauggugugguaccccccccugaccagagagcuguuccugcugaucugcaacagcggcuacaaggugaagcuguucaacgccaccaccaagaugugcagaaagacccugcugggccccgccuacggcagccccaucgagcagacccaggugcugcccgugagaagcauggccgagcugcagaagagauaccugguguucaucaacagagacaaggugggccugcagauccugcccguggacggcaacccccacaagaccagcgccaucgugugccaccccaacggcguggccggcauggccgugagcuacgacggcugcuacgccuucaccgccggcggccacgacagaagcguggugcaguggaagaucacccugagccaccccggcagccaggcccccauccugagccccagcgacaccagcagaagcuaa

SEQ ID NO: 25646 - RNA, 1965 nt, Artificial Sequence
  WDR70__Homo_sapiens__NP_060504
auggagagaagcggccccagcgaggugaccggcagcgacgccagcggccccgacccccagcuggccgugaccaugggcuucaccggcuucggcaagaaggccagaaccuucgaccuggaggccauguucgagcagaccagaagaaccgccguggagagaagcagaaagacccuggaggccagagagaaggaggaggagaugaacagagagaaggagcugagaagacagaacgaggacaucgagcccaccagcagcagaagcaacguggugagagacugcagcaagagcagcagcagagacaccagcagcagcgagagcgagcagagcagcgacagcagcgacgacgagcugaucggccccccccugccccccaagauggugggcaagcccgugaacuucauggaggaggacauccugggcccccugccccccccccugaacgaggaggaggaggaggccgaggaggaggaggaggaggaggaggaggaggagaaccccgugcacaagauccccgacagccacgagaucacccugaagcacggcaccaagaccgugagcgcccugggccuggaccccagcggcgccagacuggugaccggcggcuacgacuacgacgugaaguucugggacuucgccggcauggacgccagcuucaaggccuucagaagccugcagcccugcgagugccaccagaucaagagccugcaguacagcaacaccggcgacaugauccugguggugagcggcagcagccaggccaaggugaucgacagagacggcuucgaggugauggagugcaucaagggcgaccaguacaucguggacauggccaacaccaagggccacaccgccaugcugcacaccggcagcuggcaccccaagaucaagggcgaguucaugaccugcagcaacgacgccaccgugagaaccugggagguggagaaccccaagaagcagaagagcguguucaagcccagaaccaugcagggcaagaaggugauccccaccaccugcaccuacagcagagacggcaaccugaucgccgccgccugccagaacggcagcauccagaucugggacagaaaccugaccgugcaccccaaguuccacuacaagcaggcccacgacagcggcaccgacaccagcugcgugaccuucagcuacgacggcaacgugcuggccagcagaggcggcgacgacagccugaagcugugggacaucagacaguucaacaagccccuguucagcgccagcggccugcccaccauguuccccaugaccgacugcugcuucagccccgacgacaagcugaucgugaccggcaccagcauccagagaggcugcggcagcggcaagcugguguucuucgagagaagaaccuuccagagaguguacgagaucgacaucaccgacgccagcguggugagaugccuguggcaccccaagcugaaccagaucauggugggcaccggcaacggccuggccaagguguacuacgaccccaacaagagccagagaggcgccaagcugugcguggugaagacccagagaaaggccaagcaggccgagacccugacccaggacuacaucaucaccccccacgcccugcccauguucagagagcccagacagagaagcaccagaaagcagcuggagaaggacagacuggacccccugaagagccacaagcccgagccccccguggccggccccggcagaggcggcagagugggcacccacggcggcacccugagcagcuacaucgugaagaacaucgcccuggacaagaccgacgacagcaaccccagagaggccauccugagacacgccaaggccgccgaggacagccccuacugggugagccccgccuacagcaagacccagcccaagaccauguucgcccagguggagagcgacgacgaggaggccaagaacgagcccgaguggaagaagagaaagaucuaa

SEQ ID NO: 25647 - RNA, 3309 nt, Artificial Sequence
  WDR72__Homo_sapiens__XP_011519737
augagaaccagccugcaggccguggcccuguggggccagaaggcccccccccacagcaucaccgccaucaugaucaccgacgaccagagaaccaucgugaccggcagccaggagggccagcugugccuguggaaccugagccacgagcugaagaucagcgccaaggagcugcuguucggccacagcgccagcgugaccugccuggccagagccagagacuucagcaagcagcccuacaucgugagcgccgccgagaacggcgagaugugcguguggaacgugaccaacggccagugcauggagaaggccacccugcccuacagacacaccgccaucugcuacuaccacugcagcuucagaaugaccggcgagggcuggcugcugugcugcggcgaguaccaggacgugcugaucaucgacgccaagacccuggccguggugcacagcuucagaagcagccaguuccccgacuggaucaacugcaugugcaucgugcacagcaugagaauccaggaggacagccugcugguggugagcguggccggcgagcugaaggugugggaccugagcagcagcaucaacagcauccaggagaagcaggacguguacgagaaggagagcaaguuccuggagagccugaacugccagaccaucagauucugcaccuacaccgagagacugcugcuggugguguucagcaagugcuggaagguguacgacuacugcgacuucagccugcugcugaccgaggugagcagaaacggccaguucuucgccggcggcgaggugaucgccgcccacagaauccugaucuggaccgaggacggccacagcuacaucuaccagcugcugaacagcggccugagcaagagcaucuaccccgccgacggcagagugcugaaggagaccaucuacccccaccugcugugcagcaccagcgugcaggagaacaaggagcagagcagacccuucgugaugggcuacaugaacgagagaaaggagcccuucuacaaggugcuguucagcggcgaggugagcggcagaaucacccuguggcacauccccgacgugcccgugagcaaguucgacggcagccccagagagauccccgugaccgccaccuggacccugcaggacaacuucgacaagcacgacaccaugagccagagcaucaucgacuacuucagcggccugaaggacggcgccggcaccgccguggugaccagcagcgaguacauccccagccuggacaagcugaucugcggcugcgaggacggcaccaucaucaucacccaggcccugaacgccgccaaggccagacugcuggagggcggcagccuggugaaggacagccccccccacaaggugcugaagggccaccaccagagcgugaccagccugcuguacccccacggccugagcagcaagcuggaccagagcuggaugcugagcggcgaccuggacagcugcgugauccugugggacaucuucaccgaggagauccugcacaaguucuuccuggaggccggccccgugaccagccugcugaugagccccgagaaguucaagcugagaggcgagcagaucaucugcugcgugugcggcgaccacagcguggcccugcugcaccuggagggcaagagcugccugcugcacgccagaaagcaccuguuccccgugagaaugaucaaguggcaccccguggagaacuuccugaucgugggcugcgccgacgacagcguguacaucugggagaucgagaccggcacccuggagagacacgagaccggcgagagagccagaaucauccugaacugcugcgacgacagccagcuggugaagagcgugcugcccaucgccagcgagacccugaagcacaagagcaucgagcagagaagcagcagccccuaccagcugggcccccugcccugccccggccugcagguggagagcagcugcaaggugaccgacgccaaguucugccccagacccuucaacgugcugcccgugaagaccaaguggagcaacgugggcuuccacauccugcuguucgaccuggagaaccugguggagcugcugcugcccaccccccugagcgacguggacagcagcagcagcuucuacggcggcgaggugcugagaagagccaagagcaccguggagaagaagacccugacccugagaaagagcaagaccgccugcggcccccugagcgccgaggcccuggccaagcccaucaccgagagccuggcccagggcgacaacaccaucaaguucagcgaggagaacgacggcaucaagagacagaagaagaugaagaucagcaagaagaugcagcccaagcccagcagaaagguggacgccagccugaccaucgacaccgccaagcuguuccugagcugccugcugcccuggggcguggacaaggaccuggacuaccugugcaucaagcaccugaacauccugaagcugcagggccccaucagccugggcaucagccugaacgaggacaacuucagccugaugcugcccggcugggaccugugcaacagcggcaugaucaaggacuacagcggcgugaaccuguucagcagaaaggugcuggaccugagcgacaaguacaccgccacccugcccaaccaggugggcauccccagaggccuggagaacaacugcgacagccugagagagagcgacaccaucguguaccugcugagcagacuguuccuggugaacaagcuggugaacaugccccuggagcuggccugcagagugggcagcagcuucagaauggagagcauccacaacaagaugagaggcgccggcaacgacauccugaacaugagcagcuucuacagcugccugagaaacggcaagaacgagagccacgugcccgaggccgaccugagccugcugaagcugaucagcugcuggagagaccagagcgugcaggugaccgaggccauccaggccgugcugcuggccgaggugcagcagcacaugaagagccugggcaagauccccgugaacagccagcccgugagcauggccgagaacggcaacugcgagaugaagcagaugcugcccaagcuggaguggaccgaggagcuggagcugcagugcgugagaaacacccugccccugcagacccccgugagccccgugaagcacgacagcaacagcaacagcgccaacuuccaggacguggaggacaugcccgacagaugcgcccuggaggagagcgagagccccggcgagcccagacaccacagcuggaucgccaaggugugccccugcaaggugagcuaa

SEQ ID NO: 25648 - RNA, 1158 nt, Artificial Sequence
  WDR74__Homo_sapiens__NP_060563
auggccgccgccgccgccagauggaaccacgugugggugggcaccgagaccggcauccugaagggcgugaaccugcagagaaagcaggccgccaacuucaccgccggcggccagcccagaagagaggaggccgugagcgcccugugcuggggcaccggcggcgagacccagaugcuggugggcugcgccgacagaaccgugaagcacuucagcaccgaggacggcaucuuccagggccagagacacugccccggcggcgagggcauguucagaggccuggcccaggccgacggcacccugaucaccugcguggacagcggcauccugagaguguggcacgacaaggacaaggacaccagcagcgacccccugcuggagcugagagugggccccggcgugugcagaaugagacaggaccccgcccacccccacgugguggccaccggcggcaaggagaacgcccugaagaucugggaccugcagggcagcgaggagcccguguucagagccaagaacgugagaaacgacuggcuggaccugagagugcccaucugggaccaggacauccaguuccugcccggcagccagaagcuggugaccugcaccggcuaccaccaggugagaguguacgaccccgccagcccccagagaagacccgugcuggagaccaccuacggcgaguacccccugaccgccaugacccugacccccggcggcaacagcgugaucgugggcaacacccacggccagcuggccgagaucgaccugagacagggcagacugcugggcugccugaagggccuggccggcagcgugagaggccugcagugccaccccagcaagccccugcuggccagcugcggccuggacagagugcugagaauccacagaauccagaaccccagaggccuggagcacaagguguaccugaagagccagcugaacugccugcugcugagcggcagagacaacugggaggacgagccccaggagccccaggagcccaacaaggugccccuggaggacaccgagaccgacgagcugugggccagccuggaggccgccgccaagagaaagcugagcggccuggagcagccccagggcgcccugcagaccagaagaagaaagaagaagagacccggcagcaccagccccuaa

SEQ ID NO: 25649 - RNA, 1881 nt, Artificial Sequence
  WDR76__Homo_sapiens__NP_079184
augagcagaagcggcgccgccgccgagaaggccgacagcagacagagaccccagaugaaggugaacgaguacaaggagaaccagaacaucgccuacgugagccugagacccgcccagaccaccgugcugaucaagaccgccaagguguaccuggcccccuucagccugagcaacuaccagcuggaccagcugaugugccccaagagccugagcgagaagaacagcaacaacgagguggccugcaagaagaccaagaucaagaagaccugcagaagaaucaucccccccaagaugaagaacaccagcagcaaggccgagagcacccugcagaacagcagcagcgccgugcacaccgagagcaacaagcugcagcccaagagaaccgccgacgccaugaaccugagcguggacguggagagcagccaggacggcgacagcgacgaggacaccacccccagccuggacuucagcggccugagccccuacgagagaaagagacugaagaacaucagcgagaacgccgacuucuucgccagccugcagcugagcgagagcgccgccagacugagagagaugaucgagaagagacagccccccaagagcaagagaaagaagcccaagagagagaacggcaucggcugcagaagaagcaugagacugcugaagguggaccccagcggcgugagccugcccgccgcccccaccccccccacccugguggccgacgagaccccccugcugccccccggcccccuggagaugaccagcgagaaccaggaggacaacaacgagagauucaagggcuuccugcacaccugggccggcaugagcaagcccagcagcaagaacaccgagaagggccugagcagcaucaagagcuacaaggccaaccugaacggcauggugaucagcgaggacaccguguacaaggugaccaccggccccaucuucagcauggcccugcaccccagcgagaccagaacccugguggccgugggcgccaaguucggccaggugggccugugcgaccugacccagcagcccaaggaggacggcguguacguguuccacccccacagccagcccgugagcugccuguacuucagccccgccaaccccgcccacauccugagccugagcuacgacggcacccugagaugcggcgacuucagcagagccaucuucgaggagguguacagaaacgagagaagcagcuucagcagcuucgacuuccuggccgaggacgccagcacccugaucgugggccacugggacggcaacaugagccugguggacagaagaacccccggcaccagcuacgagaagcugaccagcagcagcaugggcaagaucagaaccgugcacgugcaccccgugcacagacaguacuucaucaccgccggccugagagacacccacaucuacgacgccagaagacugaacagcagaagaagccagccccugaucagccugaccgagcacaccaagagcaucgccagcgccuacuucagcccccugaccggcaacagaguggugaccaccugcgccgacugcaaccugagaaucuucgacagcagcugcaucagcagcaagaucccccugcugaccaccaucagacacaacaccuucaccggcagauggcugaccagauuccaggccaugugggaccccaagcaggaggacugcgugaucgugggcagcauggcccaccccagaagaguggagaucuuccacgagaccggcaagagagugcacagcuucggcggcgaguaccuggugagcgugugcagcaucaacgccaugcaccccaccagauacauccuggccggcggcaacagcagcggcaagauccacguguucaugaacgagaagagcugcuaa

SEQ ID NO: 25650 - RNA, 2448 nt, Artificial Sequence
  WDR78__Homo_sapiens__XP_011540464
augacccccggcaagcacagcggcgccagcgccagagccgccaacggcggcgccuggggcuacagagacuucagaggcggccagaagaagggcuggugcaccaccccccagcugguggccaccaugcccgugagccccgccggcagccacaagcagcagaacuucggccugaacaacgccacccagcccaagaagagcaucagcuucuucgccaccaugaaggccaccagcgugaagggcuacaccggcgccaaccagagcagaauggccgugagcaagaccgugcugaucccccccgagcugaagaccguggagaagcccaaccccaacaucaagaccacccagguguucgacaucaacggcaccgacgugacccccagaccccuguaccaccccgacccccugaccggcaccgccaagcccagcaagcugcugaccagccaggagggcagccugggcagcgaguucaucagcagcuacagccuguaccagaacaccaucaaccccagcacccugggccaguucaccagaagcgugcugggcagcagcaccgugagcaagagcagcgugagcgccagcgagagcaucgccgaggaccuggaggagcccagcuacaagagagagagacugaccagcuucaccgaccugcaggugaucagagccgcccccgagaagaucgugaccaaggaggaccuggagaagaacaucgagaucauccugaccgagaccgagacccugagauucuucgaccugcccaccgugauggugagcguggagagcgaggaggccgagaaggugacccagagaaacaagaacuacgaggugcugugcagaaacagacugggcaacgaccuguacguggagagaaugaugcagaccuucaacggcgcccccaagaacaaggacgugcagugcgacaagaucaucauggaggacaagggcaucaugagcaccgccugggaccuguacgacagcuacaacgccauggagcuggugagccugagcgugaagcagagcgugguggagagcagcagcaaggccaacgugcugcccaaggaccaggaccagagacugcccggcagcaccaccgagaagaacagcgagaccagcagccugauggacaucgagaacgugauccuggccaagauccacgaggacgaggaggaccacagcgacgccauccugaagagcgacaaguuccaccaggaccuguucuucauggagagagugcugauggagaacaucuuccagcccaagcuggccgccuacagacagcugcccgugcugaaggagcccgagcccgaggagcccgaggacgugcuggagagcgccaagcacgaggagguggaggaggagagcaagaaggaggaggaggaggagauccacgccgaggagagcaccauccccgccaaccuggagagacuguggagcuucagcugcgaccugaccaagggccugaacgugagcagccuggccuggaacaagaccaaccccgaccugcuggccgugggcuacggccacuucggcuucaaggagcagaagagaggccuggccugcugcuggagcaucaagaaccccauguggcccgagagaaucuaccagagccccuacggcgugaccgccguggacuucagcaucggcgcccccaaccugcuggccgugggcuaccacaacggcaccaucgccaucuacaacgugagaagcaacagcaacgugcccgugcuggacagcagcgagagcccccagaagcaccugggccccguguggcagcugcaguggaucgagcaggacagaggcaccaccggcgacggcaagagagagauccuggugagcaucagcgccgacggcagaaucagcaagugggugaucagaaagggccuggacugcuacgaccugaugagacugaagagaaccaccgccgccagcaacaagaagggcggcgagaaggagaagaaggacgaggcccugaucagcagacaggcccccggcaugugcuucgccuuccaccccaagggccccguguacaaggugaccuggaaccccuucugccacgacguguuccugagcugcagcgccgacuggggcgugaucaucuggcagcaggagaacgugaagcccagccugagcuucuaccccgccaccagcgugguguacgacguggccuggagccccaagagcagcuacaucuucgccgccgccaacgagaacagaguggagaucugggaccugcacaucagcacccuggacccccugaucgugaacaccgccaaccccggcaucaaguucaccaccauccuguucgccaagcagaccgacugccugcuggugggcgacagcgacggccaggugagcguguacgagcugagaaacaugcccaccgugcuggagaccggcagaggcgacaucauggacacccugcugggcagcaagagcaaccagagcgccuaa

SEQ ID NO: 25651 - RNA, 4473 nt, Artificial Sequence
  WDR7__Homo_sapiens__NP_056100
auggccggcaacagccuggugcugcccaucgugcuguggggcagaaaggcccccacccacugcaucagcgccgugcugcugaccgacgacggcgccaccaucgugaccggcugccacgacggccagaucugccugugggaccugagcguggagcugcagaucaaccccagagcccugcuguucggccacaccgccagcaucaccugccugagcaaggccugcgccagcagcgacaagcaguacaucgugagcgccagcgagagcggcgagaugugccugugggacgugagcgacggcagaugcaucgaguucaccaagcuggccugcacccacaccggcauccaguucuaccaguucagcgugggcaaccagagagagggcagacugcugugccacggccacuaccccgagauccuggugguggacgccaccagccuggaggugcuguacagccuggugagcaagaucagccccgacuggaucagcagcaugagcaucaucagaagccacagaacccaggaggacaccgugguggcccugagcgugaccggcauccugaagguguggaucgugaccagcgagaucagcgacaugcaggacaccgagcccaucuucgaggaggagagcaagcccaucuacugccagaacugccagagcaucagcuucugcgccuucacccagagaagccugcugguggugugcagcaaguacuggagaguguucgacgccggcgacuacagccugcugugcagcggccccagcgagaacggccagaccuggaccggcggcgacuucgugagcagcgacaaggugaucaucuggaccgagaacggccagagcuacaucuacaagcugcccgccagcugccugcccgccagcgacagcuucagaagcgacgugggcaaggccguggagaaccugaucccccccgugcagcacauccugcuggacagaaaggacaaggagcugcugaucugcccccccgugaccagauucuucuacggcugcagagaguacuuccacaagcugcugauccagggcgacagcagcggcagacugaacaucuggaacaucagcgacaccgccgacaagcagggcagcgaggagggccuggccaugaccaccagcaucagccugcaggaggccuucgacaagcugaaccccugccccgccggcaucaucgaccagcugagcgugauccccaacagcaacgagccccugaaggugaccgccagcguguacauccccgcccacggcagacuggugugcggcagagaggacggcagcaucgugaucgugcccgccacccagaccgccaucgugcagcugcugcagggcgagcacaugcugagaagaggcuggcccccccacagaacccugagaggccacagaaacaaggugaccugccugcuguacccccaccaggugagcgccagauacgaccagagauaccugaucagcggcggcguggacuucagcgugaucaucugggacaucuucagcggcgagaugaagcacaucuucugcgugcacggcggcgagaucacccagcugcuggugccccccgagaacugcagcgccagagugcagcacugcaucugcagcguggccagcgaccacagcgugggccugcugagccugagagagaagaagugcaucaugcuggccagcagacaccuguuccccauccaggugaucaaguggagacccagcgacgacuaccugguggugggcugcagcgacggcagcguguacguguggcagauggacaccggcgcccuggacagaugcgugaugggcaucaccgccguggagauccugaacgccugcgacgaggccgugcccgccgccguggacagccugagccaccccgccgugaaccugaagcaggccaugaccagaagaagccuggccgcccugaagaacauggcccaccacaagcugcagacccuggccaccaaccugcuggccagcgaggccagcgacaagggcaaccugcccaaguacagccacaacagccugauggugcaggccaucaagaccaaccugaccgaccccgacauccacgugcuguucuucgacguggaggcccugaucauccagcugcugaccgaggaggccagcagacccaacaccgcccugaucagccccgagaaccugcagaaggccagcggcagcagcgacaagggcggcagcuuccugaccggcaagagagccgccgugcuguuccagcaggugaaggagaccaucaaggagaacaucaaggagcaccugcuggacgacgaggaggaggacgaggagaucaugagacagagaagagaggagagcgaccccgaguacagaagcagcaagagcaagccccugacccugcuggaguacaaccugaccauggacaccgccaagcuguucaugagcugccugcacgccuggggccugaacgaggugcuggacgaggugugccuggacagacugggcaugcugaagccccacugcaccgugagcuucggccugcugagcagaggcggccacaugagccugaugcugcccggcuacaaccagcccgccugcaagcugagccacggcaagaccgaggugggcagaaagcugcccgccagcgagggcgugggcaagggcaccuacggcgugagcagagccgugaccacccagcaccugcugagcaucaucagccuggccaacacccugaugagcaugaccaacgccaccuucaucggcgaccacaugaagaagggccccaccagaccccccagacccagcacccccgaccugagcaaggccagaggcagcccccccaccagcagcaacaucgugcagggccagaucaagcagguggccgcccccguggugagcgccagaagcgacgccgaccacagcggcagcgacccccccagcgcccccgcccugcacaccugcuuccuggugaacgagggcuggagccagcuggccgccaugcacugcgugaugcugcccgaccugcugggccuggacaaguucagacccccccugcuggagaugcuggccagaagauggcaggacagaugccuggaggugagagaggccgcccaggcccugcugcuggccgagcugagaagaaucgagcaggccggcagaaaggaggccaucgacgccugggcccccuaccugccccaguacaucgaccacgugaucagccccggcgugaccagcgaggccgcccagaccaucaccaccgcccccgacgccagcggccccgaggccaaggugcaggaggaggagcacgaccugguggacgacgacaucaccaccggcugccugagcagcgugccccagaugaagaagaucagcaccagcuacgaggagagaagaaagcaggccaccgccaucgugcugcugggcgugaucggcgccgaguucggcgccgagaucgagccccccaagcugcugaccagacccagaagcagcagccagauccccgagggcuucggccugaccagcggcggcagcaacuacagccuggccagacacaccugcaaggcccugaccuuccugcugcugcagccccccagccccaagcugcccccccacagcaccaucagaagaaccgccaucgaccugaucggcagaggcuucaccgugugggagcccuacauggacgugagcgccgugcugaugggccugcuggagcugugcgccgacgccgagaagcagcuggccaacaucaccaugggccugccccugagccccgccgccgacagcgccagaagcgccagacacgcccugagccugaucgccaccgccagaccccccgccuucaucaccaccaucgccaaggaggugcacagacacaccgcccuggccgccaacacccagagccagcagaacaugcacaccaccacccuggccagagccaagggcgagauccugagagugaucgagauccugaucgagaagaugcccaccgacgugguggaccugcugguggaggugauggacaucaucauguacugccuggagggcagccuggugaagaagaagggccugcaggagugcuuccccgccaucugcagauucuacauggugagcuacuacgagagaaaccacagaaucgccgugggcgccagacacggcagcguggcccuguacgacaucagaaccggcaagugccagaccauccacggccacaagggccccaucaccgccguggccuucgcccccgacggcagauaccuggccaccuacagcaacaccgacagccacaucagcuucuggcagaugaacaccagccugcugggcagcaucggcaugcugaacagcgccccccagcugagaugcaucaagaccuaccaggugccccccgugcagcccgccagccccggcagccacaacgcccugaagcuggccagacugaucuggaccagcaacagaaacgugauccugauggcccacgacggcaaggagcacagauucaugguguaa

SEQ ID NO: 25652 - RNA, 2217 nt, Artificial Sequence
  WDR81__Homo_sapiens__NP_001157145
augcuggugagaguggugcugagccugacccccagcuuccccgagcccagcgcccuguacaccgccugcaagauggugagauggcugagcgccaagcugggccccaccguggccagcagacacguggccagaaaccugcugagacugcugaccagcugcuacgugggccccaccagacagcaguucaccgugagcagcggcgagagccccccccugagcgccggcaacaucuaccagaagagacccgugcugggcgacaucgugagcggccccgugcugagcugccugcugcacaucgccagacuguacggcgagcccgugcugaccuaccaguaccugcccuacaucagcuaccugguggcccccggcagcgccagcggccccagcagacugaacagcagaaaggaggccggccugcuggccgccgugacccugacccagaagaucaucguguaccugagcgacaccacccugauggacauccugcccagaaucagccacgaggugcugcugcccgugcugagcuuccugaccagccuggugaccggcuuccccagcggcgcccaggccagaaccauccugugcgugaagaccaucagccugaucgcccugaucugccugagaaucggccaggagauggugcagcagcaccugagcgagcccguggccaccuucuuccagguguucagccagcugcacgagcugagacagcaggaccugaagcuggaccccgccggcagaggcgagggccagcugccccaggugguguucagcgacggccagcagagacccguggaccccgcccugcuggacgagcugcagaagguguucacccuggagauggccuacaccaucuacgugcccuucagcugccugcugggcgacaucaucagaaagaucauccccaaccacgagcuggugggcgagcuggccgcccuguaccuggagagcaucagccccagcagcagaaaccccgccagcguggagcccaccaugcccggcaccggccccgagugggacccccacggcggcggcugcccccaggacgacggccacagcggcaccuucggcagcgugcuggugggcaacagaauccagauccccaacgacagcagacccgagaaccccggcccccugggccccaucagcggcgugggcggcggcggccugggcagcggcagcgacgacaacgcccugaagcaggagcugcccagaagcgugcacggccugagcggcaacuggcuggccuacuggcaguacgagaucggcgugagccagcaggacgcccacuuccacuuccaccagaucagacugcagagcuuccccggccacagcggcgccgugaagugcguggccccccugagcagcgaggacuucuuccugagcggcagcaaggacagaaccgugagacuguggccccuguacaacuacggcgacggcaccagcgagaccgcccccagacugguguacacccagcacagaaagagcguguucuucgugggccagcuggaggccccccagcacguggugagcugcgacggcgccgugcacgugugggaccccuucaccggcaagacccugagaaccguggagccccuggacagcagagugccccugaccgccguggccgugaugcccgccccccacaccagcaucaccauggccagcagcgacagcacccugagauucguggacugcagaaagcccggccugcagcacgaguucagacugggcggcggccugaaccccggccuggugagagcccuggccaucagccccagcggcagaagcgugguggccggcuucagcagcggcuucauggugcugcuggacaccagaaccggccuggugcugagaggcuggcccgcccacgagggcgacauccugcagaucaaggccguggagggcagcgugcuggugagcagcagcagcgaccacagccugaccguguggaaggagcuggagcagaagcccacccaccacuacaagagcgccagcgaccccauccacaccuucgaccuguacggcagcgagguggugaccggcaccgugagcaacaagaucggcgugugcagccugcuggagccccccagccaggccaccaccaagcugagcagcgagaacuucagaggcacccugaccagccuggcccugcugcccaccaagagacaccugcugcugggcagcgacaacggcgugaucagacugcuggccuaa

SEQ ID NO: 25653 - RNA, 948 nt, Artificial Sequence
  WDR83__Homo_sapiens__NP_115708
auggccuuccccgagcccaagcccagaccccccgagcugccccagaagagacugaagacccuggacugcggccagggcgccgugagagccgugagauucaacguggacggcaacuacugccugaccugcggcagcgacaagacccugaagcuguggaacccccugagaggcacccugcugagaaccuacagcggccacggcuacgaggugcuggacgccgccggcagcuucgacaacagcagccugugcagcggcggcggcgacaaggccguggugcugugggacguggccagcggccagguggugagaaaguucagaggccacgccggcaaggugaacaccgugcaguucaacgaggaggccaccgugauccugagcggcagcaucgacagcagcaucagaugcugggacugcagaagcagaagacccgagcccgugcagacccuggacgaggccagagacggcgugagcagcgugaaggugagcgaccacgagauccuggccggcagcguggacggcagagugagaagauacgaccugagaaugggccagcuguucagcgacuacgugggcagccccaucaccugcaccugcuucagcagagacggccagugcacccuggugagcagccuggacagcacccugagacugcuggacaaggacaccggcgagcugcugggcgaguacaagggccacaagaaccaggaguacaagcuggacugcugccugagcgagagagacacccacguggugagcugcagcgaggacggcaagguguucuucugggaccugguggagggcgcccuggcccuggcccugcccgugggcagcggcguggugcagagccuggccuaccaccccaccgagcccugccugcugaccgccaugggcggcagcgugcagugcuggagagaggaggccuacgaggccgaggacggcgccggcuaa

SEQ ID NO: 25654 - RNA, 834 nt, Artificial Sequence
  WDR86__Homo_sapiens__NP_001271190
augagcagagaguucagaggccacagaaacugcgugcugacccuggccuacagcgcccccugggaccugcccagcacccccugcgccgaggaggccgccgccggcggccugcuggugaccggcagcaccgacggcaccgccaagguguggcagguggccagcggcugcugccaccagacccugagaggccacaccggcgccgugcugugccuggugcuggacacccccggccacaccgccuucaccggcagcaccgacgccaccaucagagccugggacauccugagcggcgagcagcugagaguguucagagagcacagaggcagcgugaucugccuggagugcagcagagccgccggcacccuggcccccggccccagcaccagaagccuggagagcugcggcggcugcagcggcgccacccacagcagcagcaccgccagcagaugcaccgccagaugcagcaccccccccagaaccaccgcccccugcgccagcggcaccugcgccggcagcgaggugcccagaggcccccugagacccugcgccgccagcagaggcagcagcgccaccagaugggccgccccccccagacccugcagcagacccgaccccgccggcccccugcagacccccgcccagacccccagcggcagccagagcgccccccccugcuaccccagaugguggagacccauggccggcgagggcagaggcgccagaaagcccggcagagaggagagccccagccaggccagcggcuucagccugguggccagaagaagaugggagagagagugcagccccuggggccccccccccuuccccuucuaa

SEQ ID NO: 25655 - RNA, 1977 nt, Artificial Sequence
  WDR93__Homo_sapiens__NP_001271324
augagcuuccccagaggcagccagacccagaagaucaagcaccccaucggcaccagaaagggcccccuggaggugcccccccccaccgagaaggacuggcccaaggacgacgagcaggaccacgugcugguggaccccgacgaggagcuggacagccugccccagcccuacagaaugaucaacaagcuggugaaccugcuguucgaccagagcugggagaucaucgaggagagaaacgcccugagagaggccgagagcagccagauccagcccaccguguaccccccccugggcgagauccagcugaacaagaugcccaacugcauggccgugagccaggacuacguguucaucggcggcgccaagggcuucagcaucuacaaccuguacagcgccaagcagaucuacgccugggagaagcugaagguggacgugaccagcaucugggccaccgaccugggcaacgagauccugaucgcccccguggacgagaugggcaucaucagacuguucuacuucuacaaggagggccuguaccuggugaaggccaucaacgagguggacgacaccagcaagcagaccaccugcaucaagauggagaucagccagggcggcgacuucgccgccuuccugcugcagggcgccggcgacaucuggcuggacguguacaagcugcccaaggagaccuggcugaagaagcuggagcacccccagcugaccagcaaccccaagaagaaggugagacagccccagcugaacagccugggccccaucagcgccgacccccuggagauggacgccaacgugagcuucaagggcgacaucaagcugagccugcccguguacaucaugaagaucaagccccccaagcccgugaccggcaccaccuucaagagcccccuggagguguucgccaagaucaaggacugcuacggccugggcagcggccagaaccacuucaucaaggacagccagugggagcagcaggccgagaucuucaacgccagcuacaagaaguaccuggacagagagugggaggaggagccccugagcaccgccaccuucuacuuccugcugcccagcugccuguucgccaugccccccgaggugaagggccccagcggcauggccugcgugcugggcauccacuggaccagaagccacaacuucuuccuguacagccugaacagaacccugaaggacaaggccgaccccgagggcguguggcccugcgccgcccccaucgccgugagccagcugagcugcagcagcagcuaccuggugcuggccugcgaggacggcgugcugacccugugggaccuggccaagggccagaacauguaccccgagggccaggugaagagccagaugaagugcguggugcugugcaccgacgccagccugcaccugguggaggccagcggcacccagggccccaccaucagcgugcugguggagagacccgugaagcaccuggacaagaccaucugcgccguggcccccgugcccgcccugcccggcauggugcugaucuucagcaagaacggcagcgugugccugauggacguggccaagagagagaucaucugcgccuucgccccccccggcgccuucccccuggaggugcccuggaagcccguguucgccgugagccccgaccaccccugcuuccugcugagaggcgacuacagccacgagaccgccagcaccgacgacgccggcauccaguacagcguguucuacuucaacuucgaggccugcccccugcuggagaacaucagcaagaacugcaccaucccccagagagaccuggacaacauggccuucccccaggcccugccccuggagaagagaugcgagagauuccugcagaagagcuacagaaagcuggagaagaaccccgagaaggaggaggagcacugggccagacugcagagauacagccugagccugcagagagagaacuucaagaaguaa

SEQ ID NO: 25656 - RNA, 1299 nt, Artificial Sequence
  WEE1__Homo_sapiens__NP_001137448
auggacaccgagaagagcggcaagagagaguucgacgugagacagaccccccaggugaacaucaaccccuucacccccgacagccugcugcugcacagcagcggccagugcagaagaagaaagagaaccuacuggaacgacagcugcggcgaggacauggaggccagcgacuacgagcuggaggacgagaccagacccgccaagagaaucaccaucaccgagagcaacaugaagagcagauacaccaccgaguuccacgagcuggagaagaucggcagcggcgaguucggcagcguguucaagugcgugaagagacuggacggcugcaucuacgccaucaagagaagcaagaagccccuggccggcagcguggacgagcagaacgcccugagagagguguacgcccacgccgugcugggccagcacagccacguggugagauacuucagcgccugggccgaggacgaccacaugcugauccagaacgaguacugcaacggcggcagccuggccgacgccaucagcgagaacuacagaaucaugagcuacuucaaggaggccgagcugaaggaccugcugcugcaggugggcagaggccugagauacauccacagcaugagccuggugcacauggacaucaagcccagcaacaucuucaucagcagaaccagcauccccaacgccgccagcgaggagggcgacgaggacgacugggccagcaacaaggugauguucaagaucggcgaccugggccacgugaccagaaucagcagcccccagguggaggagggcgacagcagauuccuggccaacgaggugcugcaggagaacuacacccaccugcccaaggccgacaucuucgcccuggcccugaccguggugugcgccgccggcgccgagccccugcccagaaacggcgaccaguggcacgagaucagacagggcagacugcccagaaucccccaggugcugagccaggaguucaccgagcugcugaaggugaugauccaccccgaccccgagagaagacccagcgccauggcccuggugaagcacagcgugcugcugagcgccagcagaaagagcgccgagcagcugagaaucgagcugaacgccgagaaguucaagaacagccugcugcagaaggagcugaagaaggcccagauggccaaggccgccgccgaggagagagcccuguucaccgacagaauggccaccagaagcaccacccagagcaacagaaccagcagacugaucggcaagaagaugaacagaagcgugagccugaccaucuacuaa

SEQ ID NO: 25657 - RNA, 663 nt, Artificial Sequence
  WFDC1__Homo_sapiens__NP_001269395
augccccugaccggcgugggccccggcagcugcagaagacagaucaucagagcccugugccugcugcugcugcugcugcacgccggcagcgccaagaacaucuggaagagagcccugcccgccagacuggccgagaagagcagagccgaggaggccggcgcccccggcggccccagacagcccagagccgacagaugcccccccccccccagaacccugccccccggcgccugccaggccgccagaugccaggccgacagcgagugccccagacacagaagaugcugcuacaacggcugcgccuacgccugccuggaggccgugccccccccccccgugcuggacuggcuggugcagcccaagcccagauggcugggcggcaacggcuggcugcuggacggccccgaggaggugcugcaggccgaggccugcagcaccaccgaggacggcgccgagccccugcugugccccagcggcuacgagugccacauccugagccccggcgacguggccgagggcauccccaacagaggccagugcgugaagcagagaagacaggccgacggcagaauccugagacacaagcuguacaaggaguaccccgagggcgacagcaagaacguggccgagcccggcagaggccagcagaagcacuuccaguaa

SEQ ID NO: 25658 - RNA, 375 nt, Artificial Sequence
  WFDC2__Homo_sapiens__XP_011526797
augcccgccugcagacugggcccccuggccgccgcccugcugcugagccugcugcuguucggcuucacccuggugagcggcaccggcgccgagaagaccggcgugugccccgagcugcaggccgaccagaacugcacccaggagugcgugagcgacagcgagugcgccgacaaccugaagugcugcagcgccggcugcgccaccuucugcagccugcccaacgacaaggagggcagcugcccccaggugaacaucaacuucccccagcugggccugugcagagaccagugccagguggacagccagugccccggccagaugaagugcugcagaaacggcugcggcaaggugagcugcgugacccccaacuucuaa

SEQ ID NO: 25659 - RNA, 2673 nt, Artificial Sequence
  WFS1__Homo_sapiens__NP_001139325
auggacagcaacaccgccccccugggccccagcugcccccagcccccccccgccccccagccccaggccagaagcagacugaacgccaccgccagccuggagcaggagagaagcgagagacccagagcccccggcccccaggccggccccggccccggcgugagagacgccgccgcccccgccgagccccaggcccagcacaccagaagcagagagagagccgacggcaccggccccaccaagggcgacauggagauccccuucgaggaggugcuggagagagccaaggccggcgaccccaaggcccagaccgaggugggcaagcacuaccugcagcuggccggcgacaccgacgaggagcugaacagcugcaccgccguggacuggcuggugcuggccgccaagcagggcagaagagaggccgugaagcugcugagaagaugccuggccgacagaagaggcaucaccagcgagaacgagagagaggugagacagcugagcagcgagaccgaccuggagagagccgugagaaaggccgcccuggugauguacuggaagcugaaccccaagaagaagaagcagguggccguggccgagcugcuggagaacgugggccaggugaacgagcacgacggcggcgcccagcccggccccgugcccaagagccugcagaagcagagaagaaugcuggagagacuggugagcagcgagagcaagaacuacaucgcccuggacgacuucguggagaucaccaagaaguacgccaagggcgugauccccagcagccuguuccugcaggacgacgaggacgacgacgagcuggccggcaagagccccgaggaccugccccugagacugaagguggugaaguacccccugcacgccaucauggagaucaaggaguaccugaucgacauggccagcagagccggcaugcacuggcugagcaccaucauccccacccaccacaucaacgcccugaucuucuucuucaucgugagcaaccugaccaucgacuucuucgccuucuucaucccccuggugaucuucuaccugagcuucaucagcauggugaucugcacccugaagguguuccaggacagcaaggccugggagaacuucagaacccugaccgaccugcugcugagauucgagcccaaccuggacguggagcaggccgaggugaacuucggcuggaaccaccuggagcccuacgcccacuuccugcugagcguguucuucgugaucuucagcuuccccaucgccagcaaggacugcauccccugcagcgagcuggccgugaucaccggcuucuucaccgugaccagcuaccugagccugagcacccacgccgagcccuacaccagaagagcccuggccaccgaggugaccgccggccugcugagccugcugcccagcaugccccugaacuggcccuaccugaaggugcugggccagaccuucaucaccgugcccgugggccaccugguggugcugaacgugagcgugcccugccugcuguacguguaccugcuguaccuguucuucagaauggcccagcugagaaacuucaagggcaccuacugcuaccuggugcccuaccuggugugcuucauguggugcgagcugagcguggugauccugcuggagagcaccggccugggccugcugagagccagcaucggcuacuuccuguuccuguucgcccugcccauccugguggccggccuggcccuggugggcgugcugcaguucgccagaugguucaccagccuggagcugaccaagaucgccgugaccguggccgugugcagcgugccccugcugcugagaugguggaccaaggccagcuucagcguggugggcauggugaagagccugaccagaagcagcauggugaagcugauccugguguggcugaccgccaucgugcuguucugcugguucuacguguacagaagcgagggcaugaagguguacaacagcacccugaccuggcagcaguacggcgcccugugcggccccagagccuggaaggagaccaacauggccagaacccagauccugugcagccaccuggagggccacagagugaccuggaccggcagauucaaguacgugagagugaccgacaucgacaacagcgccgagagcgccaucaacaugcugcccuucuucaucggcgacuggaugagaugccuguacggcgaggccuaccccgccugcagccccggcaacaccagcaccgccgaggaggagcugugcagacugaagcugcuggccaagcaccccugccacaucaagaaguucgacagauacaaguucgagaucaccgugggcaugcccuucagcagcggcgccgacggcagcagaagcagagaggaggacgacgugaccaaggacaucgugcugagagccagcagcgaguucaagagcgugcugcugagccugagacagggcagccugaucgaguucagcaccauccuggagggcagacugggcagcaaguggcccguguucgagcugaaggccaucagcugccugaacugcauggcccagcugagccccaccagaagacacgugaagaucgagcacgacuggagaagcaccgugcacggcgccgugaaguucgccuucgacuucuucuucuuccccuuccugagcgccgccuaa

SEQ ID NO: 25660 - RNA, 1890 nt, Artificial Sequence
  WHSC1__Homo_sapiens__NP_015627
auggaguucagcaucaagcagagcccccugagcgugcagagcguggugaagugcaucaagaugaagcaggcccccgagauccugggcagcgccaacggcaagacccccagcugcgaggugaacagagagugcagcguguuccugagcaaggcccagcugagcagcagccugcaggagggcgugaugcagaaguucaacggccacgacgcccugcccuucauccccgccgacaagcugaaggaccugaccagcagaguguucaacggcgagcccggcgcccacgacgccaagcugagauucgagagccaggagaugaagggcaucggcaccccccccaacaccacccccaucaagaacggcagccccgagaucaagcugaagaucaccaagaccuacaugaacggcaagccccuguucgagagcagcaucugcggcgacagcgccgccgacgugagccagagcgaggagaacggccagaagcccgagaacaaggccagaagaaacagaaagagaagcaucaaguacgacagccugcuggagcagggccugguggaggccgcccuggugagcaagaucagcagccccagcgacaagaagauccccgccaagaaggagagcugccccaacaccggcagagacaaggaccaccugcugaaguacaacgugggcgaccugguguggagcaaggugagcggcuaccccugguggcccugcauggugagcgccgacccccugcugcacagcuacaccaagcugaagggccagaagaagagcgccagacaguaccacgugcaguucuucggcgacgcccccgagagagccuggaucuucgagaagagccugguggccuucgagggcgagggccaguucgagaagcugugccaggagagcgccaagcaggcccccaccaaggccgagaagaucaagcugcugaagcccaucagcggcaagcugagagcccagugggagaugggcaucgugcaggccgaggaggccgccagcaugagcguggaggagagaaaggccaaguucaccuuccuguacgugggcgaccagcugcaccugaacccccagguggccaaggaggccggcaucgccgccgagagccugggcgagauggccgagagcagcggcgugagcgaggaggccgccgagaaccccaagagcgugagagaggagugcauccccaugaagagaagaagaagagccaagcugugcagcagcgccgagacccuggagagccaccccgacaucggcaagagcaccccccagaagaccgccgaggccgaccccagaagaggcgugggcagcccccccggcagaaagaagaccaccgugagcaugcccagaagcagaaagggcgacgccgccagccaguuccugguguucugccagaagcacagagacgaggugguggccgagcaccccgacgccagcggcgaggagaucgaggagcugcugagaagccaguggagccugcugagcgagaagcagagagccagauacaacaccaaguucgcccugguggcccccgugcaggccgaggaggacagcggcaacgugaacggcaagaagagaaaccacaccaagagaauccaggaccccaccgaggacgccgaggccgaggacacccccagaaagagacugagaaccgacaagcacagccugagaaagagagacaccaucaccgacaagaccgccagaaccagcagcuacaaggccauggaggccgccagcagccugaagagccaggccgccaccaagaaccugagcgacgccugcaagccccugaagaagagaaacagagccagcaccgccgccagcagcgcccugggcuucagcaagagcagcagccccagcgccagccugaccgagaacgaggugaaguaa

SEQ ID NO: 25661 - RNA, 1938 nt, Artificial Sequence
  WHSC1L1__Homo_sapiens__NP_060248
auggacuucagcuucagcuucaugcagggcaucaugggcaacaccauccagcagcccccccagcugaucgacagcgccaacaucagacaggaggacgccuucgacaacaacagcgacaucgccgaggacggcggccagacccccuacgaggccacccugcagcagggcuuccaguaccccgccaccaccgaggaccugcccccccugaccaacggcuaccccagcagcaucagcguguacgagacccagaccaaguaccagagcuacaaccaguaccccaacggcagcgccaacggcuucggcgccgugagaaacuucagccccaccgacuacuaccacagcgagauccccaacaccagaccccacgagauccuggagaagcccagccccccccagcccccccccccccccagcgugccccagaccgugauccccaagaagaccggcagccccgagaucaagcugaagaucaccaagaccauccagaacggcagagagcuguucgagagcagccugugcggcgaccugcugaacgaggugcaggccagcgagcacaccaagagcaagcacgagagcagaaaggagaagagaaagaagagcaacaagcacgacagcagcagaagcgaggagagaaagagccacaagauccccaagcuggagcccgaggagcagaacagacccaacgagagaguggacaccgugagcgagaagcccagagaggagcccgugcugaaggaggaggcccccgugcagcccauccugagcagcgugcccaccaccgaggugagcaccggcgugaaguuccaggugggcgaccugguguggagcaaggugggcaccuaccccugguggcccugcauggugagcagcgacccccagcuggaggugcacaccaagaucaacaccagaggcgccagagaguaccacgugcaguucuucagcaaccagcccgagagagccugggugcacgagaagagagugagagaguacaagggccacaagcaguacgaggagcugcuggccgaggccaccaagcaggccagcaaccacagcgagaagcagaagaucagaaagcccagaccccagagagagagagcccagugggacaucggcaucgcccacgccgagaaggcccugaagaugaccagagaggagagaaucgagcaguacaccuucaucuacaucgacaagcagcccgaggaggcccugagccaggccaagaagagcguggccagcaagaccgaggugaagaagaccagaagacccagaagcgugcugaacacccagcccgagcagaccaacgccggcgagguggccagcagccugagcagcaccgagaucagaagacacagccagagaagacacaccagcgccgaggaggaggagcccccccccgugaagaucgccuggaagaccgccgccgccagaaagagccugcccgccagcaucaccaugcacaagggcagccuggaccugcagaagugcaacaugagccccguggugaagaucgagcagguguucgcccugcagaacgccaccggcgacggcaaguucaucgaccaguucguguacagcaccaagggcaucggcaacaagaccgagaucagcgugagaggccaggacagacugaucaucagcacccccaaccagagaaacgagaagcccacccagagcgugagcagccccgaggccaccagcggcagcaccggcagcguggagaagaagcagcagagaagaagcaucagaaccagaagcgagagcgagaagagcaccgagguggugcccaagaagaagaucaagaaggagcagguggagaccgugccccaggccaccgugaagaccggccugcagaagggcagcgccgacagaggcgugcagggcagcgugagauucagcgacagcagcgugagcgccgccaucgaggagaccguggacuaa

SEQ ID NO: 25662 - RNA, 1140 nt, Artificial Sequence
  WIF1__Homo_sapiens__NP_009122
auggccagaagaagcgccuuccccgccgccgcccuguggcuguggagcauccugcugugccugcuggcccugagagccgaggccggccccccccaggaggagagccuguaccuguggaucgacgcccaccaggccagagugcugaucggcuucgaggaggacauccugaucgugagcgagggcaagauggcccccuucacccacgacuucagaaaggcccagcagagaaugcccgccauccccgugaacauccacagcaugaacuucaccuggcaggccgccggccaggccgaguacuucuacgaguuccugagccugagaagccuggacaagggcaucauggccgaccccaccgugaacgugccccugcugggcaccgugccccacaaggccagcguggugcaggugggcuuccccugccugggcaagcaggacggcguggccgccuucgagguggacgugaucgugaugaacagcgagggcaacaccauccugcagaccccccagaacgccaucuucuucaagaccugccagcaggccgagugccccggcggcugcagaaacggcggcuucugcaacgagagaagaaucugcgagugccccgacggcuuccacggcccccacugcgagaaggcccugugcacccccagaugcaugaacggcggccugugcgugacccccggcuucugcaucugcccccccggcuucuacggcgugaacugcgacaaggccaacugcagcaccaccugcuucaacggcggcaccugcuucuaccccggcaagugcaucugcccccccggccuggagggcgagcagugcgagaucagcaagugcccccagcccugcagaaacggcggcaagugcaucggcaagagcaagugcaagugcagcaagggcuaccagggcgaccugugcagcaagcccgugugcgagcccggcugcggcgcccacggcaccugccacgagcccaacaagugccagugccaggagggcuggcacggcagacacugcaacaagagauacgaggccagccugauccacgcccugagacccgccggcgcccagcugagacagcacacccccagccugaagaaggccgaggagagaagagacccccccgagagcaacuacaucugguaa

SEQ ID NO: 25663 - RNA, 1512 nt, Artificial Sequence
  WIPF1__Homo_sapiens__NP_003378
augcccgugccccccccccccgcccccccccccccccccaccuucgcccuggccaacaccgagaagcccacccugaacaagaccgagcaggccggcagaaacgcccugcugagcgacaucagcaagggcaagaagcugaagaagaccgugaccaacgacagaagcgcccccauccuggacaagcccaagggcgccggcgccggcggcggcggcggcggcuucggcggcggcggcggcuucggcggcggcggcggcggcggcggcggcggcagcuucggcggcggcggcccccccggccugggcggccuguuccaggccggcaugcccaagcugagaagcaccgccaacagagacaacgacagcggcggcagcagacccccccugcugccccccggcggcagaagcaccagcgccaagcccuucagcccccccagcggccccggcagauuccccgugcccagccccggccacagaagcggcccccccgagccccagagaaacagaaugcccccccccagacccgacgugggcagcaagcccgacagcauccccccccccgugcccagcacccccagacccauccagagcagcccccacaacagaggcagcccccccgugcccggcggccccagacagcccagccccggccccacccccccccccuuccccggcaacagaggcaccgcccugggcggcggcagcaucagacagagcccccugagcagcagcagccccuucagcaacagacccccccugccccccacccccagcagagcccuggacgacaagcccccccccccccccccccccgugggcaacagacccagcauccacagagaggccgugccccccccccccccccagaacaacaagccccccgugcccagcacccccagacccagcgccagcagccaggcccccccccccccccccccccccagcagacccggcccccccccccugccccccagcagcagcggcaacgacgagacccccagacugccccagagaaaccugagccugagcagcagcacccccccccugcccagccccggcagaagcggcccccugccccccccccccagcgagagaccccccccccccgugagagacccccccggcagaagcggcccccugcccccccccccccccgugagcagaaacggcagcaccagcagagcccugcccgccaccccccagcugcccagcagaagcggcguggacagccccagaagcggccccagacccccccugccccccgacagacccagcgccggcgccccccccccccccccccccagcaccagcaucagaaacggcuuccaggacagccccugcgaggacgagugggagagcagauucuacuuccaccccaucagcgaccugcccccccccgagcccuacgugcagaccaccaagagcuaccccagcaagcuggccagaaacgagagcagaagcggcagcaacagaagagagagaggcgcccccccccugccccccauccccagauaa

SEQ ID NO: 25664 - RNA, 1323 nt, Artificial Sequence
  WIPF2__Homo_sapiens__NP_573571
augcccaucccccccccccccccccccccccccggccccccccccccccccaccuuccaccaggccaacaccgagcagcccaagcugagcagagacgagcagagaggcagaggcgcccugcugcaggacaucugcaagggcaccaagcugaagaaggugaccaacaucaacgacagaagcgcccccauccuggagaagcccaagggcagcagcggcggcuacggcagcggcggcgccgcccugcagcccaagggcggccuguuccagggcggcgugcugaagcugagacccgugggcgccaaggacggcagcgagaaccuggccggcaagcccgcccugcagauccccagcagcagagccgccgcccccagaccccccgugagcgccgccagcggcagaccccaggacgacaccgacagcagcagagccagccugcccgagcugcccagaaugcagagacccagccugcccgaccugagcagacccaacaccaccagcagcaccggcaugaagcacagcagcagcgccccccccccccccccccccggcagaagagccaacgccccccccaccccccugcccaugcacagcagcaaggcccccgccuacaacagagagaagccccugccccccacccccggccagagacugcaccccggcagagagggcccccccgcccccccccccgugaagcccccccccagccccgugaacaucagaaccggccccagcggccagagccuggcccccccccccccccccuacagacagccccccggcgugcccaacggccccagcagccccaccaacgagagcgcccccgagcugccccagagacacaacagccugcacagaaagacccccggccccgugagaggccuggccccccccccccccaccagcgccagccccagccugcugagcaacagaccccccccccccgccagagacccccccagcagaggcgccgccccccccccccccccccccgugaucagaaacggcgccagagacgccccccccccccccccccccuacagaaugcacggcagcgagccccccagcagaggcaagcccccccccccccccagcagaacccccgccggccccccccccccccccccccccccccugagaaacggccacagagacagcaucaccaccgugagaagcuuccuggacgacuucgagagcaaguacagcuuccaccccguggaggacuuccccgcccccgaggaguacaagcacuuccagagaaucuaccccagcaagaccaacagagccgccagaggcgcccccccccugccccccauccugagauaa

SEQ ID NO: 25665 - RNA, 1452 nt, Artificial Sequence
  WIPF3__Homo_sapiens__NP_001073998
augcccgugccccccccccccccccccccccugcccccccccccccccccccugggcgccccccccccccccccccccagcgccccccccgugagcaccgacaccagcagccugagaagagccgaccccaagggcagaagcgcccugcuggccgacauccagcagggcaccagacugagaaaggugacccagaucaacgacagaagcgccccccagaucgagagcagcaagggcaccaacaaggagggcggcggcagcgccaacaccagaggcgccagcaccccccccacccugggcgaccuguucgccggcggcuuccccgugcugagacccgccggccagagagacguggccggcggcaagaccggccagggccccggcagcagagcccccagccccagacugcccaacaagaccaucagcggcccccugaucccccccgccagccccagacugggcaacaccagcgaggcccacggcgccgccagaaccgccccccccagacccaacgugcccgccccccccccccccaccccccccccccccccccccccccugccccccccccugcccagcagcagccccaucaagaccccccuggugagcccccccggcccccugaccaagggcaaccugcccgugguggccccccccgugcccugcgccccccccccccccccccccccccccccccccaccccccccccccugccccccgccagcgugcugagcgacaaggccgugaagccccagcuggccccccugcaccugccccccaucccccccccccugccccugcugccccccugcggcuaccccggccugaaggccgagcccgccagccccgcccaggacgcccaggagccccccgcccccccccccccccugccccccuacgccagcugcagccccagagccagccugcccgcccccccccugcccggcgugaacagcagcagcgagaccccccccccccugccccccaagagccccagcuuccaggcccccccccagaaggccggcgcccaggcccugcccgccccccccgccccccccggcagccagcccuuccugcagaagaagagacacggcagacccggcgccggcggcggcaagcugaaccccccccccgccccccccgccagaagccccaccaccgagcugagcagcaagagccagcaggccaccgccuggacccccacccagcagcccggcggccagcugagaaacggcagccugcacaucaucgacgacuucgagagcaaguucaccuuccacagcguggaggacuuccccccccccgacgaguacaagcccugccagaagaucuaccccagcaagauccccagaagcagaacccccggccccuggcugcaggccgaggccgugggccagagcagcgacgacaucaagggcagaaacagccagcugagccugaagacccugagauaa

SEQ ID NO: 25666 - RNA, 1341 nt, Artificial Sequence
  WIPI1__Homo_sapiens__NP_060453
auggaggccgaggccgccgacgccccccccggcggcguggagagcgcccugagcugcuucagcuucaaccaggacugcaccagccuggccaccggcaccaaggccggcuacaagcuguucagccugagcagcguggagcagcuggaccaggugcacggcagcaacgagauccccgacguguacaucguggagagacuguucagcagcagccugguggugguggugagccacaccaagcccagacagaugaacguguaccacuucaagaagggcaccgagaucugcaacuacagcuacagcagcaacauccugagcaucagacugaacagacagagacugcuggugugccuggaggagagcaucuacauccacaacaucaaggacaugaagcugcugaagacccugcuggacauccccgccaaccccaccggccugugcgcccugagcaucaaccacagcaacagcuaccuggccuaccccggcagccugaccagcggcgagaucgugcuguacgacggcaacagccugaagaccgugugcaccaucgccgcccacgagggcacccuggccgccaucaccuucaacgccagcggcagcaagcuggccagcgccagcgagaagggcaccgugaucagaguguucagcgugcccgacggccagaagcuguacgaguucagaagaggcaugaagagauacgugaccaucagcagccugguguucagcauggacagccaguuccugugcgccagcagcaacaccgagaccgugcacaucuucaagcuggagcaggugaccaacagcagacccgaggagcccagcaccuggagcggcuacaugggcaagauguucauggccgccaccaacuaccugcccacccaggugagcgacaugaugcaccaggacagagccuucgccaccgccagacugaacuucagcggccagagaaacaucugcacccugagcaccauccagaagcugcccagacugcugguggccagcagcagcggccaccuguacauguacaaccuggacccccaggacggcggcgagugcgugcugaucaagacccacagccugcugggcagcggcaccaccgaggagaacaaggagaacgaccugagacccagccugccccagagcuacgccgccaccguggccagacccagcgccagcagcgccagcaccgugcccggcuacagcgaggacggcggcgcccugagaggcgaggugauccccgagcacgaguucgccaccggccccgugugccuggacgacgagaacgaguucccccccaucauccugugcagaggcaaccagaagggcaagaccaagcagagcuaa

SEQ ID NO: 25667 - RNA, 1332 nt, Artificial Sequence
  WIPI2__Homo_sapiens__NP_001028690
augaaccuggccagccagagcggcgaggccggcgccggccagcugcuguucgccaacuucaaccaggacaacaccgaggugaagggcgccagcagagccgccggccugggcagaagagccgugguguggagccuggccgugggcagcaagagcggcuacaaguucuucagccugagcagcguggacaagcuggagcagaucuacgagugcaccgacaccgaggacgugugcaucguggagagacuguucagcagcagccugguggccaucgugagccugaaggcccccagaaagcugaaggugugccacuucaagaagggcaccgagaucugcaacuacagcuacagcaacaccauccuggccgugaagcugaacagacagagacugaucgugugccuggaggagagccuguacauccacaacaucagagacaugaaggugcugcacaccaucagagagaccccccccaaccccgccggccugugcgcccugagcaucaacaacgacaacugcuaccuggccuaccccggcagcgccaccaucggcgaggugcagguguucgacaccaucaaccugagagccgccaacaugauccccgcccacgacagcccccuggccgcccuggccuucgacgccagcggcaccaagcuggccaccgccagcgagaagggcaccgugaucagaguguucagcauccccgagggccagaagcuguucgaguucagaagaggcgugaagagaugcgugagcaucugcagccuggccuucagcauggacggcauguuccugagcgccagcagcaacaccgagaccgugcacaucuucaagcuggagaccgugaaggagaagccccccgaggagcccaccaccuggaccggcuacuucggcaaggugcugauggccagcaccagcuaccugcccagccaggugaccgagauguucaaccagggcagagccuucgccaccgugagacugcccuucugcggccacaagaacaucugcagccuggccaccauccagaagauccccagacugcuggugggcgccgccgacggcuaccuguacauguacaaccuggacccccaggagggcggcgagugcgcccugaugaagcagcacagacuggacggcagccuggagaccaccaacgagauccuggacagcgccagccacgacugcccccuggugacccagaccuacggcgccgccgccggcaaggccuacaccgacgaccugggcgccgugggcggcgccugccuggaggacgaggccagcgcccugagacuggacgaggacagcgagcacccccccaugauccugagaaccgacuaa

SEQ ID NO: 25668 - RNA, 468 nt, Artificial Sequence
  WISP1__Homo_sapiens__NP_001191798
augagaugguuccugcccuggacccuggccgccgugaccgccgccgccgccagcaccgugcuggccaccgcccugagccccgcccccaccaccauggacuucacccccgccccccuggaggacaccagcagcagaccccaguucugcaaguggcccugcgagugcccccccagcccccccagaugcccccugggcgugagccugaucaccgacggcugcgagugcugcaagaugugcgcccagcagcugggcgacaacugcaccgaggccgccaucugcgacccccacagaggccuguacugcgacuacagcggcgacagacccagauacgccaucggcgugugcgccagaagagaggaggugagcggcugcgugcccgccagaggcauccacgagcugcacaccugcggccugcaccagcacacccugcugagcacccaggugcuguggagccugcacggccaguaa

SEQ ID NO: 25669 - RNA, 753 nt, Artificial Sequence
  WISP2__Homo_sapiens__XP_005260660
augagaggcacccccaagacccaccugcuggccuucagccugcugugccugcugagcaaggugagaacccagcugugccccacccccugcaccugccccuggcccccccccagaugcccccugggcgugccccuggugcuggacggcugcggcugcugcagagugugcgccagaagacugggcgagcccugcgaccagcugcacgugugcgacgccagccagggccuggugugccagcccggcgccggccccggcggcagaggcgcccugugccugcuggccgaggacgacagcagcugcgaggugaacggcagacuguacagagagggcgagaccuuccagccccacugcagcaucagaugcagaugcgaggacggcggcuucaccugcgugccccugugcagcgaggacgugagacugcccagcugggacugcccccaccccagaagaguggaggugcugggcaagugcugccccgagugggugugcggccagggcggcggccugggcacccagccccugcccgcccagggcccccaguucagcggccuggugagcagccugccccccggcgugcccugccccgaguggagcaccgccuggggccccugcagcaccaccugcggccugggcauggccaccagagugagcaaccagaacagauucugcagacuggagacccagagaagacugugccugagcagacccugcccccccagcagaggcagaagcccccagaacagcgccuucuaa

SEQ ID NO: 25670 - RNA, 1065 nt, Artificial Sequence
  WISP3__Homo_sapiens__NP_003871
augcagggccugcuguucagcacccugcugcuggccggccuggcccaguucugcugcagagugcagggcaccggcccccuggacaccacccccgagggcagacccggcgaggugagcgacgccccccagagaaagcaguucugccacuggcccugcaagugcccccagcagaagcccagaugcccccccggcgugagccuggugagagacggcugcggcugcugcaagaucugcgccaagcagcccggcgagaucugcaacgaggccgaccugugcgacccccacaagggccuguacugcgacuacagcguggacagacccagauacgagaccggcgugugcgccuaccugguggccgugggcugcgaguucaaccaggugcacuaccacaacggccagguguuccagcccaacccccuguucagcugccugugcgugagcggcgccaucggcugcaccccccuguucauccccaagcuggccggcagccacugcagcggcgccaagggcggcaagaagagcgaccagagcaacugcagccuggagccccugcugcagcagcugagcaccagcuacaagaccaugcccgccuacagaaaccugccccugaucuggaagaagaagugccuggugcaggccaccaaguggacccccugcagcagaaccugcggcaugggcaucagcaacagagugaccaacgagaacagcaacugcgagaugagaaaggagaagagacugugcuacauccagcccugcgacagcaacauccugaagaccaucaagauccccaagggcaagaccugccagcccaccuuccagcugagcaaggccgagaaguucguguucagcggcugcagcagcacccagagcuacaagcccaccuucugcggcaucugccuggacaagagaugcugcauccccaacaagagcaagaugaucaccauccaguucgacugccccaacgagggcagcuucaaguggaagaugcuguggaucaccagcugcgugugccagagaaacugcagagagcccggcgacaucuucagcgagcugaagauccuguaa

SEQ ID NO: 25671 - RNA, 1638 nt, Artificial Sequence
  WLS__Homo_sapiens__XP_011540493
auggccggcgccaucaucgagaacaugagcaccaagaagcugugcaucgugggcggcauccugcugguguuccagaucaucgccuuccuggugggcggccugaucgcccccggccccaccaccgccgugagcuacaugagcgugaagugcguggacgccagaaagaaccaccacaagaccaagugguucgugcccuggggccccaaccacugcgacaagaucagagacaucgaggaggccauccccagagagaucgaggccaacgacaucguguucagcgugcacaucccccugccccacauggagaugagccccugguuccaguucaugcuguucauccugcagcuggacaucgccuucaagcugaacaaccagaucagagagaacgccgaggugagcauggacgugagccuggccuacagagacgacgccuucgccgaguggaccgagauggcccacgagagagugcccagaaagcugaagugcaccuucaccagccccaagacccccgagcacgagggcagauacuacgagugcgacgugcugcccuucauggagaucggcagcguggcccacaaguucuaccugcugaacaucagacugcccgugaacgagaagaagaagaucaacgugggcaucggcgagaucaaggacaucagacuggugggcauccaccagaacggcggcuucaccaaggugugguucgccaugaagaccuuccugacccccagcaucuucaucaucauggugugguacuggagaagaaucaccaugaugagcagaccccccgugcugcuggagaaggugaucuucgcccugggcaucagcaugaccuucaucaacauccccguggagugguucagcaucggcuucgacuggaccuggaugcugcuguucggcgacaucagacagggcaucuucuacgccaugcugcugagcuucuggaucaucuucugcggcgagcacaugauggaccagcacgagagaaaccacaucgccggcuacuggaagcaggugggccccaucgccgugggcagcuucugccuguucaucuucgacaugugcgagagaggcgugcagcugaccaaccccuucuacagcaucuggaccaccgacaucggcaccgagcuggccauggccuucaucaucguggccggcaucugccugugccuguacuuccuguuccugugcuucaugguguuccagguguucagaaacaucagcggcaagcagagcagccugcccgccaugagcaaggugagaagacugcacuacgagggccugaucuucagauucaaguuccugaugcugaucacccuggccugcgccgccaugaccgugaucuucuucaucgugagccaggugaccgagggccacuggaaguggggcggcgugaccgugcaggugaacagcgccuucuucaccggcaucuacggcauguggaaccuguacguguucgcccugauguuccuguacgcccccagccacaagaacuacggcgaggaccagagcaacggcaugcagcugcccugcaagagcagagaggacugcgcccuguucgugagcgagcuguaccaggagcuguucagcgccagcaaguacagcuucaucaacgacaacgccgccagcggcaucuaa

SEQ ID NO: 25672 - RNA, 7929 nt, Artificial Sequence
  WNK1__Homo_sapiens__NP_001171914
augagcggcggcgccgccgagaagcagagcagcacccccggcagccuguuccugagcccccccgcccccgcccccaagaacggcagcagcagcgacagcagcgugggcgagaagcugggcgccgccgccgccgacgccgugaccggcagaaccgaggaguacagaagaagaagacacaccauggacaaggacagcagaggcgccgccgccaccaccaccaccaccgagcacagauucuucagaagaagcgugaucugcgacagcaacgccaccgcccuggagcugcccggccugccccugagccugccccagcccagcauccccgccgccgugccccagagcgccccccccgagccccacagagaggagaccgugaccgccaccgccaccagccagguggcccagcagccccccgccgccgccgcccccggcgagcaggccguggccggccccgcccccagcaccgugcccagcagcaccagcaaggacagacccgugagccagcccagccuggugggcagcaaggaggagcccccccccgccagaagcggcagcggcggcggcagcgccaaggagccccaggaggagagaagccagcagcaggacgacaucgaggagcuggagaccaaggccgugggcaugagcaacgacggcagauuccugaaguucgacaucgagaucggcagaggcagcuucaagaccguguacaagggccuggacaccgagaccaccguggagguggccuggugcgagcugcaggacagaaagcugaccaagagcgagagacagagauucaaggaggaggccgagaugcugaagggccugcagcaccccaacaucgugagauucuacgacagcugggagagcaccgugaagggcaagaagugcaucgugcuggugaccgagcugaugaccagcggcacccugaagaccuaccugaagagauucaaggugaugaagaucaaggugcugagaagcuggugcagacagauccugaagggccugcaguuccugcacaccagaaccccccccaucauccacagagaccugaagugcgacaacaucuucaucaccggccccaccggcagcgugaagaucggcgaccugggccuggccacccugaagagagccagcuucgccaagagcgugaucggcacccccgaguucauggcccccgagauguacgaggagaaguacgacgagagcguggacguguacgccuucggcaugugcaugcuggagauggccaccagcgaguaccccuacagcgagugccagaacgccgcccagaucuacagaagagugaccagcggcgugaagcccgccagcuucgacaagguggccauccccgaggugaaggagaucaucgagggcugcaucagacagaacaaggacgagagauacagcaucaaggaccugcugaaccacgccuucuuccaggaggagaccggcgugagaguggagcuggccgaggaggacgacggcgagaagaucgccaucaagcuguggcugagaaucgaggacaucaagaagcugaagggcaaguacaaggacaacgaggccaucgaguucagcuucgaccuggagagagacgugcccgaggacguggcccaggagaugguggagagcggcuacgugugcgagggcgaccacaagaccauggccaaggccaucaaggacagagugagccugaucaagagaaagagagagcagagacagcuggugagagaggagcaggagaagaagaagcaggaggagagcagccugaagcagcagguggagcagagcagcgccagccagaccggcaucaagcagcugcccagcgccagcaccggcauccccaccgccagcaccaccagcgccagcgugagcacccagguggagcccgaggagcccgaggccgaccagcaccagcagcugcaguaccagcagcccagcaucagcgugcugagcgacggcaccguggacagcggccagggcagcagcguguucaccgagagcagagugagcagccagcagaccgugagcuacggcagccagcacgagcaggcccacagcaccggcaccgugcccggccacauccccagcaccgugcaggcccagagccagccccacggcguguacccccccagcagcgugccccagagcauggcccaccccugcggcggcacccccaccuaccccgagagccagaucuucuuccccaccauccacgagagacccgugagcuucagccccccccccaccugcccccccaagguggccaucagccagagaagaaagagcaccagcuuccuggaggcccagacccaccacuuccagccccugcugagaaccgugggccagagccugcugccccccggcggcagccccaccaacuggacccccgaggccguggugaugcugggcaccaccgccagcagagugaccggcgagagcugcgagauccaggugcaccccauguucgagcccagccagguguacagcgacuacagacccggccuggugcugcccgaggaggcccacuacuucaucccccaggaggccguguacguggccggcgugcacuaccaggccagaguggccgagcaguacgagggcauccccuacaacagcagcgugcugagcagccccaugaagcagauccccgagcagaagcccgugcagggcggccccaccagcagcagcguguucgaguuccccagcggccaggccuuccuggugggccaccugcagaaccugagacuggacagcggccugggccccggcagcccccugagcagcaucagcgcccccaucagcaccgacgccaccagacugaaguuccaccccguguucgugccccacagcgcccccgccgugcugacccacaacaacgagagcagaagcaacugcguguucgaguuccacgugcacacccccagcagcagcagcggcgagggcggcggcauccugccccagagaguguacagaaacagacagguggccguggaccugaaccaggaggagcugcccccccagagcgugggccugcacggcuaccugcagcccgugaccgaggagaagcacaacuaccacgcccccgagcugaccgugagcgugguggagcccaucggccagaacuggcccaucggcagccccgaguacagcagcgacagcagccagaucaccagcagcgaccccagcgacuuccagagccccccccccaccggcggcgccgccgcccccuucggcagcgacgugagcaugcccuucauccaccugccccagaccgugcugcaggagagcccccuguucuucugcuucccccagggcaccaccagccagcaggugcugaccgccagcuucagcagcggcggcagcgcccugcacccccaggcccagggccagagccagggccagcccagcagcagcagccugaccggcgugagcagcagccagcccauccagcacccccagcagcagcagggcauccagcagaccgcccccccccagcagaccgugcaguacagccugagccagaccagcaccagcagcgaggccaccaccgcccagcccgugagccagccccaggccccccaggugcugccccaggugagcgccggcaagcagggcuucccccccagacugcccccccaguaccccggcgacagcaacaucgcccccagcagcaacguggccagcgugugcauccacagcaccgugcugagcccccccaugcccaccgaggugcuggccacccccggcuacuuccccaccguggugcagcccuacguggagagcaaccugcuggugcccaugggcggcgugggcggccaggugcaggugagccagcccggcggcagccuggcccaggcccccaccaccagcagccagcaggccgugcuggagagcacccagggcgugagccagguggcccccgccgagcccguggccguggcccagacccaggccacccagcccaccacccuggccagcagcguggacagcgcccacagcgacguggccagcggcaugagcgacggcaacgagaacgugcccagcagcagcggcagacacgagggcagaaccaccaagagacacuacagaaagagcgugagaagcagaagcagacacgagaagaccagcagacccaagcugagaauccugaacgugagcaacaagggcgacagagugguggagugccagcuggagacccacaacagaaagauggugaccuucaaguucgaccuggacggcgacaaccccgaggagaucgccaccaucauggugaacaacgacuucauccuggccaucgagagagagagcuucguggaccaggugagagagaucaucgagaaggccgacgagaugcugagcgaggacgugagcguggagcccgagggcgaccagggccuggagagccugcagggcaaggacgacuacggcuucagcggcagccagaagcuggagggcgaguucaagcagcccauccccgccagcagcaugccccagcagaucggcauccccaccagcagccugacccagguggugcacagcgccggcagaagauucaucgugagccccgugcccgagagcagacugagagagagcaagguguuccccagcgagaucaccgacaccguggccgccagcaccgcccagagccccggcaugaaccugagccacagcgccagcagccugagccugcagcaggccuucagcgagcugagaagagcccagaugaccgagggccccaacaccgccccccccaacuucagccacaccggccccaccuuccccguggugccccccuuccugagcagcaucgccggcgugcccaccaccgccgccgccaccgcccccgugcccgccaccagcagcccccccaacgacaucagcaccagcgugauccagagcgaggugaccgugcccaccgaggagggcaucgccggcguggccaccagcaccggcguggugaccagcggcggccugcccaucccccccgugagcgagagccccgugcugagcagcguggugagcagcaucaccauccccgccguggugagcaucagcaccaccagccccagccugcaggugcccaccagcaccagcgagaucguggugagcagcaccgcccuguaccccagcgugaccgugagcgccaccagcgccagcgccggcggcagcaccgccacccccggccccaagccccccgccguggugagccagcaggccgccggcagcaccaccgugggcgccacccugaccagcgugagcaccaccaccagcuuccccagcaccgccagccagcugugcauccagcugagcagcagcaccagcacccccacccuggccgagaccgugguggugagcgcccacagccuggacaagaccagccacagcagcaccaccggccuggccuucagccugagcgcccccagcagcagcagcagccccggcgccggcgugagcagcuacaucagccagcccggcggccugcacccccuggugauccccagcgugaucgccagcacccccauccugccccaggccgccggccccaccagcaccccccugcugccccaggugcccagcauccccccccuggugcagcccguggccaacgugcccgccgugcagcagacccugauccacagccagccccagcccgcccugcugcccaaccagccccacacccacugccccgagguggacagcgacacccagcccaaggcccccggcaucgacgacaucaagacccuggaggagaagcugagaagccuguucagcgagcacagcagcagcggcgcccagcacgccagcgugagccuggagaccagccuggugaucgagagcaccgugacccccggcauccccaccaccgccguggcccccagcaagcugcugaccagcaccaccagcaccugccugccccccaccaaccugccccugggcaccguggcccugcccgugacccccguggugacccccggccaggugagcacccccgugagcaccaccaccagcggcgugaagcccggcaccgcccccagcaagcccccccugaccaaggcccccgugcugcccgugggcaccgagcugcccgccggcacccugcccagcgagcagcugccccccuuccccggccccagccugacccagagccagcagccccuggaggaccuggacgcccagcugagaagaacccugagccccgagaugaucaccgugaccagcgccgugggccccgugagcauggccgcccccaccgccaucaccgaggccggcacccagccccagaagggcgugagccaggugaaggagggccccgugcuggccaccagcagcggcgccggcguguucaagaugggcagauuccaggugagcguggccgccgacggcgcccagaaggagggcaagaacaagagcgaggacgccaagagcgugcacuucgagagcagcaccagcgagagcagcgugcugagcagcagcagccccgagagcacccuggugaagcccgagcccaacggcaucaccauccccggcaucagcagcgacgugcccgagagcgcccacaagaccaccgccagcgaggccaagagcgacaccggccagcccaccaaggugggcagauuccaggugaccaccaccgccaacaaggugggcagauucagcgugagcaagaccgaggacaagaucaccgacaccaagaaggagggccccguggccagcccccccuucauggaccuggagcaggccgugcugcccgccgugauccccaagaaggagaagcccgagcugagcgagcccagccaccugaacggccccagcagcgaccccgaggccgccuuccugagcagagacguggacgacggcagcggcagcccccacagcccccaccagcugagcagcaagagccugcccagccagaaccugagccagagccugagcaacagcuucaacagcagcuacaugagcagcgacaacgagagcgacaucgaggacgaggaccugaagcuggagcugagaagacugagagacaagcaccugaaggagauccaggaccugcagagcagacagaagcacgagaucgagagccuguacaccaagcugggcaaggugccccccgccgugaucaucccccccgccgccccccugagcggcagaagaagaagacccaccaagagcaagggcagcaagagcagcagaagcagcagccugggcaacaagagcccccagcugagcggcaaccugagcggccagagcgccgccagcgugcugcacccccagcagacccugcacccccccggcaacauccccgagagcggccagaaccagcugcugcagccccugaagcccagccccagcagcgacaaccuguacagcgccuucaccagcgacggcgccaucagcgugcccagccugagcgcccccggccagggcaccagcagcaccaacaccgugggcgccaccgugaacagccaggccgcccaggcccagccccccgccaugaccagcagcagaaagggcaccuucaccgacgaccugcacaagcugguggacaacugggccagagacgccaugaaccugagcggcagaagaggcagcaagggccacaugaacuacgagggccccggcauggccagaaaguucagcgcccccggccagcugugcaucagcaugaccagcaaccugggcggcagcgcccccaucagcgccgccagcgccaccagccugggccacuucaccaagagcaugugccccccccagcaguacggcuuccccgccacccccuucggcgcccaguggagcggcaccggcggccccgccccccagccccugggccaguuccagcccgugggcaccgccagccugcagaacuucaacaucagcaaccugcagaagagcaucagcaacccccccggcagcaaccugagaaccaccuaa

SEQ ID NO: 25673 - RNA, 6894 nt, Artificial Sequence
  WNK2__Homo_sapiens__NP_001269323
auggacggcgacggcggcagaagagacgugcccggcacccugauggagcccggcagaggcgccggccccgccggcauggccgagcccagagccaaggccgccagacccggcccccagagauuccugagaagaagcgugguggagagcgaccaggaggagccccccggccuggaggccgccgaggcccccggcccccagcccccccagccccugcagagaagagugcugcugcugugcaagaccagaagacugaucgccgagagagccagaggcagacccgccgcccccgcccccgccgcccugguggcccagcccggcgcccccggcgcccccgccgacgccggccccgagcccgugggcacccaggagcccggccccgaccccaucgccgccgccguggagaccgcccccgcccccgacggcggccccagagaggaggccgccgccaccgugagaaaggaggacgagggcgccgccgaggccaagcccgagcccggcagaaccagaagagacgagcccgaggaggaggaggacgacgaggacgaccugaaggccguggccaccagccuggacggcagauuccugaaguucgacaucgagcugggcagaggcagcuucaagaccguguacaagggccuggacaccgagaccuggguggagguggccuggugcgagcugcaggacagaaagcugaccaagcuggagagacagagauucaaggaggaggccgagaugcugaagggccugcagcaccccaacaucgugagauucuacgacuucugggagagcagcgccaagggcaagagaugcaucgugcuggugaccgagcugaugaccagcggcacccugaagaccuaccugaagagauucaaggugaugaagcccaaggugcugagaagcuggugcagacagauccugaagggccugcuguuccugcacaccagaaccccccccaucauccacagagaccugaagugcgacaacaucuucaucaccggccccaccggcagcgugaagaucggcgaccugggccuggccacccugaagagagccagcuucgccaagagcgugaucggcacccccgaguucauggcccccgagauguacgaggagcacuacgacgagagcguggacguguacgccuucggcaugugcaugcuggagauggccaccagcgaguaccccuacagcgagugccagaacgccgcccagaucuacagaaaggugaccugcggcaucaagcccgccagcuucgagaaggugcacgaccccgagaucaaggagaucaucggcgagugcaucugcaagaacaaggaggagagauacgagaucaaggaccugcugagccacgccuucuucgccgaggacaccggcgugagaguggagcuggccgaggaggaccacggcagaaagagcaccaucgcccugagacuguggguggaggaccccaagaagcugaagggcaagcccaaggacaacggcgccaucgaguucaccuucgaccuggagaaggagacccccgacgagguggcccaggagaugaucgagagcggcuucuuccacgagagcgacgugaagaucguggccaagagcaucagagacagaguggcccugauccaguggagaagagagagaaucuggcccgcccugcagcccaaggagcagcaggacgugggcagccccgacaaggccagaggcccccccgugccccugcaggugcaggugaccuaccacgcccaggccggccagcccggcccccccgagcccgaggagcccgaggccgaccagcaccugcugccccccacccugcccaccagcgccaccagccuggccagcgacagcaccuucgacagcggccagggcagcaccguguacagcgacagccagagcagccagcagagcgugaugcugggcagccuggccgacgccgcccccagccccgcccagugcgugugcagcccccccgugagcgagggccccgugcugccccagagccugcccagccugggcgccuaccagcagcccaccgccgcccccggccugcccgugggcagcgugcccgcccccgccugcccccccagccugcagcagcacuuccccgaccccgccaugagcuucgcccccgugcugcccccccccagcacccccaugcccaccggccccggccagcccgccccccccggccagcagccccccccccuggcccagcccaccccccugccccaggugcuggccccccagcccguggugccccugcagcccgugcccccccaccugccccccuaccuggcccccgccagccaggugggcgcccccgcccagcugaagccccugcagaugccccaggccccccugcagccccuggcccaggugcccccccagaugccccccauccccguggugccccccaucaccccccuggccggcaucgacggccugccccccgcccugcccgaccugcccaccgccaccgugccccccgugccccccccccaguacuucagccccgccgugauccugcccagccuggccgccccccugccccccgccagccccgcccugccccugcaggccgugaagcugccccacccccccggcgccccccuggccaugcccugcagaaccaucgugcccaacgcccccgccaccaucccccugcuggccguggccccccccggcguggccgcccugagcauccacagcgccguggcccagcugcccggccagcccguguaccccgccgccuucccccagauggcccccaccgacgugccccccagcccccaccacaccgugcagaacaugagagccacccccccccagcccgcccugcccccccagcccacccugcccccccagcccgugcugcccccccagcccacccugcccccccagcccgugcugcccccccagcccaccagacccccccagcccgugcugcccccccagcccaugcugcccccccagcccgugcugcccccccagcccgcccugcccgugagacccgagccccugcagccccaccugcccgagcaggccgcccccgccgccacccccggcagccagauccugcugggccaccccgcccccuacgccguggacguggccgcccaggugcccaccgugcccgugccccccgccgccgugcugagccccccccugcccgaggugcugcugcccgccgcccccgagcugcugccccaguuccccagcagccuggccaccgugagcgccagcgugcagagcgugcccacccagaccgccacccugcugccccccgccaaccccccccugcccggcggccccggcaucgccagccccugccccaccgugcagcugaccguggagcccgugcaggaggagcaggccagccaggacaagccccccggccugccccagagcugcgagagcuacggcggcagcgacgugaccagcggcaaggagcugagcgacagcugcgagggcgccuucggcggcggcagacuggagggcagagccgccagaaagcaccacagaagaagcaccagagccagaagcagacaggagagagccagcagacccagacugaccauccugaacgugugcaacaccggcgacaagaugguggagugccagcuggagacccacaaccacaagauggugaccuucaaguucgaccuggacggcgacgcccccgacgagaucgccaccuacaugguggagcacgacuucauccugcaggccgagagagagaccuucaucgagcagaugaaggacgugauggacaaggccgaggacaugcugagcgaggacaccgacgccgacagaggcagcgaccccggcaccagccccccccaccugagcaccugcggccugggcaccggcgaggagagcagacagagccaggccaacgcccccguguaccagcagaacgugcugcacaccggcaagagaugguucaucaucugccccguggccgagcaccccgcccccgaggcccccgagagcagccccccccugccccugagcagccugccccccgaggccagccagggccccugcagaggccugacccugcccugccugcccuggagaagagccgccugcggcgccguguuccugagccuguucagcgccgagagcgcccagagcaagcagccccccgacagcgcccccuacaaggaccagcugagcagcaaggagcagcccagcuuccuggccagccagcagcugcugagccaggccggccccagcaacccccccggcgccccccccgccccccuggcccccagcagcccccccgugaccgcccugccccaggacggcgccgcccccgccaccagcaccaugcccgagcccgccagcggcaccgccagccaggccggcggccccggcaccccccagggccugaccagcgagcuggagaccagccagccccuggccgagacccacgaggccccccuggccgugcagccccugguggugggccuggcccccugcacccccgcccccgaggccgccagcaccagagacgccagcgcccccagagagccccugcccccccccgcccccgagcccagcccccacagcggcaccccccagcccgcccugggccagcccgccccccugcugcccgccgccgugggcgccgugagccuggccaccagccagcugcccagccccccccugggccccaccgugcccccccagccccccagcgcccuggagagcgacggcgagggccccccccccagagugggcuucguggacagcaccaucaagagccuggacgagaagcugagaacccugcuguaccaggagcacgugcccaccagcagcgccagcgccggcacccccguggaggugggcgacagagacuucacccuggagccccugagaggcgaccagcccagaagcgaggugugcggcggcgaccuggcccugccccccgugcccaaggaggccgugagcggcagagugcagcugccccagccccugguggagaagagcgagcuggcccccaccagaggcgccgugauggagcagggcaccagcagcagcaugaccgccgagagcagccccagaagcaugcugggcuacgacagagacggcagacagguggccagcgacagccacguggugcccagcgugccccaggacgugcccgccuucgugagacccgccagaguggagcccaccgacagagacggcggcgaggccggcgagagcagcgccgagcccccccccagcgacaugggcaccgugggcggccaggccagccacccccagacccugggcgccagagcccugggcagccccagaaagagacccgagcagcaggacgugagcagccccgccaagaccgugggcagauucagcguggugagcacccaggacgaguggacccuggccagcccccacagccugagauacagcgccccccccgacguguaccuggacgaggcccccagcagccccgacgugaagcuggccgugagaagagcccagaccgccagcagcaucgaggugggcgugggcgagcccgugagcagcgacagcggcgacgagggccccagagccagaccccccgugcagaagcaggccagccugcccgugagcggcagcguggccggcgacuucgugaagaaggccaccgccuuccugcagagacccagcagagccggcagccugggccccgagacccccagcagagugggcaugaaggugcccaccaucagcgugaccagcuuccacagccagagcagcuacaucagcagcgacaacgacagcgagcuggaggacgccgacaucaagaaggagcugcagagccugagagagaagcaccugaaggagaucagcgagcugcagagccagcagaagcaggagaucgaggcccuguacagaagacugggcaagccccugccccccaacgugggcuucuuccacaccgccccccccaccggcagaagaagaaagaccagcaagagcaagcugaaggccggcaagcugcugaacccccuggugagacagcugaaggugguggccagcagcaccggccaccuggccgacagcagcagaggcccccccgccaaggaccccgcccaggccagcgugggccugaccgccgacagcaccggccugagcggcaaggccgugcagacccagcagcccugcagcgugagagccagccugagcagcgacaucugcagcggccuggccagcgacggcggcggcgccagaggccagggcuggaccguguaccaccccaccagcgagagagugaccuacaagagcagcagcaagcccagagccagauuccugagcggccccgugagcgugagcaucuggagcgcccugaagagacugugccugggcaaggagcacagcagcagaagcagcaccagcagccuggcccccggccccgagcccggcccccagcccgcccugcacgugcaggcccaggugaacaacagcaacaacaagaagggcaccuucaccgacgaccugcacaagcugguggacgaguggaccagcaagaccgugggcgccgcccagcugaagcccacccugaaccagcugaagcagacccagaagcugcaggacauggaggcccaggccggcugggccgcccccggcgaggccagagccaugaccgcccccagagccggcgugggcaugcccagacugccccccgcccccggcccccugagcaccaccgugauccccggcgccgcccccacccugagcgugcccacccccgacggcgcccugggcaccgccagaagaaaccaggugugguucggccugagagugccccccaccgccugcugcggccacagcacccagcccagaggcggccagagagugggcagcaagaccgccagcuucgccgccagcgaccccgugagaagcuaa

SEQ ID NO: 25674 - RNA, 5403 nt, Artificial Sequence
  WNK3__Homo_sapiens__NP_065973
auggccaccgacagcggcgaccccgccagcaccgaggacagcgagaagcccgacggcaucagcuucgagaacagagugccccagguggccgccacccugaccguggaggccagacugaaggagaagaacagcaccuucagcgccagcggcgagaccguggagagaaagagauucuucagaaagagcguggagaugaccgaggacgacaagguggccgagagcagccccaaggacgagagaaucaaggccgccaugaacauccccagaguggacaagcugcccagcaacgugcugagaggcggccaggaggugaaguacgagcagugcagcaagagcaccagcgagaucagcaaggacugcuucaaggagaagaacgagaaggagauggaggaggaggccgagaugaaggccguggccaccagccccagcggcagauuccugaaguucgacaucgagcugggcagaggcgccuucaagaccguguacaagggccuggacaccgagaccuggguggagguggccuggugcgagcugcaggacagaaagcugaccaaggccgagcagcagagauucaaggaggaggccgagaugcugaagggccugcagcaccccaacaucgugagauucuacgacagcugggagagcauccugaagggcaagaagugcaucgugcuggugaccgagcugaugaccagcggcacccugaagaccuaccugaagagauucaaggugaugaagcccaaggugcugagaagcuggugcagacagauccugaagggccugcaguuccugcacaccagaaccccccccaucauccacagagaccugaagugcgacaacaucuucaucaccggccccaccggcagcgugaagaucggcgaccugggccuggccacccugaugagaaccagcuucgccaagagcgugaucggcacccccgaguucauggcccccgagauguacgaggagcacuacgacgagagcguggacguguacgccuucggcaugugcaugcuggagauggccaccagcgaguaccccuacagcgagugccagaacgccgcccagaucuacagaaaggugaccagcggcaucaagcccgccagcuucaacaaggugaccgaccccgaggugaaggagaucaucgagggcugcaucagacagaacaagagcgagagacugagcaucagagaccugcugaaccacgccuucuucgccgaggacaccggccugagaguggagcuggccgaggaggacgacugcagcaacagcagccuggcccugagacuguggguggaggaccccaagaagcugaagggcaagcacaaggacaacgaggccaucgaguucagcuucaaccuggagaccgacacccccgaggagguggccuacgagauggugaagagcggcuucuuccacgagagcgacagcaaggccguggccaagagcaucagagacagagugacccccaucaagaagaccagagagaagaagcccgccggcugccuggaggagagaagagacagccagugcaagagcaugggcaacguguucccccagccccagaacaccacccugccccuggcccccgcccagcagaccggcgccgagugcgaggagaccgagguggaccagcacgugagacagcagcugcugcagagaaagccccagcagcacugcagcagcgugaccggcgacaaccugagcgaggccggcgccgccagcgugauccacagcgacaccagcagccagcccagcguggccuacagcagcaaccagaccaugggcagccagauggugagcaacaucccccaggccgaggugaacgugcccggccagaucuacagcagccagcagcuggugggccacuaccagcaggugagcggccugcagaagcacagcaagcugacccagccccagauccugccccuggugcagggccagagcaccgugcugcccgugcacgugcugggccccaccguggugagccagccccaggugagcccccugaccgugcagaaggugccccagaucaagcccgugagccagcccgugggcgccgagcagcaggccgcccugcugaagcccgaccuggugagaagccugaaccaggacguggccaccaccaaggagaacgugagcagccccgacaaccccagcggcaacggcaagcaggacagaaucaagcagagaagagccagcugccccagacccgagaagggcaccaaguuccagcugaccgugcugcaggugagcaccagcggcgacaacaugguggagugccagcuggagacccacaacaacaagauggugaccuucaaguucgacguggacggcgacgcccccgaggacaucgccgacuacaugguggaggacaacuucgugcuggagagcgagaaggagaaguucguggaggagcugagagccaucgugggccaggcccaggagauccugcacgugcacuucgccaccgagagagccaccggcguggacagcaucaccguggacagcaacagcagccagaccggcagcagcgagcaggugcagaucaacagcaccagcacccagaccagcaacgagagcgccccccagagcagccccgugggcagauggagauucugcaucaaccagaccaucagaaacagagagacccagagcccccccagccugcagcacagcaugagcgccgugcccggcagacacccccugcccagccccaagaacaccagcaacaaggagaucagcagagacacccugcugaccaucgagaacaaccccugccacagagcccuguucaccagcaagagcgagcacaaggacgugguggacggcaagaucagcgagugcgccagcguggagaccaagcagcccgccauccuguaccagguggaggacaacagacagaucauggcccccgugaccaacagcagcagcuacagcaccaccagcgugagagccgugcccgccgagugcgagggccugaccaagcaggccagcaucuucauccccguguaccccugccaccagaccgccagccaggccgacgcccugaugagccaccccggcgagagcacccagaccagcggcaacagccugaccacccuggccuucgaccagaagccccagacccugagcgugcagcagcccgccauggacgccgaguucaucagccaggagggcgagaccaccgugaacaccgaggccagcagccccaagaccgugauccccacccagacccccggccuggagcccaccacccugcagcccaccaccgugcuggagagcgacggcgagagaccccccaagcuggaguucgccgacaacagaaucaagacccuggacgagaagcugagaaaccugcuguaccaggagcacagcaucagcagcaucuaccccgagagccagaaggacacccagagcaucgacagccccuucagcagcagcgccgaggacacccugagcugccccgugaccgaggugaucgccaucagccacugcggcaucaaggacagccccgugcagagccccaacuuccagcagaccggcagcaagcugcugagcaacguggccgccagccagcccgccaacaucagcguguucaagagagaccugaacgugaucaccagcgugcccagcgagcugugccugcacgagaugagcagcgacgccagccugcccggcgaccccgaggccuaccccgccgccgugagcagcggcggcgccauccaccugcagaccggcggcggcuacuucggccugagcuucaccugccccagccugaagaaccccaucagcaagaagagcuggaccagaaagcugaagagcugggccuacagacugagacagagcaccagcuucuucaagagaagcaaggugagacagguggagaccgaggagaugagaagcgccaucgcccccgaccccaucccccugaccagagagagcaccgccgacaccagagcccugaacagaugcaaggccaugagcggcagcuuccagagaggcagauuccaggugaucaccaucccccagcagcagagcgccaagaugaccagcuucggcaucgagcacaucagcguguucagcgagaccaaccacagcagcgaggaggccuucaucaagaccgccaagagccagcugguggagaucgagcccgccacccagaaccccaagaccagcuucagcuacgagaagcugcaggcccugcaggagaccugcaaggagaacaagggcgugcccaagcagggcgacaacuuccugagcuucagcgccgccugcgagaccgacgugagcagcgugacccccgagaaggaguucgaggagaccagcgccaccggcagcagcaugcagagcggcagcgagcugcugcugaaggagagagagauccugaccgccggcaagcagcccagcagcgacagcgaguucagcgccagccuggccggcagcggcaagagcguggccaagaccggccccgagagcaaccagugccugccccaccacgaggagcaggccuacgcccagacccagagcagccuguucuacagccccagcagccccaugagcagcgacgacgagagcgagaucgaggacgaggaccugaagguggagcugcagagacugagagagaagcacauccaggagguggugaaccugcagacccagcagaacaaggagcugcaggagcuguacgagagacugagaagcaucaaggacagcaagacccagagcaccgagaucccccugccccccgccagccccagaagacccagaagcuucaagagcaagcugagaagcagaccccagagccugacccacguggacaacggcaucguggccaccggcaagagcugccugaucaacgagcuggagaacccccugugcguggagagcaacgccgccagcugccagcagagccccgccagcaagaagggcauguucaccgacgaccugcacaagcugguggacgacuggaccaaggaggccgugggcaacagccugaucaagcccagccugaaccagcugaagcagagccagcacaagcuggagaccgagaacuggaacaaggugagcgagaacacccccagcaccaugggcuacaccagcaccuggaucagcagccugagccagaucagaggcgccgugcccaccagccugccccagggccugagccugcccagcuuccccggcccccugagcagcuacggcaugccccacgugugccaguacaacgccguggccggcgccggcuaccccgugcagugggugggcaucagcggcaccacccagcagagcguggugauccccgcccagagcggcggccccuuccagcccggcaugaacaugcaggccuuccccaccagcagcgugcagaaccccgccaccaucccccccggccccaaguaa

SEQ ID NO: 25675 - RNA, 3732 nt, Artificial Sequence
  WNK4__Homo_sapiens__NP_115763
augcuggccagccccgccaccgagaccaccgugcugaugagccagaccgaggccgaccuggcccugagacccccccccccccugggcaccgccggccagcccagacugggccccccccccagaagagccagaagauucagcggcaaggccgagcccagacccagaagcagcagacugagcagaagaagcagcguggaccugggccugcugagcagcuggagccugcccgccagccccgcccccgacccccccgacccccccgacagcgccggccccggccccgccagaagccccccccccagcagcaaggagccccccgagggcaccuggaccgagggcgcccccgugaaggccgccgaggacagcgccagacccgagcugcccgacagcgccgugggccccggcagcagagagccccugagagugcccgaggccguggcccuggagagaagaagagagcaggaggagaaggaggacauggagacccaggccguggccaccagccccgacggcagauaccugaaguucgacaucgagaucggcagaggcagcuucaagaccguguacagaggccuggacaccgacaccaccguggagguggccuggugcgagcugcagaccagaaagcugagcagagccgagagacagagauucagcgaggagguggagaugcugaagggccugcagcaccccaacaucgugagauucuacgacagcuggaagagcgugcugagaggccaggugugcaucgugcuggugaccgagcugaugaccagcggcacccugaagaccuaccugagaagauucagagagaugaagcccagagugcugcagagauggagcagacagauccugagaggccugcacuuccugcacagcagagugccccccauccugcacagagaccugaagugcgacaacguguucaucaccggccccaccggcagcgugaagaucggcgaccugggccuggccacccugaagagagccagcuucgccaagagcgugaucggcacccccgaguucauggcccccgagauguacgaggagaaguacgacgaggccguggacguguacgccuucggcaugugcaugcuggagauggccaccagcgaguaccccuacagcgagugccagaacgccgcccagaucuacagaaaggugaccagcggcagaaagcccaacagcuuccacaaggugaagauccccgaggugaaggagaucaucgagggcugcaucagaaccgacaagaacgagagauucaccauccaggaccugcuggcccacgccuucuucagagaggagagaggcgugcacguggagcuggccgaggaggacgacggcgagaagcccggccugaagcuguggcugagaauggaggacgccagaagaggcggcagacccagagacaaccaggccaucgaguuccuguuccagcugggcagagacgccgccgaggagguggcccaggagaugguggcccugggccuggugugcgaggccgacuaccagcccguggccagagccgugagagagagaguggccgccauccagagaaagagagagaagcugagaaaggccagagagcuggaggcccugccccccgagcccggccccccccccgccaccgugcccauggcccccggcccccccagcguguucccccccgagcccgaggagcccgaggccgaccagcaccagcccuuccuguucagacacgccagcuacagcagcaccaccagcgacugcgagaccgacggcuaccugagcagcagcggcuuccuggacgccagcgaccccgcccugcagccccccggcggcgugcccagcagccuggccgagagccaccugugccugcccagcgccuucgcccugagcauccccagaagcggccccggcagcgacuucagccccggcgacagcuacgccagcgacgccgccagcggccugagcgacgugggcgagggcaugggccagaugagaagaccccccggcagaaaccugagaagaagacccagaagcagacugagagugaccagcgugagcgaccagaacgacagagugguggagugccagcugcagacccacaacagcaagauggugaccuucagauucgaccuggacggcgacagccccgaggagaucgccgccgccaugguguacaacgaguucauccugcccagcgagagagacggcuuccugagaagaaucagagagaucauccagagaguggagacccugcugaagagagacaccggccccauggaggccgccgaggacacccugagcccccaggaggagcccgccccccugcccgcccugcccgugccccugcccgaccccagcaacgaggagcugcagagcagcaccagccuggagcacagaagcuggaccgccuucagcaccagcagcagcagccccggcaccccccugagccccggcaaccccuucagccccggcacccccaucagccccggccccaucuuccccaucaccagcccccccugccaccccagccccagccccuucagccccaucagcagccaggugagcagcaaccccagcccccaccccaccagcagcccccugcccuucagcagcagcacccccgaguuccccgugccccugagccagugccccuggagcagccugcccaccaccagcccccccaccuucagccccaccugcagccaggugacccugagcagccccuucuucccccccugccccagcaccagcagcuuccccagcaccaccgccgccccccugcugagccuggccagcgccuucagccuggccgugaugaccguggcccagagccugcugagccccagccccggccugcugagccagagcccccccgccccccccagcccccugcccagccugccccugcccccccccguggcccccggcggccaggagagccccagcccccacaccgccgagguggagagcgaggccagccccccccccgccagaccccugcccggcgaggccagacuggcccccaucagcgaggagggcaagccccagcuggugggcagauuccaggugaccagcagcaaggagcccgccgagccccugccccugcagcccaccagccccacccugagcggcagccccaagcccagcaccccccagcugaccagcgagagcagcgacaccgaggacagcgccggcggcggccccgagaccagagaggcccuggccgagagcgacagagccgccgagggccugggcgccggcguggaggaggagggcgacgacggcaaggagccccaggugggcggcagcccccagccccugagccaccccagccccguguggaugaacuacagcuacagcagccugugccugagcagcgaggagagcgagagcagcggcgaggacgaggaguucugggccgagcugcagagccugagacagaagcaccugagcgagguggagacccugcagacccugcagaagaaggagaucgaggaccuguacagcagacugggcaagcagcccccccccggcaucguggcccccgccgccaugcugagcagcagacagagaagacugagcaagggcagcuuccccaccagcagaagaaacagccugcagagaagcgagccccccggccccggcaucaugagaagaaacagccugagcggcagcagcaccggcagccaggagcagagagccagcaagggcgugaccuucgccggcgacgugggcagaauguaa

SEQ ID NO: 25676 - RNA, 1254 nt, Artificial Sequence
  WNT10A__Homo_sapiens__NP_079492
augggcagcgcccaccccagacccuggcugagacugagaccccagccccagcccagacccgcccugugggugcugcuguucuuccugcugcugcuggccgccgccaugcccagaagcgcccccaacgacauccuggaccugagacugccccccgagcccgugcugaacgccaacaccgugugccugacccugcccggccugagcagaagacagauggaggugugcgugagacaccccgacguggccgccagcgccauccagggcauccagaucgccauccacgagugccagcaccaguucagagaccagagauggaacugcagcagccuggagaccagaaacaagauccccuacgagagccccaucuucagcagaggcuucagagagagcgccuucgccuacgccaucgccgccgccggcguggugcacgccgugagcaacgccugcgcccugggcaagcugaaggccugcggcugcgacgccagcagaagaggcgacgaggaggccuucagaagaaagcugcacagacugcagcuggacgcccugcagagaggcaagggccugagccacggcgugcccgagcaccccgcccugcccaccgccagccccggccugcaggacagcugggaguggggcggcugcagccccgacaugggcuucggcgagagauucagcaaggacuuccuggacagcagagagccccacagagacauccacgccagaaugagacugcacaacaacagagugggcagacaggccgugauggagaacaugagaagaaagugcaagugccacggcaccagcggcagcugccagcugaagaccugcuggcaggugacccccgaguucagaaccgugggcgcccugcugagaagcagauuccacagagccacccugaucagaccccacaacagaaacggcggccagcuggagcccggccccgccggcgcccccagccccgcccccggcgcccccggccccagaagaagagccagccccgccgaccugguguacuucgagaagagccccgacuucugcgagagagagcccagacuggacagcgccggcaccgugggcagacugugcaacaagagcagcgccggcagcgacggcugcggcagcaugugcugcggcagaggccacaacauccugagacagaccagaagcgagagaugccacugcagauuccacuggugcugcuucguggugugcgaggagugcagaaucaccgagugggugagcgugugcaaguaa

SEQ ID NO: 25677 - RNA, 1170 nt, Artificial Sequence
  WNT10B__Homo_sapiens__NP_003385
augcuggaggagcccagacccagacccccccccagcggccuggccggccugcuguuccuggcccugugcagcagagcccugagcaacgagauccugggccugaagcugcccggcgagcccccccugaccgccaacaccgugugccugacccugagcggccugagcaagagacagcugggccugugccugagaaaccccgacgugaccgccagcgcccugcagggccugcacaucgccgugcacgagugccagcaccagcugagagaccagagauggaacugcagcgcccuggagggcggcggcagacugccccaccacagcgccauccugaagagaggcuucagagagagcgccuucagcuucagcaugcuggccgccggcgugaugcacgccguggccaccgccugcagccugggcaagcuggugagcugcggcugcggcuggaagggcagcggcgagcaggacagacugagagccaagcugcugcagcugcaggcccugagcagaggcaagagcuucccccacagccugcccagccccggccccggcagcagccccagccccggcccccaggacaccugggaguggggcggcugcaaccacgacauggacuucggcgagaaguucagcagagacuuccuggacagcagagaggcccccagagacauccaggccagaaugagaauccacaacaacagagugggcagacagguggugaccgagaaccugaagagaaagugcaagugccacggcaccagcggcagcugccaguucaagaccugcuggagagccgcccccgaguucagagccgugggcgccgcccugagagagagacugggcagagccaucuucaucgacacccacaacagaaacagcggcgccuuccagcccagacugagacccagaagacugagcggcgagcugguguacuucgagaagagccccgacuucugcgagagagaccccaccaugggcagccccggcaccagaggcagagccugcaacaagaccagcagacugcuggacggcugcggcagccugugcugcggcagaggccacaacgugcugagacagaccagaguggagagaugccacugcagauuccacuggugcugcuacgugcugugcgacgagugcaaggugaccgagugggugaacgugugcaaguaa

SEQ ID NO: 25678 - RNA, 1065 nt, Artificial Sequence
  WNT11__Homo_sapiens__NP_004617
augagagccagaccccaggugugcgaggcccugcuguucgcccuggcccugcagaccggcgugugcuacggcaucaaguggcuggcccugagcaagacccccagcgcccuggcccugaaccagacccagcacugcaagcagcuggagggccuggugagcgcccaggugcagcugugcagaagcaaccuggagcugaugcacaccguggugcacgccgccagagaggugaugaaggccugcagaagagccuucgccgacaugagauggaacugcagcagcaucgagcuggcccccaacuaccugcuggaccuggagagaggcaccagagagagcgccuucguguacgcccugagcgccgccgccaucagccacgccaucgccagagccugcaccagcggcgaccugcccggcugcagcugcggccccgugcccggcgagccccccggccccggcaacagauggggcggcugcgccgacaaccugagcuacggccugcugaugggcgccaaguucagcgacgcccccaugaaggugaagaagaccggcagccaggccaacaagcugaugagacugcacaacagcgaggugggcagacaggcccugagagccagccuggagaugaagugcaagugccacggcgugagcggcagcugcagcaucagaaccugcuggaagggccugcaggagcugcaggacguggccgccgaccugaagaccagauaccugagcgccaccaagguggugcacagacccaugggcaccagaaagcaccuggugcccaaggaccuggacaucagacccgugaaggacagcgagcugguguaccugcagagcagccccgacuucugcaugaagaacgagaaggugggcagccacggcacccaggacagacagugcaacaagaccagcaacggcagcgacagcugcgaccugaugugcugcggcagaggcuacaaccccuacaccgacagagugguggagagaugccacugcaaguaccacuggugcugcuacgugaccugcagaagaugcgagagaaccguggagagauacgugugcaaguaa

SEQ ID NO: 25679 - RNA, 1068 nt, Artificial Sequence
  WNT16__Homo_sapiens__NP_057171
augcagcugaccaccugccugagagagacccuguucaccggcgccagccagaagaccagccugugguggcugggcaucgccagcuucggcgugcccgagaagcugggcugcgccaaccugccccugaacagcagacagaaggagcugugcaagagaaagcccuaccugcugcccagcaucagagagggcgccagacugggcauccaggagugcggcagccaguucagacacgagagauggaacugcaugaucaccgccgccgccaccaccgcccccaugggcgccagcccccuguucggcuacgagcugagcagcggcaccaaggagaccgccuucaucuacgccgugauggccgccggccuggugcacagcgugaccagaagcugcagcgccggcaacaugaccgagugcagcugcgacaccacccugcagaacggcggcagcgccagcgagggcuggcacuggggcggcugcagcgacgacgugcaguacggcaugugguucagcagaaaguuccuggacuuccccaucggcaacaccaccggcaaggagaacaaggugcugcuggccaugaaccugcacaacaacgaggccggcagacaggccguggccaagcugaugagcguggacugcagaugccacggcgugagcggcagcugcgccgugaagaccugcuggaagaccaugagcagcuucgagaagaucggccaccugcugaaggacaaguacgagaacagcauccagaucagcgacaagaccaagagaaagaugagaagaagagagaaggaccagagaaagauccccauccacaaggacgaccugcuguacgugaacaagagccccaacuacugcguggaggacaagaagcugggcauccccggcacccagggcagagagugcaacagaaccagcgagggcgccgacggcugcaaccugcugugcugcggcagaggcuacaacacccacguggugagacacguggagagaugcgagugcaaguucaucuggugcugcuacgugagaugcagaagaugcgagagcaugaccgacgugcacaccugcaaguaa

SEQ ID NO: 25680 - RNA, 1113 nt, Artificial Sequence
  WNT1__Homo_sapiens__NP_005421
augggccugugggcccugcugcccggcugggugagcgccacccugcugcuggcccuggccgcccugcccgccgcccuggccgccaacagcagcggcagaugguggggcaucgugaacguggccagcagcaccaaccugcugaccgacagcaagagccugcagcuggugcuggagcccagccugcagcugcugagcagaaagcagagaagacugaucagacagaaccccggcauccugcacagcgugagcggcggccugcagagcgccgugagagagugcaaguggcaguucagaaacagaagauggaacugccccaccgcccccggcccccaccuguucggcaagaucgugaacagaggcugcagagagaccgccuucaucuucgccaucaccagcgccggcgugacccacagcguggccagaagcugcagcgagggcagcaucgagagcugcaccugcgacuacagaagaagaggccccggcggccccgacuggcacuggggcggcugcagcgacaacaucgacuucggcagacuguucggcagagaguucguggacagcggcgagaagggcagagaccugagauuccugaugaaccugcacaacaacgaggccggcagaaccaccguguucagcgagaugagacaggagugcaagugccacggcaugagcggcagcugcaccgugagaaccugcuggaugagacugcccacccugagagccgugggcgacgugcugagagacagauucgacggcgccagcagagugcuguacggcaacagaggcagcaacagagccagcagagccgagcugcugagacuggagcccgaggaccccgcccacaagccccccagcccccacgaccugguguacuucgagaagagccccaacuucugcaccuacagcggcagacugggcaccgccggcaccgccggcagagccugcaacagcagcagccccgcccuggacggcugcgagcugcugugcugcggcagaggccacagaaccagaacccagagagugaccgagagaugcaacugcaccuuccacuggugcugccacgugagcugcagaaacugcacccacaccagagugcugcacgagugccuguaa

SEQ ID NO: 25681 - RNA, 900 nt, Artificial Sequence
  WNT2B__Homo_sapiens__NP_001278809
augagaagcgugggcgagggcgccagagaguggaucagagagugccagcaccaguucagacaccacagauggaacugcaccacccuggacagagaccacaccguguucggcagagugaugcugagaagcagcagagaggccgccuucguguacgccaucagcagcgccggcguggugcacgccaucaccagagccugcagccagggcgagcugagcgugugcagcugcgaccccuacaccagaggcagacaccacgaccagagaggcgacuucgacuggggcggcugcagcgacaacauccacuacggcgugagauucgccaaggccuucguggacgccaaggagaagagacugaaggacgccagagcccugaugaaccugcacaacaacagaugcggcagaaccgccgugagaagauuccugaagcuggagugcaagugccacggcgugagcggcagcugcacccugagaaccugcuggagagcccugagcgacuucagaagaaccggcgacuaccugagaagaagauacgacggcgccgugcaggugauggccacccaggacggcgccaacuucaccgccgccagacagggcuacagaagagccaccagaaccgaccugguguacuucgacaacagccccgacuacugcgugcuggacaaggccgccggcagccugggcaccgccggcagagugugcagcaagaccagcaagggcaccgacggcugcgagaucaugugcugcggcagaggcuacgacaccaccagagugaccagagugacccagugcgagugcaaguuccacuggugcugcgccgugagaugcaaggagugcagaaacaccguggacgugcacaccugcaaggcccccaagaaggccgaguggcuggaccagaccuaa

SEQ ID NO: 25682 - RNA, 1083 nt, Artificial Sequence
  WNT2__Homo_sapiens__NP_003382
augaacgccccccugggcggcaucuggcuguggcugccccugcugcugaccuggcugacccccgaggugaacagcagcuggugguacaugagagccaccggcggcagcagcagagugaugugcgacaacgugcccggccuggugagcagccagagacagcugugccacagacaccccgacgugaugagagccaucagccagggcguggccgaguggaccgccgagugccagcaccaguucagacagcacagauggaacugcaacacccuggacagagaccacagccuguucggcagagugcugcugagaagcagcagagagagcgccuucguguacgccaucagcagcgccggcgugguguucgccaucaccagagccugcagccagggcgaggugaagagcugcagcugcgaccccaagaagaugggcagcgccaaggacagcaagggcaucuucgacuggggcggcugcagcgacaacaucgacuacggcaucaaguucgccagagccuucguggacgccaaggagagaaagggcaaggacgccagagcccugaugaaccugcacaacaacagagccggcagaaaggccgugaagagauuccugaagcaggagugcaagugccacggcgugagcggcagcugcacccugagaaccugcuggcuggccauggccgacuucagaaagaccggcgacuaccuguggagaaaguacaacggcgccauccagguggugaugaaccaggacggcaccggcuucaccguggccaacgagagauucaagaagcccaccaagaacgaccugguguacuucgagaacagccccgacuacugcaucagagacagagaggccggcagccugggcaccgccggcagagugugcaaccugaccagcagaggcauggacagcugcgaggugaugugcugcggcagaggcuacgacaccagccacgugaccagaaugaccaagugcggcugcaaguuccacuggugcugcgccgugagaugccaggacugccuggaggcccuggacgugcacaccugcaaggcccccaagaacgccgacuggaccaccgccaccuaa

SEQ ID NO: 25683 - RNA, 1059 nt, Artificial Sequence
  WNT3A__Homo_sapiens__NP_149122
auggccccccugggcuacuuccugcugcugugcagccugaagcaggcccugggcagcuaccccaucugguggagccuggccgugggcccccaguacagcagccugggcagccagcccauccugugcgccagcauccccggccuggugcccaagcagcugagauucugcagaaacuacguggagaucaugcccagcguggccgagggcaucaagaucggcauccaggagugccagcaccaguucagaggcagaagauggaacugcaccaccgugcacgacagccuggccaucuucggccccgugcuggacaaggccaccagagagagcgccuucgugcacgccaucgccagcgccggcguggccuucgccgugaccagaagcugcgccgagggcaccgccgccaucugcggcugcagcagcagacaccagggcagccccggcaagggcuggaaguggggcggcugcagcgaggacaucgaguucggcggcauggugagcagagaguucgccgacgccagagagaacagacccgacgccagaagcgccaugaacagacacaacaacgaggccggcagacaggccaucgccagccacaugcaccugaagugcaagugccacggccugagcggcagcugcgaggugaagaccugcugguggagccagcccgacuucagagccaucggcgacuuccugaaggacaaguacgacagcgccagcgagauggugguggagaagcacagagagagcagaggcuggguggagacccugagacccagauacaccuacuucaaggugcccaccgagagagaccugguguacuacgaggccagccccaacuucugcgagcccaaccccgagaccggcagcuucggcaccagagacagaaccugcaacgugagcagccacggcaucgacggcugcgaccugcugugcugcggcagaggccacaacgccagagccgagagaagaagagagaagugcagaugcguguuccacuggugcugcuacgugagcugccaggagugcaccagaguguacgacgugcacaccugcaaguaa

SEQ ID NO: 25684 - RNA, 1068 nt, Artificial Sequence
  WNT3__Homo_sapiens__NP_110380
auggagccccaccugcugggccugcugcugggccugcugcugggcggcaccagagugcuggccggcuaccccaucugguggagccuggcccugggccagcaguacaccagccugggcagccagccccugcugugcggcagcauccccggccuggugcccaagcagcugagauucugcagaaacuacaucgagaucaugcccagcguggccgagggcgugaagcugggcauccaggagugccagcaccaguucagaggcagaagauggaacugcaccaccaucgacgacagccuggccaucuucggccccgugcuggacaaggccaccagagagagcgccuucgugcacgccaucgccagcgccggcguggccuucgccgugaccagaagcugcgccgagggcaccagcaccaucugcggcugcgacagccaccacaagggcccccccggcgagggcuggaaguggggcggcugcagcgaggacgccgacuucggcgugcuggugagcagagaguucgccgacgccagagagaacagacccgacgccagaagcgccaugaacaagcacaacaacgaggccggcagaaccaccauccuggaccacaugcaccugaagugcaagugccacggccugagcggcagcugcgaggugaagaccugcuggugggcccagcccgacuucagagccaucggcgacuuccugaaggacaaguacgacagcgccagcgagauggugguggagaagcacagagagagcagaggcuggguggagacccugagagccaaguacagccuguucaagccccccaccgagagagaccugguguacuacgagaacagccccaacuucugcgagcccaaccccgagaccggcagcuucggcaccagagacagaaccugcaacgugaccagccacggcaucgacggcugcgaccugcugugcugcggcagaggccacaacaccagaaccgagaagagaaaggagaagugccacugcaucuuccacuggugcugcuacgugagcugccaggagugcaucagaaucuacgacgugcacaccugcaaguaa

SEQ ID NO: 25685 - RNA, 1122 nt, Artificial Sequence
  WNT4__Homo_sapiens__XP_011539899
augacccagcugacccccgcccccccccccgccagcagccagggcagccugugcagcacccagggcaagagaaacaagagacugcccagaacccugcccaaccagagaggcuacgagggcgaggacaccggccacauccccagauaccuggccaagcugagcagcgugggcagcaucagcgaggaggagaccugcgagaagcugaagggccugauccagagacaggugcagaugugcaagagaaaccuggaggugauggacagcgugagaagaggcgcccagcuggccaucgaggagugccaguaccaguucagaaacagaagauggaacugcagcacccuggacagccugcccguguucggcaagguggugacccagggcaccagagaggccgccuucguguacgccaucagcagcgccggcguggccuucgccgugaccagagccugcagcagcggcgagcuggagaagugcggcugcgacagaaccgugcacggcgugagcccccagggcuuccaguggagcggcugcagcgacaacaucgccuacggcguggccuucagccagagcuucguggacgugagagagagaagcaagggcgccagcagcagcagagcccugaugaaccugcacaacaacgaggccggcagaaaggccauccugacccacaugagaguggagugcaagugccacggcgugagcggcagcugcgaggugaagaccugcuggagagccgugccccccuucagacaggugggccacgcccugaaggagaaguucgacggcgccaccgagguggagcccagaagagugggcagcagcagagcccuggugcccagaaacgcccaguucaagccccacaccgacgaggaccugguguaccuggagcccagccccgacuucugcgagcaggacaugagaagcggcgugcugggcaccagaggcagaaccugcaacaagaccagcaaggccaucgacggcugcgagcugcugugcugcggcagaggcuuccacaccgcccagguggagcuggccgagagaugcagcugcaaguuccacuggugcugcuucgugaagugcagacagugccagagacugguggagcugcacaccugcagauaa

SEQ ID NO: 25686 - RNA, 1098 nt, Artificial Sequence
  WNT5A__Homo_sapiens__NP_001243034
auggccggcagcgccaugagcagcaaguucuuccugguggcccuggccaucuucuucagcuucgcccagguggugaucgaggccaacagcugguggagccugggcaugaacaaccccgugcagaugagcgagguguacaucaucggcgcccagccccugugcagccagcuggccggccugagccagggccagaagaagcugugccaccuguaccaggaccacaugcaguacaucggcgagggcgccaagaccggcaucaaggagugccaguaccaguucagacacagaagauggaacugcagcaccguggacaacaccagcguguucggcagagugaugcagaucggcagcagagagaccgccuucaccuacgccgugagcgccgccggcguggugaacgccaugagcagagccugcagagagggcgagcugagcaccugcggcugcagcagagccgccagacccaaggaccugcccagagacuggcuguggggcggcugcggcgacaacaucgacuacggcuacagauucgccaaggaguucguggacgccagagagagagagagaauccacgccaagggcagcuacgagagcgccagaauccugaugaaccugcacaacaacgaggccggcagaagaaccguguacaaccuggccgacguggccugcaagugccacggcgugagcggcagcugcagccugaagaccugcuggcugcagcuggccgacuucagaaaggugggcgacgcccugaaggagaaguacgacagcgccgccgccaugagacugaacagcagaggcaagcuggugcaggugaacagcagauucaacagccccaccacccaggaccugguguacaucgaccccagccccgacuacugcgugagaaacgagagcaccggcagccugggcacccagggcagacugugcaacaagaccagcgagggcauggacggcugcgagcugaugugcugcggcagaggcuacgaccaguucaagaccgugcagaccgagagaugccacugcaaguuccacuggugcugcuacgugaagugcaagaagugcaccgagaucguggaccaguucgugugcaaguaa

SEQ ID NO: 25687 - RNA, 1080 nt, Artificial Sequence
  WNT5B__Homo_sapiens__NP_110402
augcccagccugcugcugcuguucaccgccgcccugcugagcagcugggcccagcugcugaccgacgccaacagcugguggagccuggcccugaaccccgugcagagacccgagauguucaucaucggcgcccagcccgugugcagccagcugcccggccugagccccggccagagaaagcugugccagcuguaccaggagcacauggccuacaucggcgagggcgccaagaccggcaucaaggagugccagcaccaguucagacagagaagauggaacugcagcaccgccgacaacgccagcguguucggcagagugaugcagaucggcagcagagagaccgccuucacccacgccgugagcgccgccggcguggugaacgccaucagcagagccugcagagagggcgagcugagcaccugcggcugcagcagaaccgccagacccaaggaccugcccagagacuggcuguggggcggcugcggcgacaacguggaguacggcuacagauucgccaaggaguucguggacgccagagagagagagaagaacuucgccaagggcagcgaggagcagggcagagugcugaugaaccugcagaacaacgaggccggcagaagagccguguacaagauggccgacguggccugcaagugccacggcgugagcggcagcugcagccugaagaccugcuggcugcagcuggccgaguucagaaaggugggcgacagacugaaggagaaguacgacagcgccgccgccaugagagugaccagaaagggcagacuggagcuggugaacagcagauucacccagcccacccccgaggaccugguguacguggaccccagccccgacuacugccugagaaacgagagcaccggcagccugggcacccagggcagacugugcaacaagaccagcgagggcauggacggcugcgagcugaugugcugcggcagaggcuacaaccaguucaagagcgugcagguggagagaugccacugcaaguuccacuggugcugcuucgugagaugcaagaagugcaccgagaucguggaccaguacaucugcaaguaa

SEQ ID NO: 25688 - RNA, 1098 nt, Artificial Sequence
  WNT6__Homo_sapiens__NP_006513
augcugcccccccugcccagcagacugggccugcugcugcugcugcugcugugccccgcccacgugggcggccuguggugggccgugggcagcccccuggugauggaccccaccagcaucugcagaaaggccagaagacuggccggcagacaggccgagcugugccaggccgagcccgaggugguggccgagcuggccagaggcgccagacugggcgugagagagugccaguuccaguucagauucagaagauggaacugcagcagccacagcaaggccuucggcagaauccugcagcaggacaucagagagaccgccuucguguucgccaucaccgccgccggcgccagccacgccgugacccaggccugcagcaugggcgagcugcugcagugcggcugccaggcccccagaggcagagccccccccagacccagcggccugcccggcacccccggcccccccggccccgccggcagccccgagggcagcgccgccugggaguggggcggcugcggcgacgacguggacuucggcgacgagaagagcagacuguucauggacgccagacacaagagaggcagaggcgacaucagagcccuggugcagcugcacaacaacgaggccggcagacuggccgugagaagccacaccagaaccgagugcaagugccacggccugagcggcagcugcgcccugagaaccugcuggcagaagcugccccccuucagagaggugggcgccagacugcuggagagauuccacggcgccagcagagugaugggcaccaacgacggcaaggcccugcugcccgccgugagaacccugaagccccccggcagagccgaccugcuguacgccgccgacagccccgacuucugcgcccccaacagaagaaccggcagccccggcaccagaggcagagccugcaacagcagcgcccccgaccugagcggcugcgaccugcugugcugcggcagaggccacagacaggagagcgugcagcuggaggagaacugccugugcagauuccacuggugcugcguggugcagugccacagaugcagagugagaaaggagcugagccugugccuguaa

SEQ ID NO: 25689 - RNA, 1050 nt, Artificial Sequence
  WNT7A__Homo_sapiens__NP_004616
augaacagaaaggccagaagaugccugggccaccuguuccugagccugggcaugguguaccugagaaucggcggcuucagcagcgugguggcccugggcgccagcaucaucugcaacaagauccccggccuggcccccagacagagagccaucugccagagcagacccgacgccaucaucgugaucggcgagggcagccagaugggccuggacgagugccaguuccaguucagaaacggcagauggaacugcagcgcccugggcgagagaaccguguucggcaaggagcugaaggugggcagcagagaggccgccuucaccuacgccaucaucgccgccggcguggcccacgccaucaccgccgccugcacccagggcaaccugagcgacugcggcugcgacaaggagaagcagggccaguaccacagagacgagggcuggaaguggggcggcugcagcgccgacaucagauacggcaucggcuucgccaagguguucguggacgccagagagaucaagcagaacgccagaacccugaugaaccugcacaacaacgaggccggcagaaagauccuggaggagaacaugaagcuggagugcaagugccacggcgugagcggcagcugcaccaccaagaccugcuggaccacccugccccaguucagagagcugggcuacgugcugaaggacaaguacaacgaggccgugcacguggagcccgugagagccagcagaaacaagagacccaccuuccugaagaucaagaagccccugagcuacagaaagcccauggacaccgaccugguguacaucgagaagagccccaacuacugcgaggaggaccccgugaccggcagcgugggcacccagggcagagccugcaacaagaccgccccccaggccagcggcugcgaccugaugugcugcggcagaggcuacaacacccaccaguacgccagaguguggcagugcaacugcaaguuccacuggugcugcuacgugaagugcaacaccugcagcgagagaaccgagauguacaccugcaaguaa

SEQ ID NO: 25690 - RNA, 1050 nt, Artificial Sequence
  WNT7B__Homo_sapiens__NP_478679
augcacagaaacuucagaaaguggaucuucuacguguuccugugcuucggcgugcuguacgugaagcugggcgcccugagcagcgugguggcccugggcgccaacaucaucugcaacaagauccccggccuggcccccagacagagagccaucugccagagcagacccgacgccaucaucgugaucggcgagggcgcccagaugggcaucaacgagugccaguaccaguucagauucggcagauggaacugcagcgcccugggcgagaagaccguguucggccaggagcugagagugggcagcagagaggccgccuucaccuacgccaucaccgccgccggcguggcccacgccgugaccgccgccugcagccagggcaaccugagcaacugcggcugcgacagagagaagcagggcuacuacaaccaggccgagggcuggaaguggggcggcugcagcgccgacgugagauacggcaucgacuucagcagaagauucguggacgccagagagaucaagaagaacgccagaagacugaugaaccugcacaacaacgaggccggcagaaaggugcuggaggacagaaugcagcuggagugcaagugccacggcgugagcggcagcugcaccaccaagaccugcuggaccacccugcccaaguucagagaggugggccaccugcugaaggagaaguacaacgccgccgugcagguggagguggugagagccagcagacugagacagcccaccuuccugagaaucaagcagcugagaagcuaccagaagcccauggagaccgaccugguguacaucgagaagagccccaacuacugcgaggaggacgccgccaccggcagcgugggcacccagggcagacugugcaacagaaccagccccggcgccgacggcugcgacaccaugugcugcggcagaggcuacaacacccaccaguacaccaagguguggcagugcaacugcaaguuccacuggugcugcuucgugaagugcaacaccugcagcgagagaaccgagguguucaccugcaaguaa

SEQ ID NO: 25691 - RNA, 1056 nt, Artificial Sequence
  WNT8A__Homo_sapiens__NP_490645
augggcaaccuguucaugcugugggccgcccugggcaucugcugcgccgccuucagcgccagcgccuggagcgugaacaacuuccugaucaccggccccaaggccuaccugaccuacaccaccagcguggcccugggcgcccagagcggcaucgaggagugcaaguuccaguucgccugggagagauggaacugccccgagaacgcccugcagcugagcacccacaacagacugagaagcgccaccagagagaccagcuucauccacgccaucagcagcgccggcgugauguacaucaucaccaagaacugcagcaugggcgacuucgagaacugcggcugcgacggcagcaacaacggcaagaccggcggccacggcuggaucuggggcggcugcagcgacaacguggaguucggcgagagaaucagcaagcuguucguggacagccuggagaagggcaaggacgccagagcccugaugaaccugcacaacaacagagccggcagacuggccgugagagccaccaugaagagaaccugcaagugccacggcaucagcggcagcugcagcauccagaccugcuggcugcagcuggccgaguucagagagaugggcgacuaccugaaggccaaguacgaccaggcccugaagaucgagauggacaagagacagcugagagccggcaacagcgccgagggccacugggugcccgccgaggccuuccugcccagcgccgaggccgagcugaucuuccuggaggagagccccgacuacugcaccugcaacagcagccugggcaucuacggcaccgagggcagagagugccugcagaacagccacaacaccagcagaugggagagaagaagcugcggcagacugugcaccgagugcggccugcagguggaggagagaaagaccgaggugaucagcagcugcaacugcaaguuccaguggugcugcaccgugaagugcgaccagugcagacacguggugagcaaguacuacugcgccagaagccccggcagcgcccagagccugggcaagggcagcgccuaa

SEQ ID NO: 25692 - RNA, 1056 nt, Artificial Sequence
  WNT8B__Homo_sapiens__NP_003384
auguuccugagcaagcccagcguguacaucugccuguucaccugcgugcugcagcugagccacagcuggagcgugaacaacuuccugaugaccggccccaaggccuaccugaucuacagcagcagcguggccgccggcgcccagagcggcaucgaggagugcaaguaccaguucgccugggacagauggaacugccccgagagagcccugcagcugagcagccacggcggccugagaagcgccaacagagagaccgccuucgugcacgccaucagcagcgccggcgugauguacacccugaccagaaacugcagccugggcgacuucgacaacugcggcugcgacgacagcagaaacggccagcugggcggccagggcuggcuguggggcggcugcagcgacaacgugggcuucggcgaggccaucagcaagcaguucguggacgcccuggagaccggccaggacgccagagccgccaugaaccugcacaacaacgaggccggcagaaaggccgugaagggcaccaugaagagaaccugcaagugccacggcgugagcggcagcugcaccacccagaccugcuggcugcagcugcccgaguucagagaggugggcgcccaccugaaggagaaguaccacgccgcccugaagguggaccugcugcagggcgccggcaacagcgccgccggcagaggcgccaucgccgacaccuucagaagcaucagcaccagagagcuggugcaccuggaggacagccccgacuacugccuggagaacaagacccugggccugcugggcaccgagggcagagagugccugagaagaggcagagcccugggcagaugggagagaagaagcugcagaagacugugcggcgacugcggccuggccguggaggagagaagagccgagaccgugagcagcugcaacugcaaguuccacuggugcugcgccgugagaugcgagcagugcagaagaagagugaccaaguacuucugcagcagagccgagagacccagaggcggcgccgcccacaagcccggcagaaagcccuaa

SEQ ID NO: 25693 - RNA, 1098 nt, Artificial Sequence
  WNT9A__Homo_sapiens__NP_003386
augcuggacggcagcccccuggccagauggcuggccgccgccuucggccugacccugcugcuggccgcccugagacccagcgccgccuacuucggccugaccggcagcgagccccugaccauccugccccugacccuggagcccgaggccgccgcccaggcccacuacaaggccugcgacagacugaagcuggagagaaagcagagaagaaugugcagaagagaccccggcguggccgagacccugguggaggccgugagcaugagcgcccuggagugccaguuccaguucagauucgagagauggaacugcacccuggagggcagauacagagccagccugcugaagagaggcuucaaggagaccgccuuccuguacgccaucagcagcgccggccugacccacgcccuggccaaggccugcagcgccggcagaauggagagaugcaccugcgacgaggcccccgaccuggagaacagagaggccuggcaguggggcggcugcggcgacaaccugaaguacagcagcaaguucgugaaggaguuccugggcagaagaagcagcaaggaccugagagccagaguggacuuccacaacaaccuggugggcgugaaggugaucaaggccggcguggagaccaccugcaagugccacggcgugagcggcagcugcaccgugagaaccugcuggagacagcuggcccccuuccacgaggugggcaagcaccugaagcacaaguacgagaccgcccugaaggugggcagcaccaccaacgaggccgccggcgaggccggcgccaucagcccccccagaggcagagccagcggcgccggcggcagcgacccccugcccagaacccccgagcuggugcaccuggacgacagccccagcuucugccuggccggcagauucagccccggcaccgccggcagaagaugccacagagagaagaacugcgagagcaucugcugcggcagaggccacaacacccagagcagaguggugaccagacccugccagugccaggugagauggugcugcuacguggagugcagacagugcacccagagagaggagguguacaccugcaagggcuaa

SEQ ID NO: 25694 - RNA, 1074 nt, Artificial Sequence
  WNT9B__Homo_sapiens__NP_003387
augagacccccccccgcccuggcccuggccggccugugccugcuggcccugcccgccgccgccgccagcuacuucggccugaccggcagagaggugcugacccccuuccccggccugggcaccgccgccgcccccgcccagggcggcgcccaccugaagcagugcgaccugcugaagcugagcagaagacagaagcagcugugcagaagagagcccggccuggccgagacccugagagacgccgcccaccugggccugcuggagugccaguuccaguucagacacgagagauggaacugcagccuggagggcagaaugggccugcugaagagaggcuucaaggagaccgccuuccuguacgccgugagcagcgccgcccugacccacacccuggccagagccugcagcgccggcagaauggagagaugcaccugcgacgacagccccggccuggagagcagacaggccuggcaguggggcgugugcggcgacaaccugaaguacagcaccaaguuccugagcaacuuccugggcagcaagagaggcaacaaggaccugagagccagagccgacgcccacaacacccacgugggcaucaaggccgugaagagcggccugagaaccaccugcaagugccacggcgugagcggcagcugcgccgugagaaccugcuggaagcagcugagccccuucagagagaccggccaggugcugaagcugagauacgacagcgccgugaaggugagcagcgccaccaacgaggcccugggcagacuggagcugugggcccccgccagacagggcagccugaccaagggccuggcccccagaagcggcgaccugguguacauggaggacagccccagcuucugcagacccagcaaguacagccccggcaccgccggcagagugugcagcagagaggccagcugcagcagccugugcugcggcagaggcuacgacacccagagcagacugguggccuucagcugccacugccaggugcaguggugcugcuacguggagugccagcagugcgugcaggaggagcugguguacaccugcaagcacuaa

SEQ ID NO: 25695 - RNA, 1647 nt, Artificial Sequence
  WRAP53__Homo_sapiens__NP_001137462
augaagacccuggagacccagccccuggcccccgacugcugccccagcgaccaggaccccgcccccgcccaccccagcccccacgccagccccaugaacaagaacgccgacagcgagcugaugccccccccccccgagagaggcgacccccccagacugagccccgaccccguggccggcagcgccgugagccaggagcugagagagggcgaccccgugagccugagcaccccccuggagaccgaguucggcagccccagcgagcugagccccagaaucgaggagcaggagcugagcgagaacaccagccugcccgccgaggaggccaacggcagccugagcgaggaggaggccaacggccccgagcugggcagcggcaaggccauggaggacaccagcggcgagcccgccgccgaggacgagggcgacaccgccuggaacuacagcuucagccagcugcccagauuccugagcggcagcuggagcgaguucagcacccagcccgagaacuuccugaagggcugcaagugggcccccgacggcagcugcauccugaccaacagcgccgacaacauccugagaaucuacaaccugccccccgagcuguaccacgagggcgagcagguggaguacgccgagauggugcccgugcugagaaugguggagggcgacaccaucuacgacuacugcugguacagccugaugagcagcgcccagcccgacaccagcuacguggccagcagcagcagagagaaccccauccacaucugggacgccuucaccggcgagcugagagccagcuucagagccuacaaccaccuggacgagcugaccgccgcccacagccugugcuucagccccgacggcagccagcuguucugcggcuucaacagaaccgugagaguguucagcaccgccagacccggcagagacugcgaggugagagccaccuucgccaagaagcagggccagagcggcaucaucagcugcaucgccuucagccccgcccagccccuguacgccugcggcagcuacggcagaagccugggccuguacgccugggacgacggcagcccccuggcccugcugggcggccaccagggcggcaucacccaccugugcuuccaccccgacggcaacagauucuucagcggcgccagaaaggacgccgagcugcugugcugggaccugagacagagcggcuacccccuguggagccugggcagagaggugaccaccaaccagagaaucuacuucgaccuggaccccaccggccaguuccuggugagcggcagcaccagcggcgccgugagcgugugggacaccgacggccccggcaacgacggcaagcccgagcccgugcugagcuuccugccccagaaggacugcaccaacggcgugagccugcaccccagccugccccugcuggccaccgccagcggccagagaguguuccccgagcccaccgagagcggcgacgagggcgaggagcugggccugccccugcugagcaccagacacgugcaccuggagugcagacugcagcugugguggugcggcggcgcccccgacagcagcauccccgacgaccaccagggcgagaagggccagggcggcaccgagggcggcgugggcgagcugaucuaa

SEQ ID NO: 25696 - RNA, 423 nt, Artificial Sequence
  WRB__Homo_sapiens__NP_001139690
augagcagagugcugcagaaggacgccgagcaggagagccagaugagagccgagauccaggacaugaagcaggagcugagcaccgugaacaugauggacgaguucgccagauacgccagacuggagagaaagaucaacaagaugaccgacaagcugaagacccacgugaaggccagaaccgcccagcuggccaagaucaagugggugaucagcguggccuucuacgugcugcaggccgcccugaugaucagccugaucuggaaguacuacagcgugcccguggccguggugcccagcaaguggaucaccccccuggacagacugguggccuuccccaccagaguggccggcggcgugggcaucaccugcuggauccuggugugcaacaaggugguggccaucgugcugcaccccuucagcuaa

SEQ ID NO: 25697 - RNA, 4299 nt, Artificial Sequence
  WRN__Homo_sapiens__NP_000544
augagcgagaagaagcuggagaccaccgcccagcagagaaagugccccgaguggaugaacgugcagaacaagagaugcgccguggaggagagaaaggccugcgugagaaagagcguguucgaggacgaccugcccuuccuggaguucaccggcagcaucguguacagcuacgacgccagcgacugcagcuuccugagcgaggacaucagcaugagccugagcgacggcgacguggugggcuucgacauggaguggcccccccuguacaacagaggcaagcugggcaagguggcccugauccagcugugcgugagcgagagcaagugcuaccuguuccacgugagcagcaugagcguguucccccagggccugaagaugcugcuggagaacaaggccgugaagaaggccggcgugggcaucgagggcgaccaguggaagcugcugagagacuucgacaucaagcugaagaacuucguggagcugaccgacguggccaacaagaagcugaagugcaccgagaccuggagccugaacagccuggugaagcaccugcugggcaagcagcugcugaaggacaagagcaucagaugcagcaacuggagcaaguucccccugaccgaggaccagaagcuguacgccgccaccgacgccuacgccggcuucaucaucuacagaaaccuggagauccuggacgacaccgugcagagauucgccaucaacaaggaggaggagauccugcugagcgacaugaacaagcagcugaccagcaucagcgaggaggugauggaccuggccaagcaccugccccacgccuucagcaagcuggagaaccccagaagagugagcauccugcugaaggacaucagcgagaaccuguacagccugagaagaaugaucaucggcagcaccaacaucgagaccgagcugagacccagcaacaaccugaaccugcugagcuucgaggacagcaccaccggcggcgugcagcagaagcagaucagagagcacgaggugcugauccacguggaggacgagaccugggaccccacccuggaccaccuggccaagcacgacggcgaggacgugcugggcaacaagguggagagaaaggaggacggcuucgaggacggcguggaggacaacaagcugaaggagaacauggagagagccugccugaugagccuggacaucaccgagcacgagcugcagauccuggagcagcagagccaggaggaguaccugagcgacaucgccuacaagagcaccgagcaccugagccccaacgacaacgagaacgacaccagcuacgugaucgagagcgacgaggaccuggagauggagaugcugaagcaccugagccccaacgacaacgagaacgacaccagcuacgugaucgagagcgacgaggaccuggagauggagaugcugaagagccuggagaaccugaacagcggcaccguggagcccacccacagcaagugccugaagauggagagaaaccugggccugcccaccaaggaggaggaggaggacgacgagaacgaggccaacgagggcgaggaggacgacgacaaggacuuccuguggcccgcccccaacgaggagcaggugaccugccugaagauguacuucggccacagcagcuucaagcccgugcaguggaaggugauccacagcgugcuggaggagagaagagacaacguggccgugauggccaccggcuacggcaagagccugugcuuccaguacccccccguguacgugggcaagaucggccuggugaucagcccccugaucagccugauggaggaccaggugcugcagcugaagaugagcaacauccccgccugcuuccugggcagcgcccagagcgagaacgugcugaccgacaucaagcugggcaaguacagaaucguguacgugacccccgaguacugcagcggcaacaugggccugcugcagcagcuggaggccgacaucggcaucacccugaucgccguggacgaggcccacugcaucagcgaguggggccacgacuucagagacagcuucagaaagcugggcagccugaagaccgcccugcccauggugcccaucguggcccugaccgccaccgccagcagcagcaucagagaggacaucgugagaugccugaaccugagaaacccccagaucaccugcaccggcuucgacagacccaaccuguaccuggaggugagaagaaagaccggcaacauccugcaggaccugcagcccuuccuggugaagaccagcagccacugggaguucgagggccccaccaucaucuacugccccagcagaaagaugacccagcaggugaccggcgagcugagaaagcugaaccugagcugcggcaccuaccacgccggcaugagcuucagcaccagaaaggacauccaccacagauucgugagagacgagauccagugcgugaucgccaccaucgccuucggcaugggcaucaacaaggccgacaucagacaggugauccacuacggcgcccccaaggacauggagagcuacuaccaggagaucggcagagccggcagagacggccugcagagcagcugccacgugcugugggcccccgccgacaucaaccugaacagacaccugcugaccgagaucagaaacgagaaguucagacuguacaagcugaagaugauggccaagauggagaaguaccugcacagcagcagaugcagaagacagaucauccugagccacuucgaggacaagcaggugcagaaggccagccugggcaucaugggcaccgagaagugcugcgacaacugcagaagcagacuggaccacugcuacagcauggacgacagcgaggacaccagcugggacuucggcccccaggccuucaagcugcugagcgccguggacauccugggcgagaaguucggcaucggccugcccauccuguuccugagaggcagcaacagccagagacuggccgaccaguacagaagacacagccuguucggcaccggcaaggaccagaccgagagcugguggaaggccuucagcagacagcugaucaccgagggcuuccugguggaggugagcagauacaacaaguucaugaagaucugcgcccugaccaagaagggcagaaacuggcugcacaaggccaacaccgagagccagagccugauccugcaggccaacgaggagcugugccccaagaagcugcugcugcccagcagcaagaccgugagcagcggcaccaaggagcacugcuacaaccaggugcccguggagcugagcaccgagaagaagagcaaccuggagaagcuguacagcuacaagcccugcgacaagaucagcagcggcagcaacaucagcaagaagagcaucauggugcagagccccgagaaggccuacagcagcagccagcccgugaucagcgcccaggagcaggagacccagaucgugcuguacggcaagcugguggaggccagacagaagcacgccaacaagauggacgugccccccgccauccuggccaccaacaagauccugguggacauggccaagaugagacccaccaccguggagaacgugaagagaaucgacggcgugagcgagggcaaggccgccaugcuggccccccugcuggaggugaucaagcacuucugccagaccaacagcgugcagaccgaccuguucagcagcaccaagccccaggaggagcagaagaccagccugguggccaagaacaagaucugcacccugagccagagcauggccaucaccuacagccuguuccaggagaagaagaugccccugaagagcaucgccgagagcagaauccugccccugaugaccaucggcaugcaccugagccaggccgugaaggccggcugcccccuggaccuggagagagccggccugacccccgaggugcagaagaucaucgccgacgugaucagaaacccccccgugaacagcgacaugagcaagaucagccugaucagaaugcuggugcccgagaacaucgacaccuaccugauccacauggccaucgagauccugaagcacggccccgacagcggccugcagcccagcugcgacgugaacaagagaagaugcuuccccggcagcgaggagaucugcagcagcagcaagagaagcaaggaggaggugggcaucaacaccgagaccagcagcgccgagagaaagagaagacugcccgugugguucgccaagggcagcgacaccagcaagaagcugauggacaagaccaagagaggcggccuguucagcuaa

SEQ ID NO: 25698 - RNA, 1998 nt, Artificial Sequence
  WRNIP1__Homo_sapiens__NP_064520
auggaggugagcggccccgaggacgaccccuuccugagccagcugcaccaggugcagugccccgugugccagcagaugaugcccgccgcccacaucaacagccaccuggacagaugccugcugcugcaccccgccggccacgccgagcccgccgccggcagccacagagccggcgagagagccaagggccccagcccccccggcgccaagagaagaagacugagcgagagcagcgcccugaagcagcccgccacccccaccgccgccgagagcagcgagggcgagggcgaggagggcgacgacggcggcgagaccgagagcagagagagcuacgacgccccccccacccccagcggcgccagacugauccccgacuuccccguggccagaagcagcagccccggcagaaagggcagcggcaagagacccgccgccgccgccgccgccggcagcgccagccccagaagcugggacgaggccgaggcccaggaggaggaggaggccgugggcgacggcgacggcgacggcgacgccgacgccgacggcgaggacgaccccggccacugggacgccgacgccgccgaggccgccaccgccuucggcgccagcggcggcggcagaccccaccccagagcccuggccgccgaggagaucagacagaugcugcagggcaagccccuggccgacaccaugagacccgacacccugcaggacuacuucggccagagcaaggccgugggccaggacacccugcugagaagccugcuggagaccaacgagauccccagccugauccuguggggcccccccggcugcggcaagaccacccuggcccacaucaucgccagcaacagcaagaagcacagcaucagauucgugacccugagcgccaccaacgccaagaccaacgacgugagagacgugaucaagcaggcccagaacgagaagagcuucuucaagagaaagaccauccuguucaucgacgagauccacagauucaacaagagccagcaggacaccuuccugccccacguggagugcggcaccaucacccugaucggcgccaccaccgagaaccccagcuuccaggugaacgccgcccugcugagcagaugcagagugaucgugcuggagaagcugcccguggaggccauggugaccauccugaugagagccaucaacagccugggcauccacgugcuggacagcagcagacccaccgacccccugagccacagcagcaacagcagcagcgagcccgccauguucaucgaggacaaggccguggacacccuggccuaccugagcgacggcgacgccagagccggccugaacggccugcagcuggccgugcuggccagacugagcagcagaaagauguucugcaagaagagcggccagagcuacagccccagcagagugcugaucaccgagaacgacgugaaggagggccugcagagaagccacauccuguacgacagagccggcgaggagcacuacaacugcaucagcgcccugcacaagagcaugagaggcagcgaccagaacgccagccuguacuggcuggccagaaugcuggagggcggcgaggacccccuguacguggccagaagacuggugagauucgccagcgaggacaucggccuggccgaccccagcgcccugacccaggccguggccgccuaccagggcugccacuucaucggcaugcccgagugcgaggugcugcuggcccagugcgugguguacuucgccagagcccccaagagcaucgagguguacagcgccuacaacaacgugaaggccugccugagaaaccaccagggcccccugccccccgugccccugcaccugagaaacgcccccaccagacugaugaaggaccugggcuacggcaagggcuacaaguacaaccccauguacagcgagcccguggaccaggaguaccugcccgaggagcugagaggcguggacuucuucaagcagagaagaugcuaa

SEQ ID NO: 25699 - RNA, 1266 nt, Artificial Sequence
  WSB1__Homo_sapiens__NP_056441
auggccagcuucccccccagagugaacgagaaggagaucgugagacugagaaccaucggcgagcugcuggcccccgccgcccccuucgacaagaagugcggcagagagaacuggaccguggccuucgcccccgacggcagcuacuucgccuggagccagggccacagaaccgugaagcuggugcccuggagccagugccugcagaacuuccugcugcacggcaccaagaacgugaccaacagcagcagccugagacugcccagacagaacagcgacggcggccagaagaacaagcccagagagcacaucaucgacugcggcgacaucguguggagccuggccuucggcagcagcgugcccgagaagcagagcagaugcgugaacaucgaguggcacagauucagauucggccaggaccagcugcugcuggccaccggccugaacaacggcagaaucaagaucugggacguguacaccggcaagcugcugcugaaccugguggaccacaccgagguggugagagaccugaccuucgcccccgacggcagccugauccuggugagcgccagcagagacaagacccugagagugugggaccugaaggacgacggcaacaugaugaaggugcugagaggccaccagaacuggguguacagcugcgccuucagccccgacagcagcaugcugugcagcgugggcgccagcaaggccguguuccuguggaacauggacaaguacaccaugaucagaaagcuggagggccaccaccacgacgugguggccugcgacuucagccccgacggcgcccugcuggccaccgccagcuacgacaccagaguguacaucugggacccccacaacggcgacauccugauggaguucggccaccuguuccccccccccacccccaucuucgccggcggcgccaacgacagaugggugagaagcgugagcuucagccacgacggccugcacguggccagccuggccgacgacaagauggugagauucuggagaaucgacgaggacuaccccgugcagguggccccccugagcaacggccugugcugcgccuucagcaccgacggcagcgugcuggccgccggcacccacgacggcagcguguacuucugggccacccccagacaggugcccagccugcagcaccugugcagaaugagcaucagaagagugaugcccacccaggaggugcaggagcugcccauccccagcaagcugcuggaguuccugagcuacagaaucuaa

SEQ ID NO: 25700 - RNA, 1728 nt, Artificial Sequence
  WSCD1__Homo_sapiens__NP_056068
auggccaagcccuucuucagacugcagaaguuccugagaagaacccaguuccugcuguucuuccugaccgccgccuaccugaugaccggcagccugcugcugcugcagagagugagaguggcccugccccagggccccagagcccccggcccccugcagacccugcccguggccgccguggcccugggcgugggccugcuggacagcagagcccugcacgaccccagagugagccccgagcugcugcugggcguggacaugcugcagagcccccugaccagacccagacccggccccagauggcugagaagcagaaacagcgagcugagacagcugagaagaagaugguuccaccacuucaugagcgacagccagggcccccccgcccugggccccgaggccgccagacccgccauccacagcagaggcaccuacaucggcugcuucagcgacgacggccacgagagaacccugaagggcgccguguucuacgaccugagaaagaugaccgugagccacugccaggacgccugcgccgagagaagcuacguguacgccggccuggaggccggcgccgagugcuacugcggcaacagacugcccgccgugagcgugggccuggaggagugcaaccacgagugcaagggcgagaagggcagcgugugcggcgccguggacagacugagcguguacagaguggacgagcugcagcccggcagcagaaagagaagaaccgccaccuacagaggcugcuucagacugcccgagaacaucacccacgccuuccccagcagccugauccaggccaacgugaccgugggcaccugcagcggcuucugcagccagaaggaguucccccuggccauccugagaggcugggagugcuacugcgccuaccccacccccagauucaaccugagagacgccauggacagcagcgugugcggccaggaccccgaggcccagagacuggccgaguacugcgagguguaccagacccccgugcaggacaccagaugcaccgacagaagauuccugcccaacaagagcaagguguucguggcccugagcagcuuccccggcgccggcaacaccugggccagacaccugaucgagcacgccaccggcuucuacaccggcagcuacuacuucgacggcacccuguacaacaagggcuucaagggcgagaaggaccacuggagaagcagaagaaccaucugcgugaagacccacgagagcggcagaagagagaucgagauguucgacagcgccauccugcugaucagaaaccccuacagaagccugguggccgaguucaacagaaagugcgccggccaccugggcuacgccgccgacagaaacuggaagagcaaggaguggcccgacuucgugaacagcuacgccagcugguggagcagccacgugcuggacuggcugaaguacggcaagagacugcugguggugcacuacgaggagcugagaagaagccuggugcccacccugagagagaugguggccuuccugaacgugagcgugagcgaggagagacugcugugcguggagaacaacaaggagggcagcuucagaagaagaggcagaagaagccacgaccccgagcccuucacccccgagaugaaggaccugaucaacggcuacaucagaaccguggaccaggcccugagagaccacaacuggaccggccugcccagagaguacgugcccagauaa

SEQ ID NO: 25701 - RNA, 1698 nt, Artificial Sequence
  WSCD2__Homo_sapiens__NP_001291376
auggccaagcugugguucaaguuccagagauacuucagaagaaagcccgugagauucuucaccuuccuggcccuguaccugaccgccggcagccugguguuccugcacagcggcuucgugggccagcccgccgugagcggcaaccaggccaaccccgccgccgccggcggccccgccgagggcgccgagcugagcuuccugggcgacaugcaccugggcagaggcuucagagacaccggcgaggccagcagcaucgccagaagauacggccccugguucaagggcaaggacggcaacgagagagccaagcugggcgacuacggcggcgccuggagcagagcccugaagggcagaguggugagagagaaggaggaggagagagccaaguacaucggcugcuaccuggacgacacccagagcagagcccugagaggcgugagcuucuucgacuacaagaagaugaccaucuucagaugccaggacaacugcgccgagagaggcuaccuguacggcggccuggaguucggcgccgagugcuacugcggccacaagauccaggccaccaacgugagcgaggccgagugcgacauggagugcaagggcgagagaggcagcgugugcggcggcgccaacagacugagcguguacagacugcagcuggcccaggagagcgccagaagauacggcagcgccguguucagaggcugcuucagaagacccgacaaccugagccuggcccugcccgugaccgccgccaugcugaacaugagcguggacaagugcguggacuucugcaccgagaaggaguacccccuggccgcccuggccggcaccgccugccacugcggcuuccccaccaccagauucccccugcacgacagagaggacgagcagcugugcgcccagaagugcagcgccgaggaguucgagagcugcggcacccccagcuacuucaucguguaccagacccaggugcaggacaacagaugcauggacagaagauuccugcccggcaagagcaagcagcugaucgcccuggccagcuuccccggcgccggcaacaccugggccagacaccugaucgagcuggccaccggcuucuacaccggcagcuacuacuucgacggcagccuguacaacaagggcuucaagggcgagagagaccacuggagaagcggcagaaccaucugcaucaagacccacgagagcggccagaaggagaucgaggccuucgacgccgccauccugcugaucagaaaccccuacaaggcccugauggccgaguucaacagaaaguacggcggccacaucggcuucgccgcccacgcccacuggaagggcaaggaguggcccgaguucgugagaaacuacgcccccuggugggccacccacacccuggacuggcugaaguucggcaagaaggugcugguggugcacuucgaggaccugaagcaggaccuguucgugcagcugggcagaauggugagccugcugggcguggccgugagagaggacagacugcugugcguggagagccagaaggacggcaacuucaagagaagcggccugagaaagcuggaguacgaccccuacaccgccgacaugcagaagaccaucagcgccuacaucaagaugguggacgccgcccugaagggcagaaaccugaccggcgugcccgacgacuacuaccccagauaa

SEQ ID NO: 25702 - RNA, 1494 nt, Artificial Sequence
  WT1__Homo_sapiens__NP_000369
augcaggaccccgccagcaccugcgugcccgagcccgccagccagcacacccugagaagcggccccggcugccugcagcagcccgagcagcagggcgugagagaccccggcggcaucugggccaagcugggcgccgccgaggccagcgccgagagacugcagggcagaagaagcagaggcgccagcggcagcgagccccagcagaugggcagcgacgugagagaccugaacgcccugcugcccgccgugcccagccugggcggcggcggcggcugcgcccugcccgugagcggcgccgcccagugggcccccgugcuggacuucgccccccccggcgccagcgccuacggcagccugggcggccccgcccccccccccgccccccccccccccccccccccccccccccacagcuucaucaagcaggagcccagcuggggcggcgccgagccccacgaggagcagugccugagcgccuucaccgugcacuucagcggccaguucaccggcaccgccggcgccugcagauacggccccuucggcccccccccccccagccaggccagcagcggccaggccagaauguuccccaacgcccccuaccugcccagcugccuggagagccagcccgccaucagaaaccagggcuacagcaccgugaccuucgacggcacccccagcuacggccacacccccagccaccacgccgcccaguuccccaaccacagcuucaagcacgaggaccccaugggccagcagggcagccugggcgagcagcaguacagcgugcccccccccguguacggcugccacacccccaccgacagcugcaccggcagccaggcccugcugcugagaacccccuacagcagcgacaaccuguaccagaugaccagccagcuggagugcaugaccuggaaccagaugaaccugggcgccacccugaagggccacagcaccggcuacgagagcgacaaccacaccacccccauccugugcggcgcccaguacagaauccacacccacggcguguucagaggcauccaggacgugagaagagugcccggcguggcccccacccuggugagaagcgccagcgagaccagcgagaagagacccuucaugugcgccuaccccggcugcaacaagagauacuucaagcugagccaccugcagaugcacagcagaaagcacaccggcgagaagcccuaccagugcgacuucaaggacugcgagagaagauucagcagaagcgaccagcugaagagacaccagagaagacacaccggcgugaagcccuuccagugcaagaccugccagagaaaguucagcagaagcgaccaccugaagacccacaccagaacccacaccggcgagaagcccuucagcugcagauggcccagcugccagaagaaguucgccagaagcgacgagcuggugagacaccacaacaugcaccagagaaacaugaccaagcugcagcuggcccuguaa

SEQ ID NO: 25703 - RNA, 1191 nt, Artificial Sequence
  WTAP__Homo_sapiens__NP_001257460
augaccaacgaggagccccugcccaagaaggugagacugagcgagaccgacuucaaggugauggccagagacgagcugauccugagauggaagcaguacgaggccuacgugcaggcccuggagggcaaguacaccgaccugaacagcaacgacgugaccggccugagagagagcgaggagaagcugaagcagcagcagcaggagagcgccagaagagagaacauccuggugaugagacuggccaccaaggagcaggagaugcaggagugcaccacccagauccaguaccugaagcaggugcagcagcccagcguggcccagcugagaagcaccaugguggaccccgccaucaaccuguucuuccugaagaugaagggcgagcuggagcagaccaaggacaagcuggagcaggcccagaacgagcugagcgccuggaaguucacccccgacagccagaccggcaagaagcugauggccaagugcagaaugcugauccaggagaaccaggagcugggcagacagcugagccagggcagaaucgcccagcuggaggccgagcuggcccugcagaagaaguacagcgaggagcugaagagcagccaggacgagcugaacgacuucaucauccagcuggacgaggagguggagggcaugcagagcaccauccuggugcugcagcagcagcugaaggagaccagacagcagcuggcccaguaccagcagcagcagagccaggccagcgcccccagcaccagcagaaccaccgccagcgagcccguggagcagagcgaggccaccagcaaggacugcagcagacugaccaacggccccagcaacggcagcagcagcagacagagaaccagcggcagcggcuuccacagagagggcaacaccaccgaggacgacuuccccagcagccccggcaacggcaacaagagcagcaacagcagcgaggagagaaccggcagaggcggcagcggcuacgugaaccagcugagcgccggcuacgagagcguggacagccccaccggcagcgagaacagccugacccaccagagcaacgacaccgacagcagccacgacccccaggaggagaaggccgugagcggcaagggcaacagaaccgugggcagcagacacgugcagaacggccuggacagcagcgugaacgugcagggcagcgugcuguaa

SEQ ID NO: 25704 - RNA, 1293 nt, Artificial Sequence
  WTIP__Homo_sapiens__NP_001073905
augcagagaagcagagccggcgccgacgaggccgcccugcugcuggccggccuggcccugagagagcuggagcccggcugcggcagccccggcagaggcagaagaggccccagacccggccccggcgacgaggccgcccccgcccugggcagaagaggcaagggcagcggcggccccgaggccggcgccgacggccugagcagaggcgagagaggccccagaagagccgccgugcccgagcugagcgcccagcccgccggcagccccagagccagccuggccggcagcgacggcggcggcggcggcggcagcgccagaagcagcggcaucagccugggcuacgaccagagacacggcagccccagaagcggcagaagcgaccccagacccggccccggcccccccagcgugggcagcgccagaagcagcgugagcagccugggcagcagaggcagcgccggcgccuacgccgacuuccugccccccggcgccugccccgcccccgccagaagccccgagcccgccggccccgcccccuucccccugcccgcccugccccugccccccggcagagagggcggccccagcgccgccgagagaagacuggaggcccugaccagagagcuggagagagcccuggaggccagaaccgccagagacuacuucggcaucugcaucaagugcggccugggcaucuacggcgcccagcaggccugccaggccaugggcagccuguaccacaccgacugcuucaccugcgacagcugcggcagaagacugagaggcaaggccuucuacaacgugggcgagaagguguacugccaggaggacuuccuguacagcggcuuccagcagaccgccgacaagugcagcgugugcggccaccugaucauggagaugauccugcaggcccugggcaagagcuaccaccccggcugcuucagaugcagcgugugcaacgagugccuggacggcgugcccuucaccguggacguggagaacaacaucuacugcgugagagacuaccacaccguguucgcccccaagugcgccagcugcgccagacccauccugcccgcccagggcugcgagaccaccaucagaguggugagcauggacagagacuaccacguggccugcuaccacugcgaggacugcggccugcagcugagcggcgaggagggcagaagaugcuacccccuggccggccaccugcugugcagaagaugccaccugagaagacugcagcccggcccccugcccagccccaccgugcacgugaccgagcuguaa

SEQ ID NO: 25705 - RNA, 3360 nt, Artificial Sequence
  WWC1__Homo_sapiens__NP_001155133
augcccagacccgagcugccccugcccgagggcugggaggaggccagagacuucgacggcaagguguacuacaucgaccacaccaacagaaccaccagcuggaucgaccccagagacagauacaccaagccccugaccuucgccgacugcaucagcgacgagcugccccugggcugggaggaggccuacgacccccaggugggcgacuacuucaucgaccacaacaccaagaccacccagaucgaggaccccagagugcaguggagaagagagcaggagcacaugcugaaggacuaccuggugguggcccaggaggcccugagcgcccagaaggagaucuaccaggugaagcagcagagacuggagcuggcccagcaggaguaccagcagcugcacgccgugugggagcacaagcugggcagccaggugagccuggugagcggcagcagcagcagcagcaaguacgaccccgagauccugaaggccgagaucgccaccgccaagagcagagugaacaagcugaagagagagauggugcaccugcagcacgagcugcaguucaaggagagaggcuuccagacccugaagaagaucgacaagaagaugagcgacgcccagggcagcuacaagcuggacgaggcccaggccgugcugagagagaccaaggccaucaagaaggccaucaccugcggcgagaaggagaagcaggaccugaucaagagccuggccaugcugaaggacggcuucagaaccgacagaggcagccacagcgaccuguggagcagcagcagcagccuggagagcagcagcuucccccugcccaagcaguaccuggacgugagcagccagaccgacaucagcggcagcuucggcaucaacagcaacaaccagcuggccgagaaggugagacugagacugagauacgaggaggccaagagaagaaucgccaaccugaagauccagcuggccaagcuggacagcgaggccuggcccggcgugcuggacagcgagagagacagacugauccugaucaacgagaaggaggagcugcugaaggagaugagauucaucagccccagaaaguggacccagggcgagguggagcagcuggagauggccagaaagagacuggagaaggaccugcaggccgccagagacacccagagcaaggcccugaccgagagacugaagcugaacagcaagagaaaccagcuggugagagagcuggaggaggccaccagacagguggccacccugcacagccagcugaagagccugagcagcagcaugcagagccugagcagcggcagcagccccggcagccugaccagcagcagaggcagccugguggccagcagccuggacagcagcaccagcgccagcuucaccgaccuguacuacgaccccuucgagcagcuggacagcgagcugcagagcaagguggaguuccugcugcuggagggcgccaccggcuucagacccagcggcugcaucaccaccauccacgaggacgagguggccaagacccagaaggccgagggcggcggcagacugcaggcccugagaagccugagcggcacccccaagagcaugaccagccugagccccagaagcagccugagcagccccagcccccccugcagcccccugauggccgacccccugcuggccggcgacgccuuccugaacagccuggaguucgaggaccccgagcugagcgccacccugugcgagcugagccugggcaacagcgcccaggagagauacagacuggaggagcccggcaccgagggcaagcagcugggccaggccgugaacaccgcccagggcugcggccugaagguggccugcgugagcgccgccgugagcgacgagagcguggccggcgacagcggcguguacgaggccagcgugcagagacugggcgccagcgaggccgccgccuucgacagcgacgagagcgaggccgugggcgccaccagaauccagaucgcccugaaguacgacgagaagaacaagcaguucgccauccugaucauccagcugagcaaccugagcgcccugcugcagcagcaggaccagaaggugaacaucagaguggccgugcugcccugcagcgagagcaccaccugccuguucagaaccagaccccuggacgccagcgacacccugguguucaacgagguguucugggugagcaugagcuaccccgcccugcaccagaagacccugagaguggacgugugcaccaccgacagaagccaccuggaggagugccugggcggcgcccagaucagccuggccgaggugugcagaagcggcgagagaagcaccagaugguacaaccugcugagcuacaaguaccugaagaagcagagcagagagcugaagcccgugggcgugauggcccccgccagcggccccgccagcaccgacgccgugagcgcccugcuggagcagaccgccguggagcuggagaagagacaggagggcagaagcagcacccagacccuggaggacagcuggagauacgaggagaccagcgagaacgaggccguggccgaggaggaggaggaggagguggaggaggaggagggcgaggaggacguguucaccgagaaggccagccccgacauggacggcuaccccgcccugaagguggacaaggagaccaacaccgagacccccgcccccagccccaccguggugagacccaaggacagaagagugggcacccccagccagggccccuuccugagaggcagcaccaucaucagaagcaagaccuucagccccggcccccagagccaguacgugugcagacugaacagaagcgacagcgacagcagcacccugagcaagaagccccccuucgugagaaacagccuggagagaagaagcgugagaaugaagagacccagcccccccccccagcccagcagcgugaagagccugagaagcgagagacugaucagaaccagccuggaccuggagcuggaccugcaggccaccagaaccuggcacagccagcugacccaggagaucagcgugcugaaggagcugaaggagcagcuggagcaggccaagagccacggcgagaaggagcugccccaguggcugagagaggacgagagauucagacugcugcugagaaugcuggagaagagacagauggacagagccgagcacaagggcgagcugcagaccgacaagaugaugagagccgccgccaaggacgugcacagacugagaggccagagcugcaaggagccccccgaggugcagagcuucagagagaagauggccuucuucaccagacccagaaugaacauccccgcccugagcgccgacgacguguaa

SEQ ID NO: 25706 - RNA, 3579 nt, Artificial Sequence
  WWC2__Homo_sapiens__NP_079225
augcccagaagagccggcagcggccagcugccccugcccagaggcugggaggaggccagagacuacgacggcaagguguucuacaucgaccacaacaccagaagaaccagcuggaucgaccccagagacagacugaccaagccccugagcuucgccgacugcgugggcgacgagcugcccuggggcugggaggccggcuucgacccccagaucggcguguacuacaucgaccacaucaacaagaccacccagaucgaggaccccagaaagcaguggagaggcgagcaggagaagaugcugaaggacuaccugagcguggcccaggacgcccugagaacccagaaggagcuguaccacgugaaggagcagagacuggcccuggcccuggacgaguacgugagacugaacgacgccuacaaggagaagagcagcagccacaccagccuguucagcggcagcagcagcagcaccaaguacgaccccgacauccugaaggccgagaucagcaccaccagacugagagugaagaagcugaagagagagcugagccagaugaagcaggagcugcuguacaaggagcagggcuucgagacccugcagcagaucgacaagaagaugagcggcggccagagcggcuacgagcugagcgaggccaaggccauccugaccgagcugaagagcaucagaaaggccaucagcagcggcgagaaggagaagcaggaccugaugcagagccuggccaagcugcaggagagauuccaccuggaccagaacaucggcagaagcgagcccgaccugagaugcagccccgugaacagccaccugugccugagcagacagacccuggacgccggcagccagaccagcaucagcggcgacaucggcgugagaagcagaagcaaccuggccgagaaggugagacugagccugcaguacgaggaggccaagagaagcauggccaaccugaagaucgagcugagcaagcuggacagcgaggccuggcccggcgcccuggacaucgagaaggagaagcugaugcugaucaacgagaaggaggagcugcugaaggagcugcaguucgugaccccccagaagagaacccaggacgagcuggagagacuggaggccgagagacagagacuggaggaggagcugcugagcgugagaggcacccccagcagagcccuggccgagagacugagacuggaggagagaagaaaggagcugcugcagaagcuggaggagaccaccaagcugaccaccuaccugcacagccagcugaagagccugagcgccagcacccugagcaugagcagcggcagcagccugggcagccuggccagcagcagaggcagccugaacaccagcagcagaggcagccugaacagccugagcagcaccgagcuguacuacagcagccagagcgaccagaucgacguggacuaccaguacaagcuggacuuccugcugcaggagaagagcggcuacauccccagcggccccaucaccaccauccacgagaacgagguggugaagagccccagccagcccggccagagcggccugugcggcguggccgccgccgccaccggccacacccccccccuggccgaggcccccaagagcguggccagccugagcagcagaagcagccugagcagccugagcccccccggcagcccccuggugcuggagggcaccuuccccaugagcagcagccacgacgccagccugcaccaguucaccgccgacuucgaggacugcgagcugagcagccacuucgccgacaucagccugaucgagaaccagauccugcuggacagcgacagcggcggcgccagccagagccugagcgaggacaaggaccugaacgagugcgccagagagccccuguacgagggcaccgccgacguggagaagagccugcccaagagaagagugauccaccugcugggcgagaagaccaccugcgugagcgccgccgugagcgacgagagcguggccggcgacagcggcguguacgaggccuucgugaagcagcccagcgagauggaggacgugaccuacagcgaggaggacguggccaucguggagaccgcccaggugcagaucggccugagauacaacgccaagagcagcagcuucauggugaucaucgcccagcugagaaaccugcacgccuuccugaucccccacaccagcaagguguacuucagaguggccgugcugcccagcagcaccgacgugagcugccuguucagaaccaaggugcacccccccaccgagagcauccuguucaacgacguguucagaguggccaucagccagaccgcccugcagcagaagacccugagaguggaccugugcagcgugagcaagcacagaagagaggagugccuggccggcacccagaucagccuggccgaccugcccuucagcagcgagguguucacccugugguacaaccugcugcccagcaagcagaugcccugcaagaagaacgaggagaacgaggacagcguguuccagcccaaccagccccugguggacagcaucgaccuggacgccgugagcgcccugcuggccagaaccagcgccgagcugcuggccguggagcaggagcuggcccaggaggaggaggaggagagcggccaggaggagcccagaggccccgacggcgacuggcugaccaugcugagagaggccagcgacgagaucguggccgagaaggaggccgaggugaagcugcccgaggacagcagcugcaccgaggaccugagcagcugcaccagcgugcccgagaugaacgaggacggcaacagaaaggagagcaacugcgccaaggaccugagaagccagccccccaccagaauccccacccugguggacaaggagaccaacaccgacgaggccgccaacgacaacauggccgugagacccaaggagagaagcagccugagcagcagacagcaccccuucgugagaagcagcgugaucgugagaagccagaccuucagccccggcgagagaaaccaguacaucugcagacugaacagaagcgacagcgacagcagcacccuggccaagaagagccuguucgugagaaacagcaccgagagaagaagccugagagugaagagaaccgugugccagagcgugcugagaagaaccacccaggagugccccgugagaaccagccuggaccuggagcuggaccugcaggccagccugaccagacagagcagacugaacgacgagcugcaggcccugagagaccugagacagaagcuggaggagcugaaggcccagggcgagaccgaccugccccccggcgugcuggaggacgagagauuccagagacugcugaagcaggccgagaagcaggccgagcagagcaaggaggagcagaagcagggccugaacgccgagaagcugaugagacaggugagcaaggacgugugcagacugagagagcagagccagaaggugcccagacaggugcagagcuucagagagaagaucgccuacuucaccagagccaagaucagcauccccagccugcccgccgacgacguguaa

SEQ ID NO: 25707 - RNA, 906 nt, Artificial Sequence
  WWOX__Homo_sapiens__NP_001278926
auggagauccugcagggcagagacuucaccggcaagguggugguggugaccggcgccaacagcggcaucggcuucgagaccgccaagagcuucgcccugcacggcgcccacgugauccuggccugcagaaacauggccagagccagcgaggccgugagcagaauccuggaggaguggcacaaggccaagguggaggccaugacccuggaccuggcccugcugagaagcgugcagcacuucgccgaggccuucaaggccaagaacgugccccugcacgugcuggugugcaacgccgccaccuucgcccugcccuggagccugaccaaggacggccuggagaccaccuuccaggugaaccaccugggccacuucuaccuggugcagcugcugcaggacgugcugugcagaagcgcccccgccagagugaucguggugagcagcgagagccacagauucaccgacaucaacgacagccugggcaagcuggacuucagcagacugagccccaccaagaacgacuacugggccaugcuggccuacaacagaagcaagcugugcaacauccuguucagcaacgagcugcacagaagacugagccccagaggcgugaccagcaacgccgugcaccccggcaacaugauguacagcaacauccacagaagcugguggguguacacccugcuguucacccuggccagacccuucaccaagagcaugcagcagggcgccgccaccaccguguacugcgccgccgugcccgagcuggagggccugggcggcauguacuucaacaacugcugcagaugcaugcccagccccgaggcccagagcgaggagaccgccagaacccugugggcccugagcgagagacugauccaggagagacugggcagccagagcggcuaa

SEQ ID NO: 25708 - RNA, 2769 nt, Artificial Sequence
  WWP1__Homo_sapiens__XP_005250817
auggccaccgccagccccagaagcgacaccagcaacaaccacagcggcagacugcagcugcaggugaccgugagcagcgccaagcugaagagaaagaagaacugguucggcaccgccaucuacaccgagguggugguggacggcgagaucaccaagaccgccaagagcagcagcagcagcaaccccaagugggacgagcagcugaccgugaacgugaccccccagaccacccuggaguuccagguguggagccacagaacccugaaggccgacgcccugcugggcaaggccaccaucgaccugaagcaggcccugcugauccacaacagaaagcuggagagagugaaggagcagcugaagcugagccuggagaacaagaacggcaucgcccagaccggcgagcugaccguggugcuggacggccuggugaucgagcaggagaacaucaccaacugcagcagcagccccaccaucgagauccaggagaacggcgacgcccugcacgagaacggcgagcccagcgccagaaccaccgccagacuggccguggagggcaccaacggcaucgacaaccacgugcccaccagcacccuggugcagaacagcugcugcagcuacguggugaacggcgacaacacccccagcagccccagccagguggccgccagacccaagaacacccccgcccccaagccccuggccagcgagcccgccgacgacaccgugaacggcgagagcagcagcuucgcccccaccgacaacgccagcgugaccggcacccccguggugagcgaggagaacgcccugagccccaacugcaccagcaccaccguggaggacccccccgugcaggagauccugaccagcagcgagaacaacgagugcauccccagcaccagcgccgagcuggagagcgaggccagaagcauccuggagcccgacaccagcaacagcagaagcagcagcgccuucgaggccgccaagagcagacagcccgacggcugcauggaccccgugagacagcagagcggcaacgccaacaccgagacccugcccagcggcugggagcagagaaaggacccccacggcagaaccuacuacguggaccacaacaccagaaccaccaccugggagagaccccagccccugccccccggcugggagagaagaguggacgacagaagaagaguguacuacguggaccacaacaccagaaccaccaccuggcagagacccaccauggagagcgugagaaacuucgagcaguggcagagccagagaaaccagcugcagggcgccaugcagcaguucaaccagagauaccuguacagcgccagcaugcuggccgccgagaacgaccccuacggcccccugccccccggcugggagaagagaguggacagcaccgacagaguguacuucgugaaccacaacaccaagaccacccagugggaggaccccagaacccagggccugcagaacgaggagccccugcccgagggcugggagaucagauacaccagagagggcgugagauacuucguggaccacaacaccagaaccaccaccuucaaggaccccagaaacggcaagagcagcgugaccaagggcggcccccagaucgccuacgagagaggcuucagauggaagcuggcccacuucagauaccugugccagagcaacgcccugcccagccacgugaagaucaacgugagcagacagacccuguucgaggacagcuuccagcagaucauggcccugaagcccuacgaccugagaagaagacuguacgugaucuucagaggcgaggagggccuggacuacggcggccuggccagagagugguucuuccugcugagccacgaggugcugaaccccauguacugccuguucgaguacgccggcaagaacaacuacugccugcagaucaaccccgccagcaccaucaaccccgaccaccugagcuacuucugcuucaucggcagauucaucgccauggcccuguuccacggcaaguucaucgacaccggcuucagccugcccuucuacaagagaaugcugagcaagaagcugaccaucaaggaccuggagagcaucgacaccgaguucuacaacagccugaucuggaucagagacaacaacaucgaggagugcggccuggagauguacuucagcguggacauggagauccugggcaaggugaccagccacgaccugaagcugggcggcagcaacauccuggugaccgaggagaacaaggacgaguacaucggccugaugaccgaguggagauucagcagaggcgugcaggagcagaccaaggccuuccuggacggcuucaacgagguggugccccugcaguggcugcaguacuucgacgagaaggagcuggaggugaugcugugcggcaugcaggagguggaccuggccgacuggcagagaaacaccguguacagacacuacaccagaaacagcaagcagaucaucugguucuggcaguucgugaaggagaccgacaacgaggugagaaugagacugcugcaguucgugaccggcaccugcagacugccccugggcggcuucgccgagcugaugggcagcaacggcccccagaaguucugcaucgagaaggugggcaaggacaccuggcugcccagaagccacaccugcuucaacagacuggaccugccccccuacaagagcuacgagcagcugaaggagaagcugcuguucgccaucgaggagaccgagggcuucggccaggaguaa

SEQ ID NO: 25709 - RNA, 1008 nt, Artificial Sequence
  WWP2__Homo_sapiens__NP_001257384
auggccagcgccagcagcagcagagccggcguggcccugcccuucgagaagagccagcugacccugaagguggugagcgccaagcccaaggugcacaacagacagcccagaaucaacagcuacguggagguggccguggacggccugcccagcgagaccaagaagaccggcaagagaaucggcagcagcgagcugcuguggaacgagaucaucauccugaacgugaccgcccagagccaccuggaccugaagguguggagcugccacacccugagaaacgagcugcugggcaccgccagcgugaaccugagcaacgugcugaagaacaacggcggcaagauggagaacaugcagcugacccugaaccugcagaccgagaacaagggcagcguggugagcggcggcgagcugaccaucuuccuggacggccccaccguggaccugggcaacgugcccaacggcagcgcccugaccgacggcagccagcugcccagcagagacagcagcggcaccgccguggcccccgagaacagacaccagccccccagcaccaacugcuucggcggcagaagcagaacccacagacacagcggcgccagcgccagaaccacccccgccaccggcgagcagagccccggcgccagaagcagacacagacagcccgugaagaacagcggccacagcggccuggccaacggcaccgugaacgacgagcccaccaccgccaccgaccccgaggagcccagcguggugggcgugaccagcccccccgccgccccccugagcgugacccccaaccccaacaccaccagccugcccgcccccgccacccccgccgagggcgaggagcccagcaccagcggcacccagcagcugcccgccgccgcccaggcccccgacgcccugcccgccggcugggagcagagagagcugcccaacggcagaguguacuacguggaccacaacaccaagaccaccaccugggagagaccccugccccccggcuaa

SEQ ID NO: 25710 - RNA, 1203 nt, Artificial Sequence
  WWTR1__Homo_sapiens__NP_001161750
augaaccccgccagcgccccccccccccugcccccccccggccagcaggugauccacgugacccaggaccuggacaccgaccuggaggcccuguucaacagcgugaugaaccccaagcccagcagcuggagaaagaagauccugcccgagagcuucuucaaggagcccgacagcggcagccacagcagacagagcagcaccgacagcagcggcggccaccccggccccagacuggccggcggcgcccagcacgugagaagccacagcagccccgccagccugcagcugggcaccggcgccggcgccgccggcagccccgcccagcagcacgcccaccugagacagcagagcuacgacgugaccgacgagcugccccugccccccggcugggagaugaccuucaccgccaccggccagagauacuuccugaaccacaucgagaagaucaccaccuggcaggaccccagaaaggccaugaaccagccccugaaccacaugaaccugcaccccgccgugagcagcacccccgugccccagagaagcauggccgugagccagcccaaccuggugaugaaccaccagcaccagcagcagauggcccccagcacccugagccagcagaaccaccccacccagaacccccccgccggccugaugagcaugcccaacgcccugaccacccagcagcagcagcagcagaagcugagacugcagagaauccagauggagagagagagaaucagaaugagacaggaggagcugaugagacaggaggccgcccugugcagacagcugcccauggaggccgagacccuggcccccgugcaggccgccgugaacccccccaccaugacccccgacaugagaagcaucaccaacaacagcagcgaccccuuccugaacggcggccccuaccacagcagagagcagagcaccgacagcggccugggccugggcugcuacagcgugcccaccacccccgaggacuuccugagcaacguggacgagauggacaccggcgagaacgccggccagacccccaugaacaucaacccccagcagaccagauuccccgacuuccuggacugccugcccggcaccaacguggaccugggcacccuggagagcgaggaccugaucccccuguucaacgacguggagagcgcccugaacaagagcgagcccuuccugaccuggcuguaa

SEQ ID NO: 25711 - RNA, 2568 nt, Artificial Sequence
  XAB2__Homo_sapiens__NP_064581
augguggugauggccagacugagcagacccgagagacccgaccugguguucgaggaggaggaccugcccuacgaggaggagaucaugagaaaccaguucagcgugaagugcuggcugagauacaucgaguucaagcagggcgcccccaagcccagacugaaccagcuguacgagagagcccugaagcugcugcccugcagcuacaagcugugguacagauaccugaaggccagaagagcccaggugaagcacagaugcgugaccgaccccgccuacgaggacgugaacaacugccacgagagagccuucguguucaugcacaagaugcccagacuguggcuggacuacugccaguuccugauggaccagggcagagugacccacaccagaagaaccuucgacagagcccugagagcccugcccaucacccagcacagcagaaucuggccccuguaccugagauuccugagaagccacccccugcccgagaccgccgugagaggcuacagaagauuccugaagcugagccccgagagcgccgaggaguacaucgaguaccugaagagcagcgacagacuggacgaggccgcccagagacuggccaccguggugaacgacgagagauucgugagcaaggccggcaagagcaacuaccagcuguggcacgagcugugcgaccugaucagccagaaccccgacaaggugcagagccugaacguggacgccaucaucagaggcggccugaccagauucaccgaccagcugggcaagcuguggugcagccuggccgacuacuacaucagaagcggccacuucgagaaggccagagacguguacgaggaggccaucagaaccgugaugaccgugagagacuucacccagguguucgacagcuacgcccaguucgaggagagcaugaucgccgccaagauggagaccgccagcgagcugggcagagaggaggaggacgacguggaccuggagcugagacuggccagauucgagcagcugaucagcagaagaccccugcugcugaacagcgugcugcugagacagaacccccaccacgugcacgaguggcacaagagaguggcccugcaccagggcagacccagagagaucaucaacaccuacaccgaggccgugcagaccguggaccccuucaaggccaccggcaagccccacacccuguggguggccuucgccaaguucuacgaggacaacggccagcuggacgacgccagagugauccuggagaaggccaccaaggugaacuucaagcagguggacgaccuggccagcguguggugccagugcggcgagcuggagcugagacacgagaacuacgacgaggcccugagacugcugagaaaggccaccgcccugcccgccagaagagccgaguacuucgacggcagcgagcccgugcagaacagaguguacaagagccugaagguguggagcaugcuggccgaccuggaggagagccugggcaccuuccagagcaccaaggccguguacgacagaauccuggaccugagaaucgccaccccccagaucgugaucaacuacgccauguuccuggaggagcacaaguacuucgaggagagcuucaaggccuacgagagaggcaucagccuguucaaguggcccaacgugagcgacaucuggagcaccuaccugaccaaguucaucgccagauacggcggcagaaagcuggagagagccagagaccuguucgagcaggcccuggacggcugcccccccaaguacgccaagacccuguaccugcuguacgcccagcuggaggaggaguggggccuggccagacacgccauggccguguacgagagagccaccagagccguggagcccgcccagcaguacgacauguucaacaucuacaucaagagagccgccgagaucuacggcgugacccacaccagaggcaucuaccagaaggccaucgaggugcugagcgacgagcacgccagagagaugugccugagauucgccgacauggagugcaagcugggcgagaucgacagagccagagccaucuacagcuucugcagccagaucugcgaccccagaaccaccggcgccuucuggcagaccuggaaggacuucgaggugagacacggcaacgaggacaccaucaaggagaugcugagaaucagaagaagcgugcaggccaccuacaacacccaggugaacuucauggccagccagaugcugaaggugagcggcagcgccaccggcaccgugagcgaccuggcccccggccagagcggcauggacgacaugaagcugcuggagcagagagccgagcagcuggccgccgaggccgagagagaccagccccugagagcccagagcaagauccuguucgugagaagcgacgccagcagagaggagcuggccgagcuggcccagcaggugaaccccgaggagauccagcugggcgaggacgaggacgaggacgagauggaccuggagcccaacgaggugagacuggagcagcagagcgugcccgccgccguguucggcagccugaaggaggacuaa

SEQ ID NO: 25712 - RNA, 906 nt, Artificial Sequence
  XAF1__Homo_sapiens__NP_059993
auggagggcgacuucagcgugugcagaaacugcaagagacacguggugagcgccaacuucacccugcacgaggccuacugccugagauuccuggugcugugccccgagugcgaggagcccgugcccaaggagaccauggaggagcacugcaagcuggagcaccagcaggugggcugcaccaugugccagcagagcaugcagaagagcagccuggaguuccacaaggccaacgagugccaggagagacccguggagugcaaguucugcaagcuggacaugcagcugagcaagcuggagcugcacgagagcuacugcggcagcagaaccgagcugugccagggcugcggccaguucaucaugcacagaaugcuggcccagcacagagacgugugcagaagcgagcaggcccagcugggcaagggcgagagaaucagcgcccccgagagagagaucuacugccacuacugcaaccagaugauccccgagaacaaguacuuccaccacaugggcaagugcugccccgacagcgaguucaagaagcacuuccccgugggcaaccccgagauccugcccagcagccugcccagccaggccgccgagaaccagaccagcaccauggagaaggacgugagacccaagaccagaagcaucaacagauucccccugcacagcgagagcagcagcaagaaggcccccagaagcaagaacaagacccuggacccccugcugaugagcgagcccaagcccagaaccagcagccccagaggcgacaaggccgccuacgacauccugagaagaugcagccagugcggcauccugcugccccugcccauccugaaccagcaccaggagaagugcagauggcuggccagcagcaagggcaagcaggugagaaacuucagcuaa

SEQ ID NO: 25713 - RNA, 210 nt, Artificial Sequence
  XAGE1B__Homo_sapiens__NP_001091065
auggagagccccaagaagaagaaccagcagcugaaggugggcauccugcaccugggcagcagacagaagaagaucagaauccagcugagaagccaggugcugggcagagagaugagagacauggagggcgaccugcaggagcugcaccagagcaacaccggcgacaagagcggcuucggcuucagaagacagggcgaggacaacaccuaa

SEQ ID NO: 25714 - RNA, 246 nt, Artificial Sequence
  XAGE1E__Homo_sapiens__NP_001091073
auggagagccccaagaagaagaaccagcagcugaaggugggcauccugcaccugggcagcagacagaagaagaucagaauccagcugagaagccagugcgccaccuggaaggugaucugcaagagcugcaucagccagacccccggcaucaaccuggaccugggcagcggcgugaaggugaagaucauccccaaggaggagcacugcaagaugcccgaggccggcgaggagcagccccagguguaa

SEQ ID NO: 25715 - RNA, 1131 nt, Artificial Sequence
  XBP1__Homo_sapiens__NP_001073007
augguggugguggccgccgcccccaaccccgccgacggcacccccaaggugcugcugcugagcggccagcccgccagcgccgccggcgcccccgccggccaggcccugccccugauggugcccgcccagagaggcgccagccccgaggccgccagcggcggccugccccaggccagaaagagacagagacugacccaccugagccccgaggagaaggcccugagaagaaagcugaagaacagaguggccgcccagaccgccagagacagaaagaaggccagaaugagcgagcuggagcagcaggugguggaccuggaggaggagaaccagaagcugcugcuggagaaccagcugcugagagagaagacccacggccuggugguggagaaccaggagcugagacagagacugggcauggacgcccugguggccgaggaggaggccgaggccaagggcaacgaggugagacccguggccggcagcgccgagagcgccgccggcgccggccccguggugaccccccccgagcaccugcccauggacagcggcggcaucgacagcagcgacagcgagagcgacauccugcugggcauccuggacaaccuggaccccgugauguucuucaagugccccagccccgagcccgccagccuggaggagcugcccgagguguaccccgagggccccagcagccugcccgccagccugagccugagcgugggcaccagcagcgccaagcuggaggccaucaacgagcugaucagauucgaccacaucuacaccaagccccuggugcuggagauccccagcgagaccgagagccaggccaacgugguggugaagaucgaggaggccccccugagccccagcgagaacgaccaccccgaguucaucgugagcgugaaggaggagcccguggaggacgaccuggugcccgagcugggcaucagcaaccugcugagcagcagccacugccccaagcccagcagcugccugcuggacgccuacagcgacugcggcuacggcggcagccugagccccuucagcgacaugagcagccugcugggcgugaaccacagcugggaggacaccuucgccaacgagcuguucccccagcugaucagcguguaa

SEQ ID NO: 25716 - RNA, 345 nt, Artificial Sequence
  XCL1__Homo_sapiens__XP_011508167
augagacugcugauccuggcccugcugggcaucugcagccugaccgccuacaucguggagggcgugggcagcgaggugagcgacaagagaaccugcgugagccugaccacccagagacugcccgugagcagaaucaagaccuacaccaucaccgagggcagccugagagccgugaucuucaucaccaagagaggccugaaggugugcgccgacccccaggccaccugggugagagacguggugagaagcauggacagaaagagcaacaccagaaacaacaugauccagaccaagcccaccggcacccagcagagcaccaacaccgccgugacccugaccggcuaa

SEQ ID NO: 25717 - RNA, 345 nt, Artificial Sequence
  XCL2__Homo_sapiens__NP_003166
augagacugcugauccuggcccugcugggcaucugcagccugaccgccuacaucguggagggcgugggcagcgaggugagccacagaagaaccugcgugagccugaccacccagagacugcccgugagcagaaucaagaccuacaccaucaccgagggcagccugagagccgugaucuucaucaccaagagaggccugaaggugugcgccgacccccaggccaccugggugagagacguggugagaagcauggacagaaagagcaacaccagaaacaacaugauccagaccaagcccaccggcacccagcagagcaccaacaccgccgugacccugaccggcuaa

SEQ ID NO: 25718 - RNA, 1002 nt, Artificial Sequence
  XCR1__Homo_sapiens__NP_001019815
auggagagcagcggcaaccccgagagcaccaccuucuucuacuacgaccugcagagccagcccugcgagaaccaggccuggguguucgccacccuggccaccaccgugcuguacugccugguguuccugcugagccuggugggcaacagccuggugcugugggugcuggugaaguacgagagccuggagagccugaccaacaucuucauccugaaccugugccugagcgaccugguguucgccugccugcugcccguguggaucagccccuaccacuggggcugggugcugggcgacuuccugugcaagcugcugaacaugaucuucagcaucagccuguacagcagcaucuucuuccugaccaucaugaccauccacagauaccugagcguggugagcccccugagcacccugagagugcccacccugagaugcagagugcuggugaccauggccguguggguggccagcauccugagcagcauccuggacaccaucuuccacaaggugcugagcagcggcugcgacuacagcgagcugaccugguaccugaccagcguguaccagcacaaccuguucuuccugcugagccugggcaucauccuguucugcuacguggagauccugagaacccuguucagaagcagaagcaagagaagacacagaaccgugaagcugaucuucgccaucgugguggccuacuuccugagcuggggccccuacaacuucacccuguuccugcagacccuguucagaacccagaucaucagaagcugcgaggccaagcagcagcuggaguacgcccugcugaucugcagaaaccuggccuucagccacugcugcuucaaccccgugcuguacguguucgugggcgugaaguucagaacccaccugaagcacgugcugagacaguucugguucugcagacugcaggcccccagccccgccagcaucccccacagccccggcgccuucgccuacgagggcgccagcuucuacuaa

SEQ ID NO: 25719 - RNA, 4002 nt, Artificial Sequence
  XDH__Homo_sapiens__NP_000370
augaccgccgacaagcugguguucuucgugaacggcagaaaggugguggagaagaacgccgaccccgagaccacccugcuggccuaccugagaagaaagcugggccugagcggcaccaagcugggcugcggcgagggcggcugcggcgccugcaccgugaugcugagcaaguacgacagacugcagaacaagaucgugcacuucagcgccaacgccugccuggcccccaucugcagccugcaccacguggccgugaccaccguggagggcaucggcagcaccaagaccagacugcaccccgugcaggagagaaucgccaagagccacggcagccagugcggcuucugcacccccggcaucgugaugagcauguacacccugcugagaaaccagcccgagcccaccauggaggagaucgagaacgccuuccagggcaaccugugcagaugcaccggcuacagacccauccugcagggcuucagaaccuucgccagagacggcggcugcugcggcggcgacggcaacaaccccaacugcugcaugaaccagaagaaggaccacagcgugagccugagccccagccuguucaagcccgaggaguucaccccccuggaccccacccaggagcccaucuucccccccgagcugcugagacugaaggacacccccagaaagcagcugagauucgagggcgagagagugaccuggauccaggccagcacccugaaggagcugcuggaccugaaggcccagcaccccgacgccaagcugguggugggcaacaccgagaucggcaucgagaugaaguucaagaacaugcuguuccccaugaucgugugccccgccuggauccccgagcugaacagcguggagcacggccccgacggcaucagcuucggcgccgccugcccccugagcaucguggagaagacccugguggacgccguggccaagcugcccgcccagaagaccgagguguucagaggcgugcuggagcagcugagaugguucgccggcaagcaggugaagagcguggccagcgugggcggcaacaucaucaccgccagccccaucagcgaccugaaccccguguucauggccagcggcgccaagcugacccuggugagcagaggcaccagaagaaccgugcagauggaccacaccuucuuccccggcuacagaaagacccugcugagccccgaggagauccugcugagcaucgagauccccuacagcagagagggcgaguacuucagcgccuucaagcaggccagcagaagagaggacgacaucgccaaggugaccagcggcaugagagugcuguucaagcccggcaccaccgaggugcaggagcuggcccugugcuacggcggcauggccaacagaaccaucagcgcccugaagaccacccagagacagcugagcaagcuguggaaggaggagcugcugcaggacgugugcgccggccuggccgaggagcugcaccugccccccgacgcccccggcggcaugguggacuucagaugcacccugacccugagcuucuucuucaaguucuaccugaccgugcugcagaagcugggccaggagaaccuggaggacaagugcggcaagcuggaccccaccuucgccagcgccacccugcuguuccagaaggacccccccgccgacgugcagcuguuccaggaggugcccaagggccagagcgaggaggacauggugggcagaccccugccccaccuggccgccgacaugcaggccagcggcgaggccguguacugcgacgacauccccagauacgagaacgagcugagccugagacuggugaccagcaccagagcccacgccaagaucaagagcaucgacaccagcgaggccaagaaggugcccggcuucgugugcuucaucagcgccgacgacgugcccggcagcaacaucaccggcaucugcaacgacgagaccguguucgccaaggacaaggugaccugcgugggccacaucaucggcgccgugguggccgacacccccgagcacacccagagagccgcccagggcgugaagaucaccuacgaggagcugcccgccaucaucaccaucgaggacgccaucaagaacaacagcuucuacggccccgagcugaagaucgagaagggcgaccugaagaagggcuucagcgaggccgacaacguggugagcggcgagaucuacaucggcggccaggagcacuucuaccuggagacccacugcaccaucgccgugcccaagggcgaggccggcgagauggagcuguucgugagcacccagaacaccaugaagacccagagcuucguggccaagaugcugggcgugcccgccaacagaaucguggugagagugaagagaaugggcggcggcuucggcggcaaggagaccagaagcaccguggugagcaccgccguggcccuggccgccuacaagaccggcagacccgugagaugcaugcuggacagagacgaggacaugcugaucaccggcggcagacaccccuuccuggccagauacaaggugggcuucaugaagaccggcaccgugguggcccuggagguggaccacuucagcaacgugggcaacacccaggaccugagccagagcaucauggagagagcccuguuccacauggacaacugcuacaagauccccaacaucagaggcaccggcagacugugcaagaccaaccugcccagcaacaccgccuucagaggcuucggcggcccccagggcaugcugaucgccgagugcuggaugagcgagguggccgugaccugcggcaugcccgccgaggaggugagaagaaagaaccuguacaaggagggcgaccugacccacuucaaccagaagcuggagggcuucacccugcccagaugcugggaggagugccuggccagcagccaguaccacgccagaaagagcgagguggacaaguucaacaaggagaacugcuggaagaagagaggccugugcaucauccccaccaaguucggcaucagcuucaccgugcccuuccugaaccaggccggcgcccugcugcacguguacaccgacggcagcgugcugcugacccacggcggcaccgagaugggccagggccugcacaccaagauggugcagguggccagcagagcccugaagauccccaccagcaagaucuacaucagcgagaccagcaccaacaccgugcccaacaccagccccaccgccgccagcgugagcgccgaccugaacggccaggccguguacgccgccugccagaccauccugaagagacuggagcccuacaagaagaagaaccccagcggcagcugggaggacugggugaccgccgccuacauggacaccgugagccugagcgccaccggcuucuacagaacccccaaccugggcuacagcuucgagaccaacagcggcaaccccuuccacuacuucagcuacggcguggccugcagcgagguggagaucgacugccugaccggcgaccacaagaaccugagaaccgacaucgugauggacgugggcagcagccugaaccccgccaucgacaucggccagguggagggcgccuucgugcagggccugggccuguucacccuggaggagcugcacuacagccccgagggcagccugcacaccagaggccccagcaccuacaagauccccgccuucggcagcauccccaucgaguucagagugagccugcugagagacugccccaacaagaaggccaucuacgccagcaaggccgugggcgagcccccccuguuccuggccgccagcaucuucuucgccaucaaggacgccaucagagccgccagagcccagcacaccggcaacaacgugaaggagcuguucagacuggacagccccgccacccccgagaagaucagaaacgccugcguggacaaguucaccacccugugcgugaccggcgugcccgagaacugcaagcccuggagcgugagaguguaa

SEQ ID NO: 25720 - RNA, 588 nt, Artificial Sequence
  XG__Homo_sapiens__NP_001135391
auggagagcugguggggccugcccugccuggccuuccugugcuuccugaugcacgccagaggccagagagacuucgaccuggccgacgcccuggacgaccccgagcccaccaagaagcccaacagcgacaucuaccccaagcccaagccccccuacuacccccagcccgagaaccccgacagcggcggcaacaucuaccccagacccaagcccagaccccagccccagcccggcaacagcggcaacagcggcggcuacuucaacgacguggacagagacgacggcagauacccccccagacccagacccagaccccccgccggcggcggcggcggcggcuacagcagcuacggcaacagcgacaacacccacggcagaggcggcuacagacugaacagcagauacggcaacaccuacggcggcgaccaccacagcaccuacggcaaccccgagggcaacaugguggccaagaucgugagccccaucgugagcguggugguggugacccugcugggcgccgccgccagcuacuucaagcugaacaacagaagaaacugcuucagaacccacgagcccgagaacguguaa

SEQ ID NO: 25721 - RNA, 1494 nt, Artificial Sequence
  XIAP__Homo_sapiens__XP_011529631
augaccuucaacagcuucgagggcagcaagaccugcgugcccgccgacaucaacaaggaggaggaguucguggaggaguucaacagacugaagaccuucgccaacuuccccagcggcagccccgugagcgccagcacccuggccagagccggcuuccuguacaccggcgagggcgacaccgugagaugcuucagcugccacgccgccguggacagauggcaguacggcgacagcgccgugggcagacacagaaaggugagccccaacugcagauucaucaacggcuucuaccuggagaacagcgccacccagagcaccaacagcggcauccagaacggccaguacaagguggagaacuaccugggcagcagagaccacuucgcccuggacagacccagcgagacccacgccgacuaccugcugagaaccggccaggugguggacaucagcgacaccaucuaccccagaaaccccgccauguacagcgaggaggccagacugaagagcuuccagaacuggcccgacuacgcccaccugacccccagagagcuggccagcgccggccuguacuacaccggcaucggcgaccaggugcagugcuucugcugcggcggcaagcugaagaacugggagcccugcgacagagccuggagcgagcacagaagacacuuccccaacugcuucuucgugcugggcagaaaccugaacaucagaagcgagagcgacgccgugagcagcgacagaaacuuccccaacagcaccaaccugcccagaaaccccagcauggccgacuacgaggccagaaucuucaccuucggcaccuggaucuacagcgugaacaaggagcagcuggccagagccggcuucuacgcccugggcgagggcgacaaggugaagugcuuccacugcggcggcggccugaccgacuggaagcccagcgaggaccccugggagcagcacgccaagugguaccccggcugcaaguaccugcuggagcagaagggccaggaguacaucaacaacauccaccugacccacagccuggaggagugccuggugagaaccaccgagaagacccccagccugaccagaagaaucgacgacaccaucuuccagaaccccauggugcaggaggccaucagaaugggcuucagcuucaaggacaucaagaagaucauggaggagaagauccagaucagcggcagcaacuacaagagccuggaggugcugguggccgaccuggugaacgcccagaaggacagcaugcaggacgagagcagccagaccagccugcagaaggagaucagcaccgaggagcagcugagaagacugcaggaggagaagcugugcaagaucugcauggacagaaacaucgccaucguguucgugcccugcggccaccuggugaccugcaagcagugcgccgaggccguggacaagugccccaugugcuacaccgugaucaccuucaagcagaagaucuucaugagcuaa

SEQ ID NO: 25722 - RNA, 3366 nt, Artificial Sequence
  XIRP1__Homo_sapiens__NP_001185550
auggccgacacccagacccagguggcccccacccccaccaugagaauggccaccgccgaggaccugccccugccccccccccccgcccuggaggaccugccccugcccccccccaaggagagcuucagcaaguuccaccagcagagacaggccagcgagcugagaagacuguacagacacauccaccccgagcugagaaagaaccuggccgaggccguggccgaggaccuggccgaggugcugggcagcgaggagcccaccgagggcgacgugcagugcaugagauggaucuucgagaacuggagacuggacgccaucggcgagcacgagagacccgccgccaaggagcccgugcugugcggcgacgugcaggccaccagcagaaaguucgaggagggcagcuucgccaacagcaccgaccaggagcccaccagaccccagcccggcggcggcgacgugagagccgccagauggcuguucgagaccaagccccuggacgagcugaccggccaggccaaggagcuggaggccaccgugagagagcccgccgccagcggcgacgugcagggcaccagaaugcuguucgagaccagaccccuggacagacugggcagcagacccagccugcaggagcagagcccccuggagcugagaagcgagauccaggagcugaagggcgacgugaagaagaccgugaagcuguuccagaccgagccccugugcgccauccaggacgccgagggcgccauccacgaggugaaggccgccugcagagaggagauccagagcaacgccgugagaagcgccagauggcuguucgagaccagaccccuggacgccaucaaccaggaccccagccaggugagagugaucagaggcaucagccuggaggagggcgccagacccgacgugagcgccaccagauggaucuucgagacccagccccuggacgccaucagagagauccugguggacgagaaggacuuccagcccagccccgaccugaucccccccggccccgacgugcagcagcagcagcaccuguucgagaccagagcccuggacacccugaagggcgacgaggaggccggcgccgaggccccccccaaggaggagguggugcccggcgacgugagaagcacccuguggcuguucgagaccaagccccuggacgccuucagagacaaggugcaggugggccaccugcagagaguggacccccaggacggcgagggccaccugagcagcgacagcagcagcgcccugcccuucagccagagcgccccccagagagacgagcugaagggcgacgugaagaccuucaagaaccuguucgagacccugccccuggacagcaucggccagggcgaggugcuggcccacggcagccccagcagagaggagggcaccgacagcgccggccaggcccagggcaucggcagccccguguacgccaugcaggacagcaagggcagacugcacgcccugaccagcgugagcagagagcagaucgugggcggcgacgugcagggcuacagauggauguucgagacccagccccuggaccagcugggcagaagccccagcaccaucgacguggugagaggcaucaccagacaggaggugguggccggcgacgugggcaccgccagauggcuguucgagacccagccccuggagaugauccaccagagagagcagcaggagagacagaaggaggagggcaagagccagggcgacccccagcccgaggccccccccaagggcgacgugcagaccaucagauggcuguucgagaccugccccaugagcgagcuggccgagaagcagggcagcgaggugaccgaccccaccgccaaggccgaggcccagagcugcaccuggauguucaagccccagcccguggacagacccgugggcagcagagagcagcaccugcaggugagccaggugcccgccggcgagagacagaccgacagacacguguucgagaccgagccccugcaggccagcggcagacccugcggcagaagacccgugagauacugcagcagaguggagauccccagcggccaggugagcagacagaaggagguguuccaggcccuggaggccggcaagaaggaggagcaggagcccagagugaucgccggcagcauccccgccggcagcgugcacaaguucaccuggcuguucgagaacugccccaugggcagccuggccgccgagagcauccagggcggcaaccugcuggaggagcagcccaugagccccagcggcaacagaaugcaggagagccaggagaccgccgccgagggcacccugagaacccugcacgccacccccggcauccugcaccacggcggcauccugauggaggccagaggccccggcgagcugugccuggccaaguacgugcugagcggcaccggccagggccaccccuacaucagaaaggaggagcuggugagcggcgagcugcccagaaucaucugccaggugcugagaagacccgacguggaccagcagggccugcuggugcaggaggaccccaccggccagcugcagcugaagccccugagacugcccacccccggcagcagcggcaacaucgaggacauggaccccgagcugcagcagcugcuggccugcggccugggcaccagcguggccagaaccggccuggugaugcaggagaccgagcagggccugguggcccugaccgccuacagccugcagcccagacugaccagcaaggccagcgagagaagcagcgugcagcugcuggccagcugcaucgacaagggcgaccugagcggccugcacagccugagaugggagccccccgccgaccccagccccgugcccgccagcgagggcgcccagagccugcaccccaccgagagcaucauccacgugcccccccuggaccccagcaugggcaugggccaccugagagccagcggcgccacccccugccccccccaggccaucggcaaggccgugccccuggccggcgaggccgccgcccccgcccagcugcagaacaccgagaagcaggaggacagccacagcggccagaagggcauggccgugcugggcaagagcgagggcgccaccaccaccccccccggccccggcgcccccgaccugcuggccgccaugcagagccugagaauggccaccgccgaggcccagagccugcaccagcaggugcugaacaagcacaagcagggccccacccccaccgccaccagcaaccccauccaggacggccugagaaaggccggcgccacccagagcaacaucagacccggcggcggcagcgaccccagaauccccgccgcccccagaaagcugcuguaa

SEQ ID NO: 25723 - RNA, 2817 nt, Artificial Sequence
  XIRP2__Homo_sapiens__NP_001073278
auguuccccaugcagaagggcagccugaaccugcugagacagaagugggagagcugcgacuaccagagaagcgagugccaccccagagacagccacugcaccaucuuccagccccaggagagcaagcugcuggcccccgagggcgagguggugagcgccccccagagccuggaccccaccagccugcccuacagcaccggcgaggagauguggagcagcaagcccgaggagaaggacagcguggacaagagcaacaacaccagagaguacggcagacccgaggugcugaaggaggacagccugagcagcagaagaagaaucgagagauucagcaucgcccuggacgagcugagaagcguguucgaggcccccaagagcggcaacaagcccgccgaguacggcggcaaggagguggagaucgagagaagccugugcagccccgccuucaagagccaccccggcagccagcuggaggacagcgugaaggacagcgacaagaagggcaaggagaccagcuucgacaagaugagccccgagagcggccacagcagaaucuucgaggccaccgccggccccaacaagcccgagagcggcuucgccgaggacagcgccgccagaggcgagggcgugagcgaccugcacgagguggugagccugaaggagagaauggccagauaccaggccgccgugagcagaggcgacugcagaagcuucagcgccaacaugauggaggagagcgagaugugcgccgugcccggcggccuggccaaggugaagaagcaguucgaggacgagaucaccagcagcagaaacaccuucgcccaguaccaguaccagcaccagaacagaagcgagcaggaggccauccacagcagccaggugggcaccagcagaagcagccaggagauggccagaaacgagcaggagggcagcaaggugcagaagaucgacgugcacggcaccgagauggugagccaccuggagaagcacaccgaggaggugaaccaggccagccaguuccaccaguacgugcaggagaccgugaucgacacccccgaggacgaggagauccccaaggugagcaccaagcugcugaaggagcaguucgagaagagcgcccaggagaagauccuguacagcgacaaggagaugaccacccccgccaagcagaucaagaagcugcugcugcaggacaaggagaucugcauccugugccagaagaccguguaccccauggagugccugguggccgacaagcagaacuuccacaagagcugcuucagaugccaccacugcaacagcaagcugagccugggcaacuacgccagccugcacggccagaucuacugcaagccccacuucaagcagcuguucaagagcaagggcaacuacgacgagggcuucggccacaagcagcacaaggacagauggaacugcaagaaccagagcagaagcguggacuucauccccaacgaggagcccaacaugugcaagaacaucgccgagaacacccuggugcccggcgacagaaacgagcaccuggacgccggcaacagcgagggccagagaaacgaccugagaaagcugggcgagagaggcaagcugaaggugaucuggccccccagcaaggagauccccaagaagacccugcccuucgaggaggagcugaagaugagcaagcccaaguggccccccgagaugaccacccugcugagccccgaguucaagagcgagagccugcuggaggacgugagaacccccgagaacaagggccagagacaggaccacuuccccuuccugcagcccuaccugcagagcacccacgugugccagaaggaggacgugaucggcaucaaggagaugaagaugcccgagggcagaaaggacgagaagaaggagggcagaaagaacgugcaggacagacccagcgaggccgaggacaccaagagcaacagaaagagcgccauggaccugaacgacaacaacaacgugaucgugcagagcgccgagaaggagaagaacgagaagaccaaccagaccaacggcgccgaggugcugcaggugaccaacaccgacgacgagaugaugcccgagaaccacaaggagaaccugaacaagaacaacaacaacaacuacguggccgugagcuaccugaacaacugcagacagaagaccagcauccuggaguuccuggaccugcugccccugagcagcgaggccaacgacaccgccaacgaguacgagaucgagaagcuggagaacaccagcagaaucagcgagcugcugggcaucuucgagagcgagaagaccuacagcagaaacgugcuggccauggcccugaagaagcagaccgacagagccgccgccggcagccccgugcagcccgcccccaagcccagccugagcagaggccugauggugaagggcggcagcagcaucaucagccccgacaccaaccugcugaacaucaagggcagccacagcaagagcaagaaccugcacuucuucuucagcaacaccgugaagaucaccgccuucagcaagaagaacgagaacaucuucaacugcgaccugaucgacagcguggaccagaucaagaacaugcccugccuggaccugagagaguucggcaaggacgugaagcccuggcacguggagaccaccgaggccgccagaaacaacgagaacaccggcuucgacgcccugagccacgagugcaccgccaagccccuguuccccagaguggaggugcagagcgagcagcugaccguggaggagcagaucaagagaaacagaugcuacagcgacaccgaguaa

SEQ ID NO: 25724 - RNA, 1335 nt, Artificial Sequence
  XK__Homo_sapiens__NP_066569
augaaguuccccgccagcgugcuggccagcguguuccuguucguggccgagaccaccgccgcccugagccugagcagcaccuacagaagcggcggcgacagaauguggcaggcccugacccugcuguucagccugcugcccugcgcccuggugcagcugacccugcuguucgugcacagagaccugagcagagacagaccccuggugcugcugcugcaccugcugcagcugggcccccuguucagaugcuucgagguguucugcaucuacuuccagagcggcaacaacgaggagcccuacgugagcaucaccaagaagagacagaugcccaagaacggccugagcgaggagaucgagaaggaggugggccaggccgagggcaagcugaucacccacagaagcgccuucagcagagccagcgugauccaggccuuccugggcagcgccccccagcugacccugcagcuguacaucagcgugaugcagcaggacgugaccgugggcagaagccugcugaugaccaucagccugcugagcaucguguacggcgcccugagaugcaacauccuggccaucaagaucaaguacgacgaguacgaggugaaggugaagccccuggccuacgugugcaucuuccuguggagaagcuucgagaucgccaccagagugguggugcuggugcuguucaccagcgugcugaagaccugggugguggugaucauccugaucaacuucuucagcuucuuccuguaccccuggauccuguucuggugcagcggcagccccuuccccgagaacaucgagaaggcccugagcagagugggcaccaccaucgugcugugcuuccugacccugcuguacaccggcaucaacauguucugcuggagcgccgugcagcugaagaucgacagccccgaccugaucagcaagagccacaacugguaccagcugcugguguacuacaugaucagauucaucgagaacgccauccugcugcugcugugguaccuguucaagaccgacaucuacauguacgugugcgccccccugcuggugcugcagcugcugaucggcuacugcaccgccauccuguucaugcugguguucuaccaguucuuccaccccugcaagaagcuguucagcagcagcgugagcgagggcuuccagagauggcugagaugcuucugcugggccugcagacagcagaagcccugcgagcccaucggcaaggaggaccugcagagcagcagagacagagacgagacccccagcagcagcaagaccagccccgagcccggccaguuccugaacgccgaggaccugugcagcgccuaa

SEQ ID NO: 25725 - RNA, 1953 nt, Artificial Sequence
  XKR4__Homo_sapiens__NP_443130
auggccgccaagagcgacggcagacugaagaugaagaagagcagcgacguggccuucaccccccugcagaacagcgaccacagcggcagcgugcagggccuggcccccggccugcccagcggcagcggcgccgaggacgaggaggccgccggcggcggcugcugccccgacggcggcggcugcagcagaugcugcugcugcugcgccggcagcggcggcagcgccggcagcggcggcagcggcggcguggccggccccggcggcggcggcgccggcagcgccgcccugugccugagacugggcagagagcagagaagauacagccugugggacugccuguggauccuggccgccguggccguguacuucgccgacgugggcaccgacguguggcuggccguggacuacuaccugagaggccagagauggugguucggccugacccuguucuucguggugcugggcagccugagcgugcagguguucagcuucagaugguucgugcacgacuucagcaccgaggacagcgccaccgccgccgccgccagcagcugcccccagcccggcgccgacugcaagaccguggugggcggcggcagcgccgccggcgagggcgaggccagacccagcaccccccagagacaggccagcaacgccagcaagagcaacaucgccgccgccaacagcggcagcaacagcagcggcgccaccagagccagcggcaagcacagaagcgccagcugcagcuucugcaucuggcugcugcagagccugauccacauccugcagcugggccagaucuggagauacuuccacaccaucuaccugggcaucagaagcagacagagcggcgagaacgacagauggagauucuacuggaagaugguguacgaguacgccgacgugagcaugcugcaccugcuggccaccuuccuggagagcgccccccagcuggugcugcagcugugcaucaucgugcagacccacagccugcaggcccugcagggcuucaccgccgccgccagccuggugagccuggccugggcccuggccagcuaccagaaggcccugagagacagcagagacgacaagaagcccaucagcuacauggccgugaucauccaguucugcuggcacuucuucaccaucgccgccagagugaucaccuucgcccuguucgccagcguguuccagcuguacuucggcaucuucaucgugcugcacuggugcaucaugaccuucuggaucgugcacugcgagaccgaguucugcaucaccaagugggaggagaucguguucgacaugguggugggcaucaucuacaucuucagcugguucaacgugaaggagggcagaaccagaugcagacuguucaucuacuacuucgugauccugcuggagaacaccgcccugagcgcccugugguaccuguacaaggccccccagaucgccgacgccuucgccauccccgcccugugcgugguguucagcagcuuccugaccggcgugguguucaugcugauguacuacgccuucuuccaccccaacggccccagauucggccagagccccagcugcgccugcgaggaccccgccgccgccuucacccugccccccgacguggccaccagcacccugagaagcaucagcaacaacagaagcguggugagcgacagagaccagaaguucgccgagagagacggcugcgugcccguguuccaggugagacccaccgcccccagcacccccagcagcagaccccccagaaucgaggagagcgugaucaagaucgaccuguucagaaacagauaccccgccugggagagacacgugcuggacagaagccugagaaaggccauccuggccuucgagugcagccccagcccccccagacugcaguacaaggacgacgcccugauccaggagagacuggaguacgagaccacccuguaa

SEQ ID NO: 25726 - RNA, 1926 nt, Artificial Sequence
  XKR6__Homo_sapiens__NP_775954
auggccgccaagagcgacggcggcggcgugggcgugggcuucgcccagcugcacaaccuggacgaggccgugggcagcggcggcgaggaggacggcgagcccggcggcggcggcugcggcggcggcggcgacggcagcgagcccggcgagagcagcagcaugcacaucugccacugcugcaacaccagcagcugcuacuggggcugcagaagcgccugccugagaagccugcugggcagaaagcccagaagaagcgccgccgccgacggcggcgaccagccccugcagccccccgccgcccccggcgccggcagacagccccccacccccagcgccgccagacccgagcccccccccccccagguggagagacccuggcuggacugccuguggaucgugcuggcccugcugguguucuucggcgacgugggcaccgaccuguggcuggcccuggacuacuacagaaagggcgacuacguguacuucggccugacccuguucuucgugcuggugcccagccugcuggugcagagccugagcuucagaugguucgugcaggacuacaccggcggcggccugggcgccguggagggccugaccagcagaggcccccccaugaugggcgccggcuacgugcacggcgccgccagaggcggccccggcgugagagugagccccacccccggcgcccagagacugugcagacugagcguguggaucuggcagagcgugauccaccugcugcagaugggccagguguggagauacaucagaaccauguaccugggcauccagagccagagaagaaaggagcaccagagaagauucuacugggccaugauguacgaguacgccgacgugaacaugcugagacugcuggagaccuuccuggagagcgccccccagcuggugcugcagcuguacaucaugcugcagaagaacagcgccgagacccugcccugcgugagcagcgugaccagccugaugagccuggccugggugcuggccagcuaccacaagcugcugagagacagcagagacgacaagaagagcaugagcuacagaggcgccaucauccagguguucuggagacuguucaccaucagcagcagagugaucagcuucgcccuguucgccagcaucuuccagcuguacuucggcaucuucgugguggugcacuggugcgccauggccuucuggaucauccacggcggcaccgacuucugcaugagcaagugggaggagauccuguucaacaugguggugggcaucguguacaucuucugcugguucaacgugaaggagggcagaaccagauacagaauguucgccuacuacaccaucgugcugaccgagaacgccgcccugaccuuccugugguacuucuacagagaccccgagaccaccgacagcuacgccgugcccgcccugugcugcguguucaucagcuucguggccggcaucgccaugaugcugcuguacuacggcgugcugcaccccaccggccccagagccaagauccuggccagcagcugcugcgccgagcugcuguggggcaucccccugccccccgacguggagcccauggcccccgagauccccggcuacagaggcacccaggugacccccaccagagccgugaccgagcagcaggaggaccugaccgccgacaccugccugcccguguuccaggugagacccaugggcccccccaccccccugggcagacccuaccugcccgagggcccccugaucaagaucgacaugcccagaaagagauaccccgccugggacgcccacuucguggacagaagacugagaagaaccaucaacauccugcaguacgugacccccaccgccgugggcaucagauacagagacggcccccugcuguacgagcugcugcaguacgagagcagccuguaa

SEQ ID NO: 25727 - RNA, 1122 nt, Artificial Sequence
  XKR9__Homo_sapiens__NP_001274188
augaaguacaccaagcagaacuucaugaugagcgugcugggcaucaucaucuacgugaccgaccugaucguggacaucugggugagcgugagauucuuccacgagggccaguacguguucagcgcccuggcccugagcuucaugcuguucggcacccugguggcccagugcuucagcuacagcugguucaaggccgaccugaagaaggccggccaggagagccagcacugcuuccugcugcugcacugccugcagggcggcguguucaccagauacugguucgcccugaagagaggcuaccacgccgccuucaaguacgacagcaacaccagcaacuucguggaggagcagaucgaccugcacaaggaggugaucgacagagugaccgaccugagcaugcugagacuguucgagaccuaccuggagggcugcccccagcugauccugcagcuguacauccugcuggagcacggccaggccaacuucagccaguacgccgccaucauggugagcugcugcgccaucagcuggagcaccguggacuaccagguggcccugagaaagagccugcccgacaagaagcugcugaacggccugugccccaagaucaccuaccuguucuacaagcuguucacccugcugagcuggaugcugagcguggugcugcugcuguuccugaacgugaagaucgcccuguuccugcugcuguuccuguggcugcugggcaucaucugggccuucaagaacaacacccaguucugcaccugcaucagcauggaguuccuguacagaaucguggugggcuucauccugaucuucaccuucuucaacaucaagggccagaacaccaagugccccaugagcugcuacuacaucgugagagugcugggcacccugggcauccugaccguguucugggugugcccccugaccaucuucaaccccgacuacuucauccccaucagcaucaccaucgugcugacccugcugcugggcauccuguuccugaucguguacuacggcagcuuccaccccaacagaagcgccgagaccaagugcgacgagaucgacggcaagcccgugcugagagagugcagaaugagauacuuccugauggaguaa

SEQ ID NO: 25728 - RNA, 822 nt, Artificial Sequence
  XPA__Homo_sapiens__NP_000371
auggccgccgccgacggcgcccugcccgaggccgccgcccuggagcagcccgccgagcugcccgccagcgugagagccagcaucgagagaaagagacagagagcccugaugcugagacaggccagacuggccgccagacccuacagcgccaccgccgccgccgccaccggcggcauggccaacgugaaggccgcccccaagaucaucgacaccggcggcggcuucauccuggaggaggaggaggaggaggagcagaagaucggcaagguggugcaccagcccggccccgugauggaguucgacuacgugaucugcgaggagugcggcaaggaguucauggacagcuaccugaugaaccacuucgaccugcccaccugcgacaacugcagagacgccgacgacaagcacaagcugaucaccaagaccgaggccaagcaggaguaccugcugaaggacugcgaccuggagaagagagagcccccccugaaguucaucgugaagaagaacccccaccacagccaguggggcgacaugaagcuguaccugaagcugcagaucgugaagagaagccuggagguguggggcagccaggaggcccuggaggaggccaaggaggugagacaggagaacagagagaagaugaagcagaagaaguucgacaagaaggugaaggagcugagaagagccgugagaagcagcguguggaagagagagaccaucgugcaccagcacgaguacggccccgaggagaaccuggaggacgacauguacagaaagaccugcaccaugugcggccacgagcugaccuacgagaagauguaa

SEQ ID NO: 25729 - RNA, 2823 nt, Artificial Sequence
  XPC__Homo_sapiens__NP_004619
auggccagaaagagagccgccggcggcgagcccagaggcagagagcugagaagccagaagagcaaggccaagagcaaggccagaagagaggaggaggaggaggacgccuucgaggacgagaagccccccaagaagagccugcugagcaaggugagccagggcaagagaaagagaggcugcagccaccccggcggcagcgccgacggccccgccaagaagaagguggccaaggugaccgugaagagcgagaaccugaaggugaucaaggacgaggcccugagcgacggcgacgaccugagagacuuccccagcgaccugaagaaggcccaccaccugaagagaggcgccaccaugaacgaggacagcaacgaggaggaggaggagagcgagaacgacugggaggagguggaggagcugagcgagcccgugcugggcgacgugagagagagcaccgccuucagcagaagccugcugcccgugaagcccguggagaucgagaucgagacccccgagcaggccaagaccagagagagaagcgagaagaucaagcuggaguucgagaccuaccugagaagagccaugaagagauucaacaagggcgugcacgaggacacccacaaggugcaccugcugugccugcuggccaacggcuucuacagaaacaacaucugcagccagcccgaccugcacgccaucggccugagcaucauccccgccagauucaccagagugcugcccagagacguggacaccuacuaccugagcaaccuggugaagugguucaucggcaccuucaccgugaacgccgagcugagcgccagcgagcaggacaaccugcagaccacccuggagagaagauucgccaucuacagcgccagagacgacgaggagcuggugcacaucuuccugcugauccugagagcccugcagcugcugaccagacuggugcugagccugcagcccaucccccugaagagcgccaccgccaagggcaagaagcccagcaaggagagacugaccgccgaccccggcggcagcagcgagaccagcagccaggugcuggagaaccacaccaagcccaagaccagcaagggcaccaagcaggaggagaccuucgccaagggcaccugcagacccagcgccaagggcaagagaaacaagggcggcagaaagaagagaagcaagcccagcagcagcgaggaggacgagggccccggcgacaagcaggagaaggccacccagagaagaccccacggcagagagagaagaguggccagcagagugagcuacaaggaggagagcggcagcgacgaggccggcagcggcagcgacuucgagcugagcagcggcgaggccagcgaccccagcgacgaggacagcgagcccggcccccccaagcagagaaaggcccccgccccccagagaaccaaggccggcagcaagagcgccagcagaacccacagaggcagccacagaaaggaccccagccugcccgccgccagcagcagcagcagcagcagcaagagaggcaagaagaugugcagcgacggcgagaaggccgagaagagaagcaucgccggcaucgaccaguggcuggagguguucugcgagcaggaggagaagugggugugcguggacugcgugcacggcguggugggccagccccugaccugcuacaaguacgccaccaagcccaugaccuacguggugggcaucgacagcgacggcugggugagagacgugacccagagauacgaccccguguggaugaccgugaccagaaagugcagaguggacgccgaguggugggccgagacccugagacccuaccagagccccuucauggacagagagaagaaggaggaccuggaguuccaggccaagcacauggaccagccccugcccaccgccaucggccuguacaagaaccacccccuguacgcccugaagagacaccugcugaaguacgaggccaucuaccccgagaccgccgccauccugggcuacugcagaggcgaggccguguacagcagagacugcgugcacacccugcacagcagagacaccuggcugaagaaggccagaguggugagacugggcgaggugcccuacaagauggugaagggcuucagcaacagagccagaaaggccagacuggccgagccccagcugagagaggagaacgaccugggccuguucggcuacuggcagaccgaggaguaccagccccccguggccguggacggcaaggugcccagaaacgaguucggcaacguguaccuguuccugcccagcaugaugcccaucggcugcgugcagcugaaccugcccaaccugcacagaguggccagaaagcuggacaucgacugcgugcaggccaucaccggcuucgacuuccacggcggcuacagccaccccgugaccgacggcuacaucgugugcgaggaguucaaggacgugcugcugaccgccugggagaacgagcaggccgugaucgagagaaaggagaaggagaagaaggagaagagagcccugggcaacuggaagcugcuggccaagggccugcugaucagagagagacugaagagaagauacggccccaagagcgaggccgccgccccccacaccgacgccggcggcggccugagcagcgacgaggaggagggcaccagcagccaggccgaggccgccagaauccuggccgccagcuggccccagaacagagaggacgaggagaagcagaagcugaagggcggccccaagaagaccaagagagagaagaaggccgccgccagccaccuguuccccuucgagcagcuguaa

SEQ ID NO: 25730 - RNA, 1929 nt, Artificial Sequence
  XPNPEP1__Homo_sapiens__NP_001161076
auggccgccagcagaaagccccccagagugagagugaaccaccaggacuuccagcugagaaaccugagaaucaucgagcccaacgaggugacccacagcggcgacaccggcguggagaccgacggcagaaugccccccaaggugaccagcgagcugcugagacagcugagacaggccaugagaaacagcgaguacgugaccgagcccauccaggccuacaucauccccagcggcgacgcccaccagagcgaguacaucgcccccugcgacugcagaagagccuucgugagcggcuucgacggcagcgccggcaccgccaucaucaccgaggagcacgccgccauguggaccgacggcagauacuuccugcaggccgccaagcagauggacagcaacuggacccugaugaagaugggccugaaggacacccccacccaggaggacuggcuggugagcgugcugcccgagggcagcagagugggcguggacccccugaucauccccaccgacuacuggaagaagauggccaaggugcugagaagcgccggccaccaccugauccccgugaaggagaaccugguggacaagaucuggaccgacagacccgagagacccugcaagccccugcugacccugggccuggacuacaccggcaucagcuggaaggacaagguggccgaccugagacugaagauggccgagagaaacgugaugugguucguggugaccgcccuggacgagaucgccuggcuguucaaccugagaggcagcgacguggagcacaaccccguguucuucagcuacgccaucaucggccuggagaccaucaugcuguucaucgacggcgacagaaucgacgcccccagcgugaaggagcaccugcugcuggaccugggccuggaggccgaguacagaauccaggugcaccccuacaagagcauccugagcgagcugaaggcccugugcgccgaccugagccccagagagaaggugugggugagcgacaaggccagcuacgccgugagcgagaccauccccaaggaccacagaugcugcaugcccuacacccccaucugcaucgccaaggccgugaagaacagcgccgagagcgagggcaugagaagagcccacaucaaggacgccguggcccugugcgagcuguucaacuggcuggagaaggaggugcccaagggcggcgugaccgagaucagcgccgccgacaaggccgaggaguucagaagacagcaggccgacuucguggaccugagcuuccccaccaucagcagcaccggccccaacggcgccaucauccacuacgccgacggcaccaccgacgugaccagaaccaugcacuucggcacccccaccgccuacgagaaggagugcuucaccuacgugcugaagggccacaucgccgugagcgccgccguguuccccaccggcaccaagggccaccugcuggacagcuucgccagaagcgcccugugggacagcggccuggacuaccugcacggcaccggccacggcgugggcagcuuccugaacgugcacgagggccccugcggcaucagcuacaagaccuucagcgacgagccccuggaggccggcaugaucgugaccgacgagcccggcuacuacgaggacggcgccuucggcaucagaaucgagaacguggugcugguggugcccgugaagaccaaguacaacuucaacaacagaggcagccugaccuucgagccccugacccuggugcccauccagaccaagaugaucgacguggacagccugaccgacaaggagugcgacuggcugaacaacuaccaccugaccugcagagacgugaucggcaaggagcugcagaagcagggcagacaggaggcccuggaguggcugaucagagagacccagcccaucagcaagcagcacuaa

SEQ ID NO: 25731 - RNA, 2025 nt, Artificial Sequence
  XPNPEP2__Homo_sapiens__NP_003390
auggccagagcccacuggggcugcugccccuggcuggugcugcugugcgccugcgccuggggccacaccaagcccguggaccugggcggccaggacgugagaaacugcagcaccaacccccccuaccugcccgugaccguggugaacaccaccaugagccugaccgcccugagacagcagaugcagacccagaaccugagcgccuacaucauccccggcaccgacgcccacaugaacgaguacaucggccagcacgacgagagaagagccuggaucaccggcuucaccggcagcgccggcaccgccguggugaccaugaagaaggccgccguguggaccgacagcagauacuggacccaggccgagagacagauggacugcaacugggagcugcacaaggaggugggcaccacccccaucgugaccuggcugcugaccgagauccccgccggcggcagagugggcuucgaccccuuccugcugagcaucgacaccugggagagcuacgaccuggcccugcagggcagcaacagacagcuggugagcaucaccaccaaccugguggaccugguguggggcagcgagagaccccccgugcccaaccagcccaucuacgcccugcaggaggccuucaccggcagcaccuggcaggagaaggugagcggcgugagaagccagaugcagaagcaccagaaggugcccaccgccgugcugcugagcgcccuggaggagaccgccuggcuguucaaccugagagccagcgacauccccuacaaccccuucuucuacagcuacacccugcugaccgacagcagcaucagacuguucgccaacaagagcagauucagcagcgagacccugagcuaccugaacagcagcugcaccggccccaugugcgugcagaucgaggacuacagccaggugagagacagcauccaggccuacagccugggcgacgugagaaucuggaucggcaccagcuacaccauguacggcaucuacgagaugauccccaaggagaagcuggugaccgacaccuacagccccgugaugaugaccaaggccgugaagaacagcaaggagcaggcccugcugaaggccagccacgugagagacgccguggccgugaucagauaccugguguggcuggagaagaacgugcccaagggcaccguggacgaguucagcggcgccgagaucguggacaaguucagaggcgaggagcaguucagcagcggccccagcuucgagaccaucagcgccagcggccugaacgccgcccuggcccacuacagccccaccaaggagcugaacagaaagcugagcagcgacgagauguaccugcuggacagcggcggccaguacugggacggcaccaccgacaucaccagaaccgugcacuggggcacccccagcgccuuccagaaggaggccuacaccagagugcugaucggcaacaucgaccugagcagacugaucuuccccgccgccaccagcggcagaaugguggaggccuucgccagaagagcccugugggacgccggccugaacuacggccacggcaccggccacggcaucggcaacuuccugugcgugcacgaguggcccgugggcuuccagagcaacaacaucgccauggccaagggcauguucaccagcaucgagcccggcuacuacaaggacggcgaguucggcaucagacuggaggacguggcccuggugguggaggccaagaccaaguaccccggcagcuaccugaccuucgagguggugagcuucgugcccuacgacagaaaccugaucgacgugagccugcugagccccgagcaccugcaguaccugaacagauacuaccagaccaucagagagaaggugggccccgagcugcagagaagacagcugcuggaggaguucgaguggcugcagcagcacaccgagccccuggccgccagagcccccgacaccgccagcugggccagcgugcugguggugagcacccuggccauccugggcuggagcguguaa

SEQ ID NO: 25732 - RNA, 1524 nt, Artificial Sequence
  XPNPEP3__Homo_sapiens__NP_071381
augcccuggcugcugagcgcccccaagcuggugcccgccguggccaacgugagaggccugagcggcugcaugcugugcagccagagaagauacagccugcagcccgugcccgagagaagaauccccaacagauaccugggccagcccagccccuucacccacccccaccugcugagacccggcgaggugacccccggccugagccagguggaguacgcccugagaagacacaagcugaugagccugauccagaaggaggcccagggccagagcggcaccgaccagaccgugguggugcugagcaaccccaccuacuacaugagcaacgacauccccuacaccuuccaccaggacaacaacuuccuguaccugugcggcuuccaggagcccgacagcauccuggugcugcagagccugcccggcaagcagcugcccagccacaaggccauccuguucgugcccagaagagaccccagcagagagcugugggacggccccagaagcggcaccgacggcgccaucgcccugaccggcguggacgaggccuacacccuggaggaguuccagcaccugcugcccaagaugaaggccgagaccaacauggugugguacgacuggaugagacccagccacgcccagcugcacagcgacuacaugcagccccugaccgaggccaaggccaagagcaagaacaaggugagaggcgugcagcagcugauccagagacugagacugaucaagagccccgccgagaucgagagaaugcagaucgccggcaagcugaccagccaggccuucaucgagaccauguucaccagcaaggcccccguggaggaggccuuccuguacgccaaguucgaguucgagugcagagccagaggcgccgacauccuggccuacccccccgugguggccggcggcaacagaagcaacacccugcacuacgugaagaacaaccagcugaucaaggacggcgagauggugcugcuggacggcggcugcgagagcagcugcuacgugagcgacaucaccagaaccuggcccgugaacggcagauucaccgccccccaggccgagcuguacgaggccgugcuggagauccagagagacugccuggcccugugcuuccccggcaccagccuggagaacaucuacagcaugaugcugacccugaucggccagaagcugaaggaccugggcaucaugaagaacaucaaggagaacaacgccuucaaggccgccagaaaguacugcccccaccacgugggccacuaccugggcauggacgugcacgacacccccgacaugcccagaagccugccccugcagcccggcauggugaucaccaucgagcccggcaucuacauccccgaggacgacaaggacgcccccgagaaguucagaggccugggcgugagaaucgaggacgacgugguggugacccaggacagcccccugauccugagcgccgacugccccaaggagaugaacgacaucgagcagaucugcagccaggccagcuaa

SEQ ID NO: 25733 - RNA, 3216 nt, Artificial Sequence
  XPO1__Homo_sapiens__XP_011531399
augcccgccaucaugaccaugcuggccgaccacgccgccagacagcugcuggacuucagccagaagcuggacaucaaccugcuggacaacguggugaacugccuguaccacggcgagggcgcccagcagagaauggcccaggaggugcugacccaccugaaggagcaccccgacgccuggaccagaguggacaccauccuggaguucagccagaacaugaacaccaaguacuacggccugcagauccuggagaacgugaucaagaccagauggaagauccugcccagaaaccagugcgagggcaucaagaaguacguggugggccugaucaucaagaccagcagcgaccccaccugcguggagaaggagaagguguacaucggcaagcugaacaugauccuggugcagauccugaagcaggaguggcccaagcacuggcccaccuucaucagcgacaucgugggcgccagcagaaccagcgagagccugugccagaacaacauggugauccugaagcugcugagcgaggagguguucgacuucagcagcggccagaucacccaggugaagagcaagcaccugaaggacagcaugugcaacgaguucagccagaucuuccagcugugccaguucgugauggagaacagccagaacgccccccuggugcacgccacccuggagacccugcugagauuccugaacuggaucccccugggcuacaucuucgagaccaagcugaucagcacccugaucuacaaguuccugaacgugcccauguucagaaacgugagccugaagugccugaccgagaucgccggcgugagcgugagccaguacgaggagcaguucgugacccuguucacccugaccaugaugcagcugaagcagaugcugccccugaacaccaacaucagacuggccuacagcaacggcaaggacgacgagcagaacuucauccagaaccugagccuguuccugugcaccuuccugaaggagcacgaccagcugaucgagaagagacugaaccugagagagacccugauggaggcccugcacuacaugcugcuggugagcgagguggaggagaccgagaucuucaagaucugccuggaguacuggaaccaccuggccgccgagcuguacagagagagccccuucagcaccagcgccagcccccugcugagcggcagccagcacuucgacgugccccccagaagacagcuguaccugcccaugcuguucaaggugagacugcugauggugagcagaauggccaagcccgaggaggugcuggugguggagaacgaccagggcgagguggugagagaguucaugaaggacaccgacagcaucaaccuguacaagaacaugagagagacccugguguaccugacccaccuggacuacguggacaccgagagaaucaugaccgagaagcugcacaaccaggugaacggcaccgaguggagcuggaagaaccugaacacccugugcugggccaucggcagcaucagcggcgccaugcacgaggaggacgagaagagauuccuggugaccgugaucaaggaccugcugggccugugcgagcagaagagaggcaaggacaacaaggccaucaucgccagcaacaucauguacaucgugggccaguaccccagauuccugagagcccacuggaaguuccugaagaccguggugaacaagcuguucgaguucaugcacgagacccacgacggcgugcaggacauggccugcgacaccuucaucaagaucgcccagaagugcagaagacacuucgugcaggugcaggugggcgaggugaugcccuucaucgacgagauccugaacaacaucaacaccaucaucugcgaccugcagccccagcaggugcacaccuucuacgaggccgugggcuacaugaucggcgcccagaccgaccagaccgugcaggagcaccugaucgagaaguacaugcugcugcccaaccaggugugggacagcaucauccagcaggccaccaagaacguggacauccugaaggaccccgagaccgugaagcagcugggcagcauccugaagaccaacgugagagccugcaaggccgugggccaccccuucgugauccagcugggcagaaucuaccuggacaugcugaacguguacaagugccugagcgagaacaucagcgccgccauccaggccaacggcgagauggugaccaagcagccccugaucagaagcaugagaaccgugaagagagagacccugaagcugaucagcggcugggugagcagaagcaacgacccccagaugguggccgagaacuucgugcccccccugcuggacgccgugcugaucgacuaccagagaaacgugcccgccgccagagagcccgaggugcugagcaccauggccaucaucgugaacaagcugggcggccacaucaccgccgagaucccccagaucuucgacgccguguucgagugcacccugaacaugaucaacaaggacuucgaggaguaccccgagcacagaaccaacuucuuccugcugcugcaggccgugaacagccacugcuuccccgccuuccuggccaucccccccacccaguucaagcuggugcuggacagcaucaucugggccuucaagcacaccaugagaaacguggccgacaccggccugcagauccuguucacccugcugcagaacguggcccaggaggaggccgccgcccagagcuucuaccagaccuacuucugcgacauccugcagcacaucuucagcguggugaccgacaccagccacaccgccggccugaccaugcacgccagcauccuggccuacauguucaaccugguggaggagggcaagaucagcaccagccugaaccccggcaaccccgugaacaaccagaucuuccugcaggaguacguggccaaccugcugaagagcgccuucccccaccugcaggacgcccaggugaagcuguucgugaccggccuguucagccugaaccaggacauccccgccuucaaggagcaccugagagacuuccuggugcagaucaaggaguucgccggcgaggacaccagcgaccuguuccuggaggagagagagaucgcccugagacaggccgacgaggagaagcacaagagacagaugagcgugcccggcaucuucaacccccacgagauccccgaggagaugugcgacuaa

SEQ ID NO: 25734 - RNA, 3456 nt, Artificial Sequence
  XPO4__Homo_sapiens__NP_071904
augauggccgccgcccugggcccccccgaggugaucgcccagcuggagaacgccgccaaggugcugauggccccccccagcauggugaacaacgagcagagacagcacgccgagcacaucuuccugagcuucagaaagagcaagagccccuucgccgugugcaagcacauccuggagaccagcaagguggacuacgugcuguuccaggccgccaccgccaucauggaggccguggugagagaguggauccugcuggagaagggcagcaucgagagccugagaaccuuccugcugaccuacgugcugcagagacccaaccugcagaaguacgugagagagcagauccugcuggccguggccgugaucgugaagagaggcagccuggacaagagcaucgacugcaagagcaucuuccacgaggugagccagcugaucagcagcggcaaccccaccgugcagacccuggccugcagcauccugaccgcccugcugagcgaguucagcagcagcagcaagaccagcaacaucggccugagcauggaguuccacggcaacugcaagagaguguuccaggaggaggaccugagacagaucuucaugcugaccguggaggugcugcaggaguucagcagaagagagaaccugaacgcccagaugagcagcguguuccagagauaccuggcccuggccaaccaggugcugagcuggaacuuccugccccccaaccugggcagacacuacaucgccauguucgagagcagccagaacgugcugcugaagcccaccgagagcuggagagagacccugcuggacagcagagugauggagcuguucuucaccgugcacagaaagaucagagaggacagcgacauggcccaggacagccugcagugccuggcccagcuggccagccugcacggccccaucuuccccgacgagggcagccagguggacuaccuggcccacuucaucgagggccugcugaacaccaucaacggcaucgagaucgaggacagcgaggccgugggcaucagcagcaucaucagcaaccugaucaccguguuccccagaaacgugcugaccgccauccccagcgagcuguucagcagcuucgugaacugccugacccaccugaccugcagcuucggcagaagcgccgcccuggaggaggugcuggacaaggacgacaugguguacauggaggccuacgacaagcugcuggagagcuggcugacccuggugcaggacgacaagcacuuccacaagggcuucuucacccagcacgccgugcagguguucaacagcuacauccagugccaccuggccgcccccgacggcaccagaaaccugaccgccaacggcguggccagcagagaggaggaggagaucagcgagcugcaggaggacgacagagaccaguucagcgaccagcuggccagcgugggcaugcugggcagaaucgccgccgagcacugcaucccccugcugaccagccugcuggaggagagagugaccagacugcacggccagcugcagagacaccagcagcagcugcuggccagccccggcagcagcaccguggacaacaagaugcuggacgaccuguacgaggacauccacuggcugauccuggugaccggcuaccugcuggccgacgacacccagggcgagaccccccugaucccccccgagaucauggaguacagcaucaagcacagcagcgagguggacaucaacaccacccugcagauccugggcagccccggcgagaaggccagcagcauccccggcuacaacagaaccgacagcgugaucagacugcugagcgccauccugagagugagcgagguggagagcagagccaucagagccgaccugacccaccugcugagcccccagaugggcaaggacaucgugugguuccugaagagaugggccaagaccuaccugcugguggacgagaagcuguacgaccagaucagccugcccuucagcaccgccuucggcgccgacaccgagggcagccaguggaucaucggcuaccugcugcagaaggugaucagcaaccugagcguguggagcagcgagcaggaccuggccaacgacaccgugcagcugcuggugacccugguggagagaagagagagagccaaccuggugauccagugcgagaacugguggaaccuggccaagcaguucgccagcagaagccccccccugaacuuccugagcagccccgugcagagaacccugaugaaggcccuggugcugggcggcuucgcccacauggacaccgagaccaagcagcaguacuggaccgaggugcugcagccccugcagcagagauuccugagagugaucaaccaggagaacuuccagcagaugugccagcaggaggaggugaagcaggagaucaccgccacccuggaggcccugugcggcaucgccgaggccacccagaucgacaacguggccauccuguucaacuuccugauggacuuccugaccaacugcaucggccugauggagguguacaagaacacccccgagaccgugaaccugaucaucgagguguucguggagguggcccacaagcagaucugcuaccugggcgagagcaaggccaugaaccuguacgaggccugccugacccugcugcagguguacagcaagaacaaccugggcagacagagaaucgacgugaccgccgaggaggagcaguaccaggaccugcugcugaucauggagcugcugaccaaccugcugagcaaggaguucaucgacuucagcgacaccgacgagguguucagaggccacgagcccggccaggccgccaacagaagcgugagcgccgccgacguggugcuguacggcgugaaccugauccugccccugaugagccaggaccugcugaaguuccccacccugugcaaccaguacuacaagcugaucaccuucaucugcgagaucuuccccgagaagaucccccagcugcccgaggaccuguucaagagccugauguacagccuggagcugggcaugaccagcaugagcagcgaggugugccagcugugccuggaggcccugaccccccuggccgagcagugcgccaaggcccaggagaccgacagcccccuguuccuggccaccagacacuuccugaagcugguguucgacaugcuggugcugcagaagcacaacaccgagaugaccaccgccgccggcgaggccuucuacacccuggugugccugcaccaggccgaguacagcgagcugguggagacccugcugagcagccagcaggaccccgugaucuaccagagacuggccgacgccuucaacaagcugaccgccagcagcaccccccccacccuggacagaaagcagaagauggccuuccugaagagccuggaggaguucauggccaacgugggcggccugcugugcgugaaguaa

SEQ ID NO: 25735 - RNA, 3615 nt, Artificial Sequence
  XPO5__Homo_sapiens__NP_065801
auggccauggaccaggugaacgcccugugcgagcagcuggugaaggccgugaccgugaugauggaccccaacagcacccagagauacagacuggaggcccugaaguucugcgaggaguucaaggagaagugccccaucugcgugcccugcggccugagacuggccgagaagacccagguggccaucgugagacacuucggccugcagauccuggagcacguggugaaguucagauggaacggcaugagcagacuggagaagguguaccugaagaacagcgugauggagcugaucgccaacggcacccugaacauccuggaggaggagaaccacaucaaggacgcccugagcagaaucgugguggagaugaucaagagagaguggccccagcacuggcccgacaugcugaucgagcuggacacccugagcaagcagggcgagacccagaccgagcuggugauguucauccugcugagacuggccgaggacguggugaccuuccagacccugcccccccagagaagaagagacauccagcagacccugacccagaacauggagagaaucuucagcuuccugcugaacacccugcaggagaacgugaacaaguaccagcaggugaagaccgacaccagccaggagagcaaggcccaggccaacugcagagugggcguggccgcccugaacacccuggccggcuacaucgacugggugagcaugagccacaucaccgccgagaacugcaagcugcuggagauccugugccugcugcugaacgagcaggagcugcagcugggcgccgccgagugccugcugaucgccgugagcagaaagggcaagcuggaggacagaaagccccugauggugcuguucggcgacguggccaugcacuacauccugagcgccgcccagaccgccgacggcggcggccugguggagaagcacuacguguuccugaagagacugugccaggugcugugcgcccugggcaaccagcugugcgcccugcugggcgccgacagcgacguggagacccccagcaacuucggcaaguaccuggagagcuuccuggccuucaccacccaccccagccaguuccugagaagcagcacccagaugaccuggggcgcccuguucagacacgagauccugagcagagacccccugcugcuggccaucauccccaaguaccugagagccagcaugaccaaccuggugaagaugggcuuccccagcaagaccgacagccccagcugcgaguacagcagauucgacuucgacagcgacgaggacuucaacgccuucuucaacagcagcagagcccagcagggcgaggugaugagacuggccugcagacuggaccccaagaccagcuuccagauggccggcgaguggcugaaguaccagcugagcaccuuccuggacgccggcagcgugaacagcugcagcgccgugggcaccggcgagggcagccugugcagcguguucagccccagcuucgugcagugggaggccaugacccuguuccuggagagcgugaucacccagauguucagaacccugaacagagaggagauccccgugaacgacggcaucgagcugcugcagauggugcugaacuucgacaccaaggacccccugauccugagcugcgugcugaccaacgugagcgcccuguuccccuucgugaccuacagacccgaguuccugccccagguguucagcaagcuguucagcagcgugaccuucgagaccguggaggagagcaaggcccccagaaccagagccgugagaaacgugagaagacacgccugcagcagcaucaucaagaugugcagagacuacccccagcuggugcugcccaacuucgacaugcuguacaaccacgugaagcagcugcugagcaacgagcugcugcugacccagauggagaagugcgcccugauggaggcccuggugcugaucagcaaccaguucaagaacuacgagagacagaagguguuccuggaggagcugauggcccccguggccagcaucuggcugagccaggacaugcacagagugcugagcgacguggacgccuucaucgccuacgugggcaccgaccagaagagcugcgaccccggccuggaggaccccugcggccugaacagagccagaaugagcuucugcguguacagcauccugggcguggugaagagaaccugcuggcccaccgaccuggaggaggccaaggccggcggcuucguggugggcuacaccagcagcggcaaccccaucuucagaaaccccugcaccgagcagauccugaagcugcuggacaaccugcuggcccugaucagaacccacaacacccuguacgcccccgagaugcuggccaagauggccgagcccuucaccaaggcccuggacaugcuggacgccgagaagagcgccauccugggccugccccagccccugcuggagcugaacgacagccccguguucaagaccgugcuggagagaaugcagagauucuucagcacccuguacgagaacugcuuccacauccugggcaaggccggccccagcaugcagcaggacuucuacaccguggaggaccuggccacccagcugcugagcagcgccuucgugaaccugaacaacauccccgacuacagacugagacccaugcugagaguguucgugaagccccuggugcuguucugcccccccgagcacuacgaggcccuggugagccccauccugggcccccuguucaccuaccugcacaugagacugagccagaaguggcaggugaucaaccagagaagccugcugugcggcgaggacgaggccgccgacgagaaccccgagagccaggagaugcuggaggagcagcuggugagaaugcugaccagagaggugauggaccugaucaccgugugcugcgugagcaagaagggcgccgaccacagcagcgccccccccgccgacggcgacgacgaggagaugauggccaccgaggugacccccagcgccauggccgagcugaccgaccugggcaagugccugaugaagcacgaggacgugugcaccgcccugcugaucaccgccuucaacagccuggccuggaaggacacccugagcugccagagaaccaccagccagcugugcuggccccugcugaagcaggugcugagcggcacccugcuggccgacgccgugaccuggcuguucaccagcgugcugaagggccugcagaugcacggccagcacgacggcugcauggccagccuggugcaccuggccuuccagaucuacgaggcccugagacccagauaccuggagaucagagccgugauggagcagauccccgagauccagaaggacagccuggaccaguucgacugcaagcugcugaaccccagccugcagaagguggccgacaagagaagaaaggaccaguucaagagacugaucgccggcugcaucggcaagccccugggcgagcaguucagaaaggaggugcacaucaagaaccugcccagccuguucaagaagaccaagcccaugcuggagaccgaggugcuggacaacgacggcggcggccuggccaccaucuucgagcccuaa

SEQ ID NO: 25736 - RNA, 3336 nt, Artificial Sequence
  XPO6__Homo_sapiens__NP_001257869
augaccgaguucuuccacgacugcaccaccaacgagagaaagagagagaucgaggagcugcugaacaacuucgcccagcagaucggcgccuggagauucugccuguacuuccugagcagcaccagaaacgacuacgugaugauguacagccugaccguguucgagaaccugaucaacaagauguggcugggcgugcccagccaggacaagauggagaucagaagcugccugcccaagcugcugcuggcccaccacaagacccugcccuacuucaucagaaacaagcugugcaaggugaucguggacaucggcagacaggacuggcccauguucuaccacgacuucuucaccaacauccugcagcugauccagagccccgugaccaccccccugggccugaucaugcugaagaccaccagcgaggagcuggccugccccagagaggaccugagcguggccagaaaggaggagcugagaaagcugcugcuggaccaggugcagaccgugcugggccugcugaccggcauccuggagaccgugugggacaagcacagcgugaccgccgccacccccccccccagccccaccagcggcgagagcggcgaccugcugagcaaccugcugcagagccccagcagcgccaagcugcugaaccagcccauccccauccuggacguggagagcgaguacaucugcagccuggcccuggagugccuggcccaccuguucagcuggaucccccugagcgccagcaucacccccagccugcugaccaccaucuuccacuucgccagauucggcugcgacaucagagccagaaagauggccagcgugaacggcagcagccagaacugcgugagcggccaggagagaggcagacugggcgugcuggccaugagcugcaucaacgagcugaugagcaagaacugcgugcccauggaguucgaggaguaccugcugagaauguuccagcagaccuucuaccugcugcagaagaucaccaaggacaacaacgcccacaccgugaagagcagacuggaggagcuggacgagagcuacaucgagaaguucaccgacuuccugagacuguucgugagcgugcaccugagaagaaucgagagcuacagccaguuccccgugguggaguuccugacccugcuguucaaguacaccuuccaccagcccacccacgagggcuacuucagcugccuggacaucuggacccuguuccuggacuaccugaccagcaagaucaagagcagacugggcgacaaggaggccgugcugaacagauacgaggacgcccuggugcugcugcugaccgaggugcugaacagaauccaguucagauacaaccaggcccagcuggaggagcuggacgacgagacccuggacgacgaccagcagaccgaguggcagagauaccugagacagagccuggaggugguggccaaggugauggagcugcugcccacccacgccuucagcacccuguuccccgugcugcaggacaaccuggagguguaccugggccugcagcaguucaucgugaccagcggcagcggccacagacugaacaucaccgccgagaacgacugcagaagacugcacugcagccugagagaccugagcagccugcugcaggccgugggcagacuggccgaguacuucaucggcgacguguucgccgccagauucaacgacgcccugaccgugguggagagacuggugaaggugacccuguacggcagccagaucaagcuguacaacaucgagaccgccgugcccagcgugcugaagcccgaccugaucgacgugcacgcccagagccuggccgcccugcaggccuacagccacuggcuggcccaguacugcagcgaggugcacagacagaacacccagcaguucgugacccugaucagcaccaccauggacgccaucaccccccugaucagcaccaaggugcaggacaagcugcugcugagcgccugccaccugcuggugagccuggccaccaccgugagacccguguuccugaucagcauccccgccgugcagaagguguucaacagaaucaccgacgccagcgcccugagacugguggacaaggcccaggugcuggugugcagagcccugagcaacauccugcugcugcccuggcccaaccugcccgagaacgagcagcaguggcccgugagaagcaucaaccacgccagccugaucagcgcccugagcagagacuacagaaaccugaagcccagcgccguggccccccagagaaagaugccccuggacgacaccaagcugaucauccaccagacccugagcgugcuggaggacaucguggagaacaucagcggcgagagcaccaagagcagacagaucugcuaccagagccugcaggagagcgugcaggugagccuggcccuguuccccgccuucauccaccagagcgacgugaccgacgagaugcugagcuucuuccugacccuguucagaggccugagagugcagaugggcgugcccuucaccgagcagaucauccagaccuuccugaacauguucaccagagagcagcuggccgagagcauccugcacgagggcagcaccggcugcagagugguggagaaguuccugaagauccugcaggugguggugcaggagcccggccagguguucaagcccuuccugcccagcaucaucgcccugugcauggagcagguguaccccaucaucgccgagagacccagccccgacgugaaggccgagcuguucgagcugcuguucagaacccugcaccacaacuggagauacuucuucaagagcaccgugcuggccagcgugcagagaggcaucgccgaggagcagauggagaacgagccccaguucagcgccaucaugcaggccuucggccagagcuuccugcagcccgacauccaccuguucaagcagaaccuguucuaccuggagacccugaacaccaagcagaagcuguaccacaagaagaucuucagaaccgccaugcuguuccaguucgugaacgugcugcugcaggugcuggugcacaagagccacgaccugcugcaggaggagaucggcaucgccaucuacaacauggccagcguggacuucgacggcuucuucgccgccuuccugcccgaguuccugaccagcugcgacggcguggacgccaaccagaagagcgugcugggcagaaacuucaagauggacagagaccugcccagcuucacccagaacgugcacagacuggugaacgaccugagauacuacagacugugcaacgacagccugccccccggcaccgugaagcuguaa

SEQ ID NO: 25737 - RNA, 3264 nt, Artificial Sequence
  XPO7__Homo_sapiens__NP_055839
auggccgaccacgugcagagccuggcccagcuggagaaccugugcaagcagcuguacgagaccaccgacaccaccaccagacugcaggccgagaaggcccugguggaguucaccaacagccccgacugccugagcaagugccagcugcugcuggagagaggcagcagcagcuacagccagcugcuggccgccaccugccugaccaagcuggugagcagaaccaacaacccccugccccuggagcagagaaucgacaucagaaacuacgugcugaacuaccuggccaccagacccaagcuggccaccuucgugacccaggcccugauccagcuguacgccagaaucaccaagcugggcugguucgacugccagaaggacgacuacguguucagaaacgccaucaccgacgugaccagauuccugcaggacagcguggaguacugcaucaucggcgugaccauccugagccagcugaccaacgagaucaaccaggccgacaccacccacccccugaccaagcacagaaagaucgccagcagcuucagagacagcagccuguucgacaucuucacccugagcugcaaccugcugaagcaggccagcggcaagaaccugaaccugaacgacgagagccagcacggccugcugaugcagcugcugaagcugacccacaacugccugaacuucgacuucaucggcaccagcaccgacgagagcagcgacgaccugugcaccgugcagauccccaccagcuggagaagcgccuuccuggacagcagcacccugcagcuguucuucgaccuguaccacagcaucccccccagcuucagcccccuggugcugagcugccuggugcagaucgccagcgugagaagaagccuguucaacaacgccgagagagccaaguuccugagccaccugguggacggcgugaagagaauccuggagaacccccagagccugagcgaccccaacaacuaccacgaguucugcagacugcuggccagacugaagagcaacuaccagcugggcgagcuggugaagguggagaacuaccccgaggugaucagacugaucgccaacuucaccgugaccagccugcagcacugggaguucgcccccaacagcgugcacuaccugcugagccuguggcagagacuggccgccagcgugcccuacgugaaggccaccgagccccacaugcuggagaccuacacccccgaggugaccaaggccuacaucaccagcagacuggagagcgugcacaucauccugagagacggccuggaggacccccuggaggacaccggccuggugcagcagcagcuggaccagcugagcaccaucggcagaugcgaguacgagaagaccugcgcccugcuggugcagcuguucgaccagagcgcccagagcuaccaggagcugcugcagagcgccagcgccagccccauggacaucgccgugcaggagggcagacugaccuggcugguguacaucaucggcgccgugaucggcggcagagugagcuucgccagcaccgacgagcaggacgccauggacggcgagcuggugugcagagugcugcagcugaugaaccugaccgacagcagacuggcccaggccggcaacgagaagcuggagcuggccaugcugagcuucuucgagcaguucagaaagaucuacaucggcgaccaggugcagaagagcagcaagcuguacagaagacugagcgaggugcugggccugaacgacgagaccauggugcugagcguguucaucggcaagaucaucaccaaccugaaguacuggggcagaugcgagcccaucaccagcaagacccugcagcugcugaacgaccugagcaucggcuacagcagcgugagaaagcuggugaagcugagcgccgugcaguucaugcugaacaaccacaccagcgagcacuucagcuuccugggcaucaacaaccagagcaaccugaccgacaugagaugcagaaccaccuucuacaccgcccugggcagacugcugaugguggaccugggcgaggacgaggaccaguacgagcaguucaugcugccccugaccgccgccuucgaggccguggcccagauguucagcaccaacagcuucaacgagcaggaggccaagagaacccuggugggccuggugagagaccugagaggcaucgccuucgccuucaacgccaagaccagcuucaugaugcuguucgaguggaucuaccccagcuacaugcccauccugcagagagccaucgagcugugguaccacgaccccgccugcaccacccccgugcugaagcugauggccgagcuggugcacaacagaagccagagacugcaguucgacgugagcagccccaacggcauccugcuguucagagagaccagcaagaugaucaccauguacggcaacagaauccugacccugggcgaggugcccaaggaccagguguacgcccugaagcugaagggcaucagcaucugcuucagcaugcugaaggccgcccugagcggcagcuacgugaacuucggcguguucagacuguacggcgacgacgcccuggacaacgcccugcagaccuucaucaagcugcugcugagcaucccccacagcgaccugcuggacuaccccaagcugagccagagcuacuacagccugcuggaggugcugacccaggaccacaugaacuucaucgccagccuggagccccacgugaucauguacauccugagcagcaucagcgagggccugaccgcccuggacaccauggugugcaccggcugcugcagcugccuggaccacaucgugaccuaccuguucaagcagcugagcagaagcaccaagaagagaaccaccccccugaaccaggagagcgacagauuccugcacaucaugcagcagcaccccgagaugauccagcagaugcugagcaccgugcugaacaucaucaucuucgaggacugcagaaaccaguggagcaugagcagaccccugcugggccugauccugcugaacgagaaguacuucagcgaccugagaaacagcaucgugaacagccagccccccgagaagcagcaggccaugcaccugugcuucgagaaccugauggagggcaucgagagaaaccugcugaccaagaacagagacagauucacccagaaccugagcgccuucagaagagaggugaacgacagcaugaagaacagcaccuacggcgugaacagcaacgacaugaugagcuaa

SEQ ID NO: 25738 - RNA, 1896 nt, Artificial Sequence
  XPR1__Homo_sapiens__NP_001129141
augaaguucgccgagcaccugagcgcccacaucacccccgaguggagaaagcaguacauccaguacgaggccuucaaggacaugcuguacagcgcccaggaccaggcccccagcguggaggugaccgacgaggacaccgugaagagauacuucgccaaguucgaggagaaguucuuccagaccugcgagaaggagcuggccaagaucaacaccuucuacagcgagaagcuggccgaggcccagagaagauucgccacccugcagaacgagcugcagagcagccuggacgcccagaaggagagcaccggcgugaccacccugagacagagaagaaagcccguguuccaccugagccacgaggagagagugcagcacagaaacaucaaggaccugaagcuggccuucagcgaguucuaccugagccugauccugcugcagaacuaccagaaccugaacuucaccggcuucagaaagauccugaagaagcacgacaagauccuggagaccagcagaggcgccgacuggagaguggcccacguggagguggcccccuucuacaccugcaagaagaucaaccagcugaucagcgagaccgaggccguggugaccaacgagcuggaggacggcgacagacagaaggccaugaagagacugagagugcccccccugggcgccgcccagcccgcccccgccuggaccaccuucagagugggccuguucugcggcaucuucaucgugcugaacaucacccuggugcuggccgccguguucaagcuggagaccgacagaagcaucuggccccugaucagaaucuacagaggcggcuuccugcugaucgaguuccuguuccugcugggcaucaacaccuacggcuggagacaggccggcgugaaccacgugcugaucuucgagcugaaccccagaagcaaccugagccaccagcaccuguucgagaucgccggcuuccugggcauccuguggugccugagccugcuggccugcuucuucgcccccaucagcgugauccccaccuacguguacccccuggcccuguacggcuucaugguguucuuccugaucaaccccaccaagaccuucuacuacaagagcagauucuggcugcugaagcugcuguucagaguguucaccgcccccuuccacaaggugggcuucgccgacuucuggcuggccgaccagcugaacagccugagcgugauccugauggaccuggaguacaugaucugcuucuacagccuggagcugaagugggacgagagcaagggccugcugcccaacaacagcgaggagagaggccacagcgacaccaugguguucuucuaccuguggaucguguucuacaucaucagcagcugcuacacccugaucugggaccugaagauggacuggggccuguucgacaagaacgccggcgagaacaccuuccugagagaggagaucguguacccccagaaggccuacuacuacugcgccaucaucgaggacgugauccugagauucgccuggaccauccagaucagcaucaccagcaccacccugcugccccacagcggcgacaucaucgccaccguguucgccccccuggagguguucagaagauucguguggaacuucuucagacuggagaacgagcaccugaacaacugcggcgaguucagagccgugagagacaucagcguggccccccugaacgccgacgaccagacccugcuggagcagaugauggaccaggacgacggcgugagaaacagacagaagaacagaagcuggaaguacaaccagagcaucagccugagaagacccagacuggccagccagagcaaggccagagacaccaaggugcugaucgaggacaccgacgacgaggccaacaccuaa

SEQ ID NO: 25739 - RNA, 1902 nt, Artificial Sequence
  XRCC1__Homo_sapiens__NP_006288
augcccgagaucagacugagacacguggugagcugcagcagccaggacagcacccacugcgccgagaaccugcugaaggccgacaccuacagaaaguggagagccgccaaggccggcgagaagaccaucagcguggugcugcagcuggagaaggaggagcagauccacagcguggacaucggcaacgacggcagcgccuucguggaggugcuggugggcagcagcgccggcggcgccggcgagcaggacuacgaggugcugcuggugaccagcagcuucaugagccccagcgagagcagaagcggcagcaaccccaacagagugagaauguucggccccgacaagcuggugagagccgccgccgagaagagaugggacagagugaagaucgugugcagccagcccuacagcaaggacagccccuucggccugagcuucgugagauuccacagcccccccgacaaggacgaggccgaggcccccagccagaaggugaccgugaccaagcugggccaguucagagugaaggaggaggacgagagcgccaacagccugagacccggcgcccuguucuucagcagaaucaacaagaccagccccgugaccgccagcgaccccgccggccccagcuacgccgccgccacccugcaggccagcagcgccgccagcagcgccagccccgugagcagagccaucggcagcaccagcaagccccaggagagccccaagggcaagagaaagcuggaccugaaccaggaggagaagaagacccccagcaagccccccgcccagcugagccccagcgugcccaagagacccaagcugcccgcccccaccagaacccccgccaccgcccccgugcccgccagagcccagggcgccgugaccggcaagcccagaggcgagggcaccgagcccagaagacccagagccggccccgaggagcugggcaagauccugcagggcguggugguggugcugagcggcuuccagaaccccuucagaagcgagcugagagacaaggcccuggagcugggcgccaaguacagacccgacuggaccagagacagcacccaccugaucugcgccuucgccaacacccccaaguacagccaggugcugggccugggcggcagaaucgugagaaaggagugggugcuggacugccacagaaugagaagaagacugcccagccagagauaccugauggccggccccggcagcagcagcgaggaggacgaggccagccacagcggcggcagcggcgacgaggcccccaagcugccccagaagcagccccagaccaagaccaagcccacccaggccgccggccccagcagcccccagaagccccccacccccgaggagaccaaggccgccagccccgugcugcaggaggacaucgacaucgagggcgugcagagcgagggccaggacaacggcgccgaggacagcggcgacaccgaggacgagcugagaagaguggccgagcagaaggagcacagacugccccccggccaggaggagaacggcgaggaccccuacgccggcagcaccgacgagaacaccgacagcgaggagcaccaggagccccccgaccugcccgugcccgagcugcccgacuucuuccagggcaagcacuucuuccuguacggcgaguuccccggcgacgagagaagaaagcugaucagauacgugaccgccuucaacggcgagcuggaggacuacaugagcgacagagugcaguucgugaucaccgcccaggagugggaccccagcuucgaggaggcccugauggacaaccccagccuggccuucgugagacccagauggaucuacagcugcaacgagaagcagaagcugcugccccaccagcuguacggcguggugccccaggccuaa

SEQ ID NO: 25740 - RNA, 843 nt, Artificial Sequence
  XRCC2__Homo_sapiens__NP_005422
augugcagcgccuuccacagagccgagagcggcaccgagcugcuggccagacuggagggcagaagcagccugaaggagaucgagcccaaccuguucgccgacgaggacagccccgugcacggcgacauccuggaguuccacggccccgagggcaccggcaagaccgagaugcuguaccaccugaccgccagaugcauccugcccaagagcgagggcggccuggagguggaggugcuguucaucgacaccgacuaccacuucgacaugcugagacuggugaccauccuggagcacagacugagccagagcagcgaggagaucaucaaguacugccugggcagauucuuccugguguacugcagcagcagcacccaccugcugcugacccuguacagccuggagagcauguucugcagccaccccagccugugccugcugauccuggacagccugagcgccuucuacuggaucgacagagugaacggcggcgagagcgugaaccugcaggagagcacccugagaaagugcagccagugccuggagaagcuggugaacgacuacagacuggugcuguucgccaccacccagaccaucaugcagaaggccagcagcagcagcgaggagcccagccacgccagcagaagacugugcgacguggacaucgacuacagacccuaccugugcaaggccuggcagcagcuggugaagcacagaauguucuucagcaagcaggacgacagccagagcagcaaccaguucagccuggugagcagaugccugaagagcaacagccugaagaagcacuucuucaucaucggcgagagcggcguggaguucugcuaa

SEQ ID NO: 25741 - RNA, 1041 nt, Artificial Sequence
  XRCC3__Homo_sapiens__XP_005268103
auggaccuggaccugcuggaccugaaccccagaaucaucgccgccaucaagaaggccaagcugaagagcgugaaggaggugcugcacuucagcggccccgaccugaagagacugaccaaccugagcagccccgagguguggcaccugcugagaaccgccagccugcaccugagaggcagcagcauccugaccgcccugcagcugcaccagcagaaggagagauuccccacccagcaccagagacugagccugggcugccccgugcuggacgcccugcugagaggcggccugccccuggacggcaucaccgagcuggccggcagaagcagcgccggcaagacccagcuggcccugcagcugugccuggccgugcaguuccccagacagcacggcggccuggaggccggcgccguguacaucugcaccgaggacgccuucccccacaagagacugcagcagcugauggcccagcagcccagacugagaaccgacgugcccggcgagcugcugcagaagcugagauucggcagccagaucuucaucgagcacguggccgacguggacacccugcuggagugcgugaacaagaaggugcccgugcugcugagcagaggcauggccagacugguggugaucgacagcguggccgcccccuucagaugcgaguucgacagccaggccagcgcccccagagccagacaccugcagagccugggcgccacccugagagagcugagcagcgccuuccagagccccgugcugugcaucaaccaggugaccgaggccauggaggagcagggcgccgcccacggcccccugggcuucugggacgagagagugagccccgcccugggcaucaccugggccaaccagcugcuggugagacugcuggccgacagacugagagaggaggaggccgcccugggcugccccgccagaacccugagagugcugagcgccccccaccugccccccagcagcugcagcuacaccaucagcgccgagggcgugagaggcacccccggcacccagagccacuaa

SEQ ID NO: 25742 - RNA, 1005 nt, Artificial Sequence
  XRCC4__Homo_sapiens__NP_072044
auggagagaaagaucagcagaauccaccuggugagcgagcccagcaucacccacuuccugcaggugagcugggagaagacccuggagagcggcuucgugaucacccugaccgacggccacagcgccuggaccggcaccgugagcgagagcgagaucagccaggaggccgacgacauggccauggagaagggcaaguacgugggcgagcugagaaaggcccugcugagcggcgccggccccgccgacguguacaccuucaacuucagcaaggagagcugcuacuucuucuucgagaagaaccugaaggacgugagcuucagacugggcagcuucaaccuggagaagguggagaaccccgccgaggugaucagagagcugaucugcuacugccuggacaccaucgccgagaaccaggccaagaacgagcaccugcagaaggagaacgagagacugcugagagacuggaacgacgugcagggcagauucgagaagugcgugagcgccaaggaggcccuggagaccgaccuguacaagagauucauccuggugcugaacgagaagaagaccaagaucagaagccugcacaacaagcugcugaacgccgcccaggagagagagaaggacaucaagcaggagggcgagaccgccaucugcagcgagaugaccgccgacagagaccccguguacgacgagagcaccgacgaggagagcgagaaccagaccgaccugagcggccuggccagcgccgccgugagcaaggacgacagcaucaucagcagccuggacgugaccgacaucgcccccagcagaaagagaagacagagaaugcagagaaaccugggcaccgagcccaagauggccccccaggagaaccagcugcaggagaaggagaagcccgacagcagccugcccgagaccagcaagaaggagcacaucagcgccgagaacaugagccuggagacccugagaaacagcagccccgaggaccuguucgacgagaucuaa

SEQ ID NO: 25743 - RNA, 2199 nt, Artificial Sequence
  XRCC5__Homo_sapiens__NP_066964
auggugagaagcggcaacaaggccgccguggugcugugcauggacgugggcuucaccaugagcaacagcauccccggcaucgagagccccuucgagcaggccaagaaggugaucaccauguucgugcagagacagguguucgccgagaacaaggacgagaucgcccuggugcuguucggcaccgacggcaccgacaacccccugagcggcggcgaccaguaccagaacaucaccgugcacagacaccugaugcugcccgacuucgaccugcuggaggacaucgagagcaagauccagcccggcagccagcaggccgacuuccuggacgcccugaucgugagcauggacgugauccagcacgagaccaucggcaagaaguucgagaagagacacaucgagaucuucaccgaccugagcagcagauucagcaagagccagcuggacaucaucauccacagccugaagaagugcgacaucagccugcaguucuuccugcccuucagccugggcaaggaggacggcagcggcgacagaggcgacggccccuucagacugggcggccacggccccagcuucccccugaagggcaucaccgagcagcagaaggagggccuggagaucgugaagauggugaugaucagccuggagggcgaggacggccuggacgagaucuacagcuucagcgagagccugagaaagcugugcguguucaagaagaucgagagacacagcauccacuggcccugcagacugaccaucggcagcaaccugagcaucagaaucgccgccuacaagagcauccugcaggagagagugaagaagaccuggaccgugguggacgccaagacccugaagaaggaggacauccagaaggagaccguguacugccugaacgacgacgacgagaccgaggugcugaaggaggacaucauccagggcuucagauacggcagcgacaucgugcccuucagcaagguggacgaggagcagaugaaguacaagagcgagggcaagugcuucagcgugcugggcuucugcaagagcagccaggugcagagaagauucuucaugggcaaccaggugcugaagguguucgccgccagagacgacgaggccgccgccguggcccugagcagccugauccacgcccuggacgaccuggacaugguggccaucgugagauacgccuacgacaagagagccaacccccaggugggcguggccuucccccacaucaagcacaacuacgagugccugguguacgugcagcugcccuucauggaggaccugagacaguacauguucagcagccugaagaacagcaagaaguacgcccccaccgaggcccagcugaacgccguggacgcccugaucgacagcaugagccuggccaagaaggacgagaagaccgacacccuggaggaccuguuccccaccaccaagauccccaaccccagauuccagagacuguuccagugccugcugcacagagcccugcaccccagagagccccugccccccauccagcagcacaucuggaacaugcugaacccccccgccgaggugaccaccaagagccagaucccccugagcaagaucaagacccuguucccccugaucgaggccaagaagaaggaccaggugaccgcccaggagaucuuccaggacaaccacgaggacggccccaccgccaagaagcugaagaccgagcagggcggcgcccacuucagcgugagcagccuggccgagggcagcgugaccagcgugggcagcgugaaccccgccgagaacuucagagugcuggugaagcagaagaaggccagcuucgaggaggccagcaaccagcugaucaaccacaucgagcaguuccuggacaccaacgagacccccuacuucaugaagagcaucgacugcaucagagccuucagagaggaggccaucaaguucagcgaggagcagagauucaacaacuuccugaaggcccugcaggagaagguggagaucaagcagcugaaccacuucugggagaucguggugcaggacggcaucacccugaucaccaaggaggaggccagcggcagcagcgugaccgccgaggaggccaagaaguuccuggcccccaaggacaagcccagcggcgacaccgccgccguguucgaggagggcggcgacguggacgaccugcuggacaugaucuaa

SEQ ID NO: 25744 - RNA, 741 nt, Artificial Sequence
  XRCC6BP1__Homo_sapiens__NP_150592
auggccggcgcccccgacgagagaagaagaggccccgccgccggcgagcagcugcagcagcagcacgugagcugccagguguuccccgagagacuggcccagggcaacccccagcagggcuucuucagcagcuucuucaccagcaaccagaagugccagcugagacugcugaagacccuggagaccaaccccuacgugaagcugcugcuggacgccaugaagcacagcggcugcgccgugaacaaggacagacacuucagcugcgaggacugcaacggcaacgugagcggcggcuucgacgccagcaccagccagaucgugcugugccagaacaacauccacaaccaggcccacaugaacagaguggugacccacgagcugauccacgccuucgaccacugcagagcccacguggacugguucaccaacaucagacaccuggccugcagcgaggugagagccgccaaccugagcggcgacugcagccuggugaacgagaucuucagacugcacuucggccugaagcagcaccaccagaccugcgugagagacagagccacccugagcauccuggccgugagaaacaucagcaaggagguggccaagaaggccguggacgagguguucgagagcugcuucaacgaccacgagcccuucggcagaaucccccacaacaagaccuacgccagauacgcccacagagacuucgagaacagagacagauacuacagcaacaucuaa

SEQ ID NO: 25745 - RNA, 1830 nt, Artificial Sequence
  XRCC6__Homo_sapiens__NP_001275905
augagcggcugggagagcuacuacaagaccgagggcgacgaggaggccgaggaggagcaggaggagaaccuggaggccagcggcgacuacaaguacagcggcagagacagccugaucuuccugguggacgccagcaaggccauguucgagagccagagcgaggacgagcugacccccuucgacaugagcauccagugcauccagagcguguacaucagcaagaucaucagcagcgacagagaccugcuggccgugguguucuacggcaccgagaaggacaagaacagcgugaacuucaagaacaucuacgugcugcaggagcuggacaaccccggcgccaagagaauccuggagcuggaccaguucaagggccagcagggccagaagagauuccaggacaugaugggccacggcagcgacuacagccugagcgaggugcugugggugugcgccaaccuguucagcgacgugcaguucaagaugagccacaagagaaucaugcuguucaccaacgaggacaacccccacggcaacgacagcgccaaggccagcagagccagaaccaaggccggcgaccugagagacaccggcaucuuccuggaccugaugcaccugaagaagcccggcggcuucgacaucagccuguucuacagagacaucaucagcaucgccgaggacgaggaccugagagugcacuucgaggagagcagcaagcuggaggaccugcugagaaaggugagagccaaggagaccagaaagagagcccugagcagacugaagcugaagcugaacaaggacaucgugaucagcgugggcaucuacaaccuggugcagaaggcccugaagcccccccccaucaagcuguacagagagaccaacgagcccgugaagaccaagaccagaaccuucaacaccagcaccggcggccugcugcugcccagcgacaccaagagaagccagaucuacggcagcagacagaucauccuggagaaggaggagaccgaggagcugaagagauucgacgaccccggccugaugcugaugggcuucaagccccuggugcugcugaagaagcaccacuaccugagacccagccuguucguguaccccgaggagagccuggugaucggcagcagcacccuguucagcgcccugcugaucaagugccuggagaaggagguggccgcccugugcagauacacccccagaagaaacaucccccccuacuucguggcccuggugccccaggaggaggagcuggacgaccagaagauccaggugaccccccccggcuuccagcugguguuccugcccuucgccgacgacaagagaaagaugcccuucaccgagaagaucauggccacccccgagcaggugggcaagaugaaggccaucguggagaagcugagauucaccuacagaagcgacagcuucgagaaccccgugcugcagcagcacuucagaaaccuggaggcccuggcccuggaccugauggagcccgagcaggccguggaccugacccugcccaagguggaggccaugaacaagagacugggcagccugguggacgaguucaaggagcugguguacccccccgacuacaaccccgagggcaaggugaccaagagaaagcacgacaacgagggcagcggcagcaagagacccaagguggaguacagcgaggaggagcugaagacccacaucagcaagggcacccugggcaaguucaccgugcccaugcugaaggaggccugcagagccuacggccugaagagcggccugaagaagcaggagcugcuggaggcccugaccaagcacuuccaggacuaa

SEQ ID NO: 25746 - RNA, 5085 nt, Artificial Sequence
  XRN1__Homo_sapiens__NP_001269786
augggcgugcccaaguucuacagauggaucagcgagagauaccccugccugagcgagguggugaaggagcaccagauccccgaguucgacaaccuguaccuggacaugaacggcaucauccaccagugcagccaccccaacgacgacgacgugcacuucagaaucagcgacgacaagaucuucaccgacaucuuccacuaccuggaggugcuguucagaaucaucaagcccagaaagguguucuucauggccguggacggcguggcccccagagccaagaugaaccagcagagaggcagaagauucagaagcgccaaggaggccgaggacaagaucaagaaggccaucgagaagggcgagacccugcccaccgaggccagauucgacagcaacugcaucacccccggcaccgaguucauggccagacugcacgagcaccugaaguacuucgugaacaugaagaucagcaccgacaagagcuggcagggcgugaccaucuacuucagcggccacgagacccccggcgagggcgagcacaagaucauggaguucaucagaagcgagaaggccaagcccgaccacgaccccaacaccagacacugccuguacggccuggacgccgaccugaucaugcugggccugaccagccacgaggcccacuucagccugcugagagaggaggugagauucggcggcaagaagacccagagagugugcgcccccgaggagaccaccuuccaccugcugcaccugagccugaugagagaguacaucgacuacgaguucagcgugcugaaggagaagaucaccuucaaguacgacaucgagagaaucaucgacgacuggauccugaugggcuuccuggugggcaacgacuucaucccccaccugccccaccugcacaucaaccacgacgcccugccccugcuguacggcaccuacgugaccauccugcccgagcugggcggcuacaucaacgagagcggccaccugaaccugcccagauucgagaaguaccuggugaagcugagcgacuucgacagagagcacuucagcgagguguucguggaccugaagugguucgagagcaaggugggcaacaaguaccugaacgaggccgccggcguggccgccgaggaggccagaaacuacaaggagaagaagaagcugaagggccaggagaacagccugugcuggaccgcccuggacaagaacgagggcgagaugaucaccagcaaggacaaccuggaggacgagaccgaggacgacgaccuguucgagaccgaguucagacaguacaagagaaccuacuacaugaccaagaugggcguggacguggugagcgacgacuuccuggccgaccaggccgccugcuacgugcaggccauccaguggauccugcacuacuacuaccacggcgugcagagcuggagcugguacuaccccuaccacuacgcccccuuccugagcgacauccacaacaucagcacccugaagauccacuucgagcugggcaagcccuucaagcccuucgagcagcugcuggccgugcugcccgccgccagcaagaaccugcugcccgccugcuaccagcaccugaugaccaacgaggacagccccaucaucgaguacuacccccccgacuucaagaccgaccugaacggcaagcagcaggagugggaggccguggugcugauccccuucaucgacgagaagagacugcuggaggccauggagaccugcaaccacagccugaagaaggaggagagaaagagaaaccagcacagcgagugccugaugugcugguacgacagagacaccgaguucaucuaccccagccccuggcccgagaaguuccccgccaucgagagaugcugcaccagauacaagaucaucagccuggacgccuggagaguggacaucaacaagaacaagaucaccagaaucgaccagaaggcccuguacuucugcggcuuccccacccugaagcacaucagacacaaguucuuccugaagaagagcggcgugcagguguuccagcagagcagcagaggcgagaacaugaugcuggagauccugguggacgccgagagcgacgagcugaccguggagaacguggccagcagcgugcugggcaagagcguguucgugaacuggccccaccuggaggaggccagagugguggccgugagcgacggcgagaccaaguucuaccuggaggagccccccggcacccagaagcuguacagcggcagaaccgccccccccagcaagguggugcaccugggcgacaaggagcagagcaacugggccaaggaggugcagggcaucagcgagcacuaccugagaagaaagggcaucaucaucaacgagaccagcgccgugguguacgcccagcugcugaccggcagaaaguaccagaucaaccagaacggcgaggugagacuggagaagcaguggagcaagcagguggugcccuucguguaccagaccaucgugaaggacaucagagccuucgacagcagauucagcaacaucaagacccuggacgaccuguucccccugagaagcaugguguucaugcugggcacccccuacuacggcugcaccggcgaggugcaggacagcggcgacgugaucaccgagggcagaaucagagugaucuucagcauccccugcgagcccaaccuggacgcccugauccagaaccagcacaaguacagcaucaaguacaaccccggcuacgugcuggccagcagacugggcgugagcggcuaccuggugagcagauucaccggcagcaucuucaucggcagaggcagcagaagaaacccccacggcgaccacaaggccaacgugggccugaaccugaaguucaacaagaagaacgaggaggugcccggcuacaccaagaaggugggcagcgaguggauguacagcagcgccgccgagcagcugcuggccgaguaccuggagagagcccccgagcuguucagcuacaucgccaagaacagccaggaggacguguucuacgaggacgacaucuggcccggcgagaacgagaacggcgccgagaaggugcaggagaucaucaccuggcugaagggccaccccgugagcacccugagcagaagcagcugcgaccugcagauccuggacgccgccaucguggagaagaucgaggaggagguggagaagugcaagcagagaaagaacaacaagaaggugagagugaccgugaagccccaccugcuguacagaccccuggagcagcagcacggcgugauccccgacagagacgccgaguucugccuguucgacagaguggugaacgugagagagaacuucagcgugcccgugggccugagaggcaccaucaucggcaucaagggcgccaacagagaggccgacgugcuguucgaggugcuguucgacgaggaguuccccggcggccugaccaucagaugcagccccggcagaggcuacagacugcccaccagcgcccuggugaaccugagccacggcagcagaagcgagaccggcaaccagaagcugaccgccaucgugaagccccagcccgccgugcaccagcacagcagcagcagcagcgugagcagcggccaccugggcgcccugaaccacagcccccagagccuguucgugcccacccaggugcccaccaaggacgacgacgaguucugcaacaucuggcagagccugcagggcagcggcaagaugcaguacuuccagcccaccauccaggagaagggcgccgugcugccccaggagaucagccaggugaaccagcaccacaagagcggcuucaacgacaacagcgugaaguaccagcagagaaagcacgacccccacagaaaguucaaggaggagugcaagagccccaaggccgagugcuggagccagaagaugagcaacaagcagcccaacagcggcaucgagaacuuccuggccagccugaacaucagcaaggagaacgaggugcagagcagccaccacggcgagccccccagcgaggagcaccugagcccccagagcuucgccaugaagggcaccagaaugcugaaggagauccugaagaucgacggcagcaacaccguggaccacaagaacgagaucaagcagaucgccaacgagauccccgugagcagcaacagaagagacgaguacggccugcccagccagcccaagcagaacaagaagcuggccagcuacaugaacaagccccacagcgccaacgaguaccacaacgugcagagcauggacaacaugugcuggcccgcccccagccagaucccccccgugagcacccccgugaccgagcugagcagaaucugcagccuggugggcaugccccagcccgacuucagcuuccugagaaugccccagaccaugaccgugugccaggugaagcugagcaacggccugcuggugcacggcccccagugccacagcgagaacgaggccaaggagaaggccgcccuguucgcccugcagcagcugggcagccugggcaugaacuucccccugcccagccagguguucgccaacuaccccagcgccgugccccccggcaccaucccccccgccuuccccccccccaccgccaacaucaugcccagcagcagccaccuguucggcagcaugcccuggggccccagcgugcccgugcccggcaagcccuuccaccacacccuguacagcggcaccaugcccauggccggcggcauccccggcggcgugcacaaccaguucaucccccugcaggugaccaagaagagaguggccaacaagaagaacuucgagaacaaggaggcccagagcagccaggccacccccgugcagaccagccagcccgacagcagcaacaucgugaaggugagccccagagagagcagcagcgccagccugaagagcagccccaucgcccagcccgccagcagcuuccagguggagaccgccagccagggccacagcaucagccaccacaagagcacccccaucagcagcagcagaagaaagagcagaaagcuggccgugaacuucggcgugagcaagcccagcgaguaa

SEQ ID NO: 25747 - RNA, 2853 nt, Artificial Sequence
  XRN2__Homo_sapiens__NP_036387
augggcgugcccgccuucuucagauggcugagcagaaaguaccccagcaucaucgugaacugcguggaggagaagcccaaggagugcaacggcgugaagauccccguggacgccagcaagcccaaccccaacgacguggaguucgacaaccuguaccuggacaugaacggcaucauccaccccugcacccaccccgaggacaagcccgcccccaagaacgaggacgagaugaugguggccaucuucgaguacaucgacagacuguucagcaucgugagacccagaagacugcuguacauggccaucgacggcguggcccccagagccaagaugaaccagcagagaagcagaagauucagagccagcaaggagggcauggaggccgccguggagaagcagagagugagagaggagauccuggccaagggcggcuuccugccccccgaggagaucaaggagagauucgacagcaacugcaucacccccggcaccgaguucauggacaaccuggccaagugccugagauacuacaucgccgacagacugaacaacgaccccggcuggaagaaccugaccgugauccugagcgacgccagcgcccccggcgagggcgagcacaagaucauggacuacaucagaagacagagagcccagcccaaccacgaccccaacacccaccacugccugugcggcgccgacgccgaccugaucaugcugggccuggccacccacgagcccaacuucaccaucaucagagaggaguucaagcccaacaagcccaagcccugcggccugugcaaccaguucggccacgaggugaaggacugcgagggccugcccagagagaagaagggcaagcacgacgagcuggccgacagccugcccugcgccgagggcgaguucaucuuccugagacugaacgugcugagagaguaccuggagagagagcugaccauggccagccugcccuucaccuucgacguggagagaagcaucgacgacuggguguucaugugcuucuucgugggcaacgacuuccugccccaccugcccagccuggagaucagagagaacgccaucgacagacuggugaacaucuacaagaacguggugcacaagaccggcggcuaccugaccgagagcggcuacgugaaccugcagagagugcagaugaucaugcuggccgugggcgagguggaggacagcaucuucaagaagagaaaggacgacgaggacagcuucagaagaagacagaaggagaagagaaagagaaugaagagagaccagcccgccuucacccccagcggcauccugaccccccacgcccugggcagcagaaacagccccggcagccagguggccagcaaccccagacaggccgccuacgagaugagaaugcagaacaacagcagccccagcaucagccccaacaccagcuucaccagcgacggcagccccagcccccugggcggcaucaagagaaaggccgaggacagcgacagcgagcccgagcccgaggacaacgugagacugugggaggccggcuggaagcagagauacuacaagaacaaguucgacguggacgccgccgacgagaaguucagaagaaagguggugcagagcuacguggagggccugugcugggugcugagauacuacuaccagggcugcgccagcuggaagugguacuaccccuuccacuacgcccccuucgccagcgacuucgagggcaucgccgacaugcccagcgacuucgagaagggcaccaagcccuucaagccccuggagcagcugaugggcguguuccccgccgccagcggcaacuuccugccccccagcuggagaaagcugaugagcgaccccgacagcagcaucaucgacuucuaccccgaggacuucgccaucgaccugaacggcaagaaguacgccuggcagggcguggcccugcugcccuucguggacgagagaagacugagagccgcccuggaggagguguaccccgaccugacccccgaggagaccagaagaaacagccugggcggcgacgugcuguucgugggcaagcaccacccccugcacgacuucauccuggagcuguaccagaccggcagcaccgagcccguggaggugccccccgagcugugccacggcauccagggcaaguucagccuggacgaggaggccauccugcccgaccagaucgugugcagccccgugcccaugcugagagaccugacccagaacaccguggugagcaucaacuucaaggacccccaguucgccgaggacuacaucuucaaggccgugaugcugcccggcgccagaaagcccgccgccgugcugaagcccagcgacugggagaagagcagcaacggcagacaguggaagccccagcugggcuucaacagagacagaagacccgugcaccuggaccaggccgccuucagaacccugggccacgugaugcccagaggcagcggcaccggcaucuacagcaacgccgcccccccccccgugaccuaccagggcaaccuguacagaccccugcugagaggccaggcccagauccccaagcugaugagcaacaugagaccccaggacagcuggagaggcccccccccccuguuccagcagcagagauucgacagaggcgugggcgccgagccccugcugcccuggaacagaaugcugcagacccagaacgccgccuuccagcccaaccaguaccagaugcuggccggccccggcggcuacccccccagaagagacgacagaggcggcagacagggcuaccccagagagggcagaaaguacccccugcccccccccagcggcagauacaacuggaacuaa

SEQ ID NO: 25748 - RNA, 1797 nt, Artificial Sequence
  XRRA1__Homo_sapiens__NP_001257309
auggccuucagcggcaucuacaagcuggacgacggcaagcccuaccugaacaacugcuuccccgccagaaaccugcugagagugcccgaggagggccagggccacuggcugguggugcagaagggcaaccugaagaagaagcccaagggccuggugggcgcccaggccgagagaagagagagccugaaggccaccagcuucgaguucaagggcaagaaggagagcagaagagagaaccagguggaccugcccggccacauccuggaccaggccuuccugcugaagcaccacugcgugagaaagcccagcgaccugugcaccaucaacgccaaggagaacgacuucaagcacuuccacagcgugaucuacaucaacgccagcgagaaccugcugccccuggaggccuuccacaccuuccccgcccugaaggagcuggaccuggccuucaacggcaucaagaccaucuacgugaaguacggcgacuucaagcugcuggaguuccuggaccugagcuucaacagccugaccguggaggccaucugcgaccugggcauccugccccaccugagagugcugcugcugaccggcaacggccugaccagccugccccccaaccuggccguggccgagcaggaggccagcgugaccagccugaccagcaagagauacauccugagauuccccgcccuggagacccugaugcuggacgacaacagacugagcaaccccagcugcuucgccagccuggccggccugagaagacugaagaagcugagccuggacgagaacagaaucaucagaauccccuaccugcagcaggugcagcuguacgacgagagcguggacuggaacggcggcagaggcagcccccacaaggagccccaguucaugcugcagagcaagcccagaaugcuggaggacagcgacgagcagcuggacuacaccgugcugcccaugaagaaggacguggacagaaccggcgugcccccccugcugaagagcuuccugcaggagagacugggcauccaccugaucagaagaaagaucgugaagcccaagcaccacgugcugaugagcagaaaggagagcuggaaggugaagagcgagauccccaaggugcccaagcagccccuggugcugcaccaccccagaaugaccaccaccaagagccccagcaaggacaugcuggagcccgaggccgagcuggccgaggaccugcccaccaccaagagcaccagcguggagagcgagaugcccaccgagaaccuggagggccacagccccagcugcagaaccuucgugccccugccccccaucugcagcaacagcaccgugcacagcgaggagacccugagccaccugagcgacaccaccgugagacugagccccgagagacccagcgacgaggacagcaagagcaccgagagcaucuuccugacccaggugagcgagcugcccagcagcgugauccacaaggacgaccuggagcugaaggagaaggaccagaagaagccccccaccgcccccagagaggugaagggcaccagaagaaagcugcccaccgccuuccugcccagcaaguaccacggcuacgaggagcugcugaccgccaagcccgaccccgccuucaucgagcccaagggcauccagaagaacgcccaggcccugcagcagaugcugaagcacccccugcugugccacagcagcaagcccaagcuggacacccugcagaagcccuacgugcacaaggagaagagagugcugagcugcaccagcggccagaacggcggcugguaa

SEQ ID NO: 25749 - RNA, 1182 nt, Artificial Sequence
  XXYLT1__Homo_sapiens__NP_689744
augggccugcugagaggcggccugcccugcgccagagccauggccagacugggcgccgugagaagccacuacugcgcccugcugcuggccgccgcccuggccgugugcgccuucuacuaccugggcagcggcagagagaccuucagcagcgccaccaagagacugaaggaggccagagccggcgcccccgccgcccccagcccccccgcccuggagcuggccagaggcagcguggcccccgcccccggcgccaaggccaagagccuggagggcggcggcgccggccccguggacuaccaccugcugaugauguucaccaaggccgagcacaacgccgcccugcaggccaaggccagaguggcccugagaagccugcugagacuggccaaguucgaggcccacgaggugcugaaccugcacuucgugagcgaggaggccagcagagagguggccaagggccugcugagagagcugcugccccccgccgccggcuucaagugcaaggugaucuuccacgacguggccgugcugaccgacaagcuguuccccaucguggaggccaugcagaagcacuucagcgccggccugggcaccuacuacagcgacagcaucuucuuccugagcguggccaugcaccagaucaugcccaaggagauccugcagaucauccagcuggaccuggaccugaaguucaagaccaacaucagagagcuguucgaggaguucgacagcuuccugcccggcgccaucaucggcaucgccagagagaugcagcccguguacagacacaccuucuggcaguucagacacgagaacccccagaccagagugggcggccccccccccgagggccugcccggcuucaacagcggcgugaugcugcugaaccuggaggccaugagacagagcccccuguacagcagacugcuggagcccgcccaggugcagcagcuggccgacaaguaccacuucagaggccaccugggcgaccaggacuucuucaccaugaucggcauggagcaccccaagcuguuccacgugcuggacugcaccuggaacagacagcugugcaccugguggagagaccacggcuacagcgacguguucgaggccuacuucagaugcgagggccacgugaagaucuaccacggcaacugcaacacccccauccccgaggacuaa

SEQ ID NO: 25750 - RNA, 1611 nt, Artificial Sequence
  XYLB__Homo_sapiens__NP_005099
auggccgagcacgcccccagaagaugcugccugggcugggacuucagcacccagcaggugaaggugguggccguggacgccgagcugaacguguucuacgaggagagcgugcacuucgacagagaccugcccgaguucggcacccagggcggcgugcacgugcacaaggacggccugaccgugaccagccccgugcugaugugggugcaggcccuggacaucauccuggagaagaugaaggccagcggcuucgacuucagccaggugcuggcccugagcggcgccggccagcagcacggcagcaucuacuggaaggccggcgcccagcaggcccugaccagccugagccccgaccugagacugcaccagcagcugcaggacugcuucagcaucagcgacugccccguguggauggacagcagcaccaccgcccagugcagacagcuggaggccgccgugggcggcgcccaggcccugagcugccugaccggcagcagagccuacgagagauucaccggcaaccagaucgccaagaucuaccagcagaaccccgaggccuacagccacaccgagagaaucagccuggugagcagcuucgccgccagccuguuccugggcagcuacagccccaucgacuacagcgacggcagcggcaugaaccugcugcagauccaggacaagguguggagccaggccugccugggcgccugcgccccccaccuggaggagaagcugagcccccccgugcccagcugcagcguggugggcgccaucagcagcuacuacgugcagagauacggcuucccccccggcugcaaggugguggccuucaccggcgacaaccccgccagccuggccggcaugagacuggaggagggcgacaucgccgugagccugggcaccagcgacacccuguuccuguggcugcaggagcccaugcccgcccuggagggccacaucuucugcaaccccguggacagccagcacuacauggcccugcugugcuucaagaacggcagccugaugagagagaagaucagaaacgagagcgugagcagaagcuggagcgacuucagcaaggcccugcagagcaccgagaugggcaacggcggcaaccugggcuucuacuucgacgugauggagaucacccccgagaucaucggcagacacagauucaacaccgagaaccacaagguggccgccuuccccggcgacguggaggugagagcccugaucgagggccaguucauggccaagagaauccacgccgagggccugggcuacagagugaugagcaagaccaagauccuggccaccggcggcgccagccacaacagagagauccugcaggugcuggccgacguguucgacgcccccguguacgugaucgacaccgccaacagcgccugcgugggcagcgccuacagagccuuccacggccuggccggcggcaccgacgugcccuucagcgagguggugaagcuggcccccaaccccagacuggccgccacccccagccccggcgccagccagguguacgaggcccugcugccccaguacgccaagcuggagcagagaauccugagccagaccagaggcccccccgaguaa

SEQ ID NO: 25751 - RNA, 2880 nt, Artificial Sequence
  XYLT1__Homo_sapiens__NP_071449
augguggccgcccccugcgccagaagacuggccagaagaagccacagcgcccugcuggccgcccugaccgugcugcugcugcagacccuggugguguggaacuucagcagccuggacagcggcgccggcgagagaagaggcggcgccgccgugggcggcggcgagcagcccccccccgcccccgcccccagaagagagagaagagaccugcccgccgagcccgccgccgccagaggcggcggcggcggcggcggcggcggcggcggcggcagaggcccccaggccagagccagaggcggcggccccggcgagcccagaggccagcagcccgccagcagaggcgcccugcccgccagagcccuggacccccaccccagcccccugaucacccuggagacccaggacggcuacuucagccacagacccaaggagaaggugagaaccgacagcaacaacgagaacagcgugcccaaggacuucgagaacguggacaacagcaacuucgcccccagaacccagaagcagaagcaccagcccgagcuggccaagaagccccccagcagacagaaggagcugcugaagagaaagcuggagcagcaggagaagggcaagggccacaccuuccccggcaagggccccggcgaggugcugccccccggcgacagagccgccgccaacagcagccacggcaaggacgugagcagacccccccacgccagaaagaccggcggcagcagccccgagaccaaguacgaccagccccccaagugcgacaucagcggcaaggaggccaucagcgcccugagcagagccaagagcaagcacugcagacaggagaucggcgagaccuacugcagacacaagcugggccugcugaugcccgagaaggugaccagauucugcccccuggagggcaaggccaacaagaacgugcagugggacgaggacagcguggaguacaugcccgccaaccccgugagaaucgccuucgugcugguggugcacggcagagccagcagacagcugcagagaauguucaaggccaucuaccacaaggaccacuucuacuacauccacguggacaagagaagcaacuaccugcacagacaggugcugcaggugagcagacaguacagcaacgugagagugacccccuggagaauggccaccaucuggggcggcgccagccugcugagcaccuaccugcagagcaugagagaccugcuggagaugaccgacuggcccugggacuucuucaucaaccugagcgccgccgacuaccccaucagaaccaacgaccagcugguggccuuccugagcagauacagagacaugaacuuccugaagagccacggcagagacaacgccagauucaucagaaagcagggccuggacagacuguuccuggagugcgacgcccacauguggagacugggcgacagaagaauccccgagggcaucgccguggacggcggcagcgacugguuccugcugaacagaagauucguggaguacgugaccuucagcaccgacgaccuggugaccaagaugaagcaguucuacagcuacacccugcugcccgccgagagcuucuuccacaccgugcuggagaacagcccccacugcgacaccaugguggacaacaaccugagaaucaccaacuggaacagaaagcugggcugcaagugccaguacaagcacaucguggacuggugcggcugcagccccaacgacuucaagccccaggacuuccacagauuccagcagaccgccagacccaccuucuucgccagaaaguucgaggccguggugaaccaggagaucaucggccagcuggacuacuaccuguacggcaacuaccccgccggcacccccggccugagaagcuacugggagaacguguacgacgagcccgacggcauccacagccugagcgacgugacccugacccuguaccacagcuucgccagacugggccugagaagagccgagaccagccugcacaccgacggcgagaacagcugcagauacuaccccaugggccaccccgccagcgugcaccuguacuuccuggccgacagauuccagggcuuccugaucaagcaccacgccaccaaccuggccgugagcaagcuggagacccuggagaccugggugaugcccaagaagguguucaagaucgccagcccccccagcgacuucggcagacugcaguucagcgaggugggcaccgacugggacgccaaggagagacuguucagaaacuucggcggccugcugggccccauggacgagcccgugggcaugcagaaguggggcaagggccccaacgugaccgugaccgugaucuggguggaccccgugaacgugaucgccgccaccuacgacauccugaucgagagcaccgccgaguucacccacuacaagcccccccugaaccugccccugagacccggcguguggaccgugaagauccugcaccacugggugcccguggccgagaccaaguuccugguggccccccugaccuucagcaacagacagcccaucaagcccgaggaggcccugaagcugcacaacggcccccugagaaacgccuacauggagcagagcuuccagagccugaaccccgugcugagccugcccaucaaccccgcccagguggagcaggccagaagaaacgccgccagcaccggcaccgcccuggagggcuggcuggacagccuggugggcggcauguggaccgccauggacaucugcgccaccggccccaccgccugccccgugaugcagaccugcagccagaccgccuggagcagcuucagccccgaccccaagagcgagcugggcgccgugaagcccgacggcagacugagauaa

SEQ ID NO: 25752 - RNA, 2598 nt, Artificial Sequence
  XYLT2__Homo_sapiens__NP_071450
augguggccagcgccagagugcagaagcuggugagaagauacaagcuggccaucgccaccgcccuggccauccugcugcugcagggccuggugguguggagcuucagcggccuggaggaggacgaggccggcgagaagggcagacagagaaagcccagaccccuggaccccggcgagggcagcaaggacaccgacagcagcgccggcagaagaggcagcaccggcagaagacacggcagauggagaggcagagccgagagccccggcgugcccguggccaagguggugagagccgugaccagcagacagagagccagcagaagagugccccccgcccccccccccgaggcccccggcagacagaaccugagcggcgccgccgccggcgaggcccuggugggcgccgccggcuuccccccccacggcgacaccggcagcguggagggcgccccccagcccaccgacaacggcuucacccccaagugcgagaucgugggcaaggacgcccugagcgcccuggccagagccagcaccaagcagugccagcaggagaucgccaacguggugugccugcaccaggccggcagccugaugcccaaggccgugcccagacacugccagcugaccggcaagaugagccccggcauccagugggacgagagccaggcccagcagcccauggacggcccccccgugagaaucgccuacaugcugguggugcacggcagagccaucagacagcugaagagacugcugaaggccguguaccacgagcagcacuucuucuacauccacguggacaagagaagcgacuaccugcacagagaggugguggagcuggcccagggcuacgacaacgugagagugacccccuggagaauggugaccaucuggggcggcgccagccugcugagaauguaccugagaagcaugagagaccugcuggaggugcccggcugggccugggacuucuucaucaaccugagcgccaccgacuaccccaccagaaccaacgaggagcugguggccuuccugagcaagaacagagacaagaacuuccugaagagccacggcagagacaacagcagauucaucaagaagcagggccuggacagacuguuccacgagugcgacagccacauguggagacugggcgagagacagauccccgccggcaucgugguggacggcggcagcgacugguucgugcugaccagaagcuucguggaguacgugguguacaccgacgacccccugguggcccagcugagacaguucuacaccuacacccugcugcccgccgagagcuucuuccacaccgugcuggagaacagccuggccugcgagacccugguggacaacaaccugagagugaccaacuggaacagaaagcugggcugcaagugccaguacaagcacaucguggacuggugcggcugcagccccaacgacuucaagccccaggacuuccugagacugcagcaggugagcagacccaccuucuucgccagaaaguucgagagcaccgugaaccaggaggugcuggagauccuggacuuccaccuguacggcagcuacccccccggcacccccgcccugaaggccuacugggagaacaccuacgacgccgccgacggccccagcggccugagcgacgugaugcugaccgccuacaccgccuucgccagacugagccugcaccacgccgccaccgccgccccccccaugggcaccccccugugcagauucgagcccagaggccugcccagcagcgugcaccuguacuucuacgacgaccacuuccagggcuaccuggugacccaggccgugcagcccagcgcccagggccccgccgagacccuggagauguggcugaugccccagggcagccugaagcugcugggcagaagcgaccaggccagcagacugcagagccuggaggugggcaccgacugggaccccaaggagagacuguucagaaacuucggcggccugcugggcccccuggacgagcccguggccgugcagagaugggccagaggccccaaccugaccgccaccgugguguggaucgaccccaccuacgugguggccaccagcuacgacaucaccguggacaccgagaccgaggugacccaguacaagcccccccugagcagaccccugagacccggccccuggaccgugagacugcugcaguucugggagccccugggcgagaccagauuccuggugcugccccugaccuucaacagaaagcugccccugagaaaggacgacgccagcuggcugcacgccggccccccccacaacgaguacauggagcagagcuuccagggccugagcagcauccugaaccugccccagcccgagcuggccgaggaggccgcccagagacacacccagcugaccggccccgcccuggaggccuggaccgacagagagcugagcagcuucuggagcguggccggccugugcgccaucggccccagccccugccccagccuggagcccugcagacugaccagcuggagcagccugagccccgaccccaagagcgagcugggccccgugaaggccgacggcagacugagauaa

SEQ ID NO: 25753 - RNA, 621 nt, Artificial Sequence
  YAE1D1__Homo_sapiens__NP_001269375
augagcugggugcaggccgccagccugauccagggccccggcgacaagggcgacguguucgacgaggaggccgacgagagccugcuggcccagagagaguggcagagcaacaugcagagaagagugaaggagggcuacagagacggcaucgacgccggcaaggccgugacccugcagcagggcuucaaccagggcuacaagaagggcgccgaggugauccugaacuacggcagacugagaggcacccugagaaacagcaccgacuggagccugcugggccugagagccccccugagaagccccgaggugggcacccagcugcugcccagaccccugcccgugcccggccacauggccagcggcgccacccccaagcagcccaccgagcuggaggccacccugcugagccuggugccccagagcggcagagccacccccagauuccccgccagacugagagcccccggccccggcacccccagccacagaagaagauucagaagaaagccccacagagaccccgccgccgccugccccgccuggccccccgaggcccccagcaacagcgagacccacuucagcaccuacaacagaaucaucaucagaggcggccacaucuaa

SEQ ID NO: 25754 - RNA, 1515 nt, Artificial Sequence
  YAP1__Homo_sapiens__NP_001123617
auggaccccggccagcagccccccccccagcccgccccccagggccagggccagccccccagccagcccccccagggccagggcccccccagcggccccggccagcccgcccccgccgccacccaggccgccccccaggccccccccgccggccaccagaucgugcacgugagaggcgacagcgagaccgaccuggaggcccuguucaacgccgugaugaaccccaagaccgccaacgugccccagaccgugcccaugagacugagaaagcugcccgacagcuucuucaagccccccgagcccaagagccacagcagacaggccagcaccgacgccggcaccgccggcgcccugaccccccagcacgugagagcccacagcagccccgccagccugcagcugggcgccgugagccccggcacccugacccccaccggcguggugagcggccccgccgccacccccaccgcccagcaccugagacagagcagcuucgagauccccgacgacgugccccugcccgccggcugggagauggccaagaccagcagcggccagagauacuuccugaaccacaucgaccagaccaccaccuggcaggaccccagaaaggccaugcugagccagaugaacgugaccgcccccaccagcccccccgugcagcagaacaugaugaacagcgccagcggcccccugcccgacggcugggagcaggccaugacccaggacggcgagaucuacuacaucaaccacaagaacaagaccaccagcuggcuggaccccagacuggaccccagauucgccaugaaccagagaaucagccagagcgcccccgugaagcagccccccccccuggccccccagagcccccagggcggcgugaugggcggcagcaacagcaaccagcagcagcagaugagacugcagcagcugcagauggagaaggagagacugagacugaagcagcaggagcugcugagacaggccaugagaaacaucaaccccagcaccgccaacagccccaagugccaggagcuggcccugagaagccagcugcccacccuggagcaggacggcggcacccagaaccccgugagcagccccggcaugagccaggagcugagaaccaugaccaccaacagcagcgaccccuuccugaacagcggcaccuaccacagcagagacgagagcaccgacagcggccugagcaugagcagcuacagcgugcccagaacccccgacgacuuccugaacagcguggacgagauggacaccggcgacaccaucaaccagagcacccugcccagccagcagaacagauuccccgacuaccuggaggccauccccggcaccaacguggaccugggcacccuggagggcgacggcaugaacaucgagggcgaggagcugaugcccagccugcaggaggcccugagcagcgacauccugaacgacauggagagcgugcuggccgccaccaagcuggacaaggagagcuuccugaccuggcuguaa

SEQ ID NO: 25755 - RNA, 1434 nt, Artificial Sequence
  YARS2__Homo_sapiens__NP_001035526
auggccgcccccauccugagaagcuucagcuggggcagauggagcggcacccugaaccugagcgugcugcugccccugggccugagaaaggcccacagcggcgcccagggccugcuggccgcccagaaggccagaggccuguucaaggacuucuuccccgagaccggcaccaagaucgagcugcccgagcuguucgacagaggcaccgccagcuucccccagaccaucuacugcggcuucgaccccaccgccgacagccugcacgugggccaccugcuggcccugcugggccuguuccaccugcagagagccggccacaacgugaucgcccuggugggcggcgccaccgccagacugggcgaccccagcggcagaaccaaggagagagaggcccuggagaccgagagagugagagccaacgccagagcccugagacugggccuggaggcccuggccgccaaccaccagcagcuguucaccgacggcagaagcuggggcagcuucaccgugcuggacaacagcgccugguaccagaagcagcaccugguggacuuccuggccgccgugggcggccacuucagaaugggcacccugcugagcagacagagcgugcagcugagacugaagagccccgagggcaugagccuggccgaguucuucuaccaggugcugcaggccuacgacuucuacuaccuguuccagagauacggcugcagagugcagcugggcggcagcgaccagcugggcaacaucaugagcggcuacgaguucaucaacaagcugaccggcgaggacguguucggcaucaccgugccccugaucaccagcaccaccggcgccaagcugggcaagagcgccggcaacgccguguggcugaacagagacaagaccagccccuucgagcuguaccaguucuucgugagacagcccgacgacagcguggagagauaccugaagcuguucaccuuccugccccugcccgagaucgaccacaucaugcagcugcacgugaaggagcccgagagaagaggcccccagaagagacuggccgccgaggugaccaagcuggugcacggcagagagggccuggacagcgccaagagaugcacccaggcccuguaccacagcagcaucgacgcccuggaggugaugagcgaccaggagcugaaggagcuguucaaggaggcccccuucagcgaguucuuccuggaccccggcaccagcgugcuggacaccugcagaaaggccaacgccauccccgacggccccagaggcuacagaaugaucaccgagggcggcgugagcaucaaccaccagcaggugaccaaccccgagagcgugcugaucgugggccagcacauccugaagaacggccugagccugcugaagaucggcaagagaaacuucuacaucaucaaguggcugcagcuguaa

SEQ ID NO: 25756 - RNA, 1095 nt, Artificial Sequence
  YBX2__Homo_sapiens__NP_057066
augagcgagguggaggccgccgccggcgccaccgccgugcccgccgccaccgugcccgccaccgccgccggcgugguggccgugguggugcccgugcccgccggcgagccccagaagggcggcggcgccggcggcggcggcggcgccgccagcggccccgccgccggcacccccagcgcccccggcagcagaacccccggcaaccccgccaccgccgugagcggcacccccgccccccccgccagaagccaggccgacaagcccgugcuggccauccaggugcugggcaccgugaagugguucaacgugagaaacggcuacggcuucaucaacagaaacgacaccaaggaggacguguucgugcaccagaccgccaucaagagaaacaaccccagaaaguuccugagaagcgugggcgacggcgagaccguggaguucgacgugguggagggcgagaagggcgccgaggccaccaacgugaccggccccggcggcgugcccgugaagggcagcagauacgcccccaacagaagaaagagcagaagauucauccccagaccccccagcguggcccccccccccaugguggccgagauccccagcgccggcaccggccccggcagcaagggcgagagagccgaggacagcggccagagacccagaagauggugccccccccccuucuucuacagaagaagauucgugagaggccccagaccccccaaccagcagcagcccaucgagggcaccgacagaguggagcccaaggagaccgccccccuggagggccaccagcagcagggcgacgagagagugcccccccccagauucagacccagauacagaagacccuucagacccagacccagacagcagcccaccaccgagggcggcgacggcgagaccaagcccagccagggccccgccgacggcagcagacccgagccccagagacccagaaacagacccuacuuccagagaagaagacagcaggcccccggcccccagcaggcccccggccccagacagcccgccgcccccgagaccagcgcccccgugaacagcggcgaccccaccaccaccauccuggaguaa

SEQ ID NO: 25757 - RNA, 912 nt, Artificial Sequence
  YBX3__Homo_sapiens__NP_001138898
augagcgaggccggcgaggccaccaccaccaccaccaccacccugccccaggcccccaccgaggccgccgccgccgccccccaggaccccgcccccaagagccccgugggcagcggcgccccccaggccgccgcccccgcccccgccgcccacguggccggcaaccccggcggcgacgccgcccccgccgccaccggcaccgccgccgccgccagccuggccaccgccgccggcagcgaggacgccgagaagaaggugcuggccaccaaggugcugggcaccgugaagugguucaacgugagaaacggcuacggcuucaucaacagaaacgacaccaaggaggacguguucgugcaccagaccgccaucaagaagaacaaccccagaaaguaccugagaagcgugggcgacggcgagaccguggaguucgacgugguggagggcgagaagggcgccgaggccgccaacgugaccggccccgacggcgugcccguggagggcagcagauacgccgccgacagaagaagauacagaagaggcuacuacggcagaagaagaggcccccccagaaacgccggcgagaucggcgagaugaaggacggcgugcccgagggcgcccagcugcagggccccgugcacagaaaccccaccuacagacccagauacagaagcagaggcccccccagacccagacccgcccccgccgugggcgaggccgaggacaaggagaaccagcaggccaccagcggccccaaccagcccagcgugagaagaggcuacagaagacccuacaacuacagaagaagacccagaccccccaacgcccccagccaggacggcaaggaggccaaggccggcgaggcccccaccgagaaccccgccccccccacccagcagagcagcgccgaguaa

SEQ ID NO: 25758 - RNA, 972 nt, Artificial Sequence
  YDJC__Homo_sapiens__NP_001017964
augagcagacccagaaugagacugguggugaccgccgacgacuucggcuacugccccagaagagacgagggcaucguggaggccuuccuggccggcgccgugaccagcgugagccugcuggugaacggcgccgccaccgagagcgccgccgagcuggccagaagacacagcauccccaccggccugcacgccaaccugagcgagggcagacccgugggccccgccagaagaggcgccagcagccugcugggccccgagggcuucuuccugggcaagaugggcuucagagaggccguggccgccggcgacguggaccugccccaggugagagaggagcuggaggcccagcugagcugcuucagagagcugcugggcagagcccccacccacgccgacggccaccagcacgugcacgugcugcccggcgugugccagguguucgccgaggcccugcaggccuacggcgugagauucaccagacugccccuggagagaggcgugggcggcugcaccuggcuggaggcccccgccagagccuucgccugcgccguggagagagacgccagagccgccgugggccccuucagcagacacggccugagauggaccgacgccuucgugggccugagcaccugcggcagacacaugagcgcccacagagugagcggcgcccuggccagagugcuggagggcacccuggccggccacacccugaccgccgagcugauggcccaccccggcuaccccagcgugccccccaccggcggcugcggcgagggccccgacgccuucagcugcagcugggagagacugcacgagcugagagugcugaccgcccccacccugagagcccagcuggcccaggacggcgugcagcugugcgcccuggacgaccuggacagcaagagacccggcgaggaggugcccugcgagcccacccuggagcccuuccuggagcccagccugcuguaa

SEQ ID NO: 25759 - RNA, 684 nt, Artificial Sequence
  YEATS4__Homo_sapiens__NP_006521
auguucaagagaauggccgaguucggccccgacagcggcggcagagugaagggcgugaccaucgugaagcccaucguguacggcaacguggccagauacuucggcaagaagagagaggaggacggccacacccaccaguggaccguguacgugaagcccuacagaaacgaggacaugagcgccuacgugaagaagauccaguucaagcugcacgagagcuacggcaacccccugagaguggugaccaagccccccuacgagaucaccgagaccggcuggggcgaguucgagaucaucaucaagaucuucuucaucgaccccaacgagagacccgugacccuguaccaccugcugaagcuguuccagagcgacaccaacgccaugcugggcaagaagaccguggugagcgaguucuacgacgagaugaucuuccaggaccccaccgccaugaugcagcagcugcugaccaccagcagacagcugacccugggcgccuacaagcacgagaccgaguucgccgagcuggaggugaagaccagagagaagcuggaggccgccaagaagaagaccagcuucgagaucgccgagcugaaggagagacugaaggccagcagagagaccaucaacugccugaagaacgagaucagaaagcuggaggaggacgaccaggccaaggacaucuaa

SEQ ID NO: 25760 - RNA, 1632 nt, Artificial Sequence
  YES1__Homo_sapiens__XP_011524038
augggcugcaucaagagcaaggagaacaagagccccgccaucaaguacagacccgagaacacccccgagcccgugagcaccagcgugagccacuacggcgccgagcccaccaccgugagccccugccccagcagcagcgccaagggcaccgccgugaacuucagcagccugagcaugacccccuucggcggcagcagcggcgugacccccuucggcggcgccagcagcagcuucagcguggugcccagcagcuaccccgccggccugaccggcggcgugaccaucuucguggcccuguacgacuacgaggccagaaccaccgaggaccugagcuucaagaagggcgagagauuccagaucaucaacaacaccgagggcgacuggugggaggccagaagcaucgccaccggcaagaacggcuacauccccagcaacuacguggcccccgccgacagcauccaggccgaggagugguacuucggcaagaugggcagaaaggacgccgagagacugcugcugaaccccggcaaccagagaggcaucuuccuggugagagagagcgagaccaccaagggcgccuacagccugagcaucagagacugggacgagaucagaggcgacaacgugaagcacuacaagaucagaaagcuggacaacggcggcuacuacaucaccaccagagcccaguucgacacccugcagaagcuggugaagcacuacaccgagcacgccgacggccugugccacaagcugaccaccgugugccccaccgugaagccccagacccagggccuggccaaggacgccugggagauccccagagagagccugagacuggaggugaagcugggccagggcugcuucggcgagguguggaugggcaccuggaacggcaccaccaagguggccaucaagacccugaagcccggcaccaugaugcccgaggccuuccugcaggaggcccagaucaugaagaagcugagacacgacaagcuggugccccuguacgccguggugagcgaggagcccaucuacaucgugaccgaguucaugagcaagggcagccugcuggacuuccugaaggagggcgacggcaaguaccugaagcugccccagcugguggacauggccgcccagaucgccgacggcauggccuacaucgagagaaugaacuacauccacagagaccugagagccgccaacauccuggugggcgagaaccuggugugcaagaucgccgacuucggccuggccagacugaucgaggacaacgaguacaccgccagacagggcgccaaguuccccaucaaguggaccgcccccgaggccgcccuguacggcagauucaccaucaagagcgacguguggagcuucggcauccugcagaccgagcuggugaccaagggcagagugcccuaccccggcauggugaacagagaggugcuggagcagguggagagaggcuacagaaugcccugcccccagggcugccccgagagccugcacgagcugaugaaccugugcuggaagaaggaccccgacgagagacccaccuucgaguacauccagagcuuccuggaggacuacuucaccgccaccgagccccaguaccagcccggcgagaaccuguaa

SEQ ID NO: 25761 - RNA, 882 nt, Artificial Sequence
  YIF1A__Homo_sapiens__NP_065203
auggccuaccacagcggcuacggcgcccacggcagcaagcacagagccagagccgcccccgacccccccccccuguucgacgacaccagcggcggcuacagcagccagcccggcggcuaccccgccaccggcgccgacguggccuucagcgugaaccaccugcugggcgaccccauggccaacguggccauggccuacggcagcagcaucgccagccacggcaaggacauggugcacaaggagcugcacagauucgugagcgugagcaagcugaaguacuucuucgccguggacaccgccuacguggccaagaagcugggccugcugguguuccccuacacccaccagaacugggaggugcaguacagcagagacgccccccugccccccagacaggaccugaacgcccccgaccuguacauccccaccauggccuucaucaccuacgugcugcuggccggcauggcccugggcauccagaagagauucagccccgaggugcugggccugugcgccagcaccgcccugguguggguggugauggaggugcuggcccugcugcugggccuguaccuggccaccgugagaagcgaccugagcaccuuccaccugcuggccuacagcggcuacaaguacgugggcaugauccugagcgugcugaccggccugcuguucggcagcgacggcuacuacguggcccuggccuggaccagcagcgcccugauguacuucaucgugagaagccugagaaccgccgcccugggccccgacagcaugggcggccccgugcccagacagagacugcagcuguaccugacccugggcgccgccgccuuccagccccugaucaucuacuggcugaccuuccaccuggugagauaa

SEQ ID NO: 25762 - RNA, 372 nt, Artificial Sequence
  YIPF1__Homo_sapiens__XP_011539907
auguggagaaacagcaaggugaugaacaucgugagcuacagcuuccuggagaucgugugcguguacggcuacagccuguucaucuacauccccaccgccauccuguggaucaucccccagaaggccgugagauggauccuggugaugaucgcccugggcaucagcggcagccugcuggccaugaccuucuggcccgccgugagagaggacaacagaagaguggcccuggccaccaucgugaccaucgugcugcugcacaugcugcugagcgugggcugccuggccuacuucuucgacgcccccgagauggaccaccugcccaccaccaccgccacccccaaccagaccguggccgccgccaagagcagcuaa

SEQ ID NO: 25763 - RNA, 1053 nt, Artificial Sequence
  YIPF3__Homo_sapiens__NP_056203
auggccaccaccgccgcccccgccggcggcgccagaaacggcgccggccccgaguggggcggcuucgaggagaacauccagggcggcggcagcgccgugaucgacauggagaacauggacgacaccagcggcagcagcuucgaggacaugggcgagcugcaccagagacugagagaggaggagguggacgccgacgccgccgacgccgccgccgccgaggaggaggacggcgaguuccugggcaugaagggcuucaagggccagcugagcagacagguggccgaccagauguggcaggccggcaagagacaggccagcagagccuucagccuguacgccaacaucgacauccugagacccuacuucgacguggagcccgcccaggugagaagcagacugcuggagagcaugauccccaucaagauggugaacuucccccagaagaucgccggcgagcuguacggcccccugaugcugguguucacccugguggccauccugcugcacggcaugaagaccagcgacaccaucaucagagagggcacccugaugggcaccgccaucggcaccugcuucggcuacuggcugggcgugagcagcuucaucuacuuccuggccuaccugugcaacgcccagaucaccaugcugcagaugcuggcccugcugggcuacggccuguucggccacugcaucgugcuguucaucaccuacaacauccaccugcacgcccuguucuaccuguucuggcugcuggugggcggccugagcacccugagaaugguggccgugcuggugagcagaaccgugggccccacccagagacugcugcugugcggcacccuggccgcccugcacaugcuguuccugcuguaccugcacuucgccuaccacaaggugguggagggcauccuggacacccuggagggccccaacaucccccccauccagagagugcccagagacauccccgccaugcugcccgccgccagacugcccaccaccgugcugaacgccaccgccaaggccguggccgugacccugcagagccacuaa

SEQ ID NO: 25764 - RNA, 774 nt, Artificial Sequence
  YIPF5__Homo_sapiens__NP_001020118
augagcggcuucgagaaccugaacaccgacuucuaccagaccagcuacagcaucgacgaccagagccagcagagcuacgacuacggcggcagcggcggccccuacagcaagcaguacgccggcuacgacuacagccagcagggcagauucgugccccccgacaugaugcagccccagcagcccuacaccggccagaucuaccagcccacccaggccuacacccccgccagcccccagcccuucuacggcaacaacuucgaggacgagcccccccugcuggaggagcugggcaucaacuucgaccacaucuggcagaagacccugaccgugcugcacccccugaagguggccgacggcagcaucaugaacgagaccgaccuggccggccccaugguguucugccuggccuucggcgccacccugcugcuggccggcaagauccaguucggcuacguguacggcaucagcgccaucggcugccugggcauguucugccugcugaaccugaugagcaugaccggcgugagcuucggcugcguggccagcgugcugggcuacugccugcugcccaugauccugcugagcagcuucgccgugaucuucagccugcagggcauggugggcaucauccugaccgccggcaucaucggcuggugcagcuucagcgccagcaagaucuucaucagcgcccuggccauggagggccagcagcugcugguggccuaccccugcgcccugcuguacggcguguucgcccugaucagcguguucuaa

SEQ ID NO: 25765 - RNA, 597 nt, Artificial Sequence
  YKT6__Homo_sapiens__NP_006546
augaagcuguacagccugagcgugcuguacaagggcgaggccaagguggugcugcugaaggccgccuacgacgugagcagcuucagcuucuuccagagaagcagcgugcaggaguucaugaccuucaccagccagcugaucguggagagaagcagcaagggcaccagagccagcgugaaggagcaggacuaccugugccacguguacgugagaaacgacagccuggccggcguggugaucgccgacaacgaguaccccagcagaguggccuucacccugcuggagaaggugcuggacgaguucagcaagcagguggacagaaucgacuggcccgugggcagccccgccaccauccacuaccccgcccuggacggccaccugagcagauaccagaaccccagagaggccgaccccaugaccaaggugcaggccgagcuggacgagaccaagaucauccugcacaacaccauggagagccugcuggagagaggcgagaagcuggacgaccuggugagcaagagcgaggugcugggcacccagagcaaggccuucuacaagaccgccagaaagcagaacagcugcugcgccaucauguaa

SEQ ID NO: 25766 - RNA, 6441 nt, Artificial Sequence
  YLPM1__Homo_sapiens__NP_062535
auguaccccaacuggggcagauacggcggcagcagccacuacccccccccccccgugcccccccccccccccguggcccugcccgaggccagccccggccccggcuacagcagcagcaccacccccgccgcccccagcagcagcggcuucaugagcuucagagagcagcaccuggcccagcugcagcagcugcagcagaugcaccagaagcagaugcagugcgugcugcagccccaccaccugcccccccccccccugccccccccccccgugaugcccggcggcggcuacggcgacuggcagcccccccccccccccaugccccccccccccggccccgcccugagcuaccagaagcagcagcaguacaagcaccagaugcugcaccaccagagagacggcccccccggccuggugcccauggagcuggagagcccccccgagagcccccccgugccccccggcagcuacaugccccccagccagagcuacaugccccccccccagcccccccccagcuacuacccccccaccagcagccagcccuaccugccccccgcccagcccagccccagccagagcccccccagccagagcuaccuggcccccacccccagcuacagcagcagcagcagcagcagccagagcuaccugagccacagccagagcuaccugcccagcagccaggccagccccagcagacccagccagggccacagcaagagccagcugcuggccccccccccccccagcgccccccccggcaacaagaccaccgugcagcaggagccccuggagagcggcgccaagaacaagagcaccgagcagcagcaggccgcccccgagcccgaccccagcaccaugaccccccaggagcagcagcaguacugguacagacagcaccugcugagccugcagcagagaaccaaggugcaccugcccggccacaagaagggccccgugguggccaaggacacccccgagcccgugaaggaggaggugaccgugcccgccaccagccaggugcccgagagccccagcagcgaggagcccccccugcccccccccaacgaggaggugccccccccccugccccccgaggagccccagagcgaggaccccgaggaggacgccagacugaagcagcugcaggccgccgccgcccacuggcagcagcaccagcagcacagagugggcuuccaguaccagggcaucaugcagaagcacacccagcugcagcagauccugcagcaguaccagcagaucauccagccccccccccacauccagaccaugagcguggacaugcagcugagacacuacgagaugcagcagcagcaguuccagcaccuguaccaggagugggagagagaguuccagcugugggaggagcagcugcacagcuacccccacaaggaccagcugcaggaguacgagaagcaguggaagaccuggcagggccacaugaaggccacccagagcuaccugcaggagaaggugaacagcuuccagaacaugaagaaccaguacaugggcaacaugagcaugcccccccccuucgugcccuacagccagaugccccccccccugcccaccaugcccccccccgugcugccccccagccugcccccccccgugaugccccccgcccugcccgccaccgugcccccccccggcaugcccccccccgugaugccccccagccugcccaccagcgugcccccccccggcaugccccccagccugagcagcgccggccccccccccgugcugcccccccccagccugagcagcgccggccccccccccgugcugcccccccccagccugagcagcaccgcccccccccccgugaugccccugcccccccugagcagcgccacccccccccccggcauccccccccccggcgugccccagggcauccccccccagcugaccgccgcccccgugccccccgccagcagcagccagagcagccaggugcccgagaagcccagacccgcccugcugcccacccccgugagcuucggcagcgccccccccaccaccuaccaccccccccugcagagcgccggccccagcgagcaggugaacagcaaggccccccugagcaagagcgcccugcccuacagcagcuucagcagcgaccagggccugggcgagagcagcgccgcccccagccagcccaucaccgccgugaaggacaugcccgugagaagcggcggccugcugcccgacccccccagaagcagcuaccuggagagccccagaggccccagauucgacggccccagaagauucgaggaccugggcagcagaugcgagggccccagacccaagggccccagauucgagggcaacagacccgacggccccagacccagauacgagggccaccccgccgagggcaccaagagcaaguggggcaugauccccagaggccccgccagccaguucuacaucacccccagcaccagccugagccccagacagagcggcccccaguggaagggccccaagcccgccuucggccagcagcaccagcagcagcccaagagccaggccgagccccugagcggcaacaaggagccccuggccgacaccagcagcaaccagcagaagaacuucaagaugcagagcgccgccuucagcaucgccgccgacgugaaggacgugaaggccgcccagagcaacgagaaccugagcgacagccagcaggagccccccaagagcgaggugagcgagggccccguggagcccagcaacugggaccagaacgugcagagcauggagacccagaucgacaaggcccaggccgugacccagcccgugccccuggccaacaagcccgugcccgcccagagcaccuuccccagcaagaccggcggcauggagggcggcaccgccguggccaccagcagccugaccgccgacaacgacuucaagcccgugggcaucggccugccccacagcgagaacaaccaggacaagggccugcccagacccgacaacagagacaacagacuggagggcaacagaggcaacagcagcagcuacagaggccccggccagagcagaauggaggacaccagagacaagggccuggugaacagaggcagaggccaggccaucagcagaggccccggccuggugaagcaggaggacuucagagacaagaugaugggcagaagagaggacagcagagagaagaugaacagaggcgagggcagcagagacagaggccuggugagacccggcagcagcagagagaaggugcccggcggccugcagggcagccaggacagaggcgccgccggcagcagagagagaggcccccccagaagagccggcagccaggagagaggcccccugagaagagccggcagcagagagagaaucccccccagaagagccggcagcagagagagaggcccccccagaggccccggcagcagagagagaggccugggcagaagcgacuucggcagagacagaggccccuucagacccgagcccggcgacggcggcgagaagauguaccccuaccacagagacgagccccccagagcccccuggaaccacggcgaggagagaggccacgaggaguucccccuggacggcagaaacgcccccauggagagagagagacuggacgacugggacagagagagauacuggagagagugcgagagagacuaccaggacgacacccuggagcuguacaacagagaggacagauucagcgccccccccagcagaagccacgacggcgacagaagaggccccuggugggacgacugggagagagaccaggacauggacgaggacuacaacagagagauggagagagacauggacagagacguggacagaaucagcagacccauggacauguacgacagaagccuggacaacgagugggacagagacuacggcagaccccuggacgagcaggagagccaguucagagagagagacauccccagccugcccccccugcccccccugcccccccugcccccccuggacagauacagagacgacagauggagagaggagagaaacagagagcacggcuacgacagagacuucagagacagaggcgagcugagaaucagagaguaccccgagagaggcgacaccuggagagagaagagagacuacgugcccgacagaauggacugggagagagagagacugagcgacagaugguaccccagcgacguggacagacacagccccauggccgagcacaugcccagcagccaccacagcagcgagaugaugggcagcgacgccagccuggacagcgaccagggccugggcggcgugauggugcugagccagagacagcacgagaucauccugaaggccgcccaggagcugaagaugcugagagagcagaaggagcagcugcagaagaugaaggacuucggcagcgagccccagauggccgaccaccugcccccccaggagagcagacugcagaacaccagcagcagacccggcauguaccccccccccggcagcuacagaccccccccccccaugggcaagccccccggcagcaucgugagacccagcgccccccccgccagaagcagcgugcccgugaccagaccccccgugcccauccccccccccccccccccccccccccugcccccccccccccccgugaucaagccccagaccagcgccguggagcaggagagaugggacgaggacagcuucuacggccugugggacaccaacgacgagcagggccugaacagcgaguucaagagcgagaccgccgccauccccagcgcccccgugcugccccccccccccgugcacagcagcauccccccccccggccccgugcccaugggcaugccccccaugagcaagcccccccccgugcagcagaccguggacuacggccacggcagagacaucagcaccaacaagguggagcagauccccuacggcgagagaaucacccugagacccgacccccugcccgagagaagcaccuucgagaccgagcacgccggccagagagacagauacgacagagagagagacagagagcccuacuucgacagacagagcaacgugaucgccgaccacagagacuucaagagagacagagagacccacagagacagagacagagacagaggcgugaucgacuacgacagagacagauucgacagagagagaagacccagagacgacagagcccagagcuacagagacaagaaggaccacagcagcagcagaagaggcggcuucgacagacccagcuacgacagaaagagcgacagacccguguacgagggccccagcauguucggcggcgagagaagaaccuaccccgaggagagaaugccccugcccgcccccagccugagccaccagcccccccccgcccccagaguggagaagaagcccgagagcaagaacguggacgacauccugaagccccccggcagagagagcagacccgagagaaucguggugaucaugagaggccugcccggcagcggcaagacccacguggccaagcugaucagagacaaggagguggaguucggcggccccgcccccagagugcugagccuggacgacuacuucaucaccgagguggagaaggaggagaaggaccccgacagcggcaagaaggugaagaagaaggugauggaguacgaguacgaggccgagauggaggagaccuacagaaccagcauguucaagaccuucaagaagacccuggacgacggcuucuuccccuucaucauccuggacgccaucaacgacagagugagacacuucgaccaguucuggagcgccgccaagaccaagggcuucgagguguaccuggccgagaugagcgccgacaaccagaccugcggcaagagaaacauccacggcagaaagcugaaggagaucaacaagauggccgaccacugggagaccgcccccagacacaugaugagacuggacaucagaagccugcugcaggacgccgccaucgaggagguggagauggaggacuucgacgccaacaucgaggagcagaaggaggagaagaaggacgccgaggaggaggagagcgagcugggcuacauccccaagagcaagugggagauggacaccagcgaggccaagcuggacaagcuggacggccugagaaccggcaccaagagaaagagagacugggaggccaucgccagcagaauggaggacuaccugcagcugcccgacgacuacgacaccagagccagcgagcccggcaagaagagagugagaugggccgaccuggaggagaagaaggacgccgacagaaagagagccaucggcuucguggugggccagaccgacugggagaagaucaccgacgagagcggccaccuggccgagaaggcccugaacagaaccaaguacaucuaa

SEQ ID NO: 25767 - RNA, 2052 nt, Artificial Sequence
  YME1L1__Homo_sapiens__NP_001240795
auguucagccugagcagcaccgugcagccccaggugaccgugccccugagccaccugaucaacgccuuccacacccccaagaacaccagcgugagccugagcggcgugagcgugagccagaaccagcacagagacguggugcccgagcacgaggcccccagcagcgagcccagccugaaccugagagaccugggccugagcgagcugaagaucggccagaucgaccagcugguggagaaccugcugcccggcuucugcaagggcaagaacaucagcagccacuggcacaccagccacgugagcgcccagagcuucuucgagaacaaguacguguucauccagagcagaggcuucaagacccugaagagcagaaccagaagacugcagagcaccagcgagagacuggccgagacccagaacaucgcccccagcuucgugaagggcuuccugcugagagacagaggcagcgacguggagagccuggacaagcugaugaagaccaagaacauccccgaggcccaccaggacgccuucaagaccggcuucgccgagggcuuccugaaggcccaggcccugacccagaagaccaacgacagccugagaagaaccagacugauccuguucgugcugcugcuguucggcaucuacggccugcugaagaaccccuuccugagcgugagauucagaaccaccaccggccuggacagcgccguggaccccgugcagaugaagaacgugaccuucgagcacgugaagggcguggaggaggccaagcaggagcugcaggaggugguggaguuccugaagaacccccagaaguucaccauccugggcggcaagcugcccaagggcauccugcuggugggcccccccggcaccggcaagacccugcuggccagagccguggccggcgaggccgacgugcccuucuacuacgccagcggcagcgaguucgacgagauguucgugggcgugggcgccagcagaaucagaaaccuguucagagaggccaaggccaacgcccccugcgugaucuucaucgacgagcuggacagcgugggcggcaagagaaucgagagccccaugcaccccuacagcagacagaccaucaaccagcugcuggccgagauggacggcuucaagcccaacgagggcgugaucaucaucggcgccaccaacuuccccgaggcccuggacaacgcccugaucagacccggcagauucgacaugcaggugaccgugcccagacccgacgugaagggcagaaccgagauccugaagugguaccugaacaagaucaaguucgaccagagcguggaccccgagaucaucgccagaggcaccgugggcuucagcggcgccgagcuggagaaccuggugaaccaggccgcccugaaggccgccguggacggcaaggagauggugaccaugaaggagcuggaguucagcaaggacaagauccugaugggccccgagagaagaagcguggagaucgacaacaagaacaagaccaucaccgccuaccacgagagcggccacgccaucaucgccuacuacaccaaggacgccaugcccaucaacaaggccaccaucaugcccagaggccccacccugggccacgugagccugcugcccgagaacgacagauggaacgagaccagagcccagcugcuggcccagauggacgugagcaugggcggcagaguggccgaggagcugaucuucggcaccgaccacaucaccaccggcgccagcagcgacuucgacaacgccaccaagaucgccaagagaauggugaccaaguucggcaugagcgagaagcugggcgugaugaccuacagcgacaccggcaagcugagccccgagacccagagcgccaucgagcaggagaucagaauccugcugagagacagcuacgagagagccaagcacauccugaagacccacgccaaggagcacaagaaccuggccgaggcccugcugaccuacgagacccuggacgccaaggagauccagaucgugcuggagggcaagaagcuggaggugagauaa

SEQ ID NO: 25768 - RNA, 360 nt, Artificial Sequence
  YPEL1__Homo_sapiens__NP_037445
auggugaagaugaccaagagcaagaccuuccaggccuaccugcccaacugccacagaaccuacagcugcauccacugcagagcccaccuggccaaccacgacgagcugaucagcaagagcuuccagggcagccagggcagagccuaccuguucaacagcguggugaacgugggcugcggccccgccgaggagagagugcugcugaccggccugcacgccguggccgacaucuacugcgagaacugcaagaccacccugggcuggaaguacgagcacgccuucgagagcagccagaaguacaaggagggcaaguucaucaucgagcuggcccacaugaucaaggacaacggcugggaguaa

SEQ ID NO: 25769 - RNA, 360 nt, Artificial Sequence
  YPEL2__Homo_sapiens__NP_001005404
auggugaagaugaccagaagcaagaccuuccaggccuaccugcccagcugccacagaaccuacagcugcauccacugcagagcccaccuggccaaccacgacgagcugaucagcaagagcuuccagggcagccagggcagagccuaccuguucaacagcguggugaacgugggcugcggccccgccgaggagagagugcugcugaccggccugcacgccguggccgacaucuacugcgagaacugcaagaccacccugggcuggaaguacgagcacgccuucgagagcagccagaaguacaaggagggcaaguacaucaucgagcuggcccacaugaucaaggacaacggcugggacuaa

SEQ ID NO: 25770 - RNA, 360 nt, Artificial Sequence
  YPEL3__Homo_sapiens__NP_001138996
auggugagaaucagcaagcccaagaccuuccaggccuaccuggacgacugccacagaagauacagcugcgcccacugcagagcccaccuggccaaccacgacgaccugaucagcaagagcuuccagggcagccagggcagagccuaccuguucaacagcguggugaacgugggcugcggccccgccgaggagagagugcugcugaccggccugcacgccguggccgacauccacugcgagaacugcaagaccacccugggcuggaaguacgagcaggccuucgagagcagccagaaguacaaggagggcaaguacaucaucgagcugaaccacaugaucaaggacaacggcugggacuaa

SEQ ID NO: 25771 - RNA, 384 nt, Artificial Sequence
  YPEL4__Homo_sapiens__NP_659445
augcccagcugcgaccccggccccggccccgccugccugcccaccaagaccuucagaagcuaccugcccagaugccacagaaccuacagcugcgugcacugcagagcccaccuggccaagcacgacgagcugaucagcaagagcuuccagggcagccacggcagagccuaccuguucaacagcguggugaacgugggcugcggccccgccgagcagagacugcugcugaccggccugcacagcguggccgacaucuucugcgagagcugcaagaccacccugggcuggaaguacgagcaggccuucgagaccagccagaaguacaaggagggcaaguacaucaucgagaugagccacauggugaaggacaacggcugggacuaa

SEQ ID NO: 25772 - RNA, 366 nt, Artificial Sequence
  YPEL5__Homo_sapiens__NP_001120872
augggcagaaucuuccuggaccacaucggcggcaccagacuguucagcugcgccaacugcgacaccauccugaccaacagaagcgagcugaucagcaccagauucaccggcgccaccggcagagccuuccuguucaacaagguggugaaccugcaguacagcgaggugcaggacagagugaugcugaccggcagacacauggugagagacgugagcugcaagaacugcaacagcaagcugggcuggaucuacgaguucgccaccgaggacagccagagauacaaggagggcagagugauccuggagagagcccuggugagagagagcgagggcuucgaggagcacgugcccagcgacaacagcuaa

SEQ ID NO: 25773 - RNA, 2184 nt, Artificial Sequence
  YTHDC1__Homo_sapiens__NP_001026902
auggccgccgacagcagagaggagaaggacggcgagcugaacgugcuggacgacauccugaccgaggugcccgagcaggacgacgagcuguacaaccccgagagcgagcaggacaagaacgagaagaagggcagcaagagaaagagcgacagaauggagagcaccgacaccaagagacagaagcccagcgugcacagcagacagcuggugagcaagccccugagcagcagcgugagcaacaacaagagaaucgugagcaccaagggcaagagcgccaccgaguacaagaacgaggaguaccagagaagcgagagaaacaagagacuggacgccgacagaaagaucagacugagcagcagcgccagcagagagcccuacaagaaccagcccgagaagaccugcgugagaaagagagaccccgagagaagagccaagagccccacccccgacggcagcgagagaaucggccuggagguggacagaagagccagcagaagcagccagagcagcaaggaggaggugaacagcgaggaguacggcagcgaccacgagaccggcagcagcggcagcagcgacgagcagggcaacaacaccgagaacgaggaggagggcguggaggaggacguggaggaggacgaggagguggaggaggacgccgaggaggacgaggagguggacgaggacggcgaggaggaggaggaggaggaggaggaggaggaggaggaggaggaggaggaggaggaggaguacgagcaggacgagagagaccagaaggaggagggcaacgacuacgacaccagaagcgaggccagcgacagcggcagcgagagcgugagcuucaccgacggcagcgugagaagcggcagcggcaccgacggcagcgacgagaagaagaaggagagaaagagagccagaggcaucagccccaucguguucgacagaagcggcagcagcgccagcgagagcuacgccggcagcgagaagaagcacgagaagcugagcagcagcgugagagccgugagaaaggaccagaccagcaagcugaaguacgugcugcaggacgccagauucuuccugaucaagagcaacaaccacgagaacgugagccuggccaaggccaagggcguguggagcacccugcccgugaacgagaagaagcugaaccuggccuucagaagcgccagaagcgugauccugaucuucagcgugagagagagcggcaaguuccagggcuucgccagacugagcagcgagagccaccacggcggcagccccauccacugggugcugcccgccggcaugagcgccaagaugcugggcggcguguucaagaucgacuggaucugcagaagagagcugcccuucaccaagagcgcccaccugaccaaccccuggaacgagcacaagcccgugaagaucggcagagacggccaggagaucgagcuggagugcggcacccagcugugccugcuguucccccccgacgagagcaucgaccuguaccaggugauccacaagaugagacacaagagaagaaugcacagccagcccagaagcagaggcagacccagcagaagagagcccgugagagacgugggcagaagaagacccgaggacuacgacauccacaacagcagaaagaagcccagaaucgacuacccccccgaguuccaccagagacccggcuaccugaaggaccccagauaccaggagguggacagaagauucagcggcgugagaagagacguguuccugaacggcagcuacaacgacuacgugagagaguuccacaacaugggcccccccccccccuggcagggcaugccccccuaccccggcauggagcagcccccccaccaccccuacuaccagcaccacgccccccccccccaggcccacccccccuacagcggccaccaccccgugccccacgaggccagauacagagacaagagagugcacgacuacgacaugagaguggacgacuuccugagaagaacccaggccguggugagcggcagaagaagcagacccagagagagagacagagagagagagagagacagacccagagacaacagaagagacagagagagagacagaggcagagacagagagagagagagagagagacugugcgacagagacagagacagaggcgagagaggcagauacagaagauaa

SEQ ID NO: 25774 - RNA, 4293 nt, Artificial Sequence
  YTHDC2__Homo_sapiens__NP_073739
augagcagacccagcagcgugagccccagacagcccgcccccggcggcggcggcggcggcggccccagccccugcggccccggcggcggcggcagagccaagggccugaaggacaucagaaucgacgaggaggugaagaucgccgugaacaucgcccuggagagauucagauacggcgaccagagagagauggaguuccccagcagccugaccagcaccgagagagccuucauccacagacugagccagagccugggccuggugagcaagagcaagggcaagggcgccaacagauaccugaccgugaagaagaaggacggcagcgagaccgcccacgccaugaugaccugcaaccugacccacaacaccaagcacgccgugagaagccugauccagagauuccccgugaccaacaaggagagaaccgagcugcugcccaagaccgagagaggcaacguguucgccguggaggccgagaacagagagaugagcaagaccagcggcagacugaacaacggcaucccccagauccccgugaagagaggcgagagcgaguucgacagcuucagacagagccugcccguguucgagaagcaggaggagaucgugaagaucaucaaggagaacaagguggugcugaucgugggcgagaccggcagcggcaagaccacccagaucccccaguuccugcuggacgacugcuucaagaacggcauccccugcagaaucuucugcacccagcccagaagacuggccgccaucgccguggccgagagaguggccgccgagagaagagagagaaucggccagaccaucggcuaccagaucagacuggagagcagagugagccccaagacccugcugaccuucugcaccaacggcgugcugcugagaacccugauggccggcgacagcacccugagcaccgugacccacgugaucguggacgaggugcacgagagagacagauucagcgacuuccugcugaccaagcugagagaccugcugcagaagcaccccacccugaagcugauccugagcagcgccgcccuggacgugaaccuguucaucagauacuucggcagcugccccgugaucuacauccagggcagacccuucgaggugaaggagauguuccuggaggacauccugagaaccaccggcuacaccaacaaggagaugcugaaguacaagaaggagaagcagcaggaggagaagcagcagaccacccugaccgagugguacagcgcccaggagaacagcuucaagcccgagagccagagacagagaaccgugcugaacgugaccgacgaguacgaccugcuggacgacggcggcgacgccguguucagccagcugaccgagaaggacgugaacugccuggagcccuggcugaucaaggagauggacgccugccugagcgacaucuggcugcacaaggacaucgacgccuucgcccagguguuccaccugauccugaccgagaacgugagcguggacuacagacacagcgagaccagcgccaccgcccugaugguggccgccggcagaggcuucgccagccagguggagcagcugaucagcaugggcgccaacgugcacagcaaggccagcaacggcuggauggcccuggacugggccaagcacuucggccagaccgagaucguggaccugcuggagagcuacagcgccacccuggaguucggcaaccuggacgagagcagccuggugcagaccaacggcagcgaccugagcgccgaggacagagagcugcugaaggccuaccaccacagcuucgacgacgagaagguggaccuggaccugaucaugcaccugcuguacaacaucugccacagcugcgacgccggcgccgugcugaucuuccugcccggcuacgacgagaucgugggccugagagacagaauccuguucgacgacaagagauucgccgacagcacccacagauaccagguguucaugcugcacagcaacaugcagaccagcgaccagaagaaggugcugaagaacccccccgccggcgugagaaagaucauccugagcaccaacaucgccgagaccagcaucaccgugaacgacgugguguucgugaucgacagcggcaaggugaaggagaagagcuucgacgcccugaacuucgugaccaugcugaagaugguguggaucagcaaggccagcgccauccagagaaagggcagagccggcagaugcagacccggcaucugcuucagacuguucagcagacugagauuccagaacaugcuggaguuccagacccccgagcugcugagaaugccccugcaggagcugugccugcacaccaagcugcuggcccccgugaacugccccaucgccgacuuccugaugaaggcccccgagcccccccccgcccugaucgugagaaacgccgugcagaugcugaagaccaucgacgccauggacaccugggaggaccugaccgagcugggcuaccaccuggccgaccugcccguggagccccaccugggcaagauggugcugugcgccguggugcugaagugccuggaccccauccugaccaucgccugcacccuggccuacagagaccccuucgugcugcccacccaggccagccagaagagagccgccaugcugugcagaaagagauucaccgccggcgccuucagcgaccacauggcccugcugagagccuuccaggccuggcagaaggccagaagcgacggcugggagagagccuucugcgagaagaacuuccugagccaggccaccauggagaucaucaucggcaugagaacccagcugcugggccagcugagagccagcggcuucgugagagccagaggcggcggcgacaucagagacgugaacaccaacagcgagaacugggccguggugaaggccgcccugguggccggcauguaccccaaccuggugcacguggacagagagaaccuggugcugaccggccccaaggagaagaaggugagauuccaccccgccagcgugcugagccagccccaguacaagaagaucccccccgccaacggccaggccgccgccaucaaggcccugcccaccgacuggcugaucuacgacgagaugaccagagcccacagaaucgccaacaucagaugcugcagcgccgugacccccgugaccauccugguguucugcggccccgccagacuggccagcaacgcccugcaggagcccagcagcuucagaguggacggcauccccaacgacagcagcgacagcgagauggaggacaagaccaccgccaaccuggccgcccugaagcuggacgaguggcugcacuucacccuggagcccgaggccgccagccugcugcugcagcugagacagaaguggcacagccuguuccugagaagaaugagagcccccagcaagcccuggagccagguggacgaggccaccaucagagccaucaucgccgugcugagcaccgaggagcagagcgccggccugcagcagcccagcggcaucggccagagacccagacccaugagcagcgaggagcugccccuggccagcagcuggagaagcaacaacagcagaaagagcagcgccgacaccgaguucagcgacgagugcaccaccgccgagagagugcugaugaagagccccagccccgcccugcaccccccccagaaguacaaggacagaggcauccugcaccccaagagaggcaccgaggacagaagcgaccagagcagccugaagagcaccgacagcagcagcuaccccagccccugcgccagccccagcccccccagcagcggcaagggcagcaagagccccagccccagacccaacaugcccgugagauacuucaucaugaagagcagcaaccugagaaaccuggagaucagccagcagaagggcaucuggagcaccacccccagcaacgagagaaagcugaacagagccuucugggagagcagcaucguguaccugguguucagcgugcagggcagcggccacuuccagggcuucagcagaaugagcagcgagaucggcagagagaagagccaggacuggggcagcgccggccugggcggcguguucaagguggaguggaucagaaaggagagccugcccuuccaguucgcccaccaccugcugaaccccuggaacgacaacaagaaggugcagaucagcagagacggccaggagcuggagccccuggugggcgagcagcugcugcagcugugggagagacugccccugggcgagaagaacaccaccgacuaa

SEQ ID NO: 25775 - RNA, 741 nt, Artificial Sequence
  YWHAB__Homo_sapiens__NP_647539
augaccauggacaagagcgagcuggugcagaaggccaagcuggccgagcaggccgagagauacgacgacauggccgccgccaugaaggccgugaccgagcagggccacgagcugagcaacgaggagagaaaccugcugagcguggccuacaagaacguggugggcgccagaagaagcagcuggagagugaucagcagcaucgagcagaagaccgagagaaacgagaagaagcagcagaugggcaaggaguacagagagaagaucgaggccgagcugcaggacaucugcaacgacgugcuggagcugcuggacaaguaccugauccccaacgccacccagcccgagagcaagguguucuaccugaagaugaagggcgacuacuucagauaccugagcgagguggccagcggcgacaacaagcagaccaccgugagcaacagccagcaggccuaccaggaggccuucgagaucagcaagaaggagaugcagcccacccaccccaucagacugggccuggcccugaacuucagcguguucuacuacgagauccugaacagccccgagaaggccugcagccuggccaagaccgccuucgacgaggccaucgccgagcuggacacccugaacgaggagagcuacaaggacagcacccugaucaugcagcugcugagagacaaccugacccuguggaccagcgagaaccagggcgacgagggcgacgccggcgagggcgagaacuaa

SEQ ID NO: 25776 - RNA, 768 nt, Artificial Sequence
  YWHAE__Homo_sapiens__NP_006752
auggacgacagagaggaccugguguaccaggccaagcuggccgagcaggccgagagauacgacgagaugguggagagcaugaagaagguggccggcauggacguggagcugaccguggaggagagaaaccugcugagcguggccuacaagaacgugaucggcgccagaagagccagcuggagaaucaucagcagcaucgagcagaaggaggagaacaagggcggcgaggacaagcugaagaugaucagagaguacagacagaugguggagaccgagcugaagcugaucugcugcgacauccuggacgugcuggacaagcaccugauccccgccgccaacaccggcgagagcaagguguucuacuacaagaugaagggcgacuaccacagauaccuggccgaguucgccaccggcaacgacagaaaggaggccgccgagaacagccugguggccuacaaggccgccagcgacaucgccaugaccgagcugccccccacccaccccaucagacugggccuggcccugaacuucagcguguucuacuacgagauccugaacagccccgacagagccugcagacuggccaaggccgccuucgacgacgccaucgccgagcuggacacccugagcgaggagagcuacaaggacagcacccugaucaugcagcugcugagagacaaccugacccuguggaccagcgacaugcagggcgacggcgaggagcagaacaaggaggcccugcaggacguggaggacgagaaccaguaa

SEQ ID NO: 25777 - RNA, 744 nt, Artificial Sequence
  YWHAG__Homo_sapiens__NP_036611
augguggacagagagcagcuggugcagaaggccagacuggccgagcaggccgagagauacgacgacauggccgccgccaugaagaacgugaccgagcugaacgagccccugagcaacgaggagagaaaccugcugagcguggccuacaagaacguggugggcgccagaagaagcagcuggagagugaucagcagcaucgagcagaagaccagcgccgacggcaacgagaagaagaucgagauggugagagccuacagagagaagaucgagaaggagcuggaggccgugugccaggacgugcugagccugcuggacaacuaccugaucaagaacugcagcgagacccaguacgagagcaagguguucuaccugaagaugaagggcgacuacuacagauaccuggccgagguggccaccggcgagaagagagccaccgugguggagagcagcgagaaggccuacagcgaggcccacgagaucagcaaggagcacaugcagcccacccaccccaucagacugggccuggcccugaacuacagcguguucuacuacgagauccagaacgcccccgagcaggccugccaccuggccaagaccgccuucgacgacgccaucgccgagcuggacacccugaacgaggacagcuacaaggacagcacccugaucaugcagcugcugagagacaaccugacccuguggaccagcgaccagcaggacgacgacggcggcgagggcaacaacuaa

SEQ ID NO: 25778 - RNA, 741 nt, Artificial Sequence
  YWHAH__Homo_sapiens__NP_003396
augggcgacagagagcagcugcugcagagagccagacuggccgagcaggccgagagauacgacgacauggccagcgccaugaaggccgugaccgagcugaacgagccccugagcaacgaggacagaaaccugcugagcguggccuacaagaacguggugggcgccagaagaagcagcuggagagugaucagcagcaucgagcagaagaccauggccgacggcaacgagaagaagcuggagaaggugaaggccuacagagagaagaucgagaaggagcuggagaccgugugcaacgacgugcugagccugcuggacaaguuccugaucaagaacugcaacgacuuccaguacgagagcaagguguucuaccugaagaugaagggcgacuacuacagauaccuggccgagguggccagcggcgagaagaagaacagcgugguggaggccagcgaggccgccuacaaggaggccuucgagaucagcaaggagcagaugcagcccacccaccccaucagacugggccuggcccugaacuucagcguguucuacuacgagauccagaacgcccccgagcaggccugccugcuggccaagcaggccuucgacgacgccaucgccgagcuggacacccugaacgaggacagcuacaaggacagcacccugaucaugcagcugcugagagacaaccugacccuguggaccagcgaccagcaggacgaggaggccggcgagggcaacuaa

SEQ ID NO: 25779 - RNA, 738 nt, Artificial Sequence
  YWHAQ__Homo_sapiens__NP_006817
auggagaagaccgagcugauccagaaggccaagcuggccgagcaggccgagagauacgacgacauggccaccugcaugaaggccgugaccgagcagggcgccgagcugagcaacgaggagagaaaccugcugagcguggccuacaagaacguggugggcggcagaagaagcgccuggagagugaucagcagcaucgagcagaagaccgacaccagcgacaagaagcugcagcugaucaaggacuacagagagaagguggagagcgagcugagaagcaucugcaccaccgugcuggagcugcuggacaaguaccugaucgccaacgccaccaaccccgagagcaagguguucuaccugaagaugaagggcgacuacuucagauaccuggccgagguggccugcggcgacgacagaaagcagaccaucgacaacagccagggcgccuaccaggaggccuucgacaucagcaagaaggagaugcagcccacccaccccaucagacugggccuggcccugaacuucagcguguucuacuacgagauccugaacaaccccgagcuggccugcacccuggccaagaccgccuucgacgaggccaucgccgagcuggacacccugaacgaggacagcuacaaggacagcacccugaucaugcagcugcugagagacaaccugacccuguggaccagcgacagcgccggcgaggagugcgacgccgccgagggcgccgagaacuaa

SEQ ID NO: 25780 - RNA, 738 nt, Artificial Sequence
  YWHAZ__Homo_sapiens__NP_001129172
auggacaagaacgagcuggugcagaaggccaagcuggccgagcaggccgagagauacgacgacauggccgccugcaugaagagcgugaccgagcagggcgccgagcugagcaacgaggagagaaaccugcugagcguggccuacaagaacguggugggcgccagaagaagcagcuggagaguggugagcagcaucgagcagaagaccgagggcgccgagaagaagcagcagauggccagagaguacagagagaagaucgagaccgagcugagagacaucugcaacgacgugcugagccugcuggagaaguuccugauccccaacgccagccaggccgagagcaagguguucuaccugaagaugaagggcgacuacuacagauaccuggccgagguggccgccggcgacgacaagaagggcaucguggaccagagccagcaggccuaccaggaggccuucgagaucagcaagaaggagaugcagcccacccaccccaucagacugggccuggcccugaacuucagcguguucuacuacgagauccugaacagccccgagaaggccugcagccuggccaagaccgccuucgacgaggccaucgccgagcuggacacccugagcgaggagagcuacaaggacagcacccugaucaugcagcugcugagagacaaccugacccuguggaccagcgacacccagggcgacgaggccgaggccggcgagggcggcgagaacuaa

SEQ ID NO: 25781 - RNA, 2667 nt, Artificial Sequence
  YY1AP1__Homo_sapiens__NP_001185832
auggccggcgugggcagaagcggcggccccuggggcagaaccagaggcggcagaagcggcagacugggcgugagccugggcgcccugagcagccugccccuggaggagcugcccagaccccugugcugcagaagaugcagaagacacuucggcuucgcccugagaggcgagaccauccccgugagcguggccggcagcgccagcagccaguucgccccccuggcccugcaccugagccugcugcugagcagaaucagcgccagcagacugaccagauggcccccccccgacaagagagagggcagcgccguggaccccggcaagagaagaagccuggccgccacccccagcagcagccugcccugcacccugaucgcccugggccugagacacgagaaggaggccaacgagcugauggaggaccuguucgagaccuuccaggacgagaugggcuucagcaacauggaggacgacggccccgaggaggaggagagaguggccgagccccaggccaacuucaacaccccccaggcccugagauucgaggagcugcuggccaaccugcugaacgagcagcaccagaucgccaaggagcuguucgagcagcugaagaugaagaagcccagcgccaagcagcagaaggagguggagaaggugaagccccagugcaaggaggugcaccagacccugauccuggaccccgcccagagaaagagacugcagcagcagaugcagcagcacgugcagcugcugacccagauccaccugcuggccaccugcaaccccaaccugaaccccgaggccagcagcaccagaaucugccugaaggagcugggcaccuucgcccagagcagcaucgcccugcaccaccaguacaaccccaaguuccagacccuguuccagcccugcaaccugaugggcgccaugcagcugaucgaggacuucagcacccacgugagcaucgacugcagcccccacaagaccgugaagaagaccgccaacgaguuccccugccugcccaagcagguggccuggauccuggccaccagcaagguguucauguaccccgagcugcugcccgugugcagccugaaggccaagaacccccaggacaagauccuguucaccaaggccgaggacaaccugcuggcccugggccugaagcacuucgagggcaccgaguuccugaacccccugaucagcaaguaccugcugaccugcaagaccgccagacagcugaccgugagaaucaagaaccugaacaugaacagagcccccgacaacaucaucaaguucuacaagaagaccaagcagcugcccgugcugggcaagugcugcgaggagauccagccccaccaguggaagccccccaucgagagagaggagcacagacugcccuucuggcugaaggccagccugcccagcauccaggaggagcugagacacauggccgacggcgccagagaggugggcaacaugaccggcaccaccgagaucaacagcgaccagggccuggagaaggacaacagcgagcugggcagcgagaccagauacccccugcugcugcccaagggcguggugcugaagcugaagcccguggccgacagauuccccaagaaggccuggagacagaagagaagcagcgugcugaagccccugcugauccagcccagccccagccugcagcccagcuucaaccccggcaagacccccgcccagagcacccacagcgaggccccccccagcaagauggugcugagaaucccccaccccauccagcccgccaccgugcugcagaccgugcccggcgugcccccccugggcgugagcggcggcgagagcuucgagagccccgccgcccugcccgccaugccccccgaggccagaaccagcuucccccugagcgagagccagacccugcugagcagcgcccccgugcccaaggugaugaugcccagccccgccagcagcauguucagaaagcccuacgugagaagaagacccagcaagagaagaggcgccagagccuucagaugcaucaagcccgcccccgugauccaccccgccagcgugaucuucaccgugcccgccaccaccgugaagaucgugagccugggcggcggcugcaacaugauccagcccgugaacgccgccguggcccagagcccccagaccauccccaucgccacccugcuggugaaccccaccagcuuccccugcccccugaaccagccccugguggccagcagcgugagcccccugaucgugagcggcaacagcgugaaccugcccauccccagcacccccgaggacaaggcccacaugaacguggacaucgccugcgccguggccgacggcgagaacgccuuccagggccuggagcccaagcuggagccccaggagcugagcccccugagcgccaccguguuccccaagguggagcacagccccggccccccccccguggacaagcagugccaggagggccugagcgagaacagcgccuacagauggaccguggugaagaccgaggagggcagacaggcccuggagccccugccccagggcauccaggagagccugaacaacagcagccccggcgaccuggaggagguggugaagauggagcccgaggacgccaccgaggagaucagcggcuuccuguaa

SEQ ID NO: 25782 - RNA, 1245 nt, Artificial Sequence
  YY1__Homo_sapiens__NP_003394
auggccagcggcgacacccuguacaucgccaccgacggcagcgagaugcccgccgagaucguggagcugcacgagaucgagguggagaccauccccguggagaccaucgagaccaccguggugggcgaggaggaggaggaggacgacgacgacgaggacggcggcggcggcgaccacggcggcggcggcggccacggccacgccggccaccaccaccaccaccaccaccaccaccaccacccccccaugaucgcccugcagccccuggugaccgacgaccccacccaggugcaccaccaccaggaggugauccuggugcagaccagagaggagguggugggcggcgacgacagcgacggccugagagccgaggacggcuucgaggaccagauccugauccccgugcccgcccccgccggcggcgacgacgacuacaucgagcagacccuggugaccguggccgccgccggcaagagcggcggcggcggcagcagcagcagcggcggcggcagagugaagaagggcggcggcaagaagagcggcaagaagagcuaccugagcggcggcgccggcgccgccggcggcggcggcgccgaccccggcaacaagaagugggagcagaagcaggugcagaucaagacccuggagggcgaguucagcgugaccauguggagcagcgacgagaagaaggacaucgaccacgagaccgugguggaggagcagaucaucggcgagaacagcccccccgacuacagcgaguacaugaccggcaagaagcugccccccggcggcauccccggcaucgaccugagcgaccccaagcagcuggccgaguucgccagaaugaagcccagaaagaucaaggaggacgacgcccccagaaccaucgccugcccccacaagggcugcaccaagauguucagagacaacagcgccaugagaaagcaccugcacacccacggccccagagugcacgugugcgccgagugcggcaaggccuucguggagagcagcaagcugaagagacaccagcuggugcacaccggcgagaagcccuuccagugcaccuucgagggcugcggcaagagauucagccuggacuucaaccugagaacccacgugagaauccacaccggcgacagacccuacgugugccccuucgacggcugcaacaagaaguucgcccagagcaccaaccugaagagccacauccugacccacgccaaggccaagaacaaccaguaa

SEQ ID NO: 25783 - RNA, 1239 nt, Artificial Sequence
  ZACN__Homo_sapiens__NP_851321
augauggcccuguggagccugcugcaccugaccuuccugggcuucagcaucacccugcugcuggugcacggccagggcuuccagggcaccgccgccaucuggcccagccuguucaacgugaaccugagcaagaaggugcaggagagcauccagauccccaacaacggcagcgccccccugcugguggacgugagaguguucgugagcaacguguucaacguggacauccugagauacaccaugagcagcaugcugcugcugagacugagcuggcuggacaccagacuggccuggaacaccagcgcccaccccagacacgccaucacccugcccugggagagccuguggacccccagacugaccauccuggaggcccuguggguggacuggagagaccagagcccccaggccagaguggaccaggacggccacgugaagcugaaccuggcccuggccaccgagaccaacugcaacuucgagcugcugcacuuccccagagaccacagcaacugcagccugagcuucuacgcccugagcaacaccgccauggagcuggaguuccaggcccacguggugaacgagaucgugagcgugaagagagaguacgugguguacgaccugaagacccaggugcccccccagcagcuggugcccugcuuccaggugacccugagacugaagaacaccgcccugaagagcaucaucgcccugcuggugcccgccgaggcccugcugcuggccgacgugugcggcggccugcugccccugagagccaucgagagaaucggcuacaaggugacccugcugcugagcuaccuggugcugcacagcagccuggugcaggcccugcccagcagcagcagcugcaacccccugcugaucuacuacuucaccauccugcugcugcugcuguuccugagcaccaucgagaccgugcugcuggccggccugcuggccagaggcaaccugggcgccaagagcggccccagccccgcccccagaggcgagcagagagagcacggcaaccccggcccccaccccgccgaggagcccagcagaggcgugaagggcagccagagaagcuggcccgagaccgccgacagaaucuucuuccugguguacguggugggcgugcugugcacccaguucguguucgccggcaucuggaugugggccgccugcaagagcgacgccgcccccggcgaggccgccccccacggcagaagacccagacuguaa

SEQ ID NO: 25784 - RNA, 1368 nt, Artificial Sequence
  ZAK__Homo_sapiens__NP_598407
augagcagccugggcgccagcuucgugcagaucaaguucgacgaccugcaguucuucgagaacugcggcggcggcagcuucggcagcguguacagagccaaguggaucagccaggacaaggagguggccgugaagaagcugcugaagaucgagaaggaggccgagauccugagcgugcugagccacagaaacaucauccaguucuacggcgugauccuggagccccccaacuacggcaucgugaccgaguacgccagccugggcagccuguacgacuacaucaacagcaacagaagcgaggagauggacauggaccacaucaugaccugggccaccgacguggccaagggcaugcacuaccugcacauggaggcccccgugaaggugauccacagagaccugaagagcagaaacguggugaucgccgccgacggcgugcugaagaucugcgacuucggcgccagcagauuccacaaccacaccacccacaugagccuggugggcaccuuccccuggauggcccccgaggugauccagagccugcccgugagcgagaccugcgacaccuacagcuacggcguggugcugugggagaugcugaccagagaggugcccuucaagggccuggagggccugcagguggccuggcuggugguggagaagaacgagagacugaccauccccagcagcugccccagaagcuucgccgagcugcugcaccagugcugggaggccgacgccaagaagagacccagcuucaagcagaucaucagcauccuggagagcaugagcaacgacaccagccugcccgacaagugcaacagcuuccugcacaacaaggccgaguggagaugcgagaucgaggccacccuggagagacugaagaagcuggagagagaccugagcuucaaggagcaggagcugaaggagagagagagaagacugaagaugugggagcagaagcugaccgagcagagcaacaccccccugcugcugccccuggccgccagaaugagcgaggagagcuacuucgagagcaagaccgaggagagcaacagcgccgagaugagcugccagaucaccgccaccagcaacggcgagggccacggcaugaaccccagccugcaggccaugaugcugaugggcuucggcgacaucuucagcaugaacaaggccggcgccgugaugcacagcggcaugcagaucaacaugcaggccaagcagaacagcagcaagaccaccagcaagagaagaggcaagaaggugaacauggcccugggcuucagcgacuucgaccugagcgagggcgacgacgacgacgacgacgacggcgaggaggaggacaacgacauggacaacagcgaguaa

SEQ ID NO: 25785 - RNA, 1860 nt, Artificial Sequence
  ZAP70__Homo_sapiens__NP_001070
augcccgaccccgccgcccaccugcccuucuucuacggcagcaucagcagagccgaggccgaggagcaccugaagcuggccggcauggccgacggccuguuccugcugagacagugccugagaagccugggcggcuacgugcugagccuggugcacgacgugagauuccaccacuuccccaucgagagacagcugaacggcaccuacgccaucgccggcggcaaggcccacugcggccccgccgagcugugcgaguucuacagcagagaccccgacggccugcccugcaaccugagaaagcccugcaacagacccagcggccuggagccccagcccggcguguucgacugccugagagacgccauggugagagacuacgugagacagaccuggaagcuggagggcgaggcccuggagcaggccaucaucagccaggccccccagguggagaagcugaucgccaccaccgcccacgagagaaugcccugguaccacagcagccugaccagagaggaggccgagagaaagcuguacagcggcgcccagaccgacggcaaguuccugcugagacccagaaaggagcagggcaccuacgcccugagccugaucuacggcaagaccguguaccacuaccugaucagccaggacaaggccggcaaguacugcauccccgagggcaccaaguucgacacccuguggcagcugguggaguaccugaagcugaaggccgacggccugaucuacugccugaaggaggccugccccaacagcagcgccagcaacgccagcggcgccgccgcccccacccugcccgcccaccccagcacccugacccacccccagagaagaaucgacacccugaacagcgacggcuacacccccgagcccgccagaaucaccagccccgacaagcccagacccaugcccauggacaccagcguguacgagagccccuacagcgaccccgaggagcugaaggacaagaagcuguuccugaagagagacaaccugcugaucgccgacaucgagcugggcugcggcaacuucggcagcgugagacagggcguguacagaaugagaaagaagcagaucgacguggccaucaaggugcugaagcagggcaccgagaaggccgacaccgaggagaugaugagagaggcccagaucaugcaccagcuggacaaccccuacaucgugagacugaucggcgugugccaggccgaggcccugaugcuggugauggagauggccggcggcggcccccugcacaaguuccuggugggcaagagagaggagauccccgugagcaacguggccgagcugcugcaccaggugagcaugggcaugaaguaccuggaggagaagaacuucgugcacagagaccuggccgccagaaacgugcugcuggugaacagacacuacgccaagaucagcgacuucggccugagcaaggcccugggcgccgacgacagcuacuacaccgccagaagcgccggcaaguggccccugaagugguacgcccccgagugcaucaacuucagaaaguucagcagcagaagcgacguguggagcuacggcgugaccaugugggaggcccugagcuacggccagaagcccuacaagaagaugaagggccccgaggugauggccuucaucgagcagggcaagagaauggagugcccccccgagugcccccccgagcuguacgcccugaugagcgacugcuggaucuacaagugggaggacagacccgacuuccugaccguggagcagagaaugagagccugcuacuacagccuggccagcaagguggagggcccccccggcagcacccagaaggccgaggccgccugcgccuaa

SEQ ID NO: 25786 - RNA, 1275 nt, Artificial Sequence
  ZAR1__Homo_sapiens__NP_783318
auggccgcccugggcgacgaggugcuggacggcuacguguuccccgccugcccccccugcagcuacagauaccccuaccccgccgccaccaagggcaagggcgccgccggcggcagcuggcagcagagaggcagaggcugccugcccgccagcagccccugcagcgccggcgccgccagccugagcuuccccggcugcggcagacugaccgccgccgaguacuucgacagcuaccagagagagagacugauggcccugcuggcccaggugggccccggccugggccccagagccagaagagccggcagcugcgacguggccgugcaggugagccccagaaucgacgccgccgugcagugcagccugggcagaagaacccugcagagaagagccagagaccccgagagccccgccggccccggcgccgagggcaccaccggcggcggcagcuucagccagcagcccagcagaagaggccuggagcagggcagcccccagaacggcgcccccagacccaugagauuccccagaaccguggccguguacagcccccuggcccugagaagacugaccgccuuccuggagggccccggccccgccgccggcgagcagagaagcggcgccagcgacggcgagagaggccccccccccgccagacugcagggccccgaggagggcgagguguggaccaagaaggcccccagaagaccccagagcgacgacgacggcgaggcccaggccgccgugagagccagcugggagcagcccgccgacggccccgagcugccccccagagaggcccaggagggcgaggccgcccccagaagcgcccugagaagccccggccagccccccagcgccggcagagccagagacggcggcgacggcagagaggccgccguggccggcgagggccccagccccagaagccccgagcugggcaaggagagacugagauuccaguuccuggagcagaaguacggcuacuaccacugcaaggacugcaacaucagaugggagagcgccuacguguggugcgugcagggcaccaacaagguguacuucaagcaguucugcagaaccugccagaagagcuacaaccccuacagaguggaggacaucaccugccagagcugcaagcagaccagaugcagcugccccgugaagcugagacacguggaccccaagagaccccacagacaggaccugugcggcagaugcaagggcaagagacugagcugcgacagcaccuucagcuucaaguacaucaucuaa

SEQ ID NO: 25787 - RNA, 966 nt, Artificial Sequence
  ZAR1L__Homo_sapiens__NP_001130043
auggagagauucgugagagugcccuacggccuguaccagggcuacggcagcaccgugccccugggccagcccggccugagcggccacaagcagcccgacuggagacagaacaugggcccccccaccuuccuggccagacccggccugcuggugcccgccaacgcccccgacuacugcaucgaccccuacaagagagcccagcugaaggccauccugagccagaugaaccccagccugagccccagacugugcaagcccaacaccaaggaggugggcgugcaggugagccccagaguggacaaggccgugcagugcagccugggccccagaacccugagcagcugcagccccugggacggcagagacccccaggagccccugcccgccugcggcgugaccagccccgccaccggcagaagaggccugaucagacugagaagagacggcgacgaggccgagagcaaggcccugcccggccccgccgaggccagccagccccagccccccagcagaagaagcggcgccgacagacaggaggagcccggccagcuggaggagagcggcgagaaggacgcccccugcccccaggagaccaagagcaagcaggugcccggcgacgccgccagcgagccccugagaagacccaacuuccaguuccuggagcccaaguacggcuacuuccacugcaaggacugcaagaccagaugggagagcgccuacguguggugcaucagcggcaccaacaagguguacuucaagcagcugugcugcaagugccagaagagcuucaaccccuacagaguggaggccauccagugccagaccugcagcaagagccacugcagcugcccccagaagaagagacacaucgaccugagaagaccccacagacaggagcugugcggcagaugcaaggacaagagauucagcugcggcaacaucuacagcuucaaguacgugauguaa

SEQ ID NO: 25788 - RNA, 507 nt, Artificial Sequence
  ZASP__Homo_sapiens__NP_001276862
augcccgccagccacgcccccggcgccagcgccaacccccccugccaccugcccagcgugaucgccgacagcuuccuggccagccaccugagccccagccccgagagaaccgugaugcugggcagcgcccccgacccccugccccaggccggcagcagaagaggccacagaggcgaggccaaccccgcccccagccccagaagccacugcgccagccccaccaccagcuggaagagaagaggccccagagagggcgccagccccaccagccugcugagcagcacccccugcuggaccggccugagaggcgagggcggcggcaccggccccaccccccccggcacccccggcgccgaggacgcccccggccugagagcccugagagaggccagaggcgagggcggccugggccugggcacccugggccugcccgccuggcugccccugggcagcagaguguggguggagggccccagagugagccaggugagcugccagccccaguaa

SEQ ID NO: 25789 - RNA, 2085 nt, Artificial Sequence
  ZBED1__Homo_sapiens__NP_001164606
auggagaacaagagccuggagagcagccagaccgaccugaagcugguggcccaccccagagccaagagcaagguguggaaguacuucggcuucgacaccaacgccgagggcugcauccugcaguggaagaagaucuacugcagaaucugcauggcccagaucgccuacagcggcaacaccagcaaccugagcuaccaccuggagaagaaccaccccgaggaguucugcgaguucgugaagagcaacaccgagcagaugagagaggccuucgccaccgccuucagcaagcugaagcccgagagcagccagcagcccggccaggacgcccuggccgugaaggccggccacggcuacgacagcaagaagcagcaggagcugaccgccgccgugcugggccugaucugcgagggccuguaccccgccagcaucguggacgagcccaccuucaaggugcugcugaagaccgccgaccccagauacgagcugcccagcagaaaguacaucagcaccaaggccauccccgagaaguacggcgccgugagagaggugauccugaaggagcuggccgaggccaccuggugcggcaucagcaccgacauguggagaagcgagaaccagaacagagccuacgugacccuggccgcccacuuccugggccugggcgcccccaacugccugagcaugggcagcagaugccugaagaccuucgaggugcccgaggagaacaccgccgagaccaucaccagagugcuguacgagguguucaucgaguggggcaucagcgccaagguguucggcgccaccaccaacuacggcaaggacaucgugaaggccugcagccugcuggacguggccgugcacaugcccugccugggccacaccuucaacgccggcauccagcaggccuuccagcugcccaagcugggcgcccugcugagcagaugcagaaagcugguggaguacuuccagcagagcgccguggccauguacaugcuguacgagaagcagaagcagcagaacguggcccacugcaugcuggugagcaacagagugagcugguggggcagcacccuggccaugcugcagagacugaaggagcagcaguucgugaucgccggcgugcugguggaggacagcaacaaccaccaccugaugcuggaggccagcgagugggccaccaucgagggccugguggagcugcugcagcccuucaagcagguggccgagaugcugagcgccagcagauaccccaccaucagcauggugaagccccugcugcacaugcugcugaacaccacccugaacaucaaggagaccgacagcaaggagcugagcauggccaaggaggugaucgccaaggagcugagcaagaccuaccaggagacccccgagaucgacauguuccugaacguggccaccuuccuggaccccagauacaagagacugcccuuccugagcgccuucgagagacagcagguggagaacagagugguggaggaggccaagggccugcuggacaaggugaaggacggcggcuacagacccgccgaggacaagaucuuccccgugcccgaggagccccccgugaagaagcugaugagaaccagcacccccccccccgccagcgugaucaacaacaugcuggccgagaucuucugccagaccggcggcguggaggaccaggaggaguggcacgcccaggugguggaggagcugagcaacuucaagagccagaaggugcugggccugaacgaggacccccugaagugguggagcgacagacuggcccuguucccccugcugcccaaggugcugcagaaguacuggugcgugaccgccaccagaguggcccccgagagacuguucggcagcgccgccaacguggugagcgccaagagaaacagacuggcccccgcccacguggacgagcagguguuccuguacgagaacgccagaagcggcgccgaggccgagcccgaggaccaggacgagggcgaguggggccuggaccaggagcagguguucagccugggcgacggcgugagcggcggcuucuucggcaucagagacagcagcuuccuguaa

SEQ ID NO: 25790 - RNA, 3516 nt, Artificial Sequence
  ZBED4__Homo_sapiens__NP_055653
auggagaacaaccugaagaccugccccaaggaggacggcgacuucgugagcgacaagaucaaguucaagaucgaggaggaggacgacgacggcaucccccccgacagccuggagagaauggacuucaagagcgagcaggaggacaugaagcagaccgacagcggcggcgagagagccggccugggcggcaccggcugcagcugcaagccccccggcaaguaccugagcgccgagagcgaggacgacuacggcgcccuguucagccaguacagcagcacccuguacgacguggccauggaggccgugacccagagccugcugagcagcagaaacaugagcagcagaaagaagagccccgccuggaagcacuucuucaucagccccagagacagcaccaaggccaucugcauguacugcgugaaggaguucagcagaggcaagaacgagaaggaccugagcaccagcugccugaugagacacgugagaagagcccaccccaccgugcugauccaggagaacggcagcgugagcgccgugagcagcuuccccagccccagccugcugcugcccccccagcccgccgacgccggcgaccugagcaccauccugagccccaucaagcuggugcagaagguggccagcaagauccccagccccgacagaaucaccgaggagagcgugagcguggugagcagcgaggagaucagcagcgacaugagcgugagcgagaagugcggcagagaggaggcccuggugggcagcagcccccaccugcccgcccugcacuacgacgagcccgccgagaaccuggccgagaagagccugccccugcccaagagcaccagcggcagcagaagaagaagcgccguguggaagcacuucuaccugagcccccuggacaacagcaaggccgugugcauccacugcaugaacgaguucagcagaggcaagaacggcaaggaccugggcaccagcugccugaucagacacauguggagagcccacagagccaucgugcugcaggagaacggcggcaccggcauccccccccuguacagcaccccccccacccugcugcccagccugcugccccccgagggcgagcugagcagcgugagcagcagccccgugaagcccgugagagagagccccagcgccagcagcagccccgacagacugaccgaggaccugcagagccaccugaaccccggcgacggccugauggaggacguggccgccuucagcagcagcgacgacaucggcgaggccagcgccagcagccccgagaagcagcaggccgacggccugagccccagacuguucgagagcggcgccaucuuccagcagaacaagaaggugaugaagagacugaagagcgagguguggcaccacuucagccuggcccccauggacagccugaaggccgagugcagauacugcggcugcgccaucagcagaggcaagaagggcgacgugggcaccagcugccugaugagacaccuguacagaagacaccccgagguggugggcagccagaagggcuuccugggcgccagccuggccaacagccccuacgccacccuggccagcgccgagagcagcagcagcaagcugaccgaccugcccaccguggugaccaagaacaaccaggugauguuccccgugaacagcaagaagaccagcaagcuguggaaccacuucagcaucugcagcgccgacagcaccaagguggugugccugcacugcggcagaaccaucagcagaggcaagaagcccaccaaccugggcaccagcugccugcugagacaccugcagagauuccacagcaacgugcugaagaccgaggugagcgagaccgccagacccagcagccccgacaccagagugcccagaggcaccgagcugagcggcgccagcagcuucgacgacaccaacgagaaguucuacgacagccaccccguggccaagaagaucaccagccugaucgccgagaugaucgcccuggaccugcagcccuacagcuucguggacaacgugggcuucaacagacugcuggaguaccugaagccccaguacagccugcccgcccccagcuacuucagcagaaccgccauccccggcauguacgacaacgugaagcagaucaucaugagccaccugaaggaggccgagagcggcgugauccacuucaccagcggcaucuggaugagcaaccagaccagagaguaccugacccugaccgcccacugggugagcuucgagagccccgccagacccagaugcgacgaccaccacugcagcgcccugcuggacgugagccagguggacugcgacuacagcggcaacagcauccagaagcagcuggagugcuggugggaggccugggugaccagcaccggccugcaggugggcaucaccgugaccgacaacgccagcaucggcaagacccugaacgagggcgagcacagcagcgugcagugcuucagccacaccgugaaccugaucgugagcgaggccaucaagagccagagaauggugcagaaccugcugagccuggccagaaagaucugcgagagagugcacagaagccccaaggccaaggagaagcuggccgagcugcagagagaguacgcccugccccagcaccaccugauccaggacgugcccagcaaguggagcaccagcuuccacaugcuggagagacugaucgagcagaagagagccaucaacgagaugagcguggagugcaacuucagagagcugaucagcugcgaccagugggaggugaugcagagcgugugcagagcccugaagcccuucgaggccgccagcagagagaugagcacccagaugagcacccugagccaggugauccccauggugcacauccugaacagaaagguggagaugcuguucgaggagaccaugggcaucgacaccaugcugagaagccugaaggaggccauggugagcagacugagcgccacccugcacgaccccagauacguguucgccacccugcuggaccccagauacaaggccagccuguucaccgaggaggaggccgagcaguacaagcaggaccugaucagagagcuggagcugaugaacagcaccagcgaggacguggccgccagccacagaugcgacgccggcagccccagcaaggacagcgccgccgaggagaaccuguggagccugguggccaaggugaagaagaaggaccccagagagaagcugcccgaggccauggugcuggccuaccuggaggaggaggugcuggagcacagcugcgacccccugaccuacuggaaccugaagaaggccagcuggcccggccugagcgcccuggccgugagauuccugggcugcccccccagcaucgugcccagcgagaagcuguucaacacccccaccgagaacggcagccugggccagagcagacugaugauggagcacuucgagaagcugaucuuccugaaggugaaccugccccugaucuacuuccaguacuaa

SEQ ID NO: 25791 - RNA, 2082 nt, Artificial Sequence
  ZBED5__Homo_sapiens__NP_001137139
augaucgccccccugcugugcauccugagcuacaacuucaacaccuucgccauccugaacguguacagcaagcugaccauguucugcaccaccaacagccugcccauggaccugcugcugaagcagggcagccugaagcaggagguggagagcuucugcuaccagaucgugagcgagagcaacgaccagaaggugggcauccugcagagcgaggacaagcagcugcagcccagcgugagcaagaagagcgagggcgagcugagcagagugaaguucaucagcaacagcaacaagaucaccuucagcaagaagcccaagagaagaaaguacgacgagagcuaccugagcuucggcuucaccuacuucggcaacagagacgccccccacgcccagugcgugcugugcaagaagauccugagcaacagcagccuggcccccagcaagcugagaagacaccuggagaccaagcacgccgccuacaaggacaaggacaucagcuucuucaagcagcaccuggacagccccgagaacaacaagccccccacccccaagaucgugaacaccgacaacgagagcgccaccgaggccagcuacaacgugagcuaccacaucgcccugagcggcgaggcccacaccaucggcgagcugcugaucaagcccugcgccaaggacguggugaugagaauguucgacgagcaguacagcaagaagaucgacgccgugcagcugagcaacagcaccguggccagaagaaucaaggaccuggccgccgacaucgaggaggagcuggugugcagacugaagaucugcgacggcuucagccugcagcuggacgagagcgccgacgugagcggccuggccgugcugcugguguucgugagauacagauucaacaagagcaucgaggaggaccugcugcugugcgagagccugcagagcaacgccaccggcgaggagaucuucaacugcaucaacagcuucaugcagaagcacgagaucgagugggagaagugcguggacgugugcagcgacgccagcagagccguggacggcaagaucgccgaggccgugacccugaucaaguacguggcccccgagagcaccagcagccacugccugcuguacagacacgcccuggccgugaagaucaugcccaccagccugaagaacgugcuggaccaggccgugcagaucaucaacuacaucaaggccagaccccaccagagcagacugcugaagauccugugcgaggagaugggcgcccagcacaccgcccugcugcugaacaccgaggugagauggcugagcagaggcaaggugcuggugagacuguucgagcugagaagagagcugcugguguucauggacagcgccuucagacugagcgacugccugaccaacagcagcuggcugcugagacuggccuaccuggccgacaucuucaccaagcugaacgaggugaaccugagcaugcagggcaagaacgugaccguguucaccguguucgacaagaugagcagccugcugagaaagcuggaguucugggccagcagcguggaggaggagaacuucgacugcuuccccacccugagcgacuuccugaccgagaucaacagcaccguggacaaggacaucugcagcgccaucgugcagcaccugagaggccugagagccacccugcugaaguacuuccccgugaccaacgacaacaacgccugggugagaaaccccuucaccgugaccgugaagcccgccagccugguggccagagacuacgagagccugaucgaccugaccagcgacagccaggugaagcagaacuucagcgagcugagccugaacgacuucuggagcagccugauccaggaguaccccagcaucgccagaagagccgugagagugcugcugcccuucgccaccaugcaccugugcgagaccggcuucagcuacuacgccgccaccaagaccaaguacagaaagagacuggacgccgccccccacaugagaaucagacugagcaacaucacccccaacaucaagagaaucugcgacaagaagacccagaagcacugcagccacuaa

SEQ ID NO: 25792 - RNA, 1065 nt, Artificial Sequence
  ZBP1__Homo_sapiens__NP_001153890
auggcccaggcccccgccgaccccggcagagaggccgagagaccccagcagcacgccgccaccauccccgagacccccggcccccaguucagccagcagagagaggaggacaucuacagauuccugaaggacaacggcccccagagagcccuggugaucgcccaggcccugggcaugagaaccgccaaggacgugaacagagaccuguacagaaugaagagcagacaccugcuggacauggacgagcagagcaaggccuggaccaucuacagacccgaggacagcggcagaagagccaagagcgccagcaucaucuaccagcacaaccccaucaacaugaucugccagaacggccccaacagcuggaucagcaucgccaacagcgaggccauccagaucggccacggcaacaucaucaccagacagaccgugagcagagaggacggcagcgccggccccagacaccugcccagcauggcccccggcgacagcagcaccuggggcacccugguggaccccuggggcccccaggacauccacauggagcagagcauccugagaagagugcagcugggccacagcaacgagaugagacugcacggcgugcccagcgagggccccgcccacaucccccccggcagcccccccgugagcgccaccgccgccggccccgaggccagcuucgaggccagaauccccagccccggcacccaccccgagggcgaggccgcccagagaauccacaugaagagcugcuuccuggaggacgccaccaucggcaacagcaacaagaugagcaucagccccggcguggccggccccggcggcguggccggcagcggcgagggcgagcccggcgaggacgccggcagaagacccgccgacacccagagcagaagccacuuccccagagacaucggccagcccaucacccccagccacagcaagcugacccccaagcuggagaccaugacccugggcaacagaagccacaaggccgccgagggcagccacuacguggacgaggccagccacgagggcagcugguggggcggcggcaucuaa

SEQ ID NO: 25793 - RNA, 2616 nt, Artificial Sequence
  ZBTB10__Homo_sapiens__NP_001099009
augagcuucagcgagaugaacagaagaacccuggccuucagaggcggcggccuggugaccgccagcggcggcggcagcaccaacaacaacgccggcggcgaggccagcgccuggcccccccagccccagcccagacagccccccccccccgccccccccgcccugcagccccccaacggcagaggcgccgacgaggagguggagcuggagggccuggagccccaggaccuggaggccagcgccggccccgccgccggcgccgccgaggaggccaaggagcugcugcugccccaggacgccggcggccccaccagccugggcggcggcgccggcggcccccugcuggccgagagaaacagaagaacccuggccuucagaggcggcggcggcggcggccugggcaacaacggcagcagcagaggcagacccgagaccagcguguggccccugagacacuucaacggcagaggccccgccaccguggaccuggagcuggacgcccuggagggcaaggagcugaugcaggacggcgccagccugagcgacagcaccgaggacgaggaggagggcgccagccugggcgacggcagcggcgccgagggcggcagcugcagcagcagcagaagaagcggcggcgacggcggcgacgagguggagggcagcggcgugggcgccggcgagggcgagaccgugcagcacuucccccuggccagacccaagagccugaugcagaagcugcagugcagcuuccagaccagcuggcugaaggacuuccccuggcugagauacagcaaggacaccggccugaugagcugcggcuggugccagaagacccccgccgacggcggcagcguggaccugccccccgugggccacgacgagcugagcagaggcaccagaaacuacaagaagacccugcugcugagacaccacgugagcaccgagcacaagcugcacgaggccaacgcccaggagagcgagauccccagcgaggagggcuacugcgacuucaacagcagacccaacgagaacagcuacugcuaccagcugcugagacagcugaacgagcagagaaagaagggcauccugugcgacgugagcaucguggugagcggcaagaucuucaaggcccacaagaacauccugguggccggcagcagauucuucaagacccuguacugcuucagcaacaaggagagccccaaccagaacaacaccacccaccuggacaucgccgccgugcagggcuucagcgugauccuggacuuccuguacagcggcaaccuggugcugaccagccagaacgccaucgaggugaugaccguggccagcuaccugcagaugagcgagguggugcagaccugcagaaacuucaucaaggacgcccugaacaucagcaucaagagcgaggcccccgagagcguggugguggacuacaacaacagaaagcccgugaacagagacggccugagcagcagcagagaccagaagaucgccagcuucugggccaccagaaaccugaccaaccuggccagcaacgugaagaucgagaacgacggcugcaacguggacgagggccagaucgagaacuaccagaugaacgacagcagcugggugcaggacggcagccccgagauggccgagaacgagagcgagggccagaccaagguguucaucuggaacaacaugggcagccagggcauccaggagaccggcaagaccagaagaaagaaccagaccaccaagagauucaucuacaacaucccccccaacaacgagaccaaccuggaggacugcagcgugaugcagccccccguggccuaccccgaggagaacacccugcugaucaaggaggagcccgaccuggacggcgcccugcugagcggccccgacggcgacagaaacgugaacgccaaccugcuggccgaggccggcaccagccaggacggcggcgacgccggcaccagccacgacuucaaguacggccugaugcccggccccagcaacgacuucaaguacggccugauccccggcaccagcaacgacuucaaguacggccugauccccggcgccagcaacgacuucaaguacggccugcugcccgagagcuggcccaagcaggagaccugggagaacggcgagagcagccugaucaugaacaagcugaagugcccccacugcagcuacguggccaaguacagaagaacccugaagagacaccugcugauccacaccggcgugagaagcuucagcugcgacaucugcggcaagcuguucaccagaagagagcacgugaagagacacagccuggugcacaagaaggacaagaaguacaagugcauggugugcaagaagaucuucaugcuggccgccagcgugggcaucagacacggcagcagaagauacggcgugugcguggacugcgccgacaagagccagcccggcggccaggagggcguggaccagggccaggacaccgaguuccccagagacgaggaguacgaggagaacgaggugggcgaggccgacgaggagcugguggacgacggcgaggaccagaacgaccccagcagaugggacgagagcggcgaggugugcaugagccuggacgacuaa

SEQ ID NO: 25794 - RNA, 1380 nt, Artificial Sequence
  ZBTB12__Homo_sapiens__NP_862825
auggccagcggcguggaggugcugagauuccagcugcccggccacgaggccgccacccugagaaacaugaaccagcugagagccgaggagagauucugcgacgugaccaucguggccgacagccugaaguucagaggccacaaggugauccuggccgccugcagccccuuccugagagaccaguuccugcugaaccccagcagcgagcugcaggugagccugaugcacagcgccagaaucguggccgaccugcugcugagcugcuacaccggcgcccuggaguucgccgugagagacaucgugaacuaccugaccgccgccagcuaccugcagauggagcacgugguggagaagugcagaaacgcccugagccaguucaucgagcccaagaucggccugaaggaggacggcgugagcgaggccagccuggugagcagcaucagcgccaccaagagccugcugccccccgccagaacccccaagcccgcccccaagcccccccccccccccccccugccccccccccugcugagacccgugaagcuggaguucccccuggacgaggaccuggagcugaaggccgaggaggaggacgaggacgaggacgaggacgugagcgacaucugcaucgugaagguggagagcgcccuggagguggcccacagacugaagccccccggcggccugggcggcggccugggcaucggcggcagcgugggcggccaccugggcgagcuggcccagagcagcgugccccccagcaccguggcccccccccagggcguggugaaggccugcuacagccugagcgaggacgccgagggcgagggccugcugcugauccccggcggcagagccagcgugggcgccaccagcggccugguggaggccgccgccguggccauggccgccagaggcgccggcggcagccugggcgccggcggcagcagaggcccccugcccggcggcuucagcggcggcaacccccugaagaacaucaagugcaccaagugccccgagguguuccagggcguggagaagcugguguuccacaugagagcccagcacuucaucuucaugugccccagaugcggcaagcaguucaaccacagcagcaaccugaacagacacaugaacgugcacagaggcgugaagagccacagcugcggcaucugcggcaagugcuucacccagaagagcacccugcacgaccaccugaaccugcacagcggcgccagacccuacagaugcagcuacugcgacgugagauucgcccacaagcccgccaucagaagacaccugaaggagcagcacggcaagaccaccgccgagaacgugcuggaggccagcguggccgagaucaacgugcugaucagauaa

SEQ ID NO: 25795 - RNA, 1350 nt, Artificial Sequence
  ZBTB14__Homo_sapiens__NP_001137295
auggaguucuucaucagcaugagcgagaccaucaaguacaacgacgacgaccacaagacccuguuccugaagacccugaacgagcagagacuggagggcgaguucugcgacaucgccaucgugguggaggacgugaaguucagagcccacagaugcgugcuggccgccugcagcaccuacuucaagaagcuguucaagaagcuggagguggacagcagcagcgugaucgagaucgacuuccugagaagcgacaucuucgaggaggugcugaacuacauguacaccgccaagaucagcgugaagaaggaggacgugaaccugaugaugagcagcggccagauccugggcaucagauuccuggacaagcugugcagccagaagagagacgugagcagccccgacgagaacaacggccagagcaagagcaaguacugccugaagaucaacagacccaucggcgacgccgccgacacccaggacgacgacguggaggagaucggcgaccaggacgacagccccagcgacgacaccguggagggcaccccccccagccaggaggacggcaagagccccaccaccacccugagagugcaggaggccauccugaaggagcugggcagcgaggaggugagaaaggugaacugcuacggccaggagguggagagcauggagacccccgagagcaaggaccugggcagccagaccccccaggcccugaccuucaacgacggcaugagcgaggugaaggacgagcagacccccggcuggaccaccgccgccagcgacaugaaguucgaguaccugcuguacggccaccacagagagcagaucgccugccaggccugcggcaagaccuucagcgacgagggcagacugagaaagcacgagaagcugcacaccgccgacagacccuucgugugcgagaugugcaccaagggcuucaccacccaggcccaccugaaggagcaccugaagauccacaccggcuacaagcccuacagcugcgaggugugcggcaagagcuucaucagagcccccgaccugaagaagcacgagagagugcacagcaacgagagacccuucgccugccacaugugcgacaaggccuucaagcacaagagccaccugaaggaccacgagagaagacacagaggcgagaagcccuucgugugcggcagcugcaccaaggccuucgccaaggccagcgaccugaagagacacgagaacaacaugcacagcgagagaaagcaggugacccccagcgccauccagagcgagaccgagcagcugcaggccgccgccauggccgccgaggccgagcagcagcuggagaccaucgccugcagcuaa

SEQ ID NO: 25796 - RNA, 2022 nt, Artificial Sequence
  ZBTB16__Homo_sapiens__NP_001018011
auggaccugaccaagaugggcaugauccagcugcagaaccccagccaccccaccggccugcugugcaaggccaaccagaugagacuggccggcacccugugcgacguggugaucaugguggacagccaggaguuccacgcccacagaaccgugcuggccugcaccagcaagauguucgagauccuguuccacagaaacagccagcacuacacccuggacuuccugagccccaagaccuuccagcagauccuggaguacgccuacaccgccacccugcaggccaaggccgaggaccuggacgaccugcuguacgccgccgagauccuggagaucgaguaccuggaggagcagugccugaagaugcuggagaccauccaggccagcgacgacaacgacaccgaggccaccauggccgacggcggcgccgaggaggaggaggacagaaaggccagauaccugaagaacaucuucaucagcaagcacagcagcgaggagagcggcuacgccagcguggccggccagagccugcccggccccaugguggaccagagccccagcgugagcaccagcuucggccugagcgccaugagccccaccaaggccgccguggacagccugaugaccaucggccagagccugcugcagggcacccugcagccccccgccggccccgaggagcccacccuggccggcggcggcagacaccccggcguggccgaggugaagaccgagaugaugcagguggacgaggugcccagccaggacagccccggcgccgccgagagcagcaucagcggcggcaugggcgacaagguggaggagagaggcaaggagggccccggcacccccaccagaagcagcgugaucaccagcgccagagagcugcacuacggcagagaggagagcgccgagcaggugcccccccccgccgaggccggccaggcccccaccggcagacccgagcaccccgcccccccccccgagaagcaccugggcaucuacagcgugcugcccaaccacaaggccgacgccgugcugagcaugcccagcagcgugaccagcggccugcacgugcagcccgcccuggccgugagcauggacuucagcaccuacggcggccugcugccccagggcuucauccagagagagcuguucagcaagcugggcgagcuggccgugggcaugaagagcgagagcagaaccaucggcgagcagugcagcgugugcggcguggagcugcccgacaacgaggccguggagcagcacagaaagcugcacagcggcaugaagaccuacggcugcgagcugugcggcaagagauuccuggacagccugagacugagaaugcaccugcuggcccacagcgccggcgccaaggccuucgugugcgaccagugcggcgcccaguucagcaaggaggacgcccuggagacccacagacagacccacaccggcaccgacauggccguguucugccugcugugcggcaagagauuccaggcccagagcgcccugcagcagcacauggaggugcacgccggcgugagaagcuacaucugcagcgagugcaacagaaccuuccccagccacaccgcccugaagagacaccugagaagccacaccggcgaccaccccuacgagugcgaguucugcggcagcugcuucagagacgagagcacccugaagagccacaagagaauccacaccggcgagaagcccuacgagugcaacggcugcggcaagaaguucagccugaagcaccagcuggagacccacuacagagugcacaccggcgagaagcccuucgagugcaagcugugccaccagagaagcagagacuacagcgccaugaucaagcaccugagaacccacaacggcgccagccccuaccagugcaccaucugcaccgaguacugccccagccugagcagcaugcagaagcacaugaagggccacaagcccgaggagaucccccccgacuggagaaucgagaagaccuaccuguaccugugcuacguguaa

SEQ ID NO: 25797 - RNA, 2205 nt, Artificial Sequence
  ZBTB17__Homo_sapiens__XP_011540387
auguacaccgccaagcugagccugagccccgagaacguggacgacgugcuggccguggccaccuuccugcagaugcaggacaucaucaccgccugccacgcccugaagagccuggccgagcccgccaccagccccggcggcaacgccgaggcccuggccaccgagggcggcgacaagagagccaaggaggagaagguggccaccagcacccugagcagacuggagcaggccggcagaagcacccccaucggccccagcagagaccugaaggaggagagaggcggccaggcccagagcgccgccagcggcgccgagcagaccgagaaggccgacgcccccagagagcccccccccguggagcugaagcccgaccccaccagcggcauggccgccgccgaggccgaggccgcccugagcgagagcagcgagcaggagauggagguggagcccgccagaaagggcgaggaggagcagaaggagcaggaggagcaggaggaggagggcgccggccccgccgaggugaaggaggagggcagccagcuggagaacggcgaggcccccgaggagaacgagaacgaggagagcgccggcaccgacagcggccaggagcugggcagcgaggccagaggccugagaagcggcaccuacggcgacagaaccgagagcaaggccuacggcagcgugauccacaagugcgaggacugcggcaaggaguucacccacaccggcaacuucaagagacacaucagaauccacaccggcgagaagcccuucagcugcagagagugcagcaaggccuucagcgaccccgccgccugcaaggcccacgagaagacccacagcccccugaagcccuacggcugcgaggagugcggcaagagcuacagacugaucagccugcugaaccugcacaagaagagacacagcggcgaggccagauacagaugcgaggacugcggcaagcuguucaccaccagcggcaaccugaagagacaccagcuggugcacagcggcgagaagcccuaccagugcgacuacugcggcagaagcuucagcgaccccaccagcaagaugagacaccuggagacccacgacaccgacaaggagcacaagugcccccacugcgacaagaaguucaaccaggugggcaaccugaaggcccaccugaagauccacaucgccgacggcccccugaagugcagagagugcggcaagcaguucaccaccagcggcaaccugaagagacaccugagaauccacagcggcgagaagcccuacgugugcauccacugccagagacaguucgccgaccccggcgcccugcagagacacgugagaauccacaccggcgagaagcccugccagugcgugaugugcggcaaggccuucacccaggccagcagccugaucgcccacgugagacagcacaccggcgagaagcccuacgugugcgagagaugcggcaagagauucgugcagagcagccagcuggccaaccacaucagacaccacgacaacaucagaccccacaagugcagcgugugcagcaaggccuucgugaacgugggcgaccugagcaagcacaucaucauccacaccggcgagaagcccuaccugugcgacaagugcggcagaggcuucaacagaguggacaaccugagaagccacgugaagaccgugcaccagggcaaggccggcaucaagauccuggagcccgaggagggcagcgaggugagcguggugaccguggacgacauggugacccuggccaccgaggcccuggccgccaccgccgugacccagcugaccggccccgccacccugcccgccguggugcccgugggcgccgccgugaccgccgacgagaccgaggugcugaaggccgagaucagcaaggccgugaagcaggugcaggaggaggaccccaacacccacauccuguacgccugcgacagcugcggcgacaaguuccuggacgccaacagccuggcccagcacgugagaauccacaccgcccaggcccuggugauguuccagaccgacgccgacuucuaccagcaguacggccccggcggcaccuggcccgccggccaggugcugcaggccggcgagcugguguucagacccagagacggcgccgagggccagcccgcccuggccgagaccagccccaccgcccccgagugccccccccccgccgaguaa

SEQ ID NO: 25798 - RNA, 1596 nt, Artificial Sequence
  ZBTB18__Homo_sapiens__NP_991331
augugccccaagggcuacgaggacagcauggaguuccccgaccacagcagacaccugcugcagugccugagcgagcagagacaccagggcuuccugugcgacugcaccgugcuggugggcgacgcccaguucagagcccacagagccgugcuggccagcugcagcauguacuuccaccuguucuacaaggaccagcuggacaagagagacaucgugcaccugaacagcgacaucgugaccgcccccgccuucgcccugcugcuggaguucauguacgagggcaagcugcaguucaaggaccugcccaucgaggacgugcuggccgccgccagcuaccugcacauguacgacaucgugaaggugugcaagaagaagcugaaggagaaggccaccaccgaggccgacagcaccaagaaggaggaggacgccagcagcugcagcgacaagguggagagccugagcgacggcagcagccacaucgccggcgaccugcccagcgacgaggacgagggcgaggacgagaagcugaacauccugcccagcaagagagaccuggccgccgagcccggcaacauguggaugagacugcccagcgacagcgccggcaucccccaggccggcggcgaggccgagccccacgccaccgccgccggcaagaccguggccagccccugcagcagcaccgagagccugagccagagaagcgugaccagcgugagagacagcgccgacguggacugcgugcuggaccugagcgugaagagcagccugagcggcguggagaaccugaacagcagcuacuucagcagccaggacgugcugagaagcaaccuggugcaggugaagguggagaaggaggccagcugcgacgagagcgacgugggcaccaacgacuacgacauggagcacagcaccgugaaggagagcgugagcaccaacaacagagugcaguacgagcccgcccaccuggccccccugagagaggacagcgugcugagagagcuggacagagaggacaaggccagcgacgacgagaugaugacccccgagagcgagagagugcagguggagggcggcauggagagcagccugcugcccuacgugagcaacauccugagccccgccggccagaucuucaugugcccccugugcaacaagguguuccccagcccccacauccugcagauccaccugagcacccacuucagagagcaggacggcaucagaagcaagcccgccgccgacgugaacgugcccaccugcagccugugcggcaagaccuucagcugcauguacacccugaagagacacgagagaacccacagcggcgagaagcccuacaccugcacccagugcggcaagagcuuccaguacagccacaaccugagcagacacgccguggugcacaccagagagaagccccacgccugcaaguggugcgagagaagauucacccagagcggcgaccuguacagacacaucagaaaguuccacugcgagcuggugaacagccugagcgugaagagcgaggcccugagccugcccaccgugagagacuggacccuggaggacagcagccaggagcuguggaaguaa

SEQ ID NO: 25799 - RNA, 2226 nt, Artificial Sequence
  ZBTB20__Homo_sapiens__NP_001157814
augcuggagagaaagaagcccaagaccgccgagaaccagaaggccagcgaggagaacgagaucacccagcccggcggcagcagcgccaagcccggccugcccugccugaacuucgaggccgugcugagccccgaccccgcccugauccacagcacccacagccugaccaacagccacgcccacaccggcagcagcgacugcgacaucagcugcaagggcaugaccgagagaauccacagcaucaaccugcacaacuucagcaacagcgugcuggagacccugaacgagcagagaaacagaggccacuucugcgacgugaccgugagaauccacggcagcaugcugagagcccacagaugcgugcuggccgccggcagccccuucuuccaggacaagcugcugcugggcuacagcgacaucgagauccccagcguggugagcgugcagagcgugcagaagcugaucgacuucauguacagcggcgugcugagagugagccagagcgaggcccugcagauccugaccgccgccagcauccugcagaucaagaccgugaucgacgagugcaccagaaucgugagccagaacgugggcgacguguuccccggcauccaggacagcggccaggacacccccagaggcacccccgagagcggcaccagcggccagagcagcgacaccgagagcggcuaccugcagagccacccccagcacagcguggacagaaucuacagcgcccuguacgccugcagcaugcagaacggcagcggcgagagaagcuucuacagcggcgccguggugagccaccacgagaccgcccugggccugcccagagaccaccacauggaggaccccagcuggaucaccagaauccacgagagaagccagcagauggagagauaccugagcaccacccccgagaccacccacugcagaaagcagcccagacccgugagaauccagacccuggugggcaacauccacaucaagcaggagauggaggacgacuacgacuacuacggccagcagagagugcagauccuggagagaaacgagagcgaggagugcaccgaggacaccgaccaggccgagggcaccgagagcgagcccaagggcgagagcuucgacagcggcgugagcagcagcaucggcaccgagcccgacagcguggagcagcaguucggccccggcgccgccagagacagccaggccgagcccacccagcccgagcaggccgccgaggcccccgccgagggcggcccccagaccaaccagcuggagaccggcgccagcagccccgagagaagcaacgagguggagauggacagcaccgugaucaccgugagcaacagcagcgacaagagcgugcugcagcagcccagcgugaacaccagcaucggccagccccugcccagcacccagcuguaccugagacagaccgagacccugaccagcaaccugagaaugccccugacccugaccagcaacacccaggugaucggcaccgccggcaacaccuaccugcccgcccuguucaccacccagcccgccggcagcggccccaagcccuuccuguucagccugccccagccccuggccggccagcagacccaguucgugaccgugagccagcccggccugagcaccuucaccgcccagcugcccgccccccagccccuggccagcagcgccggccacagcaccgccagcggccagggcgagaagaagcccuacgagugcacccugugcaacaagaccuucaccgccaagcagaacuacgugaagcacauguucgugcacaccggcgagaagccccaccagugcagcaucugcuggagaagcuucagccugaaggacuaccugaucaagcacauggugacccacaccggcgugagagccuaccagugcagcaucugcaacaagagauucacccagaagagcagccugaacgugcacaugagacugcacagaggcgagaagagcuacgagugcuacaucugcaagaagaaguucagccacaagacccugcuggagagacacguggcccugcacagcgccagcaacggcaccccccccgccggcaccccccccggcgccagagccggcccccccggcgugguggccugcaccgagggcaccaccuacgugugcagcgugugccccgccaaguucgaccagaucgagcaguucaacgaccacaugagaaugcacgugagcgacggcuaa

SEQ ID NO: 25800 - RNA, 3201 nt, Artificial Sequence
  ZBTB21__Homo_sapiens__NP_001091872
auggagggccugcugcacuacaucaaccccgcccacgccaucagccugcugagcgcccugaacgaggagagacugaagggccagcugugcgacgugcugcugaucgugggcgaccagaaguucagagcccacaagaacgugcuggccgccagcagcgaguacuuccagagccuguucaccaacaaggagaacgagagccagaccguguuccagcuggacuucugcgagcccgacgccuucgacaacgugcugaacuacaucuacagcagcagccuguucguggagaagagcagccuggccgccgugcaggagcugggcuacagccugggcaucagcuuccugaccaacaucgugagcaagaccccccaggcccccuuccccaccugccccaacagaaagaagguguucguggaggacgacgagaacagcagccagaagagaagcgugaucgugugccagagcagaaacgaggcccagggcaagaccgugagccagaaccagcccgacgugagccacaccagcagacccagccccagcaucgccgugaaggccaacaccaacaagccccacgugcccaagcccaucgagccccugcacaaccugagccugaccgagaagagcuggcccaaggacagcagcgugguguacgccaagagccuggagcacagcggcagccuggacgaccccaacagaaucagccuggugaagagaaacgccgugcugcccagcaagccccugcaggacagagaggccauggacgacaagcccggcgugagcggccagcugcccaagggcaaggcccuggagcuggcccugaagagacccagaccccccgugcugagcgugugcagcagcagcgagacccccuaccugcugaaggagaccaacaagggcaacggccagggcgaggacagaaaccugcuguacuacagcaagcugggccuggugauccccagcagcggcagcggcagcggcaaccagagcaucgacagaagcggcccccuggugaagagccugcugagaagaagccugagcauggacagccaggugcccguguacagccccagcaucgaccugaagagcagccagggcagcagcagcgugagcagcgacgcccccggcaacgugcugugcgcccugagccagaagagcagccugaaggacugcagcgagaagaccgcccuggacgacagaccccaggugcugcagccccacagacugagaagcuucagcgccagccagagcaccgacagagagggcgccagccccgugaccgaggugagaaucaagaccgagcccagcagcccccugagcgaccccagcgacaucaucagagugaccgugggcgacgccgccaccaccgccgccgccagcagcagcagcgugaccagagaccugagccugaagaccgaggacgaccagaaggacaugagcagacugcccgccaagagaagauuccaggccgacagaagacugcccuucaagaagcugaaggugaacgagcacggcagccccgugagcgaggacaacuucgaggagggcagcagccccacccugcuggacgccgacuuccccgacagcgaccugaacaaggacgaguucggcgagcuggagggcaccagacccaacaagaaguucaagugcaagcacugccugaagaucuucagaagcaccgccggccugcacagacacgugaacauguaccacaaccccgagaagcccuacgccugcgacaucugccacaagagauuccacaccaacuucaagguguggacccacugccagacccagcacggcaucgugaagaaccccagccccgccagcagcagccacgccgugcuggacgagaaguuccagagaaagcugaucgacaucgugagagagagagagaucaagaaggcccugaucaucaagcugagaagaggcaagcccggcuuccagggccagagcagcagccaggcccagcaggugaucaagagaaaccugagaagcagagccaagggcgccuacaucugcaccuacugcggcaaggccuacagauuccugagccaguucaagcagcacaucaagaugcaccccggcgagaagccccugggcgugaacaagguggccaagcccaaggagcacgccccccuggccagccccguggagaacaaggagguguaccagugcagacugugcaacgccaagcugagcagccugcuggagcagggcagccacgagagacugugcagaaacgccgccgugugccccuacugcagccugagauucuucagccccgagcugaagcaggagcacgagagcaagugcgaguacaagaagcugaccugccuggagugcaugagaaccuucaagagcagcuucagcaucuggagacaccagguggaggugcacaaccagaacaacauggcccccaccgagaacuucagccugcccgugcuggaccacaacggcgacgugaccggcagcagcagaccccagagccagcccgagcccaacaaggugaaccacaucgugaccaccaaggacgacaacguguucagcgacagcagcgagcaggugaacuucgacagcgaggacagcagcugccugcccgaggaccugagccugagcaagcagcugaagauccaggugaaggaggagcccguggaggaggccgaggaggaggcccccgaggccagcaccgcccccaaggaggccggccccagcaaggaggccagccuguggcccugcgagaagugcggcaagauguucaccgugcacaagcagcuggagagacaccaggagcugcugugcagcgugaagcccuucaucugccacgugugcaacaaggccuucagaaccaacuucagacuguggagccacuuccagagccacaugagccaggccagcgaggagagcgcccacaaggagagcgaggugugccccgugcccaccaacagccccagcccccccccccugccccccccccccccccugcccaagauccagccccuggagcccgacagccccaccggccugagcgagaaccccacccccgccaccgagaagcuguucgugccccaggagagcgacacccuguucuaccacgcccccccccugagcgccaucaccuucaagagacaguucaugugcaagcugugccacagaaccuucaagaccgccuucagccuguggagccacgagcagacccacaacuaa

SEQ ID NO: 25801 - RNA, 1905 nt, Artificial Sequence
  ZBTB22__Homo_sapiens__NP_001138810
auggagcccagcccccugagccccagcggcgccgcccugccccugccccugagccuggccccccccccccugccccugcccgccgccgccguggugcacgugagcuuccccgaggugaccagcgcccugcuggagagccugaaccagcagagacugcagggccagcugugcgacgugagcaucagagugcagggcagagaguucagagcccacagagccgugcuggccgccagcagccccuacuuccacgaccaggugcugcugaagggcaugaccagcaucagccugcccagcgugauggaccccggcgccuucgagaccgugcuggccagcgccuacaccggcagacugagcauggccgccgccgacaucgugaacuuccugaccgugggcagcgugcugcagauguggcacaucguggacaagugcaccgagcugcugagagagggcagagccagcgccaccaccaccaucaccaccgccgccgccaccagcgugaccgugcccggcgccggcgugcccagcggcagcggcggcaccguggcccccgccaccaugggcagcgccagaagccacgccagcagcagagccagcgagaaccagagccccagcagcagcaacuacuucagccccagagagagcaccgacuucagcagcagcagccaggaggccuucgccgccagcgccgugggcagcggcgagagaagaggcggcggccccguguuccccgcccccguggugggcagcggcggcgccaccagcggcaagcugcugcuggaggccgacgagcugugcgacgacggcggcgacggcagaggcgccguggugcccggcgccggccugagaagacccaccuacaccccccccagcaucaugccccagaagcacuggguguacgugaagagaggcggcaacugccccgcccccaccccccuggugccccaggaccccgaccuggaggaggaggaggaggaggaggaccuggugcugaccugcgaggacgacgaggacgaggagcugggcggcagcagcagagugcccgugggcggcggccccgaggccacccugagcaucagcgacgugagaacccugagcgagccccccgacaagggcgaggagcaggugaacuucugcgagagcagcaacgacuucggccccuacgagggcggcggccccguggccggccuggacgacagcggcggccccacccccagcagcuacgcccccagccacccccccagaccccugcugccccuggacaugcagggcaaccagauccugguguuccccagcagcagcagcagcagcagcagccaggcccccggccagccccccggcaaccaggccgagcacggcgccgugaccgugggcggcaccagcgugggcagccugggcgugcccggcagcgugggcggcgugcccggcggcaccggcagcggcgacggcaacaagaucuuccugugccacugcggcaaggccuucagccacaagagcaugagagacagacacgugaacaugcaccugaaccugagacccuucgacugccccgugugcaacaagaaguucaagaugaagcaccaccugaccgagcacaugaagacccacaccggccugaagcccuacgagugcggcgugugcgccaagaaguucauguggagagacagcuucaugagacacagaggccacugcgagagaagacacagacugggcggcgugggcgccgugcccggccccggcacccccaccggccccagccugcccagcaagagagagagccccggcgugggcggcggcagcggcgacgaggccagcgccgccaccccccccagcagcagaagaguguggagcccccccagagugcacaagguggagaugggcuucggcggcggcggcggcgccaacuaa

SEQ ID NO: 25802 - RNA, 2094 nt, Artificial Sequence
  ZBTB24__Homo_sapiens__NP_055612
auggccgagaccagccccgagcccagcggccagcugguggugcacagcgacgcccacagcgacaccgugcuggccagcuucgaggaccagagaaagaagggcuuccugugcgacaucacccugaucguggagaacgugcacuucagagcccacaaggcccugcuggccgccagcagcgaguacuucagcaugauguucgccgaggagggcgagaucggccagagcaucuacaugcuggagggcaugguggccgacaccuucggcauccugcuggaguucaucuacaccggcuaccugcacgccagcgagaagagcaccgagcagauccuggccaccgcccaguuccugaagguguacgaccuggugaaggccuacaccgacuuccagaacaaccacagcagccccaagcccaccacccugaacaccgccggcgcccccgugguggugaucagcaacaagaagaacgacccccccaagagaaagagaggcagacccaagaaggugaacacccugcaggaggagaagagcgagcuggccgccgaggaggagauccagcugagagugaacaacagcgugcagaacagacagaacuucguggugaagggcgacagcggcgugcugaacgagcagaucgccgccaaggagaaggaggagagcgagcccaccugcgagcccagcagagaggaggagaugcccguggagaaggacgagaacuacgaccccaagaccgaggacggccaggccagccagagcagauacagcaagagaagaaucuggagaagcgugaagcugaaggacuacaagcuggugggcgaccaggaggaccacggcagcgccaagagaaucugcggcagaagaaagagacccggcggccccgaggccagaugcaaggacugcggcaagguguucaaguacaaccacuuccuggccauccaccagagaagccacaccggcgagagacccuucaagugcaacgagugcggcaagggcuucgcccagaagcacagccugcaggugcacaccagaaugcacaccggcgagagacccuacaccugcaccgugugcagcaaggcccugaccaccaagcacagccugcuggagcacaugagccugcacagcggccagaagagcuucaccugcgaccagugcggcaaguacuucagccagaacagacagcugaagagccacuacagagugcacaccggccacagccugcccgagugcaaggacugccacagaaaguucauggacgugagccagcugaagaagcaccugagaacccacaccggcgagaagcccuucaccugcgagaucugcggcaagagcuucaccgccaagagcagccugcagacccacaucagaauccacagaggcgagaagcccuacagcugcggcaucugcggcaagagcuucagcgacagcagcgccaagagaagacacugcauccugcacaccggcaagaagcccuucagcugccccgagugcaaccugcaguucgccagacuggacaaccugaaggcccaccugaagauccacagcaaggagaagcacgccagcgacgccagcagcaucagcggcagcagcaacaccgaggaggugagaaacauccugcagcugcagcccuaccagcugagcaccagcggcgagcaggagauccagcugcuggugaccgacagcgugcacaacaucaacuucaugcccggccccagccagggcaucagcaucgugaccgccgagagcagccagaacaugaccgccgaccaggccgccaaccugacccugcugacccagcagcccgagcagcugcagaaccugauccugagcgcccagcaggagcagaccgagcacauccagagccugaacaugaucgagagccagaugggccccagccagaccgagcccgugcacgugaucacccugagcaaggagacccuggagcaccugcacgcccaccaggagcagaccgaggagcugcaccuggccaccagcaccagcgaccccgcccagcaccugcagcugacccaggagcccggcccccccccccccacccaccacgugccccagcccaccccccugggccaggagcagagcuaa

SEQ ID NO: 25803 - RNA, 1545 nt, Artificial Sequence
  ZBTB2__Homo_sapiens__NP_065912
auggaccuggccaaccacggccugauccugcugcagcagcugaacgcccagagagaguucggcuuccugugcgacugcaccguggccaucggcgacguguacuucaaggcccacaagagcgugcuggccagcuucagcaacuacuucaagaugcuguucgugcaccagaccagcgagugcgugagacugaagcccaccgacauccagcccgacaucuucagcuaccugcugcaccugauguacaccggcaagauggccccccagcugaucgaccccgugagacuggagcagggcaucaaguuccugcacgccuacccccugauccaggaggccagccuggccagccagggcgccuucagccaccccgaccagguguucccccuggccagcagccuguacggcauccagaucgccgaccaccagcugagacaggccaccaagaucgccagcgcccccgagaagcugggcagagaccccagaccccagaccagcagaaucagccaggagcaggugcccgaggccagccagcugagccagcugaccagcaaccuggcccaggugaacagaaccaacaugacccccagcgacccccugcagaccagccugagccccgagcuggugagcacccccgugcccccccccccccccggcgaggagaccaaccuggaggccagcagcagcgacgagcagcccgccagccugaccaucgcccacgugaagcccagcaucaugaagagaaacggcagcuuccccaaguacuacgccugccaccugugcggcagaagauucacccugagaagcagccugagagagcaccugcagauccacaccggcgugcccuucaccagcagccagcagggcgagagcagagugccccugacccugugcagcaacgccgccgaccugggcaaggacgccauggaggugcccgaggccggcaugaucagcgacagcgagcugcagcacaucagcgacagccccaucaucgacggccagcagcagagcgagacccccccccccagcgacaucgccgacaucgacaaccuggagcaggccgaccaggagagagaggugaagagaagaaaguacgagugcaccaucugcggcagaaaguucauccagaagagccacuggagagagcacauguacauccacaccggcaagcccuucaagugcagcaccugcgacaagagcuucugcagagccaaccaggccgccagacacgugugccugaaccagagcaucgacaccuacaccaugguggacaagcagacccuggagcugugcaccuucgaggagggcagccagauggacaacaugcuggugcagaccaacaagcccuacaagugcaaccugugcgacaagaccuucagcacccccaacgagguggugaagcacagcugccagaaccagaacagcgacguguucgcccuggacgagggcagaagcauccugcugggcagcggcgacagcgaggugaccgagcccgaccaccccgugcuggccagcaucaagaaggagcaggagaccgugcugcuggacuaa

SEQ ID NO: 25804 - RNA, 1464 nt, Artificial Sequence
  ZBTB32__Homo_sapiens__NP_055198
augagccugccccccaucagacugcccagccccuacggcagcgacagacuggugcagcuggccgccagacugagacccgcccugugcgacacccugaucaccgugggcagccaggaguuccccgcccacagccuggugcuggccggcgugagccagcagcugggcagaagaggccagugggcccugggcgagggcaucagccccagcaccuucgcccagcugcugaacuucguguacggcgagagcguggagcugcagcccggcgagcugagaccccugcaggaggccgccagagcccugggcgugcagagccuggaggaggccugcuggagagccagaggcgacagagccaagaagcccgaccccggccugaagaagcaccaggaggagcccgagaagcccagcagaaaccccgagagagagcugggcgaccccggcgagaagcagaagcccgagcaggugagcagaaccggcggcagagagcaggagaugcugcacaagcacagcccccccagaggcagacccgagauggccggcgccacccaggaggcccagcaggagcagaccagaagcaaggagaagagacugcaggcccccgugggccagagaggcgccgacggcaagcacggcgugcugaccuggcugagagagaaccccggcggcagcgaggagagccugagaaagcugcccggcccccugccccccgccggcagccugcagaccagcgugacccccagacccagcugggccgaggcccccuggcuggugggcggccagcccgcccuguggagcauccugcugaugccccccagauacggcauccccuucuaccacagcacccccaccaccggcgccuggcaggagguguggagagagcagagaaucccccugagccugaacgcccccaagggccuguggagccagaaccagcuggccagcagcagccccacccccggcagccugccccagggccccgcccagcugagccccggcgagauggaggagagcgaccagggccacaccggcgcccuggccaccugcgccggccacgaggacaaggccggcugcccccccagaccccaccccccccccgccccccccgccagaagcagacccuacgccugcagcgugugcggcaagagauucagccugaagcaccagauggagacccacuacagagugcacaccggcgagaagcccuucagcugcagccugugcccccagagaagcagagacuucagcgccaugaccaagcaccugagaacccacggcgccgcccccuacagaugcagccugugcggcgccggcugccccagccuggccagcaugcaggcccacaugagaggccacagccccagccagcugccccccggcuggaccaucagaagcaccuuccuguacagcagcagcagacccagcagacccagcaccagccccugcugccccagcagcagcaccaccuaa

SEQ ID NO: 25805 - RNA, 2019 nt, Artificial Sequence
  ZBTB33__Homo_sapiens__NP_006768
auggagagcagaaagcugaucagcgccaccgacauccaguacagcggcagccugcugaacagccugaacgagcagagaggccacggccuguucugcgacgugaccgugaucguggaggacagaaaguucagagcccacaagaacauccugagcgccagcagcaccuacuuccaccagcuguucagcguggccggccaggugguggagcugagcuucaucagagccgagaucuucgccgagauccugaacuacaucuacagcagcaagaucgugagagugagaagcgaccugcuggacgagcugaucaagagcggccagcugcugggcgugaaguucaucgccgagcugggcgugccccugagccaggugaagagcaucagcggcaccgcccaggacggcaacaccgagccccugccccccgacagcggcgacaagaaccuggugauccagaagagcaaggacgaggcccaggacaacggcgccaccaucaugcccaucaucaccgagagcuucagccugagcgccgaggacuacgagaugaagaagaucaucgugaccgacagcgacgacgacgacgacgacgugaucuucugcagcgagauccugcccaccaaggagacccugcccagcaacaacaccguggcccaggugcagagcaaccccggccccguggccaucagcgacguggcccccagcgccagcaacaacagccccccccugaccaacaucacccccacccagaagcugcccacccccgugaaccaggccacccugagccagacccagggcagcgagaagcugcuggugagcagcgcccccacccaccugacccccaacaucauccugcugaaccagaccccccugagcaccccccccaacgugagcagcagccugcccaaccacaugcccagcagcaucaaccugcuggugcagaaccagcagacccccaacagcgccauccugaccggcaacaaggccaacgaggaggaggaggaggagaucaucgacgacgacgacgacaccaucagcagcagccccgacagcgccgugagcaacaccagccuggugccccaggccgacaccagccagaacaccagcuucgacggcagccugauccagaagaugcagauccccacccugcugcaggagccccugagcaacagccugaagaucagcgacaucaucaccagaaacaccaacgaccccggcgugggcagcaagcaccugauggagggccagaagaucaucacccuggacaccgccaccgagaucgagggccugagcaccggcugcaagguguacgccaacaucggcgaggacaccuacgacaucgugauccccgugaaggacgaccccgacgagggcgaggccagacuggagaacgagauccccaagaccagcggcagcgagauggccaacaagagaaugaaggugaagcacgacgaccacuacgagcugaucguggacggcagaguguacuacaucugcaucgugugcaagagaagcuacgugugccugaccagccugagaagacacuucaacauccacagcugggagaagaaguaccccugcagauacugcgagaagguguucccccuggccgaguacagaaccaagcacgagauccaccacaccggcgagagaagauaccagugccuggccugcggcaagagcuucaucaacuaccaguucaugagcagccacaucaagagcgugcacagccaggaccccagcggcgacagcaagcuguacagacugcaccccugcagaagccugcagaucagacaguacgccuaccugagcgacagaagcagcaccauccccgccaugaaggacgacggcaucggcuacaagguggacaccggcaaggagccccccgugggcaccaccaccagcacccagaacaagcccaugaccugggaggacaucuucauccagcaggagaacgacagcaucuucaagcagaacgugaccgacggcagcaccgaguucgaguucaucauccccgagagcuacuaa

SEQ ID NO: 25806 - RNA, 1503 nt, Artificial Sequence
  ZBTB34__Homo_sapiens__NP_001092740
auggacagcagcagcuucauccaguucgacgugcccgaguacagcagcaccgugcugagccagcugaacgagcugagacugcagggcaagcugugcgacaucaucgugcacauccagggccagcccuucagagcccacaaggccgugcuggccgccagcagccccuacuucagagaccacagcgcccugagcaccaugagcggccugagcaucagcgugaucaagaaccccaacguguucgagcagcugcugagcuucugcuacaccggcagaaugagccugcagcugaaggacguggugagcuuccugaccgccgccagcuuccugcagaugcagugcgugaucgacaagugcacccagauccuggagagcauccacagcaagaucagcgugggcgacguggacagcgugaccgugggcgccgaggagaaccccgagagcagaaacggcgugaaggacagcagcuucuucgccaaccccguggagaucagcccccccuacugcagccagggcagacagcccaccgccagcagcgaccugagaauggagaccacccccagcaaggcccugagaagcagacugcaggaggagggccacagcgacagaggcagcagcggcagcgugagcgaguacgagauccagaucgagggcgaccacgagcagggcgaccugcuggugagagagagccagaucaccgaggugaaggugaagauggagaagagcgacagacccagcugcagcgacagcagcagccugggcgacgacggcuaccacaccgagaugguggacggcgagcaggugguggccgugaacgugggcagcuacggcagcgugcugcagcacgccuacagcuacagccaggccgccagccagcccaccaacgugagcgaggccuucggcagccugagcaacagcagccccagcagaagcaugcugagcugcuucagaggcggcagagccagacagaagagagcccugagcgugcaccugcacagcgaccugcagggccuggugcagggcagcgacagcgaggccaugaugaacaaccccggcuacgagagcagccccagagagagaagcgccagaggccacugguaccccuacaacgagagacugaucugcaucuacugcggcaagagcuucaaccagaagggcagccuggacagacacaugagacugcacaugggcaucacccccuucgugugcaaguucugcggcaagaaguacaccagaaaggaccagcuggaguaccacaucagaggccacaccgacgacaagcccuucagaugcgagaucugcggcaagugcuuccccuuccagggcacccugaaccagcaccugagaaagaaccaccccggcguggccgaggugagaagcagaaucgagagccccgagagaaccgacguguacguggagcagaagcuggagaacgacgccagcgccagcgagaugggccuggacagcagaauggagauccacaccgugagcgacgcccccgacuaa

SEQ ID NO: 25807 - RNA, 3588 nt, Artificial Sequence
  ZBTB38__Homo_sapiens__NP_001073881
augaccgugaugagccugagcagagaccugaaggacgacuuccacagcgacaccgugcugagcauccugaacgagcagagaaucagaggcauccugugcgacgugaccaucaucguggaggacaccaaguucaaggcccacagcaacgugcuggccgccagcagccuguacuucaagaacaucuucuggagccacaccaucugcaucagcagccacgugcuggagcuggacgaccugaaggccgagguguucaccgagauccugaacuacaucuacagcagcaccgugguggugaagagacaggagaccgugaccgaccuggccgccgccggcaagaagcugggcaucagcuuccuggaggaccugaccgacagaaacuucagcaacagccccggccccuacguguucugcaucaccgagaagggcguggugaaggaggagaagaacgagaagagacacgaggagcccgccaucaccaacggccccagaaucaccaacgccuucagcaucaucgagaccgagaacagcaacaacauguucagcccccuggaccugagagccagcuucaagaaggugagcgacagcaugagaaccgccagccugugccuggagagaaccgacgugugccacgaggccgagcccgugagaacccuggccgagcacagcuacgccgugagcagcguggccgaggccuacagaagccagcccgugagagagcacgacggcagcagccccggcaacaccggcaaggagaacugcgaggcccuggccgccaagcccaagaccugcagaaagcccaagaccuucagcaucccccaggacagcgacagcgccaccgagaacaucccccccccccccgugagcaaccuggaggugaaccaggagagaagcccccagcccgccgccgugcugaccagaagcaagagccccaacaacgagggcgacgugcacuucagcagagaggacgagaaccagagcagcgacgugcccggcccccccgccgccgaggugcccccccugguguacaacugcagcugcugcagcaaggccuucgacagcagcacccugcugagcgcccacaugcagcugcacaagcccacccaggagccccuggugugcaaguacugcaacaagcaguucaccacccugaacagacuggacagacacgagcagaucugcaugagaagcagccacaugcccauccccggcggcaaccagagauuccuggagaacuaccccaccaucggccagaacggcggcagcuucaccggccccgagccccugcugagcgagaacagaaucggcgaguucagcagcaccggcagcacccugcccgacaccgaccacauggugaaguucgugaacggccagaugcuguacagcugcguggugugcaagagaagcuacgugacccugagcagccugagaagacacgccaacgugcacagcuggagaagaaccuaccccugccacuacugcaacaagguguucgcccuggccgaguacagaaccagacacgagaucuggcacaccggcgagagaagauaccagugcaucuucugccuggagaccuucaugaccuacuacauccugaagaaccaccagaagagcuuccacgccaucgaccacagacugagcaucagcaagaagaccgccaacggcggccugaagcccagcguguaccccuacaagcuguacagacugcugcccaugaagugcaagagagcccccuacaagagcuacagaaacagcagcuacgagaacgccagagagaacagccagaugaacgagagcgcccccggcaccuacguggugcagaacccccacagcagcgagcugcccacccugaacuuccaggacaccgugaacacccugaccaacagccccgccaucccccuggagaccagcgccugccaggacauccccaccagcgccaacgugcagaacgccgagggcaccaaguggggcgaggaggcccugaagauggaccuggacaacaacuucuacagcaccgaggugagcgugagcagcaccgagaacgccgugagcagcgaccugagagccggcgacgugcccgugcugagccugagcaacagcagcgagaacgccgccagcgugaucagcuacagcggcagcgcccccagcgugaucgugcacagcagccaguucagcagcgugaucaugcacagcaacgccaucgccgccaugaccagcagcaaccacagagccuucagcgaccccgccgugagccagagccugaaggacgacagcaagcccgagcccgacaaggugggcagauucgccagcagacccaagagcaucaaggagaagaagaagaccaccagccacaccagaggcgagauccccgaggagagcaacuacguggccgaccccggcggcagccugagcaagaccaccaacaucgccgaggagaccagcaagaucgagaccuacaucgccaagcccgcccugcccggcaccagcaccaacagcaacguggccccccugugccagaucaccgugaagaucggcaacgaggccaucgugaagagacacauccugggcagcaagcuguucuacaagagaggcagaagacccaaguaccagaugcaggaggagccccugccccagggcaacgaccccgagcccagcggcgacagcccccugggccugugccagagcgagugcauggagaugagcgagguguucgacgacgccagcgaccaggacagcaccgacaagcccuggagacccuacuacaacuacaagcccaagaagaagagcagacagcugaagaagaugagaaaggugaacuggagaaaggagcacggcaacagaagccccagccacaagugcaaguaccccgccgagcuggacugcgccgugggcaaggccccccaggacaagcccuucgaggaggaggagaccaaggagaugcccaagcugcagugcgagcugugcgacggcgacaaggccgugggcgccggcaaccagggcagaccccacagacaccugaccagcagacccuacgccugcgagcugugcgccaagcaguuccagagccccagcacccugaagaugcacaugagaugccacaccggcgagaagcccuaccagugcaagaccugcggcagaugcuucagcgugcagggcaaccugcagaagcacgagagaauccaccugggccugaaggaguucgugugccaguacugcaacaaggccuucacccugaacgagacccugaagauccacgagagaauccacaccggcgagaagagauaccacugccaguucugcuuccagagauuccuguaccugagcaccaagagaaaccacgagcagagacacaucagagagcacaacggcaagggcuacgccugcuuccagugccccaagaucugcaagaccgccgccgcccugggcaugcaccagaagaagcaccuguucaagagccccagccagcaggagaagaucggcgacgugugccacgagaacagcaacccccuggagaaccagcacuucaucggcagcgaggacaacgaccagaaggacaacauccagaccggcguggagaacguggugcuguaa

SEQ ID NO: 25808 - RNA, 2730 nt, Artificial Sequence
  ZBTB41__Homo_sapiens__NP_919290
augaagaagagaagaaaggugaccagcaaccuggagaagauccaccugggcuaccacaaggacagcagcgagggcaacguggccguggagugcgaccaggugaccuacacccacagcgccggcagacccacccccgaggcccugcacugcuaccaggagcugccccccagccccgaccagagaaagcugcugagcagccugcaguacaacaagaaccugcugaaguaccugaacgacgacagacagaagcagcccagcuucugcgaccugcugaucaucguggagggcaaggaguucagcgcccacaagguggugguggccgugggcagcagcuacuuccacgccugccugagcaagaaccccagcaccgacguggugacccuggaccacgugacccacagcguguuccagcaccugcuggaguuccuguacaccagcgaguucuucguguacaaguacgagaucccccuggugcuggaggccgccaaguuccuggacaucaucgacgccgugaagcugcugaacaacgagaacguggcccccuuccacagcgagcugaccgagaagagcagccccgaggagacccugaacgagcugaccggcagacugagcaacaaccaccagugcaaguucugcagcagacacuucugcuacaagaagagccuggagaaccaccuggccaagacccacagaagccugcugcugggcaagaagcacggccugaagaugcuggagagaagcuucagcgccagaagaagcaagagaaacagaaagugccccgugaaguucgacgacaccagcgacgacgagcaggagagcggcgacggcagcgacaaccugaaccaggagaacuucgacaaggagaagagcgacagaaacgacagcgaggaccccggcagcgaguacaacgccgaggaggacgagcuggaggaggagaugagcgacgaguacagcgacaucgaggagcagagcgagaaggaccacaacgacgccgaggaggagcccgaggccggcgacagcgugggcaacgugcacgagggccugacccccguggugauccagaacagcaacaagaagauccugcagugccccaagugcgacaagaccuucgacagaaucggcaaguacgagagccacaccagagugcacaccggcgagaagcccuucgagugcgacaucugccaccagagauacagcaccaagagcaaccugaccgugcacagaaagaagcacagcaacgagaccgaguuccacaagaaggagcacaagugccccuacugcaacaagcugcacgccagcaagaagacccuggccaagcacgugaagagauuccaccccgagaacgcccaggaguucaucagcaucaagaagaccaagagcgagagcuggaagugcgacaucugcaagaagagcuucaccagaagaccccaccuggaggagcacaugauccugcacagccaggacaagcccuucaagugcaccuacugcgaggagcacuucaagagcagauucgccagacugaagcaccaggagaaguuccaccugggccccuuccccugcgacaucugcggcagacaguucaacgacaccggcaaccugaagagacacaucgagugcacccacggcggcaagagaaaguggaccugcuucaucugcggcaagagcgugagagagagaaccacccugaaggagcaccugagaauccacagcggcgagaagccccaccugugcagcaucugcggccagagcuucagacacggcagcagcuacagacugcaccugagagugcaccacgacgacaagagauacgagugcgacgagugcggcaagaccuucaucagacacgaccaccugaccaagcacaagaagauccacagcggcgagaaggcccaccagugcgaggagugcggcaagugcuucggcagaagagaccaccugaccgugcacuacaagagcgugcaccugggcgagaagguguggcagaaguacaaggccaccuuccaccagugcgacgugugcaagaagaucuucaagggcaagagcagccuggagaugcacuucagaacccacagcggcgagaagcccuacaagugccagaucugcaaccagagcuucagaaucaagaagacccugaccaagcaccuggugauccacagcgacgccagacccuucaacugccagcacugcaacgccaccuucaagagaaaggacaagcugaaguaccacaucgaccacgugcacgagaucaagagccccgacgacccccugagcaccagcgaggagaagcuggugagccugcccguggaguacagcagcgacgacaagaucuuccagaccgagaccaagcaguacauggaccagcccaagguguaccagagcgaggccaagaccaugcugcagaacgugagcgccgaggugugcgugcccgugacccuggugcccgugcagaugcccgacacccccagcgaccuggugagacacaccaccacccugccccccagcagccacgagauccugagcccccagccccagagcaccgacuaccccagagccgccgaccuggccuuccuggagaaguacacccugaccccccagcccgccaacaucgugcaccccgugagacccgagcagaugcuggaccccagagagcagagcuaccugggcacccugcugggccuggacagcaccaccggcgugcagaacaucagcaccaacgagcaccacagcuaa

SEQ ID NO: 25809 - RNA, 1770 nt, Artificial Sequence
  ZBTB46__Homo_sapiens__XP_005260254
augaacaacagaaaggaggacauggagaucaccagccacuacagacaccugcugagagagcugaacgagcagagacagcacggcgugcugugcgacgugugcguggugguggagggcaagguguucaaggcccacaagaacgugcugcugggcagcagcagauacuucaagacccuguacugccaggugcagaagaccagcgagcaggccaccgugacccaccuggacaucgugaccgcccagggcuucaaggccaucaucgacuucauguacagcgcccaccuggcccugaccagcagaaacgugaucgaggugaugagcgccgccagcuuccugcagaugaccgacaucgugcaggccugccacgacuucaucaaggccgcccuggacaucagcaucaagagcgacgccagcgacgagcuggccgaguucgagaucggcgccagcagcagcagcagcaccgaggcccugaucagcgccgugauggccggcagaagcaucagccccuggcuggccagaagaaccagccccgccaacagcagcggcgacagcgccaucgccagcugccacgacggcggcagcagcuacggcaaggaggaccaggagcccaaggccgacggccccgacgacgugagcagccagccccuguggcccggcgacgugggcuacggcccccugagaaucaaggaggagcaggugagccccagccaguacggcggcagcgagcugcccagcgccaaggacggcgccgugcagaacagcuucagcgagcagagcgccggcgacgccuggcagcccaccggcagaagaaagaacagaaagaacaaggagaccgugagacacaucacccagcagguggaggacgacagcagagccagcagccccgugcccagcuuccugcccaccagcggcuggcccuucagcagcagagacagcaacgccgaccugagcgugaccgaggccagcagcagcgacagcagaggcgagagagccgagcuguacgcccagguggaggagggccugcugggcggcgaggccagcuaccugggccccccccugacccccgagaaggacgacgcccugcaccaggccaccgccguggccaaccugagagccgcccugaugagcaagaacagccugcugagccugaaggccgacgugcugggcgacgacggcagccugcuguucgaguaccugcccagaggcgcccacagccugagccugaacgaguucaccgugaucagaaagaaguucaagugccccuacugcagcuucagcgccaugcaccagugcauccugaagagacacaugagaagccacaccggcgagagacccuaccccugcgagaucugcggcaagaaguucaccagaagagagcacaugaagagacacacccuggugcacagcaaggacaagaaguacgugugcaaggugugcagcagaguguucaugagcgccgccagcgugggcaucagacacggcagcagaagacacggcgugugcaccgacugcgccggcagaggcauggccggcccccuggaccacggcggcggcggcggcgagggcagccccgaggcccuguuccccggcgacggccccuaccuggaggaccccgaggaccccagaggcgaggccgaggagcugggcgaggacgacgagggccuggcccccgaggacgcccugcuggccgacgacaaggacgaggaggacagccccagacccagaagcccccccggcggccccgacaaggacuucgccuggcugagcuaa

SEQ ID NO: 25810 - RNA, 1140 nt, Artificial Sequence
  ZBTB48__Homo_sapiens__XP_011539612
augagaaagcacaccggcgagaagcccuucgagugccccaagugcggcaagugcuacuucagaaaggagaaccugcuggagcacgaggccagaaacugcaugaacagaagcgagcagguguucaccugcagcgugugccaggagaccuucagaagaagaauggagcugagagugcacauggugagccacaccggcgagaugcccuacaagugcagcagcugcagccagcaguucaugcagaagaaggaccugcagagccacaugaucaagcugcacggcgcccccaagccccacgccugccccaccugcgccaagugcuuccugagcagaaccgagcugcagcugcacgaggccuucaagcacagaggcgagaagcuguucgugugcgaggagugcggccacagagccagcagcagaaacggccugcagaugcacaucaaggccaagcacagaaacgagagaccccacgugugcgaguucugcagccacgccuucacccagaaggccaaccugaacaugcaccugagaacccacaccggcgagaagcccuuccagugccaccugugcggcaagaccuucagaacccaggccagccuggacaagcacaacagaacccacaccggcgagagacccuucagcugcgaguucugcgagcagagauucaccgagaagggcccccugcugagacacguggccagcagacaccaggagggcagaccccacuucugccagaucugcggcaagaccuucaaggccguggagcagcugagagugcacgugagaagacacaagggcgugagaaaguucgagugcaccgagugcggcuacaaguucaccagacaggcccaccugagaagacacauggagauccacgacagaguggagaacuacaaccccagacagagaaagcugagaaaccugaucaucgaggacgagaagaugguggugguggcccugcagccccccgccgagcuggaggugggcagcgccgaggugaucguggagagccuggcccagggcggccuggccagccagcugcccggccagagacugugcgccgaggagagcuucaccggccccggcgugcuggagcccagccugaucaucaccgccgccgugcccgaggacugcgacaccuaa

SEQ ID NO: 25811 - RNA, 2298 nt, Artificial Sequence
  ZBTB49__Homo_sapiens__NP_660334
auggaccccguggccacccacagcugccaccugcugcagcagcugcacgagcagagaauccagggccugcugugcgacugcaugcugguggugaagggcgugugcuucaaggcccacaagaacgugcuggccgccuucagccaguacuucagaagccuguuccagaacagcagcagccagaagaacgacguguuccaccuggacgugaagaacgugagcggcaucggccagauccuggacuucauguacaccagccaccuggaccugaaccaggacaacauccaggugaugcuggacaccgcccagugccugcaggugcagaacgugcugagccugugccacaccuuccugaagagcgccaccguggugcagccccccggcaugcccugcaacagcacccugagccugcagagcacccugacccccgacgccaccugcgugaucagcgagaacuaccccccccaccugcugcaggagugcagcgccgacgcccagcagaacaagacccuggacgagagccacccccacgccagccccagcgugaacagacaccacagcgccggcgagaucagcaagcaggcccccgacaccagcgacggcagcugcaccgagcugcccuucaagcagcccaacuacuacuacaagcugagaaacuucuacagcaagcaguaccacaagcacgccgccggccccagccaggagagagugguggagcagcccuucgccuucagcaccagcaccgaccugaccaccguggagagccagcccugcgccgugagccacagcgagugcauccuggagagccccgagcaccugcccagcaacuuccuggcccagcccgugaacgacagcgccccccaccccgagagcgacgccaccugccagcagcccgugaagcagaugagacugaagaaggccauccaccugaagaagcugaacuuccugaagagccagaaguacgccgagcaggugagcgagcccaagagcgacgacggccugaccaagagacuggagagcgccagcaagaacacccuggagaaggccagcagccagagcgccgaggagaaggagagcgaggagguggugagcugcgagaacuucaacugcaucagcgagaccgagagacccgaggaccccgccgcccuggaggaccagagccagacccugcagagccagagacaguacgccugcgagcugugcggcaagcccuucaagcaccccagcaaccuggagcugcacaagagaagccacaccggcgagaagcccuucgagugcaacaucugcggcaagcacuucagccaggccggcaaccugcagacccaccugagaagacacagcggcgagaagcccuacaucugcgagaucugcggcaagagauucgccgccagcggcgacgugcagagacacaucaucauccacagcggcgagaagccccaccugugcgacaucugcggcagaggcuucagcaacuucagcaaccugaaggagcacaagaagacccacaccgccgacaagguguucaccugcgacgagugcggcaagagcuucaacaugcagagaaagcuggugaagcacagaaucagacacaccggcgagagacccuacagcugcagcgccugcggcaagugcuucggcggcagcggcgaccugagaagacacgugagaacccacaccggcgagaagcccuacaccugcgagaucugcaacaagugcuucaccagaagcgccgugcugagaagacacaagaagaugcacugcaaggccggcgacgagagccccgacgugcuggaggagcugagccaggccaucgagaccagcgaccuggagaagagccagagcagcgacagcuucagccaggacaccagcgugacccugaugcccgugagcgugaagcugcccgugcaccccguggagaacagcguggccgaguucgacagccacagcggcggcagcuacugcaagcugagaagcaugauccagccccacggcgugagcgaccaggagaagcugagccuggaccccggcaagcuggccaagccccagaugcagcagacccagccccaggccuacgccuacagcgacguggacacccccgccggcggcgagccccugcaggccgacggcauggccaugaucagaagcagccuggccgcccuggacaaccacggcggcgacccccugggcagcagagccagcagcaccaccuacagaaacagcgagggccaguucuucagcagcaugacccuguggggccuggccaugaagacccugcagaacgagaacgagcuggaccaguaa

SEQ ID NO: 25812 - RNA, 3042 nt, Artificial Sequence
  ZBTB4__Homo_sapiens__NP_065950
augcccccccccgccgaggugaccgaccccagccacgcccccgccgugcugagacagcugaacgagcagagacugagaggccuguucugcgacgugacccugaucgccggcgacaccaaguuccccgcccacagaagcgugcuggccgccagcagccccuucuucagagaggcccugcugaccagcgccccccugccccugccccccgccaccggcggcgccgcccccaaccccgccaccaccaccgccgccagcagcagcagcagcagcagcagcagcagcagcagcagcagcagcagcgccagcagcagcagcagcagcagcagcagcagccccccccccgccagcccccccgccagcagcccccccagagugcuggagcugcccggcgugcccgccgccgccuucagcgacgugcugaacuucaucuacagcgccagacuggcccugcccggcggcggcggcgacggcgccgccguggccgagaucggcgcccugggcagaagacugggcaucagcagacugcagggccugggcgagggcggcgacgccugggugccccccacccccgcccccauggccaccagccagcccgaggaggacagcuucggccccggccccagacccgccggcgagugggagggcgacagagccgaggcccaggcccccgaccugcagugcagccugcccagaagaccccugcccugcccccagugcggcaagagcuucauccaccccaagagacugcagacccacgaggcccagugcagaagaggcgccagcaccagaggcagcaccggccugggcgccggcggcgccggccccggcggccccgccggcguggacgccagcgcccugcccccccccgugggcuucagaggcggccccgagcacguggugaagguggugggcggccacgugcuguacgugugcgccgccugcgagagaagcuacgugacccugagcagccugaagagacacagcaacgugcacagcuggagaagaaaguaccccugcagauacugcgagaagguguucgcccuggccgaguacagaaccaagcacgagguguggcacaccggcgagagaagauaccagugcaucuucugcugggagaccuucgugaccuacuacaaccugaagacccaccagagagccuuccacggcaucagccccggccugcuggccagcgagaagacccccaacggcggcuacaagcccaagcugaacacccugaagcuguacagacugcugcccaugagagccgccaagagacccuacaagaccuacagccagggcgcccccgaggccccccugagccccacccugaacacccccgcccccguggccaugcccgccagccccccccccggccccccccccgcccccgagcccggccccccccccagcgugaucaccuucgcccaccccgcccccagcgugaucgugcacggcggcagcagcagcggcggcggcggcagcggcaccgccagcaccggcggcagccaggccgccagcgugaucaccuacaccgccccccccagaccccccaagaagagagaguaccccccccccccccccgagcccgccgccacccccaccagccccgccaccgccgugagccccgccaccgccgccggccccgccauggccaccaccaccgaggaggccaagggcagaaaccccagagccggcagaacccugaccuacaccgccaagcccgugggcggcaucggcggcggcggcggcccccccaccggcgccggcagaggccccagccagcugcaggccccccccccccugugccagaucaccgugagaaucggcgaggaggccaucgugaagagaagaaucagcgagaccgaccugagacccggcgagcugagcggcgaggagauggaggagagcgaggaggacgaggaggaggaggacgaggaggaggaggaggaggacgaggaggagagcaaggccggcggcgaggaccagcuguggagacccuacuacagcuacaagcccaagagaaaggccggcgccgccggcggcgccagcgugggcggcagcggccugcccagaggcagaagaccccccagauggagacagaagcuggagagaagaagcugggaggagacccccgccgccgagagccccgccggcagagccagaaccgagagaagacacagaugcggcgacugcgcccagaccuucaccacccugagaaagcugagaaagcaccaggaggcccacggcggcggcagccacagcagcagagccggcagaagacccagcaccagauucaccugcccccacugcgccaaggugugcaagaccgccgccgcccugagcagacacggccagagacacgccgccgagagacccggcggcacccccacccccgugaucgccuacagcaagggcagcgccggcaccagacccggcgacgugaaggaggaggccccccaggagaugcaggugagcagcagcagcggcgaggccggcggcggcagcaccgccgccgaggaggccagcgagaccgccagccugcaggaccccaucaucagcggcggcgaggagccccccgugguggccagcggcggcagcuacguguacccccccgugcaggaguucccccuggcccugaucggcggcggcagagagcccggcggcggcagaggcaagagcggcagcgagggccccgugggcgccggcgagggcgacagaauggagggcaucggcgccgccaaggugaccuucuaccccgagcccuacccccugguguacggcccccagcugcuggccgccuaccccuacaacuucagcaaccuggccgcccugcccguggcccugaacauggugcugcccgacgagaagggcgccggcgcccugcccuuccugcccggcguguucggcuacgccgugaacccccaggccgccccccccgccccccccaccccccccccccccacccugcccccccccaucccccccaagggcgagggcgagagagccggcguggagagaacccagaagggcgacgugggcuaa

SEQ ID NO: 25813 - RNA, 2034 nt, Artificial Sequence
  ZBTB5__Homo_sapiens__NP_055687
auggacuuccccggccacuucgagcagaucuuccagcagcugaacuaccagagacugcacggccagcugugcgacugcgugaucguggugggcaacagacacuucaaggcccacagaagcgugcuggccgccugcagcacccacuucagagcccuguucagcguggccgagggcgaccagaccaugaacaugauccagcuggacagcgagguggugaccgccgaggccuucgccgcccugaucgacaugauguacaccagcacccugaugcugggcgagagcaacgugauggacgugcugcuggccgccagccaccugcaccugaacagcguggugaaggccugcaagcacuaccugaccaccagaacccugcccaugagcccccccagcgagagagugcaggagcagagcgccagaaugcagagaagcuucaugcugcagcagcugggccugagcaucgugagcagcgcccugaacagcagccagaacggcgaggagcagcccgcccccaugagcagcagcaugagaagcaaccuggaccagagaacccccuuccccaugagaagacugcacaagagaaagcagagcgccgaggagagagccagacagagacugagacccagcaucgacgagagcgccaucagcgacgugacccccgagaacggccccagcggcgugcacagcagagaggaguucuucagccccgacagccugaagaucguggacaaccccaaggccgacggcaugaccgacaaccaggaggacagcgccaucauguucgaccagagcuucggcacccaggaggacgcccaggugcccagccagagcgacaacagcgccggcaacauggcccagcugagcauggccagcagagccacccagguggagaccagcuucgaccaggaggccgcccccgagaagagcagcuuccagugcgagaaccccgaggugggccugggcgagaaggagcacaugagagugguggugaagagcgagccccugagcagccccgagccccaggacgaggugagcgacgugaccagccaggccgagggcagcgagagcguggagguggagggcgugguggugagcgccgagaagaucgaccugagccccgagagcagcgacagaagcuucagcgacccccagagcagcaccgacagagugggcgacauccacauccuggaggugaccaacaaccuggagcacaagagcaccuucagcaucagcaacuuccugaacaagagcagaggcaacaacuucaccgccaaccagaacaacgacgacaacauccccaacaccaccagcgacugcagacuggagagcgaggcccccuaccugcugagccccgaggccggccccgccggcggccccagcagcgcccccggcagccacguggagaaccccuucagcgagcccgccgacagccacuucgugagacccaugcaggaggugaugggccugcccugcgugcagaccagcggcuaccagggcggcgagcaguucggcauggacuucagcagaagcggccugggccugcacagcagcuucagcagagugaugaucggcagccccagaggcggcgccagcaacuuccccuacuacagaagaaucgcccccaagaugcccguggugaccagcgugagaagcagccagauccccgagaacagcaccagcagccagcugaugaugaacggcgccaccagcagcuucgagaacggccaccccagccagcccggccccccccagcugaccagagccagcgccgacgugcugagcaagugcaagaaggcccugagcgagcacaacgugcuggugguggagggcgccagaaaguacgccugcaagaucugcugcaagaccuuccugacccugaccgacugcaagaagcacaucagagugcacaccggcgagaagcccuacgccugccugaagugcggcaagagauucagccagagcagccaccuguacaagcacagcaagaccaccugccugagauggcagagcagcaaccugcccagcacccugcuguaa

SEQ ID NO: 25814 - RNA, 1860 nt, Artificial Sequence
  ZBTB7C__Homo_sapiens__NP_001034449
auggccaacgacaucgacgagcugaucggcauccccuuccccaaccacagcagcgaggugcugugcagccugaacgagcagagacacgacggccugcugugcgacgugcugcugguggugcaggagcaggaguacagaacccacagaagcgugcuggccgccugcagcaaguacuucaagaagcuguucaccgccggcacccuggccagccagcccuacguguacgagaucgacuucgugcagcccgaggcccuggccgccauccuggaguucgccuacaccagcacccugaccaucaccgccggcaacgugaagcacauccugaacgccgccagaaugcuggagauccagugcaucgugaacgugugccuggagaucauggagcccggcggcgacggcggcgaggaggacgacaaggaggacgacgacgacgacgaggacgacgacgacgaggaggacgaggaggaggaggaggaggaggaggaggacgacgacgacgacaccgaggacuucgccgaccaggagaaccugcccgacccccaggacaucagcugccaccagagccccagcaagaccgaccaccugaccgagaaggccuacagcgacacccccagagacuuccccgacagcuuccaggccggcagccccggccaccugggcgugaucagagacuucagcaucgagagccugcugagagagaaccuguaccccaaggccaacauccccgacagaagacccagccugagccccuucgcccccgacuucuucccccaccuguggcccggcgacuucggcgccuucgcccagcugcccgagcagcccauggacagcggcccccuggaccuggugaucaagaacagaaagaucaaggaggaggagaaggaggagcugcccccccccccccccccccccuuccccaacgacuucuucaaggacauguuccccgaccugcccggcggcccccugggccccaucaaggccgagaacgacuacggcgccuaccugaacuuccugagcgccacccaccugggcggccuguucccccccuggccccugguggaggagagaaagcugaagcccaaggccagccagcagugccccaucugccacaaggugaucaugggcgccggcaagcugcccagacacaugagaacccacaccggcgagaagcccuacaugugcaccaucugcgaggugagauucaccagacaggacaagcugaagauccacaugagaaagcacaccggcgagagacccuaccugugcauccacugcaacgccaaguucgugcacaacuacgaccugaagaaccacaugagaauccacaccggcgugagacccuaccagugcgaguucugcuacaagagcuucaccagaagcgaccaccugcacagacacaucaagagacagagcugcagaauggccagacccagaagaggcagaaagcccgccgccuggagagccgccagccugcuguucggccccggcggccccgcccccgacaaggccgccuucgugaugccccccgcccugggcgaggugggcggccaccugggcggcgccgccgugugccugcccggccccagccccgccaagcacuuccuggccgcccccaagggcgcccugagccugcaggagcuggagagacaguucgaggagacccagaugaagcuguucggcagagcccagcuggaggccgagagaaacgccggcggccugcuggccuucgcccuggccgagaacguggccgccgccagacccuacuucccccugcccgaccccugggccgccggccuggccggccugcccggccuggccggccugaaccacguggccagcaugagcgaggccaacaacuaa

SEQ ID NO: 25815 - RNA, 1422 nt, Artificial Sequence
  ZBTB9__Homo_sapiens__NP_689948
auggagacccccaccccccugccccccgugcccgccagccccaccugcaaccccgcccccagaaccauccagaucgaguucccccagcacagcagcagccugcuggagagccugaacagacacagacuggagggcaaguucugcgacgugagccugcuggugcagggcagagagcugagagcccacaaggccgugcuggccgccgccagccccuacuuccacgacaagcugcugcugggcgacgcccccagacugacccugcccagcgugaucgaggccgacgccuucgagggccugcugcagcugaucuacagcggcagacugagacugccccuggacgcccugcccgcccaccugcugguggccagcggccugcagauguggcaggugguggaccagugcagcgagauccugagagagcuggagaccagcggcggcggcaucagcgccagaggcggcaacagcuaccacgcccugcugagcaccaccagcagcaccggcggcuggugcaucagaagcagccccuuccagacccccgugcagagcagcgccagcaccgagagccccgccagcaccgagagccccgugggcggcgagggcagcgagcugggcgaggugcugcagauccagguggaggaggaggaggaggaggaggaggacgacgacgacgaggaccagggcagcgccacccugagccagaccccccagccccagagagugagcggcguguuccccagaccccacggcccccacccccugcccaugaccgccacccccagaaagcugcccgagggcgagagcgccccccuggagcugcccgccccccccgcccugccccccaagaucuucuacaucaagcaggagcccuucgagcccaaggaggagaucagcggcagcggcacccagcccggcggcgccaaggaggagaccaagguguucagcggcggcgacaccgagggcaacggcgagcugggcuuccugcugcccagcggccccggccccaccagcggcggcggcggccccagcuggaagcccguggaccugcacggcaacgagauccugagcggcggcggcggccccggcggcgccggccaggccgugcacggccccgugaagcugggcggcaccccccccgccgacggcaagagauucggcugccugugcggcaagagauucgccgugaagcccaagagagacagacacaucaugcugaccuucagccugagacccuucggcugcggcaucugcaacaagagauucaagcugaagcaccaccugaccgagcacaugaagacccacgccggcgcccugcacgccugcccccacugcggcagaagauucagagugcacgccugcuuccugagacacagagaccugugcaagggccagggcugggccaccgcccacuggaccuacaaguaa

SEQ ID NO: 25816 - RNA, 669 nt, Artificial Sequence
  ZC2HC1B__Homo_sapiens__NP_001013645
auggccggcgccgagcccuuccuggccgacggcaaccaggagcuguuccccugcgaggugugcggcagaagauucgccgccgacgugcuggagagacacggccccaucugcaagaagcuguucaacagaaagagaaagcccuucagcagccugaagcagagacugcagggcaccgacauccccaccgugaagaagaccccccagagcaagagcccccccgugagaaagagcaacuggagacagcagcacgaggacuucaucaacgccaucagaagcgccaagcagugcaugcuggccaucaaggagggcagaccccugccccccccccccccccccagccugaaccccgacuacauccagagacccuacugcaugagaagauucaacgagagcgccgccgagagacacaccaacuucugcaaggaccagagcagcagaagaguguucaaccccgcccagaccgccgccaagcuggccagcagagcccagggcagagcccagaugggccccaagaaggagcccaccgugaccagcgccgugggcgcccugcugcagaacagagugcugguggccaccaacgaggugcccaccaagagcggccuggccauggaccccgccagcggcgccaagcugagacagggcuucagcaagagcagcaagaaggacuaa

SEQ ID NO: 25817 - RNA, 1305 nt, Artificial Sequence
  ZC3H10__Homo_sapiens__NP_116175
augcccgacagagacagcuacgccaacggcaccggcagcagcggcggcggccccggcggcggcggcagcgaggaggccagcggcgccggcgugggcagcggcggcgccagcagcgacgccaucugcagagacuuccugagaaacgugugcaagagaggcaagagaugcagauacagacaccccgacaugagcgaggugagcaaccugggcgugagcaagaacgaguucaucuucugccacgacuuccagaacaaggagugcagcagacccaacugcagauucauccacggcagcaaggaggacgaggacggcuacaagaagaccggcgagcugccccccagacugagacagaagguggccgccggccugggccugagccccgccgaccugcccaacggcaaggaggaggugcccaucugcagagacuuccugaagggcgacugccagagaggcgccaagugcaaguucagacaccugcagagagacuucgaguucgacgccagaggcggcggcggcaccggcggcggcagcaccggcagcgugcugcccggcagaagacacgaccuguacgacaucuacgaccugcccgacagaggcuucgaggaccacgagcccggccccaagagaagaagaggcggcugcugcccccccgacggcccccacuucgagagcuacgaguacagccuggccccccccagaggcguggagugcagacugcuggaggaggagaacgccaugcugagaaagagaguggaggagcugaagaagcaggugagcaaccugcuggccaccaacgaggugcugcuggagcagaacgcccaguucagaaaccaggccaaggugaucacccugagcagcaccgcccccgccaccgagcagacccuggcccccaccgugggcaccguggccaccuucaaccacggcaucgcccagacccacaccacccugagcagccaggcccugcagcccagacccgugagccagcaggagcugguggcccccgccggcgcccccgccgccccccccaccaacgccgccccccccgccgcccccccccccccccccccccaccugacccccgagaucaccccccugagcgccgcccuggcccagaccaucgcccagggcauggcccccccccccgugagcauggcccccguggccgugagcguggcccccguggcccccguggccgugagcauggcccagccccuggccggcaucaccaugagccacaccaccacccccauggugaccuaccccaucgccagccagagcaugagaaucaccgccaugccccacuaa

SEQ ID NO: 25818 - RNA, 2433 nt, Artificial Sequence
  ZC3H11A__Homo_sapiens__NP_055642
augcccaaccagggcgaggacugcuacuucuucuucuacagcaccugcaccaagggcgacagcugccccuucagacacugcgaggccgccaucggcaacgagaccgugugcacccuguggcaggagggcagaugcuucagacaggugugcagauucagacacauggagaucgacaagaagagaagcgagauccccugcuacugggagaaccagcccaccggcugccagaagcugaacugcgccuuccaccacaacagaggcagauacguggacggccuguuccugccccccagcaagaccgugcugcccaccgugcccgagagccccgaggaggaggugaaggccagccagcugagcgugcagcagaacaagcugagcgugcagagcaaccccagcccccagcugagaagcgugaugaagguggagagcagcgagaacgugcccagccccacccacccccccguggugaucaacgccgccgacgacgacgaggacgacgacgaccaguucagcgaggagggcgacgagaccaagacccccacccugcagcccacccccgaggugcacaacggccugagagugaccagcgugagaaagcccgccgugaacaucaagcagggcgagugccugaacuucggcaucaagacccuggaggagaucaagagcaagaagaugaaggagaagagcaagaagcagggcgagggcagcagcggcgugagcagccugcugcugcaccccgagcccgugcccggccccgagaaggagaacgugagaaccguggugagaaccgugacccugagcaccaagcagggcgaggagccccuggugagacugagccugaccgagagacugggcaagagaaaguucagcgccggcggcgacagcgaccccccccugaagagaagccuggcccagagacugggcaagaagguggaggcccccgagaccaacaucgacaagacccccaagaaggcccaggugagcaagagccugaaggagagacugggcaugagcgccgaccccgacaacgaggacgccaccgacaaggugaacaaggugggcgagauccacgugaagacccuggaggagauccugcuggagagagccagccagaagagaggcgagcugcagaccaagcugaagaccgagggccccagcaagaccgacgacagcaccagcggcgccagaagcagcagcaccaucagaaucaagaccuucagcgaggugcuggccgagaagaagcacagacagcaggaggccgagagacagaagagcaagaaggacaccaccugcaucaagcugaagaucgacagcgagaucaagaagaccguggugcugccccccaucguggccagcagaggccagagcgaggagcccgccggcaagaccaagagcaugcaggaggugcacaucaagacccuggaggagaucaagcuggagaaggcccugagagugcagcagagcagcgagagcagcaccagcagccccagccagcacgaggccacccccggcgccagaagacugcugagaaucaccaagagaaccggcaugaaggaggagaagaaccugcaggagggcaacgagguggacagccagagcagcaucagaaccgaggccaaggaggccagcggcgagaccaccggcguggacaucaccaagauccaggugaagagaugcgagaccaugagagagaagcacaugcagaagcagcaggagagagagaagagcgugcugaccccccugagaggcgacguggccagcugcaacacccagguggccgagaagcccgugcugaccgccgugcccggcaucaccagacaccugaccaagagacugcccaccaagagcagccagaagguggagguggagaccagcggcaucggcgacagccugcugaacgugaagugcgccgcccagacccuggagaagagaggcaaggccaagcccaaggugaacgugaagcccagcguggugaagguggugagcagccccaagcuggcccccaagagaaaggccguggagaugcacgccgccgugaucgccgccgugaagccccugagcagcagcagcgugcugcaggagccccccgccaagaaggccgccguggccguggugccccuggugagcgaggacaagagcgugaccgugcccgaggccgagaaccccagagacagccuggugcugccccccacccagagcagcagcgacagcagcccccccgaggugagcggccccagcagcagccagaugagcaugaagaccagaagacugagcagcgccagcaccggcaagcccccccugagcguggaggacgacuucgagaagcugaucugggagaucagcggcggcaagcuggaggccgagaucgaccuggaccccggcaaggacgaggacgaccugcugcuggagcugagcgagaugaucgacagcuaa

SEQ ID NO: 25819 - RNA, 2652 nt, Artificial Sequence
  ZC3H12C__Homo_sapiens__NP_203748
augcccggcggcggcagccaggaguacggcgugcugugcauccaggaguacagaaagaacagcaagguggagagcagcaccagaaacaacuucaugggccugaaggaccaccugggccacgaccugggccaccuguacguggagagcaccgacccccagcugagccccgccgugcccuggagcaccguggagaaccccagcauggacaccgugaacgugggcaaggacgagaaggaggccagcgaggagaacgccagcagcggcgacagcgaggagaacaccaacagcgaccacgagagcgagcagcugggcagcaucagcguggagcccggccugaucaccaagacccacagacagcugugcagaagccccugccuggagccccacauccugaagagaaacgagauccugcaggacuucaagcccgaggagagccagaccaccagcaaggaggccaagaagccccccgacguggugagagaguaccagaccaagcuggaguucgcccugaagcugggcuacagcgaggagcaggugcagcuggugcugaacaagcugggcaccgacgcccugaucaacgacauccugggcgagcuggugaagcugggcaacaagagcgaggccgaccagaccgugagcaccaucaacaccaucaccagagagaccagcagccuggagagccagagaagcgagagccccaugcaggagaucgugaccgacgacggcgagaaccugagacccaucgugaucgacggcagcaacguggccaugagccacggcaacaaggagguguucagcugcagaggcaucaagcuggccguggacugguuccuggagagaggccacaaggacaucaccguguucgugcccgccuggagaaaggagcagagcagacccgacgcccugaucaccgaccaggagauccugagaaagcuggagaaggagaagauccugguguucacccccagcagaagagugcagggcagaagaguggugugcuacgacgacagauucaucgugaagcuggccuucgagagcgacggcaucaucgugagcaacgacaacuacagagaccuggccaacgagaagcccgaguggaagaaguucaucgacgagagacugcugauguacagcuucgugaacgacaaguucaugccccccgacgacccccugggcagacacggccccagccuggacaacuuccugagaaagaagcccaucgugcccgagcacaagaagcagcccugccccuacggcaagaagugcaccuacggccacaagugcaaguacuaccaccccgagagaggcagccagccccagagaagcguggccgacgagcugagagccaugagcagaaacaccgccgccaagaccgccaacgagggcggccuggugaagagcaacagcgugcccugcagcaccaaggccgacagcaccagcgacgugaagagaggcgcccccaagagacagagcgaccccagcaucagaacccagguguaccaggaccuggaggagaagcugcccaccaagaacaagcuggagaccagaagcgugcccagccuggugagcauccccgccaccagcaccgccaagccccagagcaccaccagccugagcaacggccugcccagcggcgugcacuuccccccccaggaccagagaccccagggccaguaccccagcaugaugauggccaccaagaaccacggcacccccaugcccuacgagcaguaccccaagugcgacagccccguggacaucggcuacuacagcaugcugaacgccuacagcaaccugagccugagcggccccagaagccccgagagaagauucagccuggacaccgacuacagaaucagcagcguggccagcgacugcagcagcgagggcagcaugagcugcggcagcagcgacagcuacgugggcuacaacgacagaagcuacgugagcagccccgacccccagcuggaggagaaccugaagugccagcacaugcacccccacagcagacugaacccccagcccuuccugcagaacuuccacgacccccugaccagaggccagagcuacagccacgaggagcccaaguuccaccacaagcccccccugccccaccuggcccugcaccugccccacagcgccgugggcgccagaagcagcugccccggcgacuaccccagcccccccagcagcgcccacagcaaggccccccaccugggcagaagccugguggccaccagaaucgacagcaucagcgacagcagacuguacgacagcagccccagcagacagagaaagcccuacagcagacaggagggccugggcagcugggagagacccggcuacggcaucgacgccuacggcuacagacagaccuacagccugcccgacaacagcacccagcccugcuacgagcaguucaccuuccagagccugcccgagcagcaggagcccgccuggagaauccccuacugcggcaugccccaggacccccccagauaccaggacaacagagagaagaucuacaucaaccugugcaacaucuucccccccgaccuggugagaaucgugaugaagagaaacccccacaugaccgacgcccagcagcuggccgccgccauccugguggagaagagccagcugggcuacuaa

SEQ ID NO: 25820 - RNA, 1584 nt, Artificial Sequence
  ZC3H12D__Homo_sapiens__NP_997243
auggagcaccccagcaagauggaguucuuccagaagcugggcuacgacagagaggacgugcugagagugcugggcaagcugggcgagggcgcccuggugaacgacgugcugcaggagcugaucagaaccggcagcagacccggcgcccuggagcaccccgccgcccccagacuggugcccagaggcagcugcggcgugcccgacagcgcccagagaggccccggcaccgcccuggaggaggacuucagaacccuggccagcagccugagacccaucgugaucgacggcagcaacguggccaugagccacggcaacaaggagaccuucagcugcagaggcaucaagcuggccguggacugguucagagacagaggccacaccuacaucaagguguucgugcccagcuggagaaaggacccccccagagccgacacccccaucagagagcagcacgugcuggccgagcuggagagacaggccgugcugguguacacccccagcagaaaggugcacggcaagagacuggugugcuacgacgacagauacaucgugaagguggccuacgagcaggacggcgugaucgugagcaacgacaacuacagagaccugcagagcgagaaccccgaguggaagugguucaucgagcagagacugcugauguucagcuucgugaacgacagauucaugccccccgacgacccccugggcagacacggccccagccugagcaacuuccugagcagaaagcccaagccccccgagcccagcuggcagcacugccccuacggcaagaagugcaccuacggcaucaagugcaaguucuaccaccccgagagaccccaccacgcccagcuggccguggccgacgagcugagagccaagaccggcgccagacccggcgccggcgccgaggagcagagaccccccagagcccccggcggcagcgccggcgccagagccgcccccagagagcccuucgcccacagccugccccccgccagaggcagccccgaccuggccgcccugagaggcagcuucagcagacuggccuucagcgacgaccugggcccccugggccccccccugcccgugcccgccugcagccugacccccagacugggcggccccgacugggugagcgccggcggcagagugcccggcccccugagccugcccagccccgagagccaguucagccccggcgaccugccccccccccccggccugcagcugcagcccagaggcgagcacagacccagagaccugcacggcgaccugcugagccccagaagaccccccgacgaccccugggccagaccccccagaagcgacagauuccccggcagaagcgugugggccgagcccgccuggggcgacggcgccaccggcggccugagcguguacgccaccgaggacgacgagggcgacgccagagccagagccagaaucgcccuguacagcguguuccccagagaccagguggacagagugauggccgccuuccccgagcugagcgaccuggccagacugauccugcuggugcagagaugccagagcgccggcgccccccugggcaagcccuaa

SEQ ID NO: 25821 - RNA, 2208 nt, Artificial Sequence
  ZC3H14__Homo_sapiens__NP_001153575
auggagaucggcaccgagaucagcagaaagaucagaagcgccaucaagggcaagcugcaggagcugggcgccuacguggacgaggagcugcccgacuacaucauggugaugguggccaacaagaagagccaggaccagaugaccgaggaccugagccuguuccugggcaacaacaccaucagauucaccguguggcugcacggcgugcuggacaagcugagaagcgugaccaccgagcccagcagccugaagagcagcgacaccaacaucuucgacagcaacgugcccagcaacaagagcaacuucagcagaggcgacgagagaagacacgaggccgccgugcccccccuggccauccccagcgccagacccgagaagagagacagcagagugagcaccagcagccaggagagcaagaccaccaacgugagacagaccuacgacgacggcgccgccaccagacugaugagcaccgugaagccccugagagagcccgcccccagcgaggacgugaucgacaucaagcccgagcccgacgaccugaucgacgaggaccugaacuucgugcaggagaacccccugagccagaagaagcccaccgugacccugaccuacggcagcagcagacccagcaucgagaucuacagaccccccgccagcagaaacgccgacagcggcgugcaccugaacagacugcaguuccagcagcagcagaacagcauccacgccgccaagcagcuggacaugcagagcagcuggguguacgagaccggcagacugugcgagcccgaggugcugaacagccuggaggagaccuacagccccuucuucagaaacaacagcgagaagaugagcauggaggacgagaacuucagaaagagaaagcugcccguggugagcagcguggugaaggugaagaaguucaaccacgacggcgaggaggaggaggaggacgacgacuacggcagcagaaccggcagcaucagcagcagcgugagcgugcccgccaagcccgagagaagacccagccugccccccagcaagcaggccaacaagaaccugauccugaaggccaucagcgaggcccaggagagcgugaccaagaccaccaacuacagcaccgugccccagaagcagacccugcccguggcccccagaaccagaaccagccaggaggagcugcuggccgagguggugcagggccagagcagaacccccagaaucagcccccccaucaaggaggaggagaccaagggcgacagcguggagaagaaccagggcacccagcagagacagcugcugagcagacugcagaucgaccccgugauggccgagacccugcagaugagccaggacuacuacgacauggagagcauggugcacgccgacaccagaagcuucauccugaagaagcccaagcugagcgaggagguggugguggcccccaaccaggagagcggcaugaagaccgccgacagccugagagugcugagcggccaccugaugcagaccagagaccuggugcagcccgacaagcccgccagccccaaguucaucgugacccuggacggcgugcccagcccccccggcuacaugagcgaccaggaggaggacaugugcuucgagggcaugaagcccgugaaccagaccgccgccagcaacaagggccugagaggccugcugcacccccagcagcugcaccugcugagcagacagcuggaggaccccaacggcagcuucagcaacgccgagaugagcgagcugagcguggcccagaagcccgagaagcugcuggagagaugcaaguacuggcccgccugcaagaacggcgacgagugcgccuaccaccaccccaucagccccugcaaggccuuccccaacugcaaguucgccgagaagugccuguucgugcaccccaacugcaaguacgacgccaagugcaccaagcccgacugccccuucacccacgugagcagaagaauccccgugcugagccccaagcccguggccccccccgccccccccagcagcagccagcugugcagauacuuccccgccugcaagaagauggagugccccuucuaccaccccaagcacugcagauucaacacccagugcaccagacccgacugcaccuucuaccaccccaccaucaacgugccccccagacacgcccugaaguggaucagaccccagaccagcgaguaa

SEQ ID NO: 25822 - RNA, 1281 nt, Artificial Sequence
  ZC3H15__Homo_sapiens__NP_060941
augccccccaagaagcaggcccaggccggcggcagcaagaaggccgagcagaagaagaaggagaagaucaucgaggacaagaccuucggccugaagaacaagaagggcgccaagcagcagaaguucaucaaggccgugacccaccaggugaaguucggccagcagaaccccagacagguggcccagagcgaggccgagaagaagcugaagaaggacgacaagaagaaggagcugcaggagcugaacgagcuguucaagcccgugguggccgcccagaagaucagcaagggcgccgaccccaagagcguggugugcgccuucuucaagcagggccagugcaccaagggcgacaagugcaaguucagccacgaccugacccuggagagaaagugcgagaagagaagcguguacaucgacgccagagacgaggagcuggagaaggacaccauggacaacugggacgagaagaagcuggaggagguggugaacaagaagcacggcgaggccgagaagaagaagcccaagacccagaucgugugcaagcacuuccuggaggccaucgagaacaacaaguacggcugguucugggugugccccggcggcggcgacaucugcauguacagacacgcccugccccccggcuucgugcugaagaaggacaagaagaaggaggagaaggaggacgagaucagccuggaggaccugaucgagagagagagaagcgcccugggccccaacgugaccaagaucacccuggagagcuuccuggccuggaagaagagaaagagacaggagaagaucgacaagcuggagcaggacauggagagaagaaaggccgacuucaaggccggcaaggcccuggugaucagcggcagagagguguucgaguucagacccgagcuggugaacgacgacgacgaggaggccgacgacaccagauacacccagggcaccggcggcgacgagguggacgacagcgugagcgugaacgacaucgaccugagccuguacauccccagagacguggacgagaccggcaucaccguggccagccuggagagauucagcaccuacaccagcgacaaggacgagaacaagcugagcgaggccagcggcggcagagccgagaacggcgagagaagcgaccuggaggaggacaacgagagagagggcaccgagaacggcgccaucgacgccgugcccguggacgagaaccuguucaccggcgaggaccuggacgagcuggaggaggagcugaacacccuggaccuggaggaguaa

SEQ ID NO: 25823 - RNA, 2847 nt, Artificial Sequence
  ZC3H3__Homo_sapiens__NP_055932
auggaggagaaggagauccugagaagacagaucagacugcugcagggccugaucgacgacuacaagacccugcacggcaacgcccccgcccccggcacccccgccgccagcggcuggcagccccccaccuaccacagcggcagagccuucagcgccagauaccccagacccagcagaagaggcuacagcagccaccacggccccagcuggagaaagaaguacagccuggugaacagaccccccggccccagcgacccccccgccgaccacgccgugagaccccugcacggcgccagaggcggccagccccccgugccccagcagcacgugcuggagagacaggugcagcugagccagggccagaacguggugaucaaggugaagccccccagcaagagcggcagcgccagcgccagcggcgcccagagaggcagccuggaggaguucgaggagacccccuggagcgaccagagacccagagagggcgagggcgagccccccagaggccagcugcagcccagcagacccaccagagccagaggcaccugcagcguggaggacccccugcuggugugccagaaggagcccggcaagcccagaauggugaagagcgugggcagcgugggcgacagccccagagagcccagaagaaccgugagcgagagcgugaucgccgugaaggccagcuuccccagcagcgcccugccccccagaaccggcguggcccugggcagaaagcugggcagccacagcguggccagcugcgccccccagcugcugggcgacagaagaguggacgccggccacaccgaccagcccgugcccagcggcagcgugggcggccccgccagacccgccagcggccccagacaggccagagaggccagccugguggugaccugcagaaccaacaaguucagaaagaacaacuacaaguggguggccgccagcagcaagagccccagaguggccagaagagcccugagccccagaguggccgccgagaacgugugcaaggccagcgccggcauggccaacaagguggagaagccccagcugaucgccgaccccgagcccaagcccagaaagcccgccaccagcagcaagcccggcagcgcccccagcaaguacaaguggaaggccagcagccccagcgccagcagcagcagcagcuucagauggcagagcgaggccagcagcaaggaccacgccagccagcugagccccgugcugagcagaagccccagcggcgacagacccgccgugggccacagcggccugaagccccugagcggcgagaccccccugagcgccuacaaggugaagagcagaaccaagaucaucagaagaagaagcagcaccagccugcccggcgacaagaagagcggcaccagccccgccgccaccgccaagagccaccugagccugagaagaagacaggcccugagaggcaagagcagccccgugcugaagaagacccccaacaagggccuggugcaggugaccacccacagacugugcagacugccccccagcagagcccaccugcccaccaaggaggccagcagccugcacgccgugagaaccgcccccaccagcaaggugaucaagaccagauacagaaucgugaagaagacccccgccagcccccugagcgccccccccuucccccugagccugcccagcuggagagccagaagacugagccugagcagaagccuggugcugaacagacugagacccguggccagcggcggcggcaaggcccagcccggcagccccugguggagaagcaagggcuacagaugcaucggcggcgugcuguacaaggugagcgccaacaagcugagcaagaccagcggccagcccagcgacgccggcagcagaccccugcugagaaccggcagacuggaccccgccggcagcugcagcagaagccuggccagcagagccgugcagagaagccuggccaucaucagacaggccagacagagaagagagaagagaaaggaguacugcauguacuacaacagauucggcagaugcaacagaggcgagagaugccccuacauccacgaccccgagaagguggccgugugcaccagauucgugagaggcaccugcaagaagaccgacggcaccugccccuucagccaccacgugagcaaggagaagaugcccgugugcagcuacuuccugaagggcaucugcagcaacagcaacugccccuacagccacguguacgugagcagaaaggccgaggugugcagcgacuuccugaagggcuacugcccccugggcgccaagugcaagaagaagcacacccugcugugccccgacuucgccagaagaggcgccugccccagaggcgcccagugccagcugcugcacagaacccagaagagacacagcagaagagccgccaccagccccgcccccggccccagcgacgccaccgccagaagcagagugagcgccagccacggccccagaaagcccagcgccagccagagacccaccagacagacccccagcagcgccgcccugaccgccgccgccguggccgcccccccccacugccccggcggcagcgccagccccagcagcagcaaggccagcagcagcagcagcagcagcagcagcccccccgccagccuggaccacgaggcccccagccugcaggaggccgcccuggccgccgccugcagcaacagacugugcaagcugcccagcuucaucagccugcagagcagccccagccccggcgcccagcccagagugagagcccccagagccccccugaccaaggacagcggcaagccccugcacaucaagcccagacuguaa

SEQ ID NO: 25824 - RNA, 3912 nt, Artificial Sequence
  ZC3H4__Homo_sapiens__NP_055983
auggaggccgcccccggcacccccccccccccccccagcgagagcccccccccccccagcccccccccccccagcacccccagccccccccccugcagccccgacgccagacccgccaccccccaccugcugcaccacagacugccccugcccgacgacagagaggacggcgagcuggaggagggcgagcuggaggacgacggcgccgaggagacccaggacaccagcggcggccccgagagaagcagaaaggagaagggcgagaagcaccacagcgacagcgacgaggagaagagccacagaagacugaagagaaagagaaagaaggagagagagaaggagaagagaagaagcaagaagagaagaaagagcaagcacaagagacacgccagcagcagcgacgacuucagcgacuucagcgacgacagcgacuucagccccagcgagaagggccacagaaaguacagagaguacagcccccccuacgcccccagccaccagcaguacccccccagccacgccaccccccugcccaagaaggccuacagcaagauggacagcaagagcuacggcauguacgaggacuacgagaacgagcaguacggcgaguacgagggcgacgaggaggaggacaugggcaaggaggacuacgacgacuucaccaaggagcugaaccaguacagaagagccaaggagggcagcagcagaggcagaggcagcagaggcagaggcagaggcuacagaggcagaggcagcagaggcggcagcagaggcagaggcaugggcagaggcagcagaggcagaggcagaggcagcaugggcggcgaccaccccgaggacgaggaggacuucuacgaggaggagauggacuacggcgagagcgaggagcccaugggcgacgacgacuacgacgaguacagcaaggagcugaaccaguacagaagaagcaaggacagcagaggcagaggccugagcagaggcagaggcagaggcagcagaggcagaggcaagggcaugggcagaggcagaggcagaggcggcagcagaggcggcaugaacaagggcggcaugaacgacgacgaggacuucuacgacgaggacaugggcgacggcggcggcggcagcuacagaagcagagaccacgacaagccccaccagcagagcgacaagaagggcaaggugaucugcaaguacuucguggagggcagaugcaccuggggcgaccacugcaacuucagccacgacaucgagcugcccaagaagagagagcugugcaaguucuacaucaccggcuucugcgccagagccgagaacugccccuacaugcacggcgacuuccccugcaagcuguaccacaccaccggcaacugcaucaacggcgacgacugcauguucagccacgacccccugaccgaggagaccagagagcugcuggacaagaugcuggccgacgacgccgaggccggcgccgaggacgagaaggagguggaggagcugaagaagcagggcaucaacccccugcccaagcccccccccggcgugggccugcugcccaccccccccagaccccccggcccccaggcccccaccagccccaacggcagacccaugcagggcggcccccccccccccccccccccccccccccccccccccggccccccccagaugcccaugcccgugcacgagccccugagcccccagcagcugcagcagcaggacauguacaacaagaagauccccagccuguucgagaucguggugagacccaccggccagcuggccgagaagcugggcgugagauuccccggccccggcggcccccccggccccaugggccccggccccaacaugggcccccccggccccaugggcggccccaugcaccccgacaugcaccccgacaugcaccccgacaugcaccccgacaugcacgccgacaugcacgccgacaugcccaugggccccggcaugaaccccggcccccccaugggccccggcggcccccccaugaugcccuacggccccggcgacagcccccacagcggcaugaugccccccaucccccccgcccagaacuucuacgagaacuucuaccagcagcaggagggcauggagauggagcccggccugcugggcgacgccgaggacuacggccacuacgaggagcugcccggcgagcccggcgagcaccuguuccccgagcacccccuggagcccgacagcuucagcgagggcggcccccccggcagacccaagcccggcgccggcgugcccgacuuccugcccagcgcccagagagcccuguaccugagaauccagcagaagcagcaggaggaggaggagagagccagaagacuggccgagagcagcaagcaggacagagagaacgaggagggcgacaccggcaacugguacagcagcgacgaggacgagggcggcagcagcgugaccagcauccugaagacccugagacagcagaccagcagcagaccccccgccagcgugggcgagcugagcagcagcggccugggcgaccccagacugcagaagggccaccccaccggcagcagacuggccgaccccagacugagcagagaccccagacugaccagacacguggaggccagcggcggcagcggccccggcgacagcggccccagcgaccccagacuggccagagcccugcccaccagcaagcccgagggcagccugcacagcagccccgugggccccagcagcagcaagggcagcggccccccccccaccgaggaggaggagggcgagagagcccugagagagaaggccgugaacaucccccuggacccccugcccggccacccccugagagaccccagaagccagcugcagcaguucagccacaucaagaaggacgugacccugagcaagcccagcuucgccagaaccgugcuguggaaccccgaggaccugaucccccugcccauccccaagcaggacgccgugccccccgugcccgccgcccugcagagcaugcccacccuggaccccagacugcacagagccgccaccgccggcccccccaacgccagacagagacccggcgccagcaccgacagcagcacccagggcgccaaccugcccgacuucgagcugcugagcagaauccugaagaccgugaacgccaccggcagcagcgccgcccccggcagcagcgacaagcccagcgaccccagagugagaaaggcccccaccgaccccagacugcagaagcccaccgacagcaccgccagcagcagagccgccaagcccggccccgccgaggcccccagccccaccgccagccccagcggcgacgccagcccccccgccaccgcccccuacgaccccagagugcuggccgccggcggccugggccagggcggcggcggcggccagagcagcgugcugagcggcaucagccuguacgaccccagaacccccaacgccggcggcaaggccaccgagcccgccgccgacaccggcgcccagcccaagggcgccgagggcaacggcaagagcagcgccagcaaggccaaggagccccccuucgugagaaagagcgcccuggagcagcccgagaccggcaaggccggcgccgacggcggcacccccaccgacagauacaacagcuacaacagacccagacccaaggccgccgccgcccccgccgccaccaccgccacccccccccccgagggcgcccccccccagcccggcgugcacaaccugcccgugcccacccuguucggcaccgugaagcagacccccaagaccggcagcggcagccccuucgccggcaacagccccgccagagagggcgagcaggacgccgccagccugaaggacguguucaagggcuucgaccccaccgccagccccuucugccaguaa

SEQ ID NO: 25825 - RNA, 2916 nt, Artificial Sequence
  ZC3H7A__Homo_sapiens__NP_054872
augagcaacgugagcgaggagagaagaaagagacagcagaacaucaaggagggccugcaguucauccagagcccccugagcuaccccggcacccaggagcaguacgccguguaccugagagcccuggugagaaaccuguucaacgagggcaacgacguguacagagagcacgacuggaacaacagcaucagccaguacaccgaggcccugaacaucgccgacuacgccaagagcgaggagauccugauccccaaggagaucaucgagaagcuguacaucaacagaaucgccugcuacagcaacaugggcuuccacgacaaggugcuggaggacugcaacaucgugcugagccugaacgccagcaacugcaaggcccuguacagaaagagcaaggcccugagcgaccugggcagauacaagaaggccuacgacgccguggccaagugcagccuggccgugccccaggacgagcacgugaucaagcugacccaggagcuggcccagaagcugggcuucaagaucagaaaggccuacgugagagccgagcugagccugaagagcgugcccggcgacggcgccaccaaggcccugaaccacagcguggaggacaucgagcccgaccugcugacccccagacaggaggccgugcccguggugagccugcccgcccccagcuucagccacgaggugggcagcgagcuggccagcgugcccgugaugccccugaccagcauccugccccugcagguggaggagagcgcccugcccagcgccgugcuggccaacggcggcaagaugcccuucaccaugcccgaggccuuccuggacgacggcgacauggugcugggcgacgagcuggacgaccugcuggacagcgcccccgagaccaacgagaccgugaugcccagcgcccuggugagaggcccccugcagaccgccagcgugagccccagcaugcccuucagcgccagccugcugggcacccugcccaucggcgccagauacgcccccccccccagcuucagcgaguucuaccccccccugaccagcagccuggaggacuucugcagcagccugaacagcuucagcaugagcgagagcaagagagaccugagcaccagcaccagcagagagggcaccccccugaacaacagcaacagcagccugcugcugaugaacggccccggcagccuguucgccagcgagaacuuccugggcaucagcagccagcccagaaacgacuucggcaacuucuucggcagcgccgugaccaagcccagcagcagcgugacccccagacacccccuggagggcacccacgagcugagacaggccugccagaucugcuucgugaagagcggccccaagcugauggacuucaccuaccacgccaacaucgaccacaagugcaagaaggacauccugaucggcagaaucaagaacguggaggacaagagcuggaagaagaucagacccagacccaccaagaccaacuacgagggccccuacuacaucugcaaggacguggccgccgaggaggagugcagauacagcggccacugcaccuucgccuacugccaggaggagaucgacguguggacccuggagagaaagggcgccuucagcagagaggccuucuucggcggcaacggcaagaucaaccugaccguguucaagcugcugcaggagcaccugggcgaguucaucuuccugugcgagaagugcuucgaccacaagcccagaaugaucagcaagagaaacaaggacaacagcaccgccugcagccaccccgugaccaagcacgaguucgaggacaacaagugccuggugcacauccugagagagaccaccgugaaguacagcaagaucagaagcuuccacggccagugccagcuggaccugugcagacacgaggugagauacggcugccugagagaggacgagugcuucuacgcccacagccugguggagcugaagguguggaucaugcagaacgagaccggcaucagccacgacgccaucgcccaggagagcaagagauacuggcagaaccuggaggccaacgugcccggcgcccaggugcugggcaaccagaucaugcccggcuuccugaacaugaagaucaaguucgugugcgcccagugccugagaaacggccaggugaucgagcccgacaagaacagaaaguacugcagcgccaaggccagacacagcuggaccaaggacagaagagccaugagagugaugagcaucgagagaaagaaguggaugaacaucagaccccugcccaccaagaagcagaugccccugcaguucgaccugugcaaccacaucgccagcggcaagaagugccaguacgugggcaacugcagcuucgcccacagccccgaggagagagagguguggaccuacaugaaggagaacggcauccaggacauggagcaguucuacgagcuguggcugaagagccagaagaacgagaagagcgaggacaucgccagccagagcaacaaggagaacggcaagcagauccacaugcccaccgacuacgccgaggugaccguggacuuccacugcuggaugugcggcaagaacugcaacagcgagaagcaguggcagggccacaucagcagcgagaagcacaaggagaagguguuccacaccgaggacgaccaguacugcuggcagcacagauuccccaccggcuacuucagcaucugcgacagauacaugaacggcaccugccccgagggcaacagcugcaaguucgcccacggcaacgccgagcugcacgagugggaggagagaagagacgcccugaagaugaagcugaacaaggccagaaaggaccaccugaucggccccaacgacaacgacuucggcaaguacagcuuccuguucaaggaccugaacuaa

SEQ ID NO: 25826 - RNA, 2934 nt, Artificial Sequence
  ZC3H7B__Homo_sapiens__NP_060060
auggagagacagaagagaaaggccgacaucgagaagggccugcaguucauccagagcacccugccccugaagcaggaggaguacgaggccuuccugcugaagcuggugcagaaccuguucgccgagggcaacgaccuguucagagagaaggacuacaagcaggcccuggugcaguacauggagggccugaacguggccgacuacgccgccagcgaccagguggcccugcccagagagcugcugugcaagcugcacgugaacagagccgccugcuacuucaccaugggccuguacgagaaggcccuggaggacagcgagaaggcccugggccuggacagcgagagcaucagagcccuguucagaaaggccagagcccugaacgagcugggcagacacaaggaggccuacgagugcagcagcagaugcagccuggcccugccccacgacgagagcgugacccagcugggccaggagcuggcccagaagcugggccugagagugagaaaggccuacaagagaccccaggagcuggagaccuucagccugcugagcaacggcaccgccgccggcguggccgaccagggcaccagcaacggccugggcagcaucgacgacaucgagaccgacugcuacguggaccccagaggcagccccgcccugcugcccagcacccccaccaugccccuguucccccacgugcuggaccugcuggccccccuggacagcagcagaacccugcccagcaccgacagccuggacgacuucagcgacggcgacguguucggccccgagcuggacacccugcuggacagccugagccuggugcagggcggccugagcggcagcggcgugcccagcgagcugccccagcugauccccguguuccccggcggcaccccccugcugccccccguggugggcggcagcauccccgugagcagcccccugccccccgccagcuucggccuggugauggaccccagcaagaagcuggccgccagcgugcuggacgcccuggacccccccggccccacccuggacccccuggaccugcugcccuacagcgagaccagacuggacgcccuggacagcuucggcagcaccagaggcagccuggacaagcccgacagcuucauggaggagaccaacagccaggaccacagaccccccagcggcgcccagaagcccgcccccagccccgagcccugcaugcccaacaccgcccugcugaucaagaacccccuggccgccacccacgaguucaagcaggccugccagcugugcuaccccaagaccggccccagagccggcgacuacaccuacagagagggccuggagcacaagugcaagagagacauccugcugggcagacugagaagcagcgaggaccagaccuggaagagaaucagacccagacccaccaagaccagcuucgugggcagcuacuaccugugcaaggacaugaucaacaagcaggacugcaaguacggcgacaacugcaccuucgccuaccaccaggaggagaucgacguguggaccgaggagagaaagggcacccugaacagagaccugcuguucgacccccugggcggcgugaagagaggcagccugaccaucgccaagcugcugaaggagcaccagggcaucuucaccuuccugugcgagaucugcuucgacagcaagcccagaaucaucagcaagggcaccaaggacagccccagcgugugcagcaaccuggccgccaagcacagcuucuacaacaacaagugccuggugcacaucgugagaagcaccagccugaaguacagcaagaucagacaguuccaggagcacuuccaguucgacgugugcagacacgaggugagauacggcugccugagagaggacagcugccacuucgcccacagcuucaucgagcugaagguguggcugcugcagcaguacagcggcaugacccacgaggacaucgugcaggagagcaagaaguacuggcagcagauggaggcccacgccggcaaggccagcagcagcaugggcgcccccagaacccacggccccagcaccuucgaccugcagaugaaguucgugugcggccagugcuggagaaacggccaggugguggagcccgacaaggaccugaaguacugcagcgccaaggccagacacugcuggaccaaggagagaagagugcugcuggugaugagcaaggccaagagaaagugggugagcgugagaccccugcccagcaucagaaacuucccccagcaguacgaccugugcauccacgcccagaacggcagaaagugccaguacgugggcaacugcagcuucgcccacagccccgaggagagagacauguggaccuucaugaaggagaacaagauccuggacaugcagcagaccuacgacauguggcugaagaagcacaaccccggcaagcccggcgagggcacccccaucagcagcagagagggcgagaagcagauccagaugcccaccgacuacgccgacaucaugaugggcuaccacugcuggcugugcggcaagaacagcaacagcaagaagcaguggcagcagcacauccagagcgagaagcacaaggagaagguguucaccagcgacagcgacgccagcggcugggccuucagauuccccaugggcgaguucagacugugcgacagacugcagaagggcaaggccugccccgacggcgacaagugcagaugcgcccacggccaggaggagcugaacgaguggcuggacagaagagaggugcugaagcagaagcuggccaaggccagaaaggacaugcugcugugccccagagacgacgacuucggcaaguacaacuuccugcugcaggaggacggcgaccuggccggcgccacccccgaggcccccgccgccgccgccaccgccaccaccggcgaguaa

SEQ ID NO: 25827 - RNA, 2709 nt, Artificial Sequence
  ZC3HAV1__Homo_sapiens__NP_064504
auggccgaccccgaggugugcugcuucaucaccaagauccugugcgcccacggcggcagaauggcccuggacgcccugcugcaggagaucgcccugagcgagccccagcugugcgaggugcugcagguggccggccccgacagauucguggugcuggagaccggcggcgaggccggcaucaccagaagcgugguggccaccaccagagccagagugugcagaagaaaguacugccagagacccugcgacaaccugcaccugugcaagcugaaccugcugggcagaugcaacuacagccagagcgagagaaaccugugcaaguacagccacgaggugcugagcgaggagaacuucaaggugcugaagaaccacgagcugagcggccugaacaaggaggagcuggccgugcugcugcugcagagcgaccccuucuucaugcccgagaucugcaagagcuacaagggcgagggcagacagcagaucugcaaccagcagccccccugcagcagacugcacaucugcgaccacuucaccagaggcaacugcagauuccccaacugccugagaagccacaaccugauggacagaaaggugcuggccaucaugagagagcacggccugaaccccgacguggugcagaacauccaggacaucugcaacagcaagcacaugcagaagaacccccccggccccagagcccccagcagccacagaagaaacauggccuacagagccagaagcaagagcagagacagauucuuccagggcagccaggaguuccuggccagcgccagcgccagcgccgagagaagcugcacccccagccccgaccagaucagccacagagccagccuggaggacgcccccguggacgaccugaccagaaaguucaccuaccugggcagccaggacagagccagaccccccagcggcagcagcaaggccaccgaccugggcggcaccagccaggccggcaccagccagagauuccuggagaacggcagccaggaggaccugcugcacggcaaccccggcagcaccuaccuggccagcaacagcaccagcgcccccaacuggaagagccugaccagcuggaccaacgaccagggcgccagaagaaagaccguguucagccccacccugcccgccgccagaagcagccugggcagccugcagacccccgaggccgugaccaccagaaagggcaccggccugcugagcagcgacuacagaaucaucaacggcaagagcggcacccaggacauccagcccggcccccuguucaacaacaacgccgacggcguggccaccgacaucaccagcaccagaagccugaacuacaagagcaccagcagcggccacagagagaucagcagccccagaauccaggacgccggccccgccagcagagacgugcaggccaccggcagaaucgccgacgacgccgaccccagaguggcccuggugaacgacagccugagcgacgugaccagcaccaccagcagcagaguggacgaccacgacagcgaggagaucugccuggaccaccugugcaagggcugcccccugaacggcagcugcagcaaggugcacuuccaccugcccuacagauggcagaugcugaucggcaagaccuggaccgacuucgagcacauggagaccaucgagaagggcuacugcaaccccggcauccaccugugcagcgugggcagcuacaccaucaacuucagagugaugagcugcgacagcuuccccaucagaagacugagcacccccagcagcgugaccaagcccgccaacagcguguucaccaccaaguggaucugguacuggaagaacgagagcggcaccuggauccaguacggcgaggagaaggacaagagaaagaacagcaacguggacagcagcuaccuggagagccuguaccagagcugccccagaggcguggugcccuuccaggccggcagcagaaacuacgagcugagcuuccagggcaugauccagaccaacaucgccagcaagacccagaaggacgugaucagaagacccaccuucgugccccagugguacgugcagcagaugaagagaggccccgaccaccagcccgccaagaccagcagcgugagccugaccgccaccuucagaccccaggaggacuucugcuuccugagcagcaagaaguacaagcugagcgagauccaccaccugcaccccgaguacgugagagugagcgagcacuucaaggccagcaugaagaacuucaagaucgagaagaucaagaagaucgagaacagcgagcugcuggacaaguucaccuggaagaagagccagaugaaggaggagggcaagcugcuguucuacgccaccagcagagccuacguggagagcaucugcagcaacaacuucgacagcuuccugcacgagacccacgagaacaaguacggcaagggcaucuacuucgccaaggacgccaucuacagccacaagaacugccccuacgacgccaagaacguggugauguucguggcccaggugcuggugggcaaguucaccgagggcaacaucaccuacaccagcccccccccccaguucgacagcugcguggacaccagaagcaaccccagcguguucgugaucuuccagaaggaccagguguacccccaguacgugaucgaguacaccgaggacaaggccugcgugaucagcuaa

SEQ ID NO: 25828 - RNA, 1446 nt, Artificial Sequence
  ZC3HC1__Homo_sapiens__NP_001269119
augagaggccugcccagaaagagagaggccuggacccagccccacccccuggaggcccuguacgagagccugagagugcuggagaaggacaccagcgccaccagccagagcgugaacggcagcccccaggccgagcagcccagccuggagagcaccagcaaggaggccuucuucagcagaguggagaccuucagcagccugaagugggccggcaagcccuucgagcugagcccccuggugugcgccaaguacggcugggugaccguggagugcgacaugcugaagugcagcagcugccaggccuuccugugcgccagccugcagcccgccuucgacuucgacagauacaagcagagaugcgccgagcugaagaaggcccugugcaccgcccacgagaaguucugcuucuggcccgacagccccagccccgacagauucggcaugcugccccuggacgagcccgccauccuggugagcgaguuccuggacagauuccagagccugugccaccuggaccugcagcugcccagccugagacccgaggaccugaagaccaugugccugaccgaggacaagaucagccugcugcugcaccugcuggaggacgagcuggaccacagaaccgacgagagaaagaccaccaucaagcugggcagcgacauccaggugcacgugaccgccugcauccugagcgugugcggcugggccugcagcagcagccuggagagcaugcagcugagccugaucaccugcagccagugcaugagaaaggugggccuguggggcuuccagcagaucgagagcagcaugaccgaccuggacgccagcuucggccugaccagcagccccauccccggccuggagggcagacccgagagacugccccuggugcccgagagccccagaagaaugaugaccagaagccaggacgccaccuucagccccggcagcgagcaggccgagaagagccccggccccaucgugagcagaaccagaagcugggacagcagcagccccguggacagacccgagcccgaggccgccagccccaccaccagaaccagacccgugaccagaagcaugggcaccggcgacacccccggccuggaggugcccagcagcccccugagaaaggccaagagagccagacugugcagcagcagcagcagcgacaccagcagcagaagcuucuucgaccccaccagccagcacagagacuggugccccugggugaacaucacccugggcaaggagagcagagagaacggcggcaccgagcccgacgccagcgcccccgccgagcccggcuggaaggccgugcugaccauccugcuggcccacaagcagagcagccagcccgccgagaccgacagcaugagccugagcgagaagagcagaaagguguucagaaucuucagacagugggagagccugugcagcugcuaa

SEQ ID NO: 25829 - RNA, 531 nt, Artificial Sequence
  ZC4H2__Homo_sapiens__NP_001171504
auggccgacgagcaggagaucaugugcaagcuggagagcaucaaggagaucagaaacaagacccugcagauggagaagaucaaggccagacugaaggccgaguucgaggcccuggagagcgaggagagacaccugaaggaguacaagcaggagauggaccugcugcugcaggagaagauggcccacguggaggagcugagacugauccacgccgacaucaacgugauggagaacaccaucaagcagagcgagaacgaccugaacaagcugcuggagagcaccagaagacugcacgacgaguacaagccccugaaggagcacguggacgcccugagaaugacccugggccugcagagacugcccgaccugugcgaggaggaggagaagcugagccuggagcccgccugccacgugaccagcaaguucaccggcaugcaccuguacgcccuguucgccagacccagagugggccccggcacccccaagagcagaaacggcagcagaaugaacaaggagagagagagcaccuaa

SEQ ID NO: 25830 - RNA, 3915 nt, Artificial Sequence
  ZCCHC11__Homo_sapiens__XP_011539402
auggaggagagcaagacccugaagagcgagaaccacgagcccaagaagaacgugaucugcgaggagagcaaggccgugcaggugaucggcaaccagacccugaaggccagaaacgacaagagcgugaaggagaucgagaacagcagccccaacagaaacagcagcaagaagaacaagcagaacgacaucugcaucgagaagaccgaggugaagagcugcaaggugaacgccgccaaccugcccggccccaaggaccugggccuggugcugagagaccagagccacugcaaggccaagaaguuccccaacagccccgugaaggccgagaaggccaccaucagccaggccaagagcgagaaggccaccagccugcaggccaaggccgagaagagccccaagagccccaacagcgugaaggccgagaaggccagcagcuaccagaugaagagcgagaaggugcccagcagccccgccgaggccgagaagggccccagccugcugcugaaggacaugagacagaagaccgagcugcagcagaucggcaagaagauccccagcagcuucaccagcguggacaaggugaacaucgaggccgugggcggcgagaagugcgcccugcagaacagccccagaagccagaagcagcagaccugcaccgacaacaccggcgacagcgacgacagcgccagcggcaucgaggacgugagcgacgaccugagcaagaugaagaacgacgagagcaacaaggagaacagcagcgagauggacuaccuggagaacgccaccgugaucgacgagagcgcccugacccccgagcagagacugggccugaagcaggccgaggagagacuggagagagaccacaucuucagacuggagaagagaagccccgaguacaccaacugcagauaccugugcaagcugugccugauccacaucgagaacauccagggcgcccacaagcacaucaaggagaagagacacaagaagaacauccuggagaagcaggaggagagcgagcugagaagccugcccccccccagccccgcccaccuggccgcccugagcguggccgugaucgagcuggccaaggagcacggcaucaccgacgacgaccugagagugagacaggagaucguggaggagaugagcaaggugaucaccaccuuccugcccgagugcagccugagacuguacggcagcagccugaccagauucgcccugaagagcagcgacgugaacaucgacaucaaguucccccccaagaugaaccaccccgaccugcugaucaaggugcugggcauccugaagaagaacgugcuguacguggacguggagagcgacuuccacgccaaggugcccgugguggugugcagagacagaaagagcggccugcugugcagagugagcgccggcaacgacauggccugccugaccaccgaccugcugaccgcccugggcaagaucgagcccguguucaucccccuggugcuggccuucagauacugggccaagcugugcuacaucgacagccagaccgacggcggcauccccagcuacugcuucgcccugauggugauguucuuccugcagcagagaaagcccccccugcugcccugccugcugggcagcuggaucgagggcuucgaccccaagagaauggacgacuuccagcugaagggcaucguggaggagaaguucgugaagugggagugcaacagcagcagcgccaccgagaagaacagcaucgccgaggagaacaaggccaaggccgaccagcccaaggacgacaccaagaagaccgagaccgacaaccagagcaacgccaugaaggagaagcacggcaagagcccccuggcccuggagacccccaacagagugagccugggccagcuguggcuggagcugcugaaguucuacacccuggacuucgcccuggaggaguacgugaucugcgugagaauccaggacauccugaccagagagaacaagaacuggcccaagagaagaaucgccaucgaggaccccuucagcgugaagagaaacguggccagaagccugaacagccagcugguguacgaguacgugguggagagauucagagccgccuacagauacuucgccugcccccagaccaagggcggcaacaagagcaccguggacuucaagaagagagagaagggcaagaucagcaacaagaagcccgugaagagcaacaacauggccaccaacggcugcauccugcugggcgagaccaccgagaagaucaacgccgagagagagcagcccgugcagugcgacgagauggacugcaccagccagagaugcaucaucgacaacaacaaccugcuggugaacgagcuggacuucgccgaccacggccaggacagcagcagccugagcaccagcaagagcagcgagaucgagcccaagcuggacaagaagcaggacgaccuggcccccagcgagaccugccugaagaaggagcugagccagugcaacugcaucgaccugagcaagagccccgaccccgacaagagcaccggcaccgacugcagaagcaaccuggagaccgagagcagccaccagagcgugugcaccgacaccagcgccaccagcugcaacugcaaggccaccgaggacgccagcgaccugaacgacgacgacaaccugcccacccaggagcuguacuacguguucgacaaguucauccugaccagcggcaagccccccaccaucgugugcagcaucugcaagaaggacggccacagcaagaacgacugccccgaggacuucagaaagaucgaccugaagccccugccccccaugaccaacagauucagagagauccuggaccuggugugcaagagaugcuucgacgagcugagcccccccugcagcgagcagcacaacagagagcagauccugaucggccuggagaaguucauccagaaggaguacgacgagaaggccagacugugccuguucggcagcagcaagaacggcuucggcuucagagacagcgaccuggacaucugcaugacccuggagggccacgagaacgccgagaagcugaacugcaaggagaucaucgagaaccuggccaagauccugaagagacaccccggccugagaaacauccugcccaucaccaccgccaaggugcccaucgugaaguucgagcacagaagaagcggccuggagggcgacaucagccuguacaacacccuggcccagcacaacaccagaaugcuggccaccuacgccgccaucgaccccagagugcaguaccugggcuacaccaugaagguguucgccaagagaugcgacaucggcgacgccagcagaggcagccugagcagcuacgccuacauccugauggugcuguacuuccugcagcagagaaagccccccgugauccccgugcugcaggagaucuucgacggcaagcagaucccccagagaaugguggacggcuggaacgccuucuucuucgacaagaccgaggagcugaagaagagacugcccagccugggcaagaacaccgagagccugggcgagcuguggcugggccugcugagauucuacaccgaggaguucgacuucaaggaguacgugaucagcaucagacagaagaagcugcugaccaccuucgagaagcaguggaccagcaagugcaucgccaucgaggaccccuucgaccugaaccacaaccugggcgccggcgugagcagaaagaugaccaacuucaucaugaaggccuucaucaacggcagaaagcuguucggcacccccuucuacccccugaucggcagagaggccaccaucagccccaccaagaccggcuucaugagcgugagauucaccuacuuccaguacauccacagcguguggagaaucggcugcaccaaguaa

SEQ ID NO: 25831 - RNA, 1209 nt, Artificial Sequence
  ZCCHC12__Homo_sapiens__NP_776159
auggccagcaucaucgccagagugggcaacagcagaagacugaacgccccccugccccccugggcccacagcaugcugagaagccugggcagaagccugggccccaucauggccagcauggccgacagaaacaugaagcuguucagcggcagaguggugcccgcccagggcgaggagaccuucgagaacuggcugacccaggugaacggcgugcugcccgacuggaacaugagcgaggaggagaagcugaagagacugaugaagacccugagaggccccgccagagaggugaugagagugcugcaggccaccaaccccaaccugagcguggccgacuuccugagagccaugaagcugguguucggcgagagcgagagcagcgugaccgcccacggcaaguucuucaacacccugcaggcccagggcgagaaggccagccuguacgugaucagacuggaggugcagcugcagaacgccauccaggccggcaucaucgccgagaaggacgccaacagaaccagacugcagcagcugcugcugggcggcgagcugagcagagaccugagacugagacugaaggacuuccugagaauguacgccaacgagcaggagagacugcccaacuuccuggagcugaucagaauggugagagaggaggaggacugggacgacgccuucaucaagagaaagagacccaagagaagcgagagcaugguggagagagccgugagccccguggccuuccagggcagcccccccaucgugaucggcagcgccgacugcaacgugaucgagaucgacgacacccuggacgacagcgacgaggacgugauccugguggagagccaggaccccccccugcccagcuggggcgcccccccccugagagacagagccagaccccaggacgaggugcuggugaucgacagcccccacaacagcagagcccaguuccccagcaccagcggcggcagcggcuacaagaacaacggccccggcgagaugagaagagccagaaagagaaagcacaccaucagaugcagcuacugcggcgaggagggccacagcaaggagaccugcgacaacgagagcgacaaggcccagguguucgagaaccugaucaucacccugcaggagcugacccacaccgagauggagagaagcagaguggcccccggcgaguacaacgacuucagcgagccccuguaa

SEQ ID NO: 25832 - RNA, 2850 nt, Artificial Sequence
  ZCCHC14__Homo_sapiens__NP_055959
auggccagcaaccaccccgccuucagcuuccaccagaagcaggugcugagacaggagcugacccagauccagagcagccugaacggcggcggcggccacggcggcaagggcgcccccggccccggcggcgcccugcccaccugccccgccugccacaagaucacccccagaaccgaggcccccgugagcagcgugagcaacagccuggagaacgcccugcacaccagcgcccacagcaccgaggagagccugcccaagagaccccugggcaagcacagcaaggugagcguggagaagaucgaccugaagggccugagccacaccaagaacgacagaaacguggagugcagcuucgaggugcuguggagcgacagcagcaucaccagcgugaccaagagcagcagcgaggugaccgaguucaucagcaagcugugccagcuguaccccgaggagaaccuggagaagcugauccccugccuggccggccccgacgccuucuacguggagagaaaccacguggaccuggacagcggccugagauaccuggccagccugcccagccacgugcugaagaacgaccacgugagaagauuccugagcaccagcagccccccccagcagcugcagagccccagccccggcaaccccagccugagcaaggugggcaccgugaugggcgugagcggcagacccgugugcggcguggccggcauccccagcagccagagcggcgcccagcaccacggccagcaccccgccggcagcgccgccccccugccccacugcagccacgccggcagcgccggcagcgcccuggccuacagaacccagauggacaccagccccgccauccugaugcccagcagccugcagaccccccagacccaggagcagaacggcauccuggacuggcugagaaagcugagacugcacaaguacuaccccguguucaagcagcugagcauggagaaguuccugagccugaccgaggaggaccugaacaaguucgagagccugaccaugggcgccaagaagaagcugaagacccagcuggagcuggagaaggagaagagcgagagaagaugccugaaccccagcgcccccccccuggugaccagcagcggcguggccagagugccccccaccagccacgugggccccgugcagagcggcagaggcagccacgccgccgagcugagaguggagguggagcagccccaccaccagcugcccagagagggcagcagcagcgaguacagcagcagcagcagcagccccaugggcgugcaggccagagaggagagcagcgacagcgccgaggagaacgacagaagaguggagauccaccuggagagcagcgacaaggagaagcccgugaugcugcugaaccacuucaccagcagcagcgccagacccaccgcccaggugcugcccgugcagaacgaggccagcagcaaccccagcggccaccacccccugcccccccagaugcugagcgccgccagccacaucacccccaucagaaugcugaacagcgugcacaagcccgagagaggcagcgccgacaugaagcugcugagcagcagcgugcacagccugcugagccuggaggagagaaacaagggcagcggccccagaagcagcaugaagguggacaagagcuucggcagcgccaugauggacgugcugcccgccagcgccccccaccagcccgugcaggugcugagcggccugagcgagagcagcagcaugagccccaccgugagcuucggccccagaaccaagguggugcacgccagcacccuggacagagugcugaagaccgcccagcagcccgcccuggugguggagaccagcaccgccgccaccggcacccccagcaccgugcugcacgccgccagaccccccaucaagcugcugcugagcagcagcgugcccgccgacagcgccaucagcggccagaccagcugccccaacaacgugcagaucagcgugccccccgccaucaucaaccccagaaccgcccuguacaccgccaacaccaagguggccuucagcgccaugagcagcaugcccgugggcccccugcagggcggcuucugcgccaacagcaacaccgccagccccagcagccaccccagcaccagcuucgccaacauggccacccugcccagcugccccgcccccagcagcagccccgcccugagcagcgugcccgagagcagcuucuacagcagcagcggcggcggcggcagcaccggcaacauccccgccagcaaccccaaccaccaccaccaccaccaccaccagcagccccccgcccccccccagcccgccccccccccccccggcugcaucgugugcaccagcugcggcugcagcggcagcugcggcagcagcggccugaccgugagcuacgccaacuacuuccagcaccccuucagcggccccagcguguucaccuuccccuuccugcccuucagccccaugugcagcagcggcuacgugagcgcccagcaguacggcggcggcagcaccuuccccguggugcacgcccccuacagcagcagcggcacccccgaccccgugcugagcggccagagcaccuucgccgugccccccaugcagaacuucauggccggcaccgccggcguguaccagacccagggccuggugggcagcagcaacggcagcagccacaagaagagcggcaaccugagcugcuacaacugcggcgccaccggccacagagcccaggacugcaagcagcccagcauggacuucaacagacccggcaccuucagacugaaguacgccccccccgccgagagccuggacagcaccgacuaa

SEQ ID NO: 25833 - RNA, 3537 nt, Artificial Sequence
  ZCCHC2__Homo_sapiens__NP_060212
augcugagaaugaagcugccccugaagcccacccaccccgccgagcccccccccgaggccgaggagcccgaggccgacgccagacccggcgccaaggcccccagcagaagaagaagagacugcagaccccccccccccccccccccccccgccggccccagcagaggcccccugccccccccccccccccccagaggccugggcccccccguggccggcggcgccgccgccggcgccggcaugcccggcggcggcggcggccccagcgccgcccugagagagcaggagagaguguacgagugguucggccuggugcugggcagcgcccagagacuggaguucaugugcggccugcuggaccugugcaacccccuggagcugagauuccugggcagcugccuggaggaccuggccagaaaggacuaccacuaccugagagacagcgaggccaaggccaacggccugagcgaccccggcccccuggccgacuucagagagcccgccgugagaagcagacugaucguguaccuggcccugcugggcagcgagaacagagaggccgccggcagacugcacagacugcugccccagguggacagcgugcugaagagccugagagccgccagaggcgagggcagcagaggcggcgccgaggacgagagaggcgaggacggcgacggcgagcaggacgccgagaaggacggcagcggccccgagggcggcaucguggagcccagagugggcggcggccugggcagcagagcccaggaggagcugcugcugcuguucaccauggccagccugcaccccgccuucagcuuccaccagagagugacccugagagagcaccuggagagacugagagccgcccugagaggcggccccgaggacgccgagguggagguggagcccugcaaguucgccggccccagagcccagaacaacagcgcccacggcgacuacaugcagaacaacgagagcagccugaucgagcaggcccccaucccccaggacggccugaccguggccccccacagagcccagagagaggccgugcacaucgagaagaucaugcugaagggcgugcagagaaagagagccgacaaguacugggaguacaccuucaaggugaacuggagcgaccugagcgugaccaccgugaccaagacccaccaggagcugcaggaguuccugcugaagcugcccaaggagcugagcagcgagaccuucgacaagaccauccugagagcccugaaccagggcagccugaagagagaggagagaagacaccccgaccuggagcccauccugagacagcuguucagcagcagcagccaggccuuccugcagagccagaaggugcacagcuucuuccagagcaucagcagcgacagccugcacagcaucaacaaccugcagagcagccugaagaccagcaagauccuggagcaccugaaggaggacagcagcgaggccagcagccaggaggaggacgugcugcagcacgccaucauccacaagaagcacaccggcaagagccccaucgugaacaacaucggcaccagcugcagcccccuggacggccugaccaugcaguacagcgagcagaacggcaucguggacuggagaaagcagagcugcaccaccauccagcaccccgagcacugcgugaccagcgccgaccagcacagcgccgagaagagaagccugagcagcaucaacaagaagaagggcaagccccagaccgagaaggagaagaucaagaagaccgacaacagacugaacagcagaaucaacggcaucagacugagcaccccccagcacgcccacggcggcaccgugaaggacgugaaccuggacaucggcagcggccacgacaccugcggcgagaccagcagcgagagcuacagcagccccagcagccccagacacgacggcagagagagcuucgagagcgaggaggagaaggacagagacaccgacagcaacagcgaggacagcggcaaccccagcaccaccagauucaccggcuacggcagcgugaaccagaccgugaccgugaagccccccgugcagaucgccagccugggcaacgagaacggcaaccugcuggaggacccccugaacagccccaaguaccagcacaucagcuucaugcccacccugcacugcgugaugcacaacggcgcccagaagagcgaggugguggugcccgcccccaagcccgccgacggcaagaccaucggcaugcuggugcccagccccguggccaucagcgccaucagagagagcgccaacagcacccccgugggcauccugggccccaccgccugcaccggcgagagcgagaagcaccuggagcugcuggccagcccccugcccauccccagcaccuuccugccccacagcagcacccccgcccugcaccugaccgugcagagacugaagcugccccccccccagggcagcagcgagagcugcaccgugaacaucccccagcagccccccggcagccugagcaucgccagccccaacaccgccuucauccccauccacaaccccggcagcuuccccggcagccccguggccaccaccgaccccaucaccaagagcgccagccagguggugggccugaaccagauggugccccagaucgagggcaacaccggcaccgugccccagcccaccaacgugaagguggugcugcccgccgccggccugagcgccgcccagccccccgccagcuacccccugcccggcagcccccuggccgccggcgugcugcccagccagaacagcagcgugcugagcaccgccgccaccagcccccagcccgccagcgccggcaucagccaggcccaggccaccgugccccccgccgugcccacccacacccccggccccgcccccagccccagccccgcccugacccacagcaccgcccagagcgacagcaccagcuacaucagcgccgugggcaacaccaacgccaacggcaccguggugcccccccagcagaugggcagcggccccugcggcagcugcggcagaagaugcagcugcggcaccaacggcaaccugcagcugaacagcuacuacuaccccaaccccaugcccggccccauguacagagugcccagcuucuucacccugcccagcaucugcaacggcagcuaccugaaccaggcccaccagagcaacggcaaccagcugcccuucuuccugccccagacccccuacgccaacggccuggugcacgaccccgugaugggcagccaggccaacuacggcaugcagcagauggccggcuucggcagauucuaccccguguaccccgcccccaacgugguggccaacaccagcggcagcggccccaagaagaacggcaacgugagcugcuacaacugcggcgugagcggccacuacgcccaggacugcaagcagagcagcauggaggccaaccagcagggcaccuacagacugagauacgcccccccccugccccccagcaacgacacccuggacagcgccgacuaa

SEQ ID NO: 25834 - RNA, 1212 nt, Artificial Sequence
  ZCCHC3__Homo_sapiens__NP_149080
auggccaccggcggcggcgccgaggaggagagaaagagaggcagaccccagcugcugccccccgccagacccgccgccagaggcgaggaggccgacggcggcagagagaagaugggcugggcccagguggugaagaaccuggccgagaagaagggcgaguucagagagcccagaccccccagaagagaggaggagagcggcggcggcggcggcagcgccggccugggcggccccgccggccuggccgcccccgaccugggcgacuucccccccgccggcagaggcgaccccaagggcagaagaagagaccccgccggcgaggccguggaccccagaaagaagaagggcgccgccgaggccggcagaagaaagaaggccgaggccgccgccgccgccauggccacccccgccagacccggcgaggccgaggacgccgccgagagaccccugcaggacgagcccgccgccgccgccggccccggcaagggcagauuccuggugagaaucugcuuccagggcgacgagggcgccugccccaccagagacuucguggugggcgcccugauccugagaagcaucggcauggaccccagcgacaucuacgccgugauccagauccccggcagcagagaguucgacgugagcuucagaagcgccgagaagcuggcccuguuccugagaguguacgaggagaagagagagcaggaggacugcugggagaacuucguggugcugggcagaagcaagagcagccugaagacccuguucauccuguucagaaacgagaccguggacguggaggacaucgugaccuggcugaagagacacugcgacgugcuggccgugcccgugaaggugaccgacagauucggcaucuggaccggcgaguacaagugcgagaucgagcugagacagggcgagggcggcgugagacaccugcccggcgccuucuuccugggcgccgagagaggcuacagcugguacaagggccagcccaagaccugcuucaagugcggcagcagaacccacaugagcggcagcugcacccaggacagaugcuucagaugcggcgaggagggccaccugagccccuacugcagaaagggcaucgugugcaaccugugcggcaagagaggccacgccuucgcccagugccccaaggccgugcacaacagcguggccgcccagcugaccggcguggccggccacuaa

SEQ ID NO: 25835 - RNA, 4488 nt, Artificial Sequence
  ZCCHC6__Homo_sapiens__NP_001171988
augggcgacaccgccaagcccuacuucgugaagagaaccaaggacagaggcaccauggacgacgacgacuucagaagaggccacccccagcaggacuaccugaucaucgacgaccacgccaagggccacggcagcaagauggagaagggccugcagaagaagaagaucacccccggcaacuacggcaacacccccagaaagggccccugcgccgugagcagcaaccccuacgccuucaagaaccccaucuacagccagcccgccuggaugaacgacagccacaaggaccagagcaagagauggcugagcgacgagcacaccggcaacagcgacaacuggagagaguucaagcccggccccagaauccccgugaucaacagacagagaaaggacagcuuccaggagaacgaggacggcuacagauggcaggacaccagaggcugcagaaccgugagaagacuguuccacaaggaccugaccagccuggagaccaccagcgagauggaggccggcagccccgagaacaagaagcagagaagcagacccagaaagcccagaaagaccagaaacgaggagaacgagcaggacggcgaccuggagggccccgugaucgacgagagcgugcugagcaccaaggagcugcugggccugcagcaggccgaggagagacugaagagagacugcaucgacagacugaagagaagacccagaaacuaccccaccgccaaguacaccugcagacugugcgacgugcugaucgagagcaucgccuucgcccacaagcacaucaaggagaagagacacaagaagaacaucaaggagaagcaggaggaggagcugcugaccacccugcccccccccacccccagccagaucaacgccgugggcaucgccaucgacaagguggugcaggaguucggccugcacaacgagaaccuggagcagagacuggagaucaagagaaucauggagaacguguuccagcacaagcugcccgacugcagccugagacuguacggcagcagcugcagcagacugggcuucaagaacagcgacgugaacaucgacauccaguuccccgccaucaugagccagcccgacgugcugcugcuggugcaggagugccugaagaacagcgacagcuucaucgacguggacgccgacuuccacgccagagugcccgugguggugugcagagagaagcagagcggccugcugugcaaggugagcgccggcaacgagaacgccugccugaccaccaagcaccugaccgcccugggcaagcuggagcccaagcuggugccccuggugaucgccuucagauacugggccaagcugugcagcaucgacagacccgaggagggcggccugccccccuacguguucgcccugauggccaucuucuuccugcagcagagaaaggagccccugcugcccguguaccugggcagcuggaucgagggcuucagccugagcaagcugggcaacuucaaccugcaggacaucgagaaggacguggugaucugggagcacaccgacagcgccgccggcgacaccggcaucaccaaggaggaggcccccagagagacccccaucaagagaggccaggugagccugauccuggacgugaagcaccagcccagcgugcccgugggccagcuguggguggagcugcugagauucuacgcccuggaguucaaccuggccgaccuggugaucagcaucagagugaaggagcuggugagcagagagcugaaggacuggcccaagaagagaaucgccaucgaggaccccuacagcgugaagagaaacguggccagaacccugaacagccagcccguguucgaguacauccugcacugccugagaaccaccuacaaguacuucgcccugccccacaagaucaccaagagcagccugcugaagccccugaacgccaucaccugcaucagcgagcacagcaaggaggugaucaaccaccaccccgacgugcagaccaaggacgacaagcugaagaacagcgugcuggcccagggccccggcgccaccagcagcgccgccaacaccugcaaggugcagccccugacccugaaggagaccgccgagagcuucggcagcccccccaaggaggagaugggcaacgagcacaucagcgugcaccccgagaacagcgacugcauccaggccgacgugaacagcgacgacuacaagggcgacaagguguaccaccccgagaccggcagaaagaacgagaaggagaaggugggcagaaagggcaagcaccugcugaccguggaccagaagagaggcgagcacguggugugcggcagcaccagaaacaacgagagcgagagcacccuggaccuggagggcuuccagaaccccaccgccaaggagugcgagggccuggccacccuggacaacaaggccgaccuggacggcgagagcaccgagggcaccgaggagcuggaggacagccugaaccacuucacccacagcgugcagggccagaccagcgagaugauccccagcgacgaggaggaggaggacgacgaggaggaggaggaggaggaggagcccagacugaccaucaaccagagagaggacgaggacggcauggccaacgaggacgagcuggacaacaccuacaccggcagcggcgacgaggacgcccugagcgaggaggacgacgagcugggcgaggccgccaaguacgaggacgugaaggagugcggcaagcacguggagagagcccugcugguggagcugaacaagaucagccugaaggaggagaacgugugcgaggagaagaacagccccguggaccagagcgacuucuucuacgaguucagcaagcugaucuucaccaagggcaagagccccaccguggugugcagccugugcaagagagagggccaccugaagaaggacugccccgaggacuucaagagaauccagcuggagccccugcccccccugacccccaaguuccugaacauccuggaccaggugugcauccagugcuacaaggacuucagccccaccaucaucgaggaccaggccagagagcacaucagacagaaccuggagagcuucaucagacaggacuuccccggcaccaagcugagccuguucggcagcagcaagaacggcuucggcuucaagcagagcgaccuggacgugugcaugaccaucaacggccuggagaccgccgagggccuggacugcgugagaaccaucgaggagcuggccagagugcugagaaagcacagcggccugagaaacauccugcccaucaccaccgccaaggugcccaucgugaaguucuuccaccugagaagcggccuggagguggacaucagccuguacaacacccuggcccugcacaacaccagacugcugagcgccuacagcgccaucgaccccagagugaaguaccugugcuacaccaugaagguguucaccaagaugugcgacaucggcgacgccagcagaggcagccugagcagcuacgccuacacccugauggugcuguacuuccugcagcagagaaacccccccgugauccccgugcugcaggagaucuacaagggcgagaagaagcccgagaucuucguggacggcuggaacaucuacuucuucgaccagaucgacgagcugcccaccuacuggagcgagugcggcaagaacaccgagagcgugggccagcuguggcugggccugcugagauucuacaccgaggaguucgacuucaaggagcacgugaucagcaucagaagaaagagccugcugaccaccuucaagaagcaguggaccagcaaguacaucgugaucgaggaccccuucgaccugaaccacaaccugggcgccggccugagcagaaagaugaccaacuucaucaugaaggccuucaucaacggcagaagaguguucggcauccccgugaagggcuuccccaaggacuaccccagcaagauggaguacuucuucgaccccgacgugcugaccgagggcgagcuggcccccaacgacagaugcugcagaaucugcggcaagaucggccacuucaugaaggacugccccaugagaagaaaggugagaagaagaagagaccaggaggacgcccugaaccagagauaccccgagaacaaggagaagagaagcaaggaggacaaggagauccacaacaaguacaccgagagagaggugagcaccaaggaggacaagcccauccagugcaccccccagaaggccaagcccaugagagccgccgccgaccugggcagagagaagauccugagaccccccguggagaaguggaagagacaggacgacaaggaccugagagagaagagaugcuucaucugcggcagagagggccacaucaagaaggagugcccccaguucaagggcagcagcggcagccugagcagcaaguacaugacccagggcaaggccagcgccaagagaacccagcaggagagcuaa

SEQ ID NO: 25836 - RNA, 2124 nt, Artificial Sequence
  ZCCHC8__Homo_sapiens__NP_060082
auggccgccgagguguacuucggcgaccuggagcuguucgagcccuucgaccaccccgaggagagcauccccaagcccgugcacaccagauucaaggacgacgacggcgacgaggaggacgagaacggcgugggcgacgccgagcugagagagagacugagacagugcgaggagaccaucgagcagcugagagccgagaaccaggagcugaagagaaagcugaacauccugaccagacccagcggcauccuggugaacgacaccaagcuggacggccccauccugcagauccuguucaugaacaacgccaucagcaagcaguaccaccaggagaucgaggaguucgugagcaaccuggugaagagauucgaggagcagcagaagaacgacguggagaagaccagcuucaaccugcugccccagcccagcagcaucgugcuggaggaggaccacaagguggaggagagcugcgccaucaagaacaacaaggaggccuucagcguggugggcagcgugcuguacuucaccaacuucugccuggacaagcugggccagccccugcugaacgagaacccccagcugagcgagggcugggagauccccaaguaccaccagguguucagccacaucgugagccuggagggccaggagauccaggugaaggccaagagacccaagccccacugcuucaacugcggcagcgaggagcaccagaugaaggacugccccaugcccagaaacgccgccagaaucagcgagaagagaaaggaguacauggacgccugcggcgaggccaacaaccagaacuuccagcagagauaccacgccgaggagguggaggagagauucggcagauucaagcccggcgugaucagcgaggagcugcaggacgcccugggcgugaccgacaagagccugccccccuucaucuacagaaugagacagcugggcuacccccccggcuggcugaaggaggccgagcuggagaacagcggccuggcccuguacgacggcaaggacggcaccgacggcgagaccgaggugggcgagauccagcagaacaagagcgugaccuacgaccugagcaagcuggugaacuaccccggcuucaacaucagcacccccagaggcauccccgacgaguggagaaucuucggcagcauccccaugcaggccugccagcagaaggacguguucgccaacuaccugaccagcaacuuccaggcccccggcgugaagagcggcaacaagagaagcagcagccacagcagccccggcagccccaagaagcagaagaacgagagcaacagcgccggcagccccgccgacauggagcuggacagcgacauggaggugccccacggcagccagagcagcgagagcuuccaguuccagcccccccugccccccgacacccccccccugcccagaggcacccccccccccguguucacccccccccugcccaagggcacccccccccugacccccagcgacagcccccagaccagaaccgccagcggcgccguggacgaggacgcccugacccuggaggagcuggaggagcagcagagaagaaucugggccgcccuggagcaggccgagagcgugaacagcgacagcgacgugcccguggacaccccccugaccggcaacagcguggccagcagccccugccccaacgagcuggaccugcccgugcccgagggcaagaccagcgagaagcagacccuggacgagcccgaggugcccgagaucuucaccaagaagagcgaggccggccacgccagcagccccgacagcgaggugaccagccugugccagaaggagaaggccgagcuggcccccgugaacaccgagggcgcccugcuggacaacggcagcguggugcccaacugcgacaucagcaacggcggcagccagaagcuguuccccgccgacaccagccccagcaccgccaccaagauccacagccccauccccgacaugagcaaguucgccaccggcaucacccccuucgaguucgagaacauggccgagagcaccggcauguaccugagaaucagaagccugcugaagaacagccccagaaaccagcagaagaacaagaaggccagcgaguaa

SEQ ID NO: 25837 - RNA, 654 nt, Artificial Sequence
  ZCRB1__Homo_sapiens__NP_149105
augagcggcggccuggcccccagcaagagcaccguguacgugagcaaccugcccuucagccugaccaacaacgaccuguacagaaucuucagcaaguacggcaagguggugaaggugaccaucaugaaggacaaggacaccagaaagagcaagggcguggccuucauccuguuccuggacaaggacagcgcccagaacugcaccagagccaucaacaacaagcagcuguucggcagagugaucaaggccagcaucgccaucgacaacggcagagccgccgaguucaucagaagaagaaacuacuucgacaagagcaagugcuacgagugcggcgagagcggccaccugagcuacgccugccccaagaacaugcugggcgagagagagccccccaagaagaaggagaagaagaagaagaagaaggcccccgagcccgaggaggagaucgaggagguggaggagagcgaggacgagggcgaggaccccgcccuggacagccugagccaggccaucgccuuccagcaggccaagaucgaggaggagcagaagaaguggaagcccagcagcggcgugcccagcaccagcgacgacagcagaagacccagaaucaagaagagcaccuacuucagcgacgaggaggagcugagcgacuaa

SEQ ID NO: 25838 - RNA, 1575 nt, Artificial Sequence
  ZCWPW1__Homo_sapiens__NP_001244937
augaugaccacccugcagaacaaggaggagugcggcaagggccccaagagaaucuucgccccccccgcccagaagagcuacagccugcugcccugcagccccaacagccccaaggaggagacccccggcaucagcagccccgagaccgaggccagaaucagccugcccaaggccagccugaagaagaaggaggagaaggccaccaugaagaacgugcccagcagagagcaggagaagaagagaaaggcccagaucaacaagcaggccgagaagaaggagaaggagaagagcagccugaccaacgccgaguucgaggagaucgugcagaucgugcugcagaagagccugcaggagugccugggcaugggcagcggccuggacuucgccgagaccagcugcgcccagcccguggugagcacccagagcgacaaggagcccggcaucaccgccagcgccaccgacaccgacaacgccaacggcgaggaggugccccacacccaggagaucagcgugagcugggagggcgaggccgcccccgagaucagaaccagcaagcugggccagcccgaccccgcccccagcaagaagaagagcaacagacugacccugagcaagagaaagaaggaggcccaggacgagaagguggagaagacccagggcggccacgagcacagacaggaggacagacugaagaagaccgugcaggaccacagccagaucagagaccagcagaagggcgagaucagcggcuucggccagugccuggugugggugcagugcagcuuccccaacugcggcaaguggagaagacugugcggcaacaucgaccccagcgugcugcccgacaacuggagcugcgaccagaacaccgacgugcaguacaacagaugcgacauccccgaggagaccuggaccggccuggagagcgacguggccuacgccagcuacauccccggcagcaucaucugggccaagcaguacggcuaccccugguggcccggcaugaucgagagcgaccccgaccugggcgaguacuuccuguucaccagccaccuggacagccugcccagcaaguaccacgugaccuucuucggcgagaccgugagcagagccuggauccccgugaacaugcugaagaacuuccaggagcugagccuggagcugagcgugaugaagaagagaagaaacgacugcagccagaagcugggcguggcccugaugauggcccaggaggccgagcagaucagcauccaggagagagugaaccuguucggcuucuggagcagauucaacggcagcaacagcaacggcgagagaaaggaccugcagcugagcggccugaacagccccggcagcugccuggagaagaaggagaaggaggaggagcuggagaaggaggagggcgagaagaccgcccugagaaagaaccugaagcugcccagagccagacccuggcagcccgccuuccagagagagaagaagcuggagcagugccagagaaccugggccuaccagagagugagaggccccgccccccaccugagaaagaagagccccgacaccggcaaccccuaa

SEQ ID NO: 25839 - RNA, 7065 nt, Artificial Sequence
  ZDBF2__Homo_sapiens__NP_065974
augcagaagagacagggcuacugcagcuacugcagagugcaguacaacaaccuggagcagcaccuguucagcgcccagcacagaagccugaccagacagagcagaagacagaucugcaccagcagccugauggagagauuccugcaggacgugcugcagcaccaccccuaccacugccaggagagcagcagcacccaggacgagacccacgugaacaccggcagcagcagcgagguggugcaccuggacgacgccuucagcgaggaggaggaggaggacgaggacaagguggaggacgaggacgccaccgaggagagacccagcgaggugagcgagcccaucgaggagcugcacagcagaccccacaagagccaggagggcacccaggaggugagcgugagacccagcgugauccagaagcuggagaagggccagcagcagccccuggaguucgugcacaagaucggcgccagcgugagaaagugcaaccugguggacaucggccaggccaccaacaacagaagcaaccuggugagaccccccgugaucugcaacgcccccgccagcugccugcccgagagcagcaacgacagacccgugaccgccaacaccaccagccugccccccgccgcccaccuggacagcgugagcaagugcgaccccaacaagguggagaaguaccuggagcagcccgacggcgccagcagaaaccccgugcccagcagccacguggagaccaccagcuucagcuaccagaagcacaaggagagcaacagaaagagccugagaaugaacagcgacaagcuggugcuguggaaggacgugaagagccagggcaagacccugagcgccggccugaaguuccacgagagaaugggcaccaagggcagccugagagugaagagccccagcaagcuggccgugaaccccaacaagaccgacaugcccagcaacaagggcaucuucgaggacaccaucgccaagaaccacgaggaguucuucagcaacauggacugcacccaggaggagaagcaccugguguucaacaagaccgccuucugggagcagaagugcagcgugagcagcgagaugaaguucgacugcaucagccugcagagcgccagcgaccagccccaggagaccgcccaggaccugagccuguggaaggaggagcagaucgaccaggaggacaacuacgagagcagaggcagcgagaugagcuucgacugcagcagcagcuuccacagccugaccgaccagagcaaggugagcgccaaggaggugaaccugagcaaggaggugagaaccgacgugcaguacaagaacaacaagagcuacgugagcaagaucagcagcgacugcgacgacauccugcaccuggugaccaaccagagccagaugaucgugaaggagaucagccugcagaacgccagacacaucagccugguggaccagagcuacgagagcagcagcagcgagaccaacuucgacugcgacgccagcccccagagcaccagcgacuacccccagcagagcgugaccgaggugaaccugcccaaggaggugcacaucggccugguggacaagaacuacggcagcagcagcagcgaggugagcgccgacagcguguucccccugcagagcgugguggacagaccccccguggccgugaccgagaccaagcugagaaagaaggcccacaccagccugguggacaacuacggcagcagcugcagcgagaccagcuucgacugcgacgugagccuggagagcgugguggaccacccccagcugaccgugaagggcagaaaccugaagggcagacaggugcaccugaagcacaagaagagaaagcccagcagcgccaaggcccaccuggacugcgacgugagccugggcaccguggccgacgagagccagagagccguggagaagaucaaccugcugaaggagaagaacgccgaccugauggacaugaacugcgagagccacggccccgagaugggcuuccaggccgacgcccagcuggccgaccagagccagguggccgagaucgagagacagaagguggacguggaccuggagaacaagagcgugcagagcagcagaagcagccugagcagcgacagccccgccagccuguaccacagcgcccacgacgagccccaggaggcccuggacgaggugaaccugaaggagcugaacaucgacauggaggugagaagcuacgacugcagcagcagcgagcugaccuucgacagcgaccccccccugcugagcgugaccgagcagagccaccuggacgccgagggcaaggagagacacaucgaccuggaggacgagagcugcgagagcgacagcagcgagaucaccuucgacagcgacaucccccuguacagcgugaucgaccagcccgagguggccguguacgaggaggagaccguggaccuggagagcaagagcaacgagagcugcgugagcgagaucaccuucgacagcgacaucccccugcacagcggcaacgaccaccccgagguggccgugaaggaggugauccagaaggaggaguacauccaccuggagagaaagaacgacgagcccagcggcagcgagaucagcagcgacagccacgccccccugcacagcgugaccaacagccccgagguggccgugaagaagcugaacccccagaaggaggagcaggugcaccuggagaacaaggagaacgagcccaucgacagcgaggugagccuggacuacaacaucaucuuccacagcgugaccggcagaagcgaggaccccaucaaggagaucagccugcacaccaaggagcacauguaccuggagaacaagagcguguucgagaccagccuggacagcgacgugccccugcaggccgccacccacaagcccgaggugaucgugaaggagaccuggcugcagagagagaagcacgccgaguuccagggcagaagcaccgaguucagcggcagcaagaccagccuggacagcggcgugccccacuacagcgugaccgagccccagguggccgugaacaagaucaacagaaagaagcaguacgugcuggagaacaagaacgacaagugcagcggcagcgagaucauccuggacagcaacgugcccccccagagcaugaccgaccagccccagcuggccuuccugaaggagaagcacgugaaccugaaggacaagaacagcaagagcggcgacagcaagaucaccuucgacagcgagcagcugcaggaggccgugaagaagaucgaccaguggaaggaggaggugaucggccugaagaacaagaucaacgagcccagcaccuacaagcugauccaccaccccgacgugagcgugcagagcguggccgaccagcccaagguggccaucaagcacgugaaccugggcaacgagaaccacauguaccuggaggugaagaacagccaguacagcugcagcgagaugaaccuggacagcggcuuccugggccagagcaucgugaacagaccccagaucaccauccuggagcaggagcacaucgagcuggagggcaagcacaaccagugcugcggcagcgaggugagcuucgacagcgacgacccccugcagagcguggccgacagacugagagagaccgugaaggagaucagccuguggaaggacgaggagguggacaccgaggacagaagaaacgaggccaagggcuucgagaucauguacgacagcgacgugcugcagcccguggccggccagcccgaggagguggugaaggaggugagccuguggaaggagcacguggaccuggagaacaagaucgugaagcccaccgacagcagaaucaacuucgacagccacgagccccugcagagcgugaccaacaagauccccggcgccaacaaggagaucaaccugcugagagaggagcacgugugccuggacgacaagggcuacgugcccagcgacagcgagaucaucuacgugagcaacaucccccugcagagcgugaucaagcagccccacauccuggaggaggagcacgccagccuggaggacaagagcagcaacagcuacagccccgaggagagcagcgacagcaacgacagcuuccaggccgccgccgacgagcugcagaagcccgugaaggagaucaaccuguggaaggaggaccacaucuaccuggaggacaagagcuacaagcugggcgacuucgacgugagcuacgccagccacauccccgugcaguucgugaccgaccagagcagcgugcccgugaaggagaucaaccugcagaagaaggaccacaacgaccuggagaacaagaacugcgaggugugcggcagcgagaucaagugccacagcugcgugcaccugcagagcgagguggaccagccccaggugagcuacaaggaggccgaccugcagaaggaggagcacguggugauggaggagaagaccgaccagcccagcgacagcgagaugauguacgacagcgacgugcccuuccagaucguggugaaccaguuccccggcagcgugaaggagacccaccugcccaagguggugcugguggaccuggugcccggcgacagcgacuacgaggugaucagcgacgacaucccccugcagcuggugaccgaccccccccagcugaccgugaaggacaucagcugcaucaacaccgagugcaucgacaucgaggacaagagcugcgacuucuucggcagcgaggugagaugcaacugcaaggccagcacccccagcaugaccaaccagugcaaggagaccuucaagaucaucaacagaaagaaggacuacaucauccugggcgagcccagcugccagagcugcggcagcgagaugaacuucaacguggacgccagcgaccagagcaugaccuacgagagccagggccccgacgagaagauggugaaguacaucgacagcgaggacaagagcugcggcuacaacggcagcaagggcaaguucaaccuggaggacaccagccacagaaccacccacagacugcagaaggcccacaaggaggccagccugagaaaggaccccagaaacgccggccugaagggcaagagcugccagagcagcgccagcgccguggacuucggcgccagcagcaagagcgcccugcacagaagagccgacaagaagaagagaagcaagcugaagcacagagaccuggaggugagcugcgagcccgacggcuucgagaugaacuuccagugcgcccccccccugcccagcgacaccgaccagccccaggagaccgugaagaagagacaccccugcaagaaggugagcagcgaccugaaggagaagaaccacgacagccagagcagcagcgugcugaagguggacagcgugagaaaccugaagaaggccaaggacgugaucgaggacaaccccgacgagcccgugcuggaggcccugccccacgugccccccagcuucgugggcaagaccuggagccagaucaugagagaggacgacaucaagaucaacgcccuggugaaggaguucagagagggcagauuccacugcuacuucgacgacgacugcgagaccaagaaggugagcagcaagggcaagaagaaggugaccugggccgaccugcagggcaaggaggacaccgcccccacccaggccgugagcgagagcgacgacaucgugugcggcaucagcgacaucgacgaccugagcguggcccuggacaagcccugccacagacacccccccgccgagagaccccccaagcagaagggcagaguggccagccagugccagaccgccaagaucagccacagcacccagaccagcugcaagaacuaccccgugaugaagagaaagaucaucagacaggaggaggacccccccaagagcaagugcagcagacugcaggacgacagaaagaccaagaagaaggugaagaucggcaccguggaguuccccgccagcugcaccaaggugcugaagcccaugcagcccaaggcccuggugugcgugcugagcagccugaacaucaagcugaaggagggcgagggccugcccuuccccaagaugagacaccacagcugggacaacgacaucagauucaucugcaaguacaagagaaacaucuucgacuacuacgagccccugaucaagcagaucgugaucagccccccccugagcgugaucgugcccgaguucgagagaagaaacugggugaagauccacuucaacagaagcaaccagaacagcagcgccggcgacaacgacgccgacggccagggcagcgccagcgccccccugauggccgugcccgccagauacggcuucaacagccaccagggcaccagcgacagcagccuguuccuggaggagagcaaggugcugcacgccagagagcugcccaagaagagaaacuuccagcugaccuuccugaaccacgacguggugaagaucagccccaagagcgugagaaacaagcugcuggagagccagagcaagaagaagauccacggcaagagagugaccaccagcagcaacaagcugggcuuccccaagaagguguacaagcccaucauccugcagcagaagcccagaaaggccagcgagaagcagagcaucuggaucagaaccaagcccagcgacaucaucagaaaguacaucagcaaguacagcguguuccugagacacagauaccagagcagaagcgccuuccugggcagauaccugaagaagaagaagagcguggugagcagacugaagaaggccaagagaaccgccaaggugcugcugaacagcagcgugccccccgccggcgccgaggagcugagcagcgccauggccaaccccccccccaagagacccgugagagccagcugcagaguggccagaagaagaaagaagaccgacgagagcuaccacggcagacagaagggccccagcacccccgugagagccuacgaccugagaagcagcagcugccugcagcagagagagagaaugaugaccagacuggccaacaagcugagaggcaacgaggugaaguaa

SEQ ID NO: 25840 - RNA, 1239 nt, Artificial Sequence
  ZDHHC11__Homo_sapiens__NP_079062
auggacaccagaagcggcagccagugcagcgugacccccgaggccauccugaacaacgagaagcuggugcugccccccagaaucagcagagugaacggcuggagccugccccugcacuacuuccagguggugaccugggccguguucgugggccugagcagcgccaccuucggcaucuucauccccuuccugccccacgccuggaaguacaucgccuacguggugaccggcggcaucuucagcuuccaccugguggugcaccugaucgccagcugcaucgaccccgccgacagcaacgugagacugaugaagaacuacagccagcccaugccccuguucgacagaagcaagcacgcccacgugauccagaaccaguucugccaccugugcaaggugaccgugaacaagaagaccaagcacugcaucagcugcaacaagugcgugagcggcuucgaccaccacugcaaguggaucaacaacugcgugggcagcagaaacuacugguucuucuucagcaccguggccagcgccaccgccggcaugcugugccugaucgccauccugcuguacgugcuggugcaguaccuggugaaccccggcgugcugagaaccgaccccagauacgaggacgugaagaacaugaacaccuggcugcuguuccugccccuguuccccgugcaggugcagacccugaucguggugaucaucggcaugcuggugcugcugcuggacuuccugggccuggugcaccugggccagcugcugaucuuccacaucuaccugaaggccaagaagaugaccaccuucgaguaccugaucaacaacagaaaggaggagagcagcaagcaccaggccgugagaaaggaccccuacgugcagauggacaagggcgugcugcagcagggcgccggcgcccugggcagcagcgcccagggcgugaaggccaagagcagccugcugauccacaagcaccugugccacuucugcaccagcgugaaccaggacggcgacagcaccgccagagagggcgacgaggaccccugccccagcgcccugggcgccaaggccagaaacagcagacugaucugcagaagacugugccaguucagcaccagagugcaccccgacggcggcagcauggcccaggaggccgacgacgcccccagcaucagcacccugggccugcagcaggagaccaccgagcccaugaagaccgacagcgccgagagcgaggacuaa

SEQ ID NO: 25841 - RNA, 804 nt, Artificial Sequence
  ZDHHC12__Homo_sapiens__NP_116188
auggcccccugggcccugcugagccccggcgugcuggugagaaccggccacaccgugcugaccuggggcaucacccuggugcuguuccugcacgacaccgagcugagacagugggaggagcagggcgagcugcugcugccccugaccuuccugcugcuggugcugggcagccugcugcuguaccuggccgugagccugauggaccccggcuacgugaacgugcagccccagccccaggaggagcugaaggaggagcagaccgccauggugccccccgccaucccccugagaagaugcagauacugccuggugcugcagccccugagagccagacacugcagagagugcagaagaugcgugagaagauacgaccaccacugccccuggauggagaacugcgugggcgagagaaaccacccccuguucgugguguaccuggcccugcagcugguggugcugcuguggggccuguaccuggccuggagcggccugagauucuuccagcccuggggccuguggcugagaagcagcggccugcuguucgccaccuuccugcugcugagccuguucagccugguggccagccugcugcuggugagccaccuguaccugguggccagcaacaccaccaccugggaguucaucagcagccacagaaucgccuaccugagacagagacccagcaaccccuucgacagaggccugaccagaaaccuggcccacuucuucugcggcuggcccagcggcagcugggagacccugugggccgaggaggaggaggagggcagcagccccgccguguaa

SEQ ID NO: 25842 - RNA, 1479 nt, Artificial Sequence
  ZDHHC13__Homo_sapiens__NP_001001483
auggugauccugcugcugcagcacggcgccgaccccacccugaucgacggcgagggcuucagcagcauccaccuggccgugcuguuccagcacaugcccaucaucgccuaccugaucagcaagggccagagcgugaacaugaccgacgugaacggccagaccccccugaugcugagcgcccacaaggugaucggccccgagcccaccggcuuccugcugaaguucaaccccagccugaacgugguggacaagauccaccagaacaccccccugcacugggccguggccgccggcaacgugaacgccguggacaagcugcuggaggccggcagcagccuggacauccagaacgugaagggcgagaccccccuggacauggcccugcagaacaagaaccagcugaucauccacaugcugaagaccgaggccaagaugagagccaaccagaaguucagacuguggagauggcugcagaagugcgagcuguuccugcugcugaugcugagcgugaucaccaugugggccaucggcuacauccuggacuucaacagcgacagcuggcugcugaagggcugccugcuggugacccuguucuuccugaccagccuguuccccagauuccuggugggcuacaagaaccugguguaccugcccaccgccuuccugcugagcagcguguucuggaucuucaugaccugguucauccuguucuuccccgaccuggccggcgcccccuucuacuucagcuucaucuucagcaucguggccuuccuguacuucuucuacaagaccugggccaccgaccccggcuucaccaaggccagcgaggaggagaagaaggugaacaucaucacccuggccgagaccggcagccuggacuucagaaccuucugcaccagcugccugaucagaaagccccugagaagccugcacugccacgugugcaacugcugcguggccagauacgaccagcacugccuguggaccggcagaugcaucggcuucggcaaccaccacuacuacaucuucuuccuguucuuccugagcauggugugcggcuggaucaucuacggcagcuucaucuaccugagcagccacugcgccaccaccuucaaggaggacggccuguggaccuaccugaaccagaucguggccugcagccccugggugcuguacauccugaugcuggccaccuuccacuucagcuggagcaccuuccugcugcugaaccagcuguuccagaucgccuuccugggccugaccagccacgagagaaucagccugcagaagcagagcaagcacaugaagcagacccugagccugagaaagacccccuacaaccugggcuucaugcagaaccuggccgacuucuuccagugcggcugcuucggccuggugaagcccugcgugguggacuggaccagccaguacaccaugguguuccaccccgccagagagaaggugcugagaagcguguaa

SEQ ID NO: 25843 - RNA, 1467 nt, Artificial Sequence
  ZDHHC14__Homo_sapiens__NP_078906
augccccccggcggcggcggccccaugaaggacugcgaguacagccagaucagcacccacagcagcagccccauggagagcccccacaagaagaagaagaucgccgccagaagaaagugggagguguuccccggcagaaacaaguucuucugcaacggcagaaucaugauggccagacagaccggcguguucuaccugacccuggugcugauccuggugaccagcggccuguucuucgccuucgacugccccuaccuggccgugaagaucacccccgccauccccgccguggccggcauccuguucuucuucgugaugggcacccugcugagaaccagcuucagcgaccccggcgugcugcccagagccacccccgacgaggccgccgaccuggagagacagaucgacaucgccaacggcaccagcagcggcggcuacagacccccccccagaaccaaggaggugaucaucaacggccagaccgugaagcugaaguacugcuucaccugcaagaucuucagaccccccagagccagccacugcagccugugcgacaacugcguggagagauucgaccaccacugccccugggugggcaacugcgugggcaagagaaacuacagauucuucuacauguucauccugagccugagcuuccugaccguguucaucuucgccuucgugaucacccacgugauccugagaagccagcagaccggcuuccugaacgcccugaaggacagccccgccagcgugcuggaggccguggugugcuucuucagcguguggagcaucgugggccugagcggcuuccacaccuaccugaucagcagcaaccagaccaccaacgaggacaucaagggcagcuggagcaacaagagaggcaaggagaacuacaaccccuacagcuacggcaacaucuucaccaacugcugcguggcccugugcggccccaucagccccagccugaucgacagaagaggcuacauccagcccgacaccccccagcccgccgcccccagcaacggcaucaccauguacggcgccacccagagccagagcgacaugugcgaccaggaccagugcauccagagcaccaaguucgugcugcaggccgccgccaccccccugcugcagagcgagcccagccugaccagcgacgagcugcaccugcccggcaagcccggccugggcacccccugcgccagccugacccugggcccccccaccccccccgccagcaugcccaaccuggccgaggccacccuggccgacgugaugcccagaaaggacgagcacaugggccaccaguuccugacccccgacgaggcccccagcccccccagacugcuggccgccggcagcccccuggcccacagcagaaccaugcacgugcugggccuggccagccaggacagccugcacgaggacagcgugagaggccuggugaagcugagcagcguguaa

SEQ ID NO: 25844 - RNA, 987 nt, Artificial Sequence
  ZDHHC15__Homo_sapiens__NP_001139728
augagaagaggcuggaagauggcccugagcggcggccugagaugcugcagaagagugcugagcugggugcccgugcuggugaucgugcugguggugcuguggagcuacuacgccuacguguucgagcugugccuggugaucuaccugauccuguaccacgccaucuucguguucuucaccuggaccuacuggaagagcaucuucacccugccccagcagcccaaccagaaguuccaccugagcuacaccgacaaggagagauacgagaacgaggagagacccgaggugcagaagcagaugcugguggacauggccaagaagcugcccguguacaccagaaccggcagcggcgccgugagauucugcgacagaugccaccugaucaagcccgacagaugccaccacugcagcgugugcgccaugugcgugcugaagauggaccaccacugccccugggugaacaacugcaucggcuucagcaacuacaaguucuuccugcaguuccuggccuacagcgugcuguacugccuguacaucgccaccaccguguucagcuacuucaucaaguacuggagaggcgagcugcccagcgugagaagcaaguuccacgugcuguuccugcuguucguggccugcauguucuucgugagccuggugauccuguucggcuaccacugcuggcuggugagcagaaacaagaccacccuggaggccuucugcacccccguguucaccagcggccccgagaagaacggcuucaaccugggcuucaucaagaacauccagcagguguucggcgacaagaagaaguucuggcugauccccaucggcagcagccccggcgacggccacagcuuccccaugagaagcaugaacgagagccagaacccccugcuggccaacgaggagaccugggaggacaacgaggacgacaaccaggacuaccccgagggcagcagcagccuggccguggagaccgagaccuaa

SEQ ID NO: 25845 - RNA, 1899 nt, Artificial Sequence
  ZDHHC17__Homo_sapiens__NP_056151
augcagagagaggagggcuucaacaccaagauggccgacggccccgacgaguacgacaccgaggccggcugcgugccccugcugcaccccgaggagaucaagccccagagccacuacaaccacggcuacggcgagccccugggcagaaagacccacaucgacgacuacagcaccugggacaucgugaaggccacccaguacggcaucuacgagagaugcagagagcugguggaggccggcuacgacgugagacagcccgacaaggagaacgugacccugcugcacugggccgccaucaacaacagaaucgaccuggugaaguacuacaucagcaagggcgccaucguggaccagcugggcggcgaccugaacagcaccccccugcacugggccaccagacagggccaccugagcaugguggugcagcugaugaaguacggcgccgaccccagccugaucgacggcgagggcugcagcugcauccaccuggccgcccaguucggccacaccagcaucguggccuaccugaucgccaagggccaggacguggacaugauggaccagaacggcaugaccccccugaugugggccgccuacagaacccacagcguggaccccaccagacugcugcugaccuucaacgugagcgugaaccugggcgacaaguaccacaagaacaccgcccugcacugggccgugcuggccggcaacaccaccgugaucagccugcugcuggaggccggcgccaacguggacgcccagaacaucaagggcgagagcgcccuggaccuggccaagcagagaaagaacguguggaugaucaaccaccugcaggaggccagacaggccaagggcuacgacaaccccagcuuccugagaaagcugaaggccgacaaggaguucagacagaaggugaugcugggcacccccuuccuggugaucuggcuggugggcuucaucgccgaccugaacaucgacagcuggcugaucaagggccugauguacggcggcgugugggccaccgugcaguuccugagcaagagcuucuucgaccacagcaugcacagcgcccugccccugggcaucuaccuggccaccaaguucuggauguacgugaccugguucuucugguucuggaacgaccugaacuuccuguucauccaccugcccuuccuggccaacagcguggcccuguucuacaacuucggcaagagcuggaagagcgaccccggcaucaucaaggccaccgaggagcagaagaagaagaccaucguggagcuggccgagaccggcagccuggaccugagcaucuucugcagcaccugccugaucagaaagcccgugagaagcaagcacugcggcgugugcaacagaugcaucgccaaguucgaccaccacugccccugggugggcaacugcgugggcgccggcaaccacagauacuucaugggcuaccuguucuuccugcuguucaugaucugcuggaugaucuacggcugcaucagcuacuggggccugcacugcgagaccaccuacaccaaggacggcuucuggaccuacaucacccagaucgccaccugcagccccuggauguucuggauguuccugaacagcguguuccacuucauguggguggccgugcugcugaugugccagauguaccagaucagcugccugggcaucaccaccaacgagagaaugaacgccagaagauacaagcacuucaaggugaccaccaccagcaucgagagccccuucaaccacggcugcgugagaaacaucaucgacuucuucgaguucagaugcugcggccuguucagacccgugaucguggacuggaccagacaguacaccaucgaguacgaccagaucagcggcagcggcuaccagcugguguaa

SEQ ID NO: 25846 - RNA, 1458 nt, Artificial Sequence
  ZDHHC1__Homo_sapiens__NP_037436
auguacaagaugaacaucugcaacaagcccagcaacaagaccgcccccgagaagagcguguggaccgcccccgcccagcccagcggccccagccccgagcugcagggccagagaagcagaagaaacggcuggagcuggcccccccacccccugcagaucguggccuggcugcuguaccuguucuucgccgugaucggcuucggcauccuggugccccugcugccccaccacugggugcccgccggcuacgccugcaugggcgccaucuucgccggccaccugguggugcaccugaccgccgugagcaucgaccccgccgacgccaacgugagagacaagagcuacgccggcccccugcccaucuucaacagaagccagcacgcccacgugaucgaggaccugcacugcaaccugugcaacguggacgugagcgccagaagcaagcacugcagcgccugcaacaagugcgugugcggcuucgaccaccacugcaaguggcugaacaacugcgugggcgagagaaacuacagacuguuccugcacagcguggccagcgcccugcugggcgugcugcugcuggugcugguggccaccuacguguucguggaguucuucgugaaccccaugagacugagaaccaacagacacuucgaggugcugaagaaccacaccgacgugugguucguguuccugcccgccgcccccguggagacccaggcccccgccauccuggcccuggccgcccugcugauccugcugggccugcugagcaccgcccugcugggccaccugcugugcuuccacaucuaccugauguggcacaagcugaccaccuacgaguacaucgugcagcacagacccccccaggaggccaagggcgugcacagagagcuggagagcugcccccccaagaugagacccauccaggagauggaguucuacaugagaaccuucagacacaugagacccgagccccccggccaggccggccccgccgccgugaacgccaagcacagcagacccgccagccccgaccccacccccggcagaagagacugcgccggcccccccgugcagguggagugggacagaaagaagccccugcccuggagaagcccccugcugcugcuggccauguggggcccccaggccccccccugccugugcagaaagagaggcagaggcgccugcaucaagugcgagagacugagacccagaaucagaagaagaggccugggcccccccgccgccgcccccgccagaagaagaauccccagaacccccgcccugugcaccccccuggcccugcccgcccccaccaccagaagaagacagagccccuggaccagauuccaguggagaagaagagccugggccgccccccuguggccccccagaggcgccggcgccgacagccccagauggagaggcagaagagugagaccccccuucagcuaa

SEQ ID NO: 25847 - RNA, 1104 nt, Artificial Sequence
  ZDHHC2__Homo_sapiens__NP_057437
auggcccccagcggccccggcagcagcgccagaagaagaugcagaagagugcuguacuggauccccgugguguucaucacccugcugcugggcuggagcuacuacgccuacgccauccagcugugcaucgugagcauggagaacaccggcgagcagguggugugccugauggccuaccaccugcuguucgccauguucguguggagcuacuggaagaccaucuucacccugcccaugaaccccagcaaggaguuccaccugagcuacgccgagaaggaccugcuggagagagagcccagaggcgaggcccaccaggaggugcugagaagagccgccaaggaccugcccaucuacaccagaaccaugagcggcgccaucagauacugcgacagaugccagcugaucaagcccgacagaugccaccacugcagcgugugcgacaagugcauccugaagauggaccaccacugccccugggugaacaacugcgugggcuucagcaacuacaaguucuuccugcuguuccuggccuacagccugcuguacugccuguucaucgccgccaccgaccugcaguacuucaucaaguucuggaccaacggccugcccgacacccaggccaaguuccacaucauguuccuguucuucgccgccgccauguucagcgugagccugagcagccuguucggcuaccacugcuggcuggugagcaagaacaagagcacccuggaggccuucagaagccccguguucagacacggcaccgacaagaacggcuucagccugggcuucagcaagaacaugagacagguguucggcgacgagaagaaguacuggcugcugcccaucuucagcagccugggcgacggcugcagcuuccccaccugccuggugaaccaggaccccgagcaggccagcacccccgccggccugaacagcaccgccaagaaccuggagaaccaccaguuccccgccaagccccugagagagagccagagccaccugcugaccgacagccagagcuggaccgagagcagcaucaaccccggcaagugcaaggccggcaugagcaaccccgcccugaccauggagaacgagaccuaa

SEQ ID NO: 25848 - RNA, 1038 nt, Artificial Sequence
  ZDHHC7__Homo_sapiens__NP_001139020
augcagcccagcggccacagacugagagacguggagcaccacccccugcuggccgagaacgacaacuacgacagcagcagcagcagcagcagcgaggccgacguggccgacagagugugguucaucagagacggcugcggcaugaucugcgccgugaugaccuggcugcugguggccuacgccgacuucguggugaccuucgugaugcugcugcccagcaaggacuucugguacagcguggugaacggcgugaucuucaacugccuggccgugcuggcccugagcagccaccugagaaccaugcugaccgaccccgagaagagcagcgacugcagacccagcgccugcaccgugaagaccggccuggaccccacccuggugggcaucugcggcgagggcaccgagagcgugcagagccugcugcugggcgccgugcccaagggcaacgccaccaaggaguacauggagagccugcagcugaagcccggcgaggugaucuacaagugccccaagugcugcugcaucaagcccgagagagcccaccacugcagcaucugcaagagaugcaucagaaagauggaccaccacugccccugggugaacaacugcgugggcgagaagaaccagagauucuucgugcuguucaccauguacaucgcccugagcagcgugcacgcccugauccugugcggcuuccaguucaucagcugcgugagaggccaguggaccgagugcagcgacuucagcccccccaucaccgugauccugcugaucuuccugugccuggagggccugcuguucuucaccuucaccgccgugauguucggcacccagauccacagcaucugcaacgacgagaccgagaucgagagacugaagagcgagaagcccaccugggagagaagacugagaugggagggcaugaagagcguguucggcggcccccccagccugcuguggaugaaccccuucgugggcuucagauucagaagacugcccaccagacccagaaagggcggccccgaguucagcguguaa

SEQ ID NO: 25849 - RNA, 2298 nt, Artificial Sequence
  ZDHHC8__Homo_sapiens__NP_037505
augcccagaagccccggcaccagacugaagcccgccaaguacauccccguggccaccgccgccgcccugcuggugggcagcagcacccuguucuucguguucaccugccccuggcugaccagagccgugagccccgccgugcccguguacaacggcaucaucuuccuguucgugcuggccaacuucagcauggccaccuucauggaccccggcguguuccccagagccgacgaggacgaggacaaggaggacgacuucagagccccccuguacaagaacguggacgugagaggcauccaggugagaaugaaguggugcgccaccugccacuucuacagaccccccagaugcagccacugcagcgugugcgacaacugcguggaggacuucgaccaccacugccccugggugaacaacugcaucggcagaagaaacuacagauacuucuuccuguuccugcugagccugagcgcccacauggugggcgugguggccuucggccugguguacgugcugaaccacgccgagggccugggcgccgcccacaccaccaucaccauggccgugaugugcguggccggccuguucuucauccccgugaucggccugaccggcuuccacguggugcuggugaccagaggcagaaccaccaacgagcaggugaccggcaaguucagaggcggcgugaaccccuucaccagaggcugcugcggcaacguggagcacgugcugugcagcccccuggcccccagauacgugguggagccccccagacugccccuggccgugagccugaagccccccuuccugagacccgagcugcuggacagagccgccccccugaaggugaagcugagcgacaacggccugaaggccggccugggcagaagcaagagcaagggcagccuggacagacuggacgagaagccccuggaccugggccccccccugccccccaagaucgaggccggcaccuucagcagcgaccugcagacccccagacccggcagcgccgagagcgcccugagcgugcagagaaccagcccccccacccccgccauguacaaguucagacccgccuuccccaccggccccaaggugcccuucugcggccccggcgagcaggugcccggccccgacagccugacccugggcgacgacagcaucagaagccuggacuucgugagcgagcccagccuggaccugcccgacuacggccccggcggccugcacgccgccuacccccccagccccccccugagcgccagcgacgccuucagcggcgcccugagaagccugagccugaaggccagcagcagaagaggcggcgaccacguggcccugcagccccugagaagcgagggcggcccccccaccccccacagaagcaucuucgccccccacgcccugcccaacagaaacggcagccugagcuacgacagccugcugaaccccggcagccccggcggccacgccugccccgcccaccccgccgugggcguggccggcuaccacagccccuaccugcaccccggcgccaccggcgacccccccagaccccugcccagaagcuucagccccgugcugggccccagacccagagagcccagccccgugagauacgacaaccugagcagaaccaucauggccagcauccaggagagaaaggacagagaggagagagagagacugcugagaagccaggccgacagccuguucggcgacagcggcguguacgacgcccccagcagcuacagccugcagcaggccagcgugcugagcgagggccccagaggccccgcccugagauacggcagcagagacgaccugguggccggccccggcuucggcggcgccagaaaccccgcccugcagaccagccugagcagccugagcagcagcgugagcagagcccccagaaccagcagcagcagccugcaggccgaccaggccagcagcaacgcccccggccccagacccagcagcggcagccacagaagccccgccagacagggccugcccagcccccccggcaccccccacagccccagcuacgccggccccaaggccguggccuucauccacaccgaccugcccgagcccccccccagccugaccgugcagagagaccacccccagcugaagaccccccccagcaagcugaacggccagagccccggccuggccagacugggccccgccaccggcccccccggccccagcgccagccccaccagacacacccuggugaagaaggugagcggcgugggcggcaccaccuacgagaucagcguguaa

SEQ ID NO: 25850 - RNA, 1095 nt, Artificial Sequence
  ZDHHC9__Homo_sapiens__NP_001008223
augagcgugaugguggugagaaagaaggugaccagaaagugggagaagcugcccggcagaaacaccuucugcugcgacggcagagugaugauggccagacagaagggcaucuucuaccugacccuguuccugauccugggcaccugcacccuguucuucgccuucgagugcagauaccuggccgugcagcugagccccgccauccccguguucgccgccaugcuguuccuguucagcauggccacccugcugagaaccagcuucagcgaccccggcgugauccccagagcccugcccgacgaggccgccuucaucgagauggagaucgaggccaccaacggcgccgugccccagggccagagacccccccccagaaucaagaacuuccagaucaacaaccagaucgugaagcugaaguacugcuacaccugcaagaucuucagaccccccagagccagccacugcagcaucugcgacaacugcguggagagauucgaccaccacugccccugggugggcaacugcgugggcaagagaaacuacagauacuucuaccuguucauccugagccugagccugcugaccaucuacguguucgccuucaacaucguguacguggcccugaagagccugaagaucggcuuccuggagacccugaaggagacccccggcaccgugcuggaggugcugaucugcuucuucacccuguggagcguggugggccugaccggcuuccacaccuuccugguggcccugaaccagaccaccaacgaggacaucaagggcagcuggaccggcaagaacagagugcagaaccccuacagccacggcaacaucgugaagaacugcugcgaggugcugugcggcccccugccccccagcgugcuggacagaagaggcauccugccccuggaggagagcggcagcagaccccccagcacccaggagaccagcagcagccugcugccccagagccccgcccccaccgagcaccugaacagcaacgagaugcccgaggacagcagcacccccgaggagaugcccccccccgagccccccgagcccccccaggaggccgccgaggccgagaaguaa

SEQ ID NO: 25851 - RNA, 3327 nt, Artificial Sequence
  ZEB1__Homo_sapiens__NP_001121600
augaaggugaccaacuacaacaccgugguggagaccaacagcgacagcgacgacgaggacaagcugcacaucguggaggaggagagcgugaccgacgccgccgacugcgagggcgugcccgaggacgaccugcccaccgaccagaccgugcugcccggcagaagcagcgagagagagggcaacgccaagaacugcugggaggacgacaccggcaaggagggccaggagauccugggccccgaggcccaggccgacgaggccggcugcaccgugaaggacgacgagugcgagagcgacgccgagaacgagcagaaccacgaccccaacguggaggaguuccugcagcagcaggacaccgccgugaucuuccccgaggcccccgaggaggaccagagacagggcacccccgaggccagcggccacgacgagaacggcacccccgacgccuucagccagcugcugaccugccccuacugcgacagaggcuacaagagauucaccagccugaaggagcacaucaaguacagacacgagaagaacgaggacaacuucagcugcagccugugcagcuacaccuucgccuacagaacccagcuggagagacacaugaccagccacaagagcggcagagaccagagacacgugacccagagcggcugcaacagaaaguucaagugcaccgagugcggcaaggccuucaaguacaagcaccaccugaaggagcaccugagaauccacagcggcgagaagcccuacgagugccccaacugcaagaagagauucagccacagcggcagcuacagcagccacaucagcagcaagaagugcaucagccugauccccgugaacggcagacccagaaccggccugaagaccagccagugcagcagccccagccugagcgccagccccggcagccccaccagaccccagaucagacagaagaucgagaacaagccccugcaggagcagcugagcgugaaccagaucaagaccgagcccguggacuacgaguucaagcccaucgugguggccagcggcaucaacugcagcaccccccugcagaacggcguguucaccggcggcggcccccugcaggccaccagcagcccccagggcauggugcaggccguggugcugcccaccgugggccuggugagccccaucagcaucaaccugagcgacauccagaacgugcugaagguggccguggacggcaacgugaucagacaggugcuggagaacaaccaggccaaccuggccagcaaggagcaggagaccaucaacgccagccccauccagcagggcggccacagcgugaucagcgccaucagccugccccugguggaccaggacggcaccaccaagaucaucaucaacuacagccuggagcagcccagccagcugcagguggugccccagaaccugaagaaggagaaccccguggccaccaacagcugcaagagcgagaagcugcccgaggaccugaccgugaagagcgagaaggacaagagcuucgagggcggcgugaacgacagcaccugccugcugugcgacgacugccccggcgacaucaacgcccugcccgagcugaagcacuacgaccugaagcagcccacccagccccccccccugcccgccgccgaggccgagaagcccgagagcagcgugagcagcgccaccggcgacggcaaccugagccccagccagcccccccugaagaaccugcugagccugcugaaggccuacuacgcccugaacgcccagcccagcgccgaggagcugagcaagaucgccgacagcgugaaccugccccuggacguggugaagaagugguucgagaagaugcaggccggccagaucagcgugcagagcagcgagcccagcagccccgagcccggcaaggugaacauccccgccaagaacaacgaccagccccagagcgccaacgccaacgagccccaggacagcaccgugaaccugcagagcccccugaagaugaccaacagccccgugcugcccgugggcagcaccaccaacggcagcagaagcagcacccccagccccagcccccugaaccugagcagcagcagaaacacccagggcuaccuguacaccgccgagggcgcccaggaggagccccagguggagccccuggaccugagccugcccaagcagcagggcgagcugcuggagagaagcaccaucaccagcguguaccagaacagcguguacagcgugcaggaggagccccugaaccugagcugcgccaagaaggagccccagaaggacagcugcgugaccgacagcgagcccguggugaacgugaucccccccagcgccaaccccaucaacaucgccauccccaccgugaccgcccagcugcccaccaucguggccaucgccgaccagaacagcgugcccugccugagagcccuggccgccaacaagcagaccauccugaucccccagguggccuacaccuacagcaccaccgugagccccgccgugcaggagcccccccugaaggugauccagcccaacggcaaccaggacgagagacaggacaccagcagcgagggcgugagcaacguggaggaccagaacgacagcgacagcaccccccccaagaagaagaugagaaagaccgagaacggcauguacgccugcgaccugugcgacaagaucuuccagaagagcagcagccugcugagacacaaguacgagcacaccggcaagagaccccacgagugcggcaucugcaagaaggccuucaagcacaagcaccaccugaucgagcacaugagacugcacagcggcgagaagcccuaccagugcgacaagugcggcaagagauucagccacagcggcagcuacagccagcacaugaaccacagauacagcuacugcaagagagaggccgaggagagagacagcaccgagcaggaggaggccggccccgagauccugagcaacgagcacgugggcgccagagccagccccagccagggcgacagcgacgagagagagagccugaccagagaggaggacgaggacagcgagaaggaggaggaggaggaggacaaggagauggaggagcugcaggaggagaaggagugcgagaagccccagggcgacgaggaggaggaggaggaggaggaggagguggaggaggaggagguggaggaggccgagaacgagggcgaggaggccaagaccgagggccugaugaaggacgacagagccgagagccaggccagcagccugggccagaaggugggcgagagcagcgagcaggugagcgaggagaagaccaacgaggccuaa

SEQ ID NO: 25852 - RNA, 3573 nt, Artificial Sequence
  ZEB2__Homo_sapiens__NP_001165124
augaagcagcccaucauggccgacggccccagaugcaagagaagaaagcaggccaaccccagaagaaagaacguggugaacuacgacaacgugguggacaccggcagcgagaccgacgaggaggacaagcugcacaucgccgaggacgacggcaucgccaacccccuggaccaggagaccagccccgccagcgugcccaaccacgagagcagcccccacgugagccaggcccugcugcccagagaggaggaggaggacgagaucagagagggcggcguggagcaccccuggcacaacaacgagauccugcaggccagcguggacggccccgugaagaacgccaacugcaccagcgacuucgaggaguacuucgccaagagaaagcuggaggagagagacggccacgccgugagcaucgaggaguaccugcagagaagcgacaccgccaucaucuaccccgaggcccccgaggagcugagcagacugggcacccccgaggccaacggccaggaggagaacgaccugccccccggcacccccgacgccuucgcccagcugcugaccugccccuacugcgacagaggcuacaagagacugaccagccugaaggagcacaucaaguacagacacgagaagaacgaggagaacuucagcugcccccugugcagcuacaccuucgccuacagaacccagcuggagagacacauggugacccacaagcccggcaccgaccagcaccagaugcugacccagggcgccggcaacagaaaguucaagugcaccgagugcggcaaggccuucaaguacaagcaccaccugaaggagcaccugagaauccacagcggcgagaagcccuacgagugccccaacugcaagaagagauucagccacagcggcagcuacagcagccacaucagcagcaagaagugcaucggccugaucagcgugaacggcagaaugagaaacaacaucaagaccggcagcagccccaacagcgugagcagcagccccaccaacagcgccaucacccagcugagaaacaagcuggagaacggcaagccccugagcaugagcgagcagaccggccugcugaagaucaagaccgagccccuggacuucaacgacuacaaggugcugauggccacccacggcuucagcggcaccagccccuucaugaacggcggccugggcgccaccagcccccugggcgugcaccccagcgcccagagccccaugcagcaccugggcgugggcauggaggccccccugcugggcuuccccaccaugaacagcaaccugagcgaggugcagaaggugcugcagaucguggacaacaccgugagcagacagaagauggacugcaaggccgaggagaucagcaagcugaagggcuaccacaugaaggaccccugcagccagcccgaggagcagggcgugaccagccccaacaucccccccgugggccugcccguggugagccacaacggcgccaccaagagcaucaucgacuacacccuggagaaggugaacgaggccaaggccugccugcagagccugaccaccgacagcagaagacagaucagcaacaucaagaaggagaagcugagaacccugaucgaccuggugaccgacgacaagaugaucgagaaccacaacaucagcacccccuucagcugccaguucugcaaggagagcuuccccggccccaucccccugcaccagcacgagagauaccugugcaagaugaacgaggagaucaaggccgugcugcagccccacgagaacaucgugcccaacaaggccggcguguucguggacaacaaggcccugcugcugagcagcgugcugagcgagaagggcaugaccagccccaucaaccccuacaaggaccacaugagcgugcugaaggccuacuacgccaugaacauggagcccaacagcgacgagcugcugaagaucagcaucgccgugggccugccccaggaguucgugaaggagugguucgagcagagaaagguguaccaguacagcaacagcagaagccccagccuggagagaagcagcaagccccuggcccccaacagcaacccccccaccaaggacagccugcugcccagaagccccgugaagcccauggacagcaucaccagccccagcaucgccgagcugcacaacagcgugaccaacugcgaccccccccugagacugaccaagcccagccacuucaccaacaucaagcccguggagaagcuggaccacagcagaagcaacacccccagcccccugaaccugagcagcaccagcagcaagaacagccacagcagcagcuacacccccaacagcuucagcagcgaggagcugcaggccgagccccuggaccugagccugcccaagcagaugaaggagcccaagagcaucaucgccaccaagaacaagaccaaggccagcagcaucagccuggaccacaacagcgugagcagcagcagcgagaacagcgacgagccccugaaccugaccuucaucaagaaggaguucagcaacagcaacaaccuggacaacaagagcaccaaccccguguucagcaugaaccccuucagcgccaagccccuguacaccgcccugcccccccagagcgccuucccccccgccaccuucaugccccccgugcagaccagcauccccggccugagacccuaccccggccuggaccagaugagcuuccugccccacauggccuacaccuaccccaccggcgccgccaccuucgccgacaugcagcagagaagaaaguaccagagaaagcagggcuuccagggcgagcugcuggacggcgcccaggacuacaugagcggccuggacgacaugaccgacagcgacagcugccugagcagaaagaagaucaagaagaccgagagcggcauguacgccugcgaccugugcgacaagaccuuccagaagagcagcagccugcugagacacaaguacgagcacaccggcaagagaccccaccagugccagaucugcaagaaggccuucaagcacaagcaccaccugaucgagcacagcagacugcacagcggcgagaagcccuaccagugcgacaagugcggcaagagauucagccacagcggcagcuacagccagcacaugaaccacagauacagcuacugcaagagagaggccgaggagagagaggccgccgagagagaggccagagagaagggccaccuggagcccaccgagcugcugaugaacagagccuaccugcagagcaucaccccccagggcuacagcgacagcgaggagagagagagcaugcccagagacggcgagagcgagaaggagcacgagaaggagggcgaggacggcuacggcaagcugggcagacaggacggcgacgaggaguucgaggaggaggaggaggagagcgagaacaagagcauggacaccgaccccgagaccaucagagacgaggaggagaccggcgaccacagcauggacgacagcagcgaggacggcaagauggagaccaagagcgaccacgaggaggacaacauggaggacggcauguaa

SEQ ID NO: 25853 - RNA, 684 nt, Artificial Sequence
  ZFAND3__Homo_sapiens__NP_068762
augggcgacgccggcagcgagagaagcaaggcccccagccugccccccagaugccccugcggcuucuggggcagcagcaagaccaugaaccugugcagcaagugcuucgccgacuuccagaagaagcagcccgacgacgacagcgcccccagcaccagcaacagccagagcgaccuguucagcgaggagaccaccagcgacaacaacaacaccagcaucaccacccccacccugagccccagccagcagccccugcccaccgagcugaacgugaccagccccagcaaggaggagugcggccccugcaccgacaccgcccacgugagccugaucacccccaccaagagaagcugcggcaccgacagccagagcgagaacgaggccagccccgugaagagacccagacugcuggagaacaccgagagaagcgaggagaccagcagaagcaagcagaagagcagaagaagaugcuuccagugccagaccaagcuggagcuggugcagcaggagcugggcagcugcagaugcggcuacguguucugcaugcugcacagacugcccgagcagcacgacugcaccuucgaccacaugggcagaggcagagaggaggccaucaugaagauggugaagcuggacagaaaggugggcagaagcugccagagaaucggcgagggcugcagcuaa

SEQ ID NO: 25854 - RNA, 642 nt, Artificial Sequence
  ZFAND5__Homo_sapiens__NP_001095891
auggcccaggagaccaaccagacccccggccccaugcugugcagcaccggcugcggcuucuacggcaaccccagaaccaacggcaugugcagcgugugcuacaaggagcaccugcagagacagcagaacagcggcagaaugagccccaugggcaccgccagcggcagcaacagccccaccagcgacagcgccagcgugcagagagccgacaccagccugaacaacugcgagggcgccgccggcagcaccagcgagaagagcagaaacgugcccguggccgcccugcccgugacccagcagaugaccgagaugagcaucagcagagaggacaagaucaccacccccaagaccgaggugagcgagcccguggugacccagcccagccccagcgugagccagcccagcaccagccagagcgaggagaaggcccccgagcugcccaagcccaagaagaacagaugcuucaugugcagaaagaaggugggccugaccggcuucgacugcagaugcggcaaccuguucugcggccugcacagauacagcgacaagcacaacugccccuacgacuacaaggccgaggccgccgccaagaucagaaaggagaaccccguggugguggccgagaagauccagagaaucuaa

SEQ ID NO: 25855 - RNA, 591 nt, Artificial Sequence
  ZFAND6__Homo_sapiens__NP_001229846
auggcccaggagaccaaccacagccaggugcccaugcugugcagcaccggcugcggcuucuacggcaaccccagaaccaacggcaugugcagcgugugcuacaaggagcaccugcagagacagaacagcagcaacggcagaaucagcccccccgugcagugcaccgacggcagcgugcccgaggcccagagcgcccuggacagcaccagcagcagcaugcagcccagccccgugagcaaccagagccugcugagcgagagcguggccagcagccagcuggacagcaccagcguggacaaggccgugcccgagaccgaggacgugcaggccagcgugagcgacaccgcccagcagcccagcgaggagcagagcaagagccuggagaagcccaagcagaagaagaacagaugcuucaugugcagaaagaaggugggccugaccggcuucgagugcagaugcggcaacguguacugcggcgugcacagauacagcgacgugcacaacugcagcuacaacuacaaggccgacgccgccgagaagaucagaaaggagaaccccgugguggugggcgagaagauccagaagaucuaa

SEQ ID NO: 25856 - RNA, 3696 nt, Artificial Sequence
  ZFAT__Homo_sapiens__NP_001025110
augugcaagugcugcaaccuguucagccccaaccagagcgagcugcugagccacgugagcgagaagcacauggaggagggcgugaacguggacgagaucaucaucccccugagaccccugagcacccccgagccccccaacagcagcaagaccggcgacgaguuccuggugaugaagagaaagagaggcagacccaagggcagcaccaagaagagcagcaccgaggaggagcuggccgagaacaucgugagccccaccgaggacagcccccuggcccccgaggagggcaacagccugccccccagcagccuggagugcagcaagugcugcagaaaguucagcaacaccagacagcugagaaagcacaucugcaucaucgugcugaaccugggcgaggaggagggcgaggccggcaacgagagcgaccuggagcuggagaagaagugcaaggaggacgacagagagaaggccagcaagagacccagaagccagaagaccgagaaggugcagaagaucagcggcaaggaggccagacagcugagcggcgccaagaagcccaucaucagcguggugcugaccgcccacgaggccauccccggcgccaccaagaucgugcccguggaggccggcccccccgagaccggcgccaccaacagcgagaccaccagcgccgaccuggugcccagaagaggcuaccaggaguacgccauccagcagacccccuacgagcagcccaugaagagcagcagacugggccccacccagcugaagaucuucaccugcgaguacugcaacaagguguucaaguucaagcacagccugcaggcccaccugagaauccacaccaacgagaagcccuacaagugcccccagugcagcuacgccagcgccaucaaggccaaccugaacgugcaccugagaaagcacaccggcgagaaguucgccugcgacuacugcagcuucaccugccugagcaagggccaccugaaggugcacaucgagagagugcacaagaagaucaagcagcacugcagauucugcaagaagaaguacagcgacgugaagaaccugaucaagcacaucagagacgcccacgacccccaggacaagaaggugaaggaggcccuggacgagcugugccugaugaccagagagggcaagagacagcugcuguacgacugccacaucugcgagagaaaguucaagaacgagcuggacagagacagacacaugcuggugcacggcgacaaguggcccuucgccugcgagcugugcggccacggcgccaccaaguaccaggcccuggagcugcacgugagaaagcaccccuucguguacgugugcgccgugugcagaaagaaguucgugagcagcaucagacugagaacccacaucaaggaggugcacggcgccgcccaggaggcccugguguucaccagcagcaucaaccagagcuucugccugcuggagcccggcggcgacauccagcaggaggcccugggcgaccagcugcagcugguggaggaggaguucgcccugcagggcgugaacgcccugaaggaggaggccugccccggcgacacccagcuggaggagggcagaaaggagcccgaggcccccggcgagaugcccgcccccgccgugcaccuggccagcccccaggccgagagcaccgcccugccccccugcgagcuggagaccaccguggugagcagcagcgaccugcacagccaggagguggugagcgacgacuuccugcugaagaacgacaccagcagcgccgaggcccacgccgcccccgagaagccccccgacaugcagcacagaagcagcgugcagacccagggcgaggugaucacccugcugcugagcaaggcccagagcgccggcagcgaccaggagagccacggcgcccagagcccccugggcgagggccagaacauggccgugcugagcgccggcgaccccgaccccagcagaugccugagaagcaaccccgccgaggccagcgaccugcugccccccguggccggcggcggcgacaccaucacccaccagcccgacagcugcaaggccgcccccgagcacagaagcggcaucaccgccuucaugaaggugcugaacagccugcagaagaagcagaugaacaccagccugugcgagagaaucagaaagguguacggcgaccuggagugcgaguacugcggcaagcuguucugguaccaggugcacuucgacaugcacgugagaacccacaccagagagcaccuguacuacugcagccagugccacuacagcagcaucaccaagaacugccugaagagacacgugauccagaagcacagcaacauccugcugaagugccccaccgacggcugcgacuacagcacccccgacaaguacaagcugcaggcccaccugaaggugcacaccgcccuggacaagagaagcuacagcugccccgugugcgagaagagcuucagcgaggacagacugaucaagagccacaucaagaccaaccaccccgaggugagcaugagcaccaucagcgaggugcugggcagaagagugcagcugaagggccugaucggcaagagagccaugaagugccccuacugcgacuucuacuucaugaagaacggcagcgaccugcagagacacaucugggcccacgagggcgugaagcccuucaagugcagccugugcgaguacgccaccagaagcaagagcaaccugaaggcccacaugaacagacacagcaccgagaagacccaccugugcgacaugugcggcaagaaguucaagagcaagggcacccugaagagccacaagcugcugcacaccgccgacggcaagcaguucaagugcaccgugugcgacuacaccgccgcccagaagccccagcugcugagacacauggagcagcacgugagcuucaagcccuucagaugcgcccacugccacuacagcugcaacaucagcggcagccugaagagacacuacaacagaaagcaccccaacgaggaguacgccaacgugggcaccggcgagcuggccgccgaggugcugauccagcagggcggccugaagugccccgugugcagcuucguguacggcaccaagugggaguucaacagacaccugaagaacaagcacggccugaaggugguggagaucgacggcgaccccaagugggagaccgccaccgaggcccccgaggagcccagcacccaguaccugcacaucaccgaggccgaggaggacgugcagggcacccaggccgccguggccgcccugcaggaccugagauacaccagcgagagcggcgacagacuggaccccaccgccgugaacauccugcagcagaucaucgagcugggcgccgagacccacgacgccaccgcccuggccagcgugguggccauggcccccggcaccgugaccguggugaagcaggugaccgaggaggagcccagcagcaaccacaccgugaugauccaggagaccgugcagcaggccagcguggagcuggccgagcagcaccaccugguggugagcagcgacgacguggagggcaucgagaccgugaccguguacacccagggcggcgaggccagcgaguucaucguguacgugcaggaggccaugcagcccguggaggagcaggccguggagcagcccgcccaggagcuguaa

SEQ ID NO: 25857 - RNA, 5970 nt, Artificial Sequence
  ZFC3H1__Homo_sapiens__NP_659419
auggccaccgccgacacccccgcccccgccagcagcggccugagccccaaggaggagggcgagcuggaggacggcgagaucagcgacgacgacaacaacagccagaucagaagcagaagcagcagcagcagcagcggcggcggccugcugcccuaccccagaagaagacccccccacagcgccagaggcggcggcagcggcggcggcggcggcagcagcagcagcagcagcagcagccagcagcagcugagaaacuucagcagaagcagacacgccagcgagagaggccaccugagaggccccagcagcuacagacccaaggagcccuucagaagccacccccccagcgugagaaugcccagcagcagccugagcgagagcagccccagacccagcuucugggagagaagccaccuggcccuggacagauucagauucagaggcagacccuacagaggcggcagcagauggagcagaggcagaggcgugggcgagagaggcggcaagcccggcugcagacccccccugggcggcggcgccggcagcggcuucagcagcagccagagcuggagagagcccagcccccccagaaagagcagcaagagcuucggcagaagccccagcagaaagcagaacuacagcagcaagaacgagaacugcguggaggagaccuucgaggaccugcugcugaaguacaagcagauccagcuggagcuggagugcaucaacaaggacgagaagcuggcccugagcagcaaggaggagaacgugcaggaggaccccaagacccugaacuucgaggaccagaccagcaccgacaacgugagcaucaccaaggacagcagcaaggagguggcccccgaggagaagacccaggugaagaccuuccaggccuucgagcugaagccccugagacagaagcugacccugcccggcgacaagaacagacugaagaaggugaaggacggcgccaagccccugagccugaagagcgacaccaccgacagcagccagggccugcaggacaaggagcagaaccugaccagaagaaucagcaccagcgacauccugagcgagaagaagcugggcgaggacgaggaggagcugagcgagcugcagcugagacugcuggcccugcagagcgccagcaagaaguggcagcagaaggagcagcaggugaugaaggagagcaaggagaagcugaccaagaccaagaccgugcagcagaaggugaagaccagcaccaagacccacagcgccaagaaggugagcaccaccgccaagcaggcccugagaaagcagcagaccaaggccuggaagaagcugcagcagcagaaggagcaggagagacagaaggaggaggaccagagaaagcaggccgaggaggaggagagaagaaagagagaggaggagaucagaaagaucagagaccugagcaaccaggaggagcaguacaacagauucaugaagcuggugggcggcaagagaagaagcagaagcaagagcagcgaccccgaccugagaagaagccuggacaagcagcccaccgacagcggcggcggcaucuaccaguacgacaacuacgaggagguggccauggacaccgacagcgagaccagcagccccgcccccagccccgugcagccccccuucuucagcgagugcagccugggcuacuucagccccgcccccagccugagccugcccccccccccccaggugagcagccugcccccccugagccagcccuacguggagggccugugcgugagccuggagccccugcccccccugcccccccugcccccccugccccccgaggaccccgagcagccccccaagccccccuucgccgacgaggaggaggaggaggagaugcugcugagagaggagcugcugaagagccuggccaacaagagagccuucaagcccgaggagaccagcagcaacagcgacccccccagcccccccgugcugaacaacagccaccccgugcccagaagcaaccugagcaucgugagcaucaacaccgugagccagcccagaauccagaaccccaaguuccacagaggccccagacugcccagaaccgugaucagccugcccaagcacaagagcgugguggugacccugaacgacagcgacgacagcgagagcgacggcgaggccagcaagagcaccaacagcguguucggcggccuggagagcaugaucaaggaggccagaagaaccgccgagcaggccagcaagcccaaggugccccccaagagcgagaaggagaacgacccccugagaacccccgaggcccugcccgaggagaagaagaucgaguacagacugcugaaggaggagaucgccaacagagagaagcagagacugaucaagagcgaccagcugaagaccagcagcagcagccccgccaacagcgacguggagaucgacggcaucggcagaaucgccauggugaccaagcaggugaccgacgccgagagcaagcugaagaagcacagaauccugcugaugaaggacgagagcgugcugaagaaccuggugcagcaggaggccaagaagaaggagagcgugagaaacgccgaggccaagaucaccaagcugaccgagcagcugcaggccaccgagaagauccugaacgugaacagaauguuccugaagaagcugcaggagcagauccacagagugcagcagagagugaccaucaagaaggcccugacccugaaguacggcgaggagcuggccagagccaaggccguggccagcaaggagaucggcaagagaaagcuggagcaggacagauucggccccaacaagaugaugagacuggacagcagccccgugagcagccccagaaagcacagcgccgagcugaucgccauggagaagagaagacugcagaagcuggaguacgaguacgcccugaagauccagaagcugaaggaggccagagcccugaaggccaaggagcagcagaacaucagccccgugguggaggaggagcccgaguucagccugccccagcccagccugcacgaccugacccaggacaagcugacccuggacaccgaggagaacgacguggacgacgagauccugagcggcagcagcagagagagaagaagaagcuuccuggagagcaacuacuucaccaagcccaaccugaagcacaccgacaccgccaacaaggagugcaucaacaagcugaacaagaacaccguggagaagcccgagcuguuccugggccugaagaucggcgagcugcagaagcuguacagcaaggccgacagccugaagcagcugauccugaagaccaccaccggcaucaccgagaaggugcugcacggccaggagaucagcguggacguggacuucgugaccgcccagagcaagaccauggaggugaagcccugccccuucagacccuaccacagcccccugcugguguucaagagcuacagauucagccccuacuacagaaccaaggagaagcugccccugagcagcgugagcuacagcaacaugaucgagcccgaccagugcuucugcagauucgaccugaccggcaccugcaacgacgacgacugccaguggcagcacauccaggacuacacccugagcagaaagcagcuguuccaggacauccugagcuacaaccugagccugaucggcugcgccgagaccagcaccaacgaggagaucaccgccagcgccgagaaguacguggagaagcuguucggcgugaacaaggacagaaugagcauggaccagauggccgugcugcuggugagcaacaucaacgagagcaagggccacaccccccccuucaccaccuacaaggacaagagaaaguggaagcccaaguucuggagaaagcccaucagcgacaacagcuucagcagcgacgaggagcagagcaccggccccaucaaguacgccuuccagcccgagaaccagaucaacgugcccgcccuggacaccguggugacccccgacgacgugagauacuucaccaacgagaccgacgacaucgccaaccuggaggccagcgugcuggagaaccccagccacgugcagcuguggcugaagcuggccuacaaguaccugaaccagaacgagggcgagugcagcgagagccuggacagcgcccugaacgugcuggccagagcccuggagaacaacaaggacaaccccgagaucuggugccacuaccugagacuguucagcaagagaggcaccaaggacgaggugcaggagaugugcgagaccgccguggaguacgcccccgacuaccagagcuucuggaccuuccugcaccuggagagcaccuucgaggagaaggacuacgugugcgagagaaugcuggaguuccugaugggcgccgccaagcaggagaccagcaacauccugagcuuccagcugcuggaggcccugcuguucagagugcagcugcacaucuucaccggcagaugccagagcgcccuggccauccugcagaacgcccugaagagcgccaacgacggcaucguggccgaguaccugaagaccagcgacagaugccuggccuggcuggccuacauccaccugaucgaguucaacauccugcccagcaaguucuacgaccccagcaacgacaaccccagcagaaucgugaacaccgagagcuucgugaugcccuggcaggccgugcaggacgugaagaccaaccccgacaugcugcuggccguguucgaggacgccgugaaggccugcaccgacgagagccuggccguggaggagagaaucgaggccugccugccccuguacaccaacaugaucgcccugcaccagcugcuggagagauacgaggccgccauggagcugugcaagagccugcuggagagcugccccaucaacugccagcugcuggaggcccugguggcccuguaccugcagaccaaccagcacgacaaggccagagccguguggcugaccgccuucgagaagaacccccagaacgccgagguguucuaccacaugugcaaguucuucauccugcagaacagaggcgacaaccugcugcccuuccugagaaaguucaucgccagcuucuucaagcccggcuucgagaaguacaacaaccuggaccuguucagauaccugcugaacauccccggccccaucgacauccccagcagacugugcaagggcaacuucgacgacgacauguucaaccaccaggugcccuaccuguggcugaucuacugccugugccacccccugcagagcagcaucaaggagaccguggaggccuacgaggccgcccugggcguggccaugagaugcgacaucgugcagaagaucuggauggacuaccugguguucgccaacaacagagccgccggcagcagaaacaaggugcaggaguucaaguucuucaccgaccuggugaacagaugccuggugaccgugcccgccagauaccccauccccuucagcagcgccgacuacuggagcaacuacgaguuccacaacagagugaucuucuucuaccugagcugcgugcccaagacccagcacagcaagacccuggagagauucugcagcgugaugcccgccaacagcggccuggcccugagacugcugcagcacgagugggaggagagcaacgugcagauccugaagcugcaggccaagauguucaccuacaacauccccaccugccuggccaccuggaagaucgccaucgccgccgagaucgugcugaagggccagagagaggugcacagacuguaccagagagcccugcagaagcugccccugugcgccagccuguggaaggaccagcugcuguucgaggccagcgagggcggcaagaccgacaaccugagaaagcuggugagcaagugccaggagaucggcgugagccugaacgagcugcugaaccugaacagcaacaagaccgagagcaagaaccacuaa

SEQ ID NO: 25858 - RNA, 4569 nt, Artificial Sequence
  ZFHX2__Homo_sapiens__XP_006720345
augaccuucaccaccaaggugcugagcgcccccacccugagcccccuggacaacggccaggagccccccacccacggccccgagcccacccccagcagagaccaggccgccgagggccccaaccugacccccgaggccagccccgacccccugcccgagcccccccuggccagcguggaggugcccgacaagcccagcggcagccccggccagccccccagccccgcccccagccccgugcccgagcccgacgcccaggccgaggacguggcccccccccccaccauggccgaggaggaggagggcaccaccggcgagcugagaagcgccgagcccgcccccgccgacagcagacacccccugaccuacagaaagaccaccaacuucgcccuggacaaguuccuggaccccgccagacccuacaagugcaccgugugcaaggagagcuucacccagaagaacauccugcuggugcacuacaacagcgugagccaccugcacaagaugaagaaggccgccaucgaccccagcgcccccgccagaggcgaggccggcgccccccccaccaccaccgccgccaccgacaagcccuucaagugcaccgugugcagagugagcuacaaccagagcagcacccuggagauccacaugagaagcgugcugcaccagaccagaagcagaggcaccaagaccgacagcaagaucgagggccccgagagaagccaggaggagcccaaggagggcgagaccgagggcgaggugggcaccgagaagaagggccccgacaccagcggcuucaucagcggccugcccuuccugagcccccccccccccccccuggaccugcacagauuccccgccccccuguucaccccccccgugcugccccccuucccccuggugcccgagagccugcugaagcugcagcagcagcagcugcugcugcccuucuaccugcacgaccugaaggugggccccaagcugacccuggccggccccgcccccgugcugagccugcccgccgccaccccccccccccccccccagccccccaaggccgagcuggccgagagagagugggagagaccccccauggccaaggagggcaacgaggccggccccagcagcccccccgacccccugcccaacgaggccgccagaaccgccgccaaggcccugcuggagaacuucggcuucgagcuggugauccaguacaacgagggcaagcaggccgugccccccccccccaccccccccccccccgaggcccugggcggcggcgacaagcuggccugcggcgccugcggcaagcuguucagcaacaugcugauccugaagacccacgaggagcacgugcacagaagauuccugcccuucgaggcccugagcagauacgccgcccaguucagaaagagcuacgacagccuguaccccccccuggccgagccccccaagccccccgacggcagccuggacagccccgugccccaccugggcccccccuuccuggugcccgagcccgaggccggcggcaccagagcccccgaggagagaagcagagccggcggccacuggcccaucgaggaggaggagagcagcagaggcaaccugcccccccuggugcccgccggcagaagauucagcagaaccaaguucaccgaguuccagacccaggcccugcagagcuucuucgagaccagcgccuaccccaaggacggcgagguggagagacuggccagccugcugggccuggccagcagaguggugguggugugguuccagaacgccagacagaaggccagaaagaacgccugcgagggcggcagcaugcccaccggcggcggcaccggcggcgccagcggcugcagaagaugccacgccaccuucagcugcguguucgagcuggugagacaccugaagaagugcuacgacgaccagacccuggaggaggaggaggaggaggccgagagaggcgaggaggaggaggagguggaggaggaggagguggaggaggagcagggccuggagccccccgccggccccgagggcccccugcccgagccccccgacggcgaggagcugagccaggccgaggccaccaaggccggcggcaaggagcccgaggagaaggccacccccagccccagccccgcccacaccugcgaccagugcgccaucagcuucagcagccaggaccugcugaccagccacagaagacugcacuuccugcccagccugcagcccagcgcccccccccagcugcuggaccugccccugcugguguucggcgagagaaacccccugguggccgccaccagccccaugcccggccccccccugaagagaaagcacgaggacggcagccugagccccaccggcagcgaggccggcggcggcggcgagggcgagccccccagagacaagagacugagaaccaccauccugcccgagcagcuggagauccuguacagaugguacaugcaggacagcaaccccaccagaaagaugcuggacugcaucagcgaggaggugggccugaagaagagaguggugcaggugugguuccagaacaccagagccagagagagaaagggccaguucagaagcacccccggcggcgugcccagccccgccgugaagccccccgccaccgccacccccgccagccugcccaaguucaaccugcugcugggcaagguggacgacggcaccggcagagaggcccccaagagagaggcccccgccuuccccuaccccaccgccacccuggccagcggcccccagcccuuccugccccccggcaaggaggccaccacccccacccccgagcccccccugccccugcugcccccccccccccccagcgaggaggagggccccgaggagccccccaaggccagccccgagagcgaggccugcagccugagcgccggcgaccugagcgacagcagcgccagcagccuggccgagcccgagagccccggcgccggcggcaccagcggcggccccggcggcggcaccggcgugcccgacggcaugggccagagaagauacagaacccagaugagcagccugcagcugaagaucaugaaggccugcuacgaggccuacagaacccccaccaugcaggagugcgaggugcugggcgaggagaucggccugcccaagagagugauccaggugugguuccagaacgccagagccaaggagaagaaggccaagcugcagggcaccgccgccggcagcaccggcggcagcagcgagggccugcuggccgcccagagaaccgacugccccuacugcgacgugaaguacgacuucuacgugagcugcagaggccaccuguucagcagacagcaccuggccaagcugaaggaggccgugagagcccagcugaagagcgagagcaagugcuacgaccuggcccccgcccccgaggccccccccgcccugaaggccccccccgccaccacccccgccagcaugccccugggcgccgcccccacccugcccagacuggcccccgugcugcugagcggccccgcccuggcccagcccccccugggcaaccuggcccccuucaacagcggccccgccgccagcagcggccugcugggccuggccaccagcgugcugcccaccaccaccguggugcagaccgccggccccggcagaccccugccccagagacccaugcccgaccagaccaacaccagcaccgccggcaccaccgaccccgugcccggcccccccaccgagccccugggcgacaaggugagcagcgagagaaagcccguggccggccccaccagcagcagcaacgacgcccugaagaaccugaaggcccugaagaccaccgugcccgcccugcugggcggccaguuccugcccuucccccugccccccgccggcggcaccgccccccccgccguguucggcccccagcugcagggcgccuacuuccagcagcuguacggcaugaagaagggccuguuccccaugaaccccaugaucccccagacccugaucggccugcugcccaacgcccugcugcagccccccccccagccccccgagcccaccgccaccgccccccccaagccccccgagcugcccgcccccggcgagggcgaggccggcgagguggacgagcugcugaccggcagcaccggcaucagcaccguggacgugacccacagauaccugugcagacagugcaagauggccuucgacggcgaggcccccgccaccgcccaccagagaagcuucugcuucuucggcagaggcagcggcggcagcaugccccccccccugagagugcccaucugcaccuaccacugccuggccugcgaggugcugcugagcggcagagaggcccuggccagccaccugagaagcagcgcccacagaagaaaggccgcccccccccagggcggcccccccaucagcaucaccaacgccgccaccgccgccagcgccgccguggccuucgccaaggaggaggccagacugccccacaccgacagcaaccccaagaccaccaccaccagcacccugcuggcccuguaa

SEQ ID NO: 25859 - RNA, 8370 nt, Artificial Sequence
  ZFHX3__Homo_sapiens__NP_001158238
augagacugggcggcggccagcuggugagcgaggagcugaugaaccugggcgagagcuucauccagaccaacgaccccagccugaagcuguuccagugcgccgugugcaacaaguucaccaccgacaaccuggacaugcugggccugcacaugaacguggagagaagccugagcgaggacgaguggaaggccgugaugggcgacagcuaccagugcaagcugugcagauacaacacccagcugaaggccaacuuccagcugcacugcaagaccgacaagcacgugcagaaguaccagcugguggcccacaucaaggagggcggcaaggccaacgaguggagacugaagugcguggccaucggcaaccccgugcaccugaagugcaacgccugcgacuacuacaccaacagccuggagaagcugagacugcacaccgugaacagcagacacgaggccagccugaagcuguacaagcaccugcagcagcacgagagcggcguggagggcgagagcugcuacuaccacugcgugcugugcaacuacagcaccaaggccaagcugaaccugauccagcacgugagaagcaugaagcaccagagaagcgagagccugagaaagcugcagagacugcagaagggccugcccgaggaggacgaggaccugggccagaucuucaccaucagaagaugccccagcaccgaccccgaggaggccaucgaggacguggagggccccagcgagaccgccgccgaccccgaggagcuggccaaggaccaggagggcggcgccagcagcagccaggccgagaaggagcugaccgacagccccgccaccagcaagagaaucagcuuccccggcagcagcgagagcccccugagcagcaagagacccaagaccgccgaggagaucaagcccgagcagauguaccagugccccuacugcaaguacagcaacgccgacgugaacagacugagagugcacgccaugacccagcacagcgugcagcccaugcugagaugcccccugugccaggacaugcugaacaacaagauccaccugcagcugcaccugacccaccugcacagcguggcccccgacugcguggagaagcugaucaugaccgugaccacccccgagauggugaugcccagcagcauguuccugcccgccgccgugcccgacagagacggcaacagcaaccuggaggaggccggcaagcagcccgagaccagcgaggaccugggcaagaacauccugcccagcgccagcaccgagcagagcggcgaccugaagcccagccccgccgaccccggcagcgugagagaggacagcggcuucaucugcuggaagaagggcugcaaccagguguucaagaccagcgccgcccugcagacccacuucaacgaggugcacgccaagagaccccagcugcccgugagcgacagacacguguacaaguacagaugcaaccagugcagccuggccuucaagaccaucgagaagcugcagcugcacagccaguaccacgugaucagagccgccaccaugugcugccugugccagagaagcuucagaaccuuccaggcccugaagaagcaccuggagaccagccaccuggagcugagcgaggccgacauccagcagcuguacggcggccugcuggccaacggcgaccugcuggccaugggcgaccccacccuggccgaggaccacaccaucaucguggaggaggacaaggaggaggagagcgaccuggaggacaagcagagccccaccggcagcgacagcggcagcgugcaggaggacagcggcagcgagcccaagagagcccugcccuucagaaagggccccaacuucaccauggagaaguuccuggaccccagcagacccuacaagugcaccgugugcaaggagagcuucacccagaagaacauccugcuggugcacuacaacagcgugagccaccugcacaagcugaagagagcccugcaggagagcgccaccggccagcccgagcccaccagcagccccgacaacaagcccuucaagugcaacaccugcaacguggccuacagccagagcagcacccuggagauccacaugagaagcgugcugcaccagaccaaggccagagccgccaagcuggaggccgccagcggcagcagcaacggcaccggcaacagcagcagcaucagccugagcagcagcacccccagccccgugagcaccagcggcagcaacaccuucaccaccagcaaccccagcagcgccggcaucgcccccagcagcaaccugcugagccaggugcccaccgagagcgugggcaugcccccccugggcaaccccaucggcgccaacaucgccagccccagcgagcccaaggaggccaacagaaagaagcuggccgacaugaucgccagcagacagcagcagcagcagcagcagcagcagcagcagcagcagcagcagcagcagcagcaggcccagacccuggcccaggcccaggcccaggugcaggcccaccugcagcaggagcugcagcagcaggccgcccugauccagagccagcuguucaaccccacccugcugccccacuuccccaugaccaccgagacccugcugcagcugcagcagcagcagcaccugcuguuccccuucuacauccccagcgccgaguuccagcugaaccccgaggugagccugcccgugaccagcggcgcccugacccugaccggcaccggccccggccugcuggaggaccugaaggcccaggugcaggugccccagcagagccaccagcagauccugccccagcagcagcagaaccagcugagcaucgcccagagccacagcgcccugcugcagcccagccagcaccccgagaagaagaacaagcuggugaucaaggagaaggagaaggagagccagagagagagagacagcgccgagggcggcgagggcaacaccggccccaaggagacccugcccgacgcccugaaggccaaggagaagaaggagcuggcccccggcggcggcagcgagcccagcaugcugccccccagaaucgccagcgacgccagaggcaacgccaccaaggcccugcuggagaacuucggcuucgagcuggugauccaguacaacgagaacaagcagaaggugcagaagaagaacggcaagaccgaccagggcgagaaccuggagaagcuggagugcgacagcugcggcaagcuguucagcaacauccugauccugaagagccaccaggagcacgugcaccagaacuacuuccccuucaagcagcuggagagauucgccaagcaguacagagaccacuacgacaagcuguacccccugagaccccagacccccgagcccccccccccccccccccccccccccccccccccccugcccgccgcccccccccagcccgccagcacccccgccauccccgccagcgccccccccaucaccagccccaccaucgcccccgcccagcccagcgugccccugacccagcugagcaugcccauggagcugcccaucuucagcccccugaugaugcagaccaugccccugcagacccugcccgcccagcugcccccccagcugggccccguggagccccugcccgccgaccuggcccagcuguaccagcaccagcugaaccccacccugcugcagcagcagaacaagagacccagaaccagaaucaccgacgaccagcugagagugcugagacaguacuucgacaucaacaacagccccagcgaggagcagaucaaggagauggccgacaagagcggccugccccagaaggugaucaagcacugguucagaaacacccuguucaaggagagacagagaaacaaggacagccccuacaacuucagcaacccccccaucaccagccuggaggagcugaagaucgacagcagaccccccagccccgagccccccaagcaggaguacuggggcagcaagagaagcagcagaaccagauucaccgacuaccagcugagagugcugcaggacuucuucgacgccaacgccuaccccaaggacgacgaguucgagcagcugagcaaccugcugaaccugcccaccagagugaucguggugugguuccagaacgccagacagaaggccagaaagaacuacgagaaccagggcgagggcaaggacggcgagagaagagagcugaccaacgacagauacaucagaaccagcaaccugaacuaccagugcaagaagugcagccugguguuccagagaaucuucgaccugaucaagcaccagaagaagcugugcuacaaggacgaggacgaggagggccaggacgacagccagaacgaggacagcauggacgccauggagauccugacccccaccagcagcagcugcagcacccccaugcccagccaggccuacagcgcccccgcccccagcgccaacaacaccgccagcagcgccuuccugcagcugaccgccgaggccgaggagcuggccaccuucaacagcaagaccgaggccggcgacgagaagcccaagcuggccgaggcccccagcgcccagcccaaccagacccaggagaagcagggccagcccaagcccgagcugcagcagcaggagcagcccgagcagaagaccaacaccccccagcagaagcugccccagcuggugagccugcccagccugccccagccccccccccaggccccccccccccagugcccccugccccagagcagccccagccccagccagcugagccaccugccccugaagccccugcacaccagcaccccccagcagcuggccaaccugcccccccagcugauccccuaccagugcgaccagugcaagcuggccuuccccagcuucgagcacuggcaggagcaccagcagcugcacuuccugagcgcccagaaccaguucauccacccccaguuccuggacagaagccuggacaugcccuucaugcuguucgaccccagcaacccccugcuggccagccagcugcugagcggcgccaucccccagauccccgccagcagcgccaccagccccagcacccccaccagcaccaugaacacccugaagagaaagcuggaggagaaggccagcgccagccccggcgagaacgacagcggcaccggcggcgaggagccccagagagacaagagacugagaaccaccaucacccccgagcagcuggagauccuguaccagaaguaccugcuggacagcaaccccaccagaaagaugcuggaccacaucgcccacgaggugggccugaagaagagaguggugcaggugugguuccagaacaccagagccagagagagaaagggccaguucagagccgugggccccgcccaggcccacagaagaugccccuucugcagagcccuguucaaggccaagaccgcccuggaggcccacaucagaagcagacacuggcacgaggccaagagagccggcuacaaccugacccugagcgccaugcugcuggacugcgacggcggccugcagaugaagggcgacaucuucgacggcaccagcuucagccaccugccccccagcagcagcgacggccagggcgugccccugagccccgugagcaagaccauggagcugagccccagaacccugcugagccccagcagcaucaagguggagggcaucgaggacuucgagagccccagcaugagcagcgugaaccugaacuucgaccagaccaagcuggacaacgacgacugcagcagcgugaacaccgccaucaccgacaccaccaccggcgacgagggcaacgccgacaacgacagcgccaccggcaucgccaccgagaccaagagcagcagcgcccccaacgagggccugaccaaggccgccaugauggccaugagcgaguacgaggacagacugagcagcggccuggugagccccgcccccagcuucuacagcaaggaguacgacaacgagggcaccguggacuacagcgagaccagcagccuggccgaccccugcagccccagccccggcgccagcggcagcgccggcaagagcggcgacagcggcgacagacccggccagaagagauucagaacccagaugaccaaccugcagcugaaggugcugaagagcugcuucaacgacuacagaacccccaccaugcuggagugcgaggugcugggcaacgacaucggccugcccaagagaguggugcaggugugguuccagaacgccagagccaaggagaagaagagcaagcugagcauggccaagcacuucggcaucaaccagaccagcuacgagggccccaagaccgagugcacccugugcggcaucaaguacagcgccagacugagcgugagagaccacaucuucagccagcagcacaucagcaaggugaaggacaccaucggcagccagcuggacaaggagaaggaguacuucgaccccgccaccgugagacagcugauggcccagcaggagcuggacagaaucaagaaggccaacgaggugcugggccuggccgcccagcagcagggcauguucgacaacaccccccugcaggcccugaaccugcccaccgccuaccccgcccugcagggcaucccccccgugcugcugcccggccugaacagccccagccugcccggcuucacccccagcaacaccgcccugaccagccccaagcccaaccugaugggccugcccagcaccaccgugcccagccccggccugcccaccagcggccugcccaacaagcccagcagcgccagccugagcagccccacccccgcccaggccaccauggccaugggcccccagcagcccccccagcagcagcagcagcagcagcagccccaggugcagcagcccccccccccccccgccgcccagcccccccccaccccccagcugccccugcagcagcagcagcagagaaaggacaaggacagcgagaaggugaaggagaaggagaaggcccacaagggcaagggcgagccccugcccgugcccaagaaggagaagggcgaggcccccaccgccaccgccgccaccaucagcgccccccugcccaccauggaguacgccguggaccccgcccagcugcaggcccugcaggccgcccugaccagcgaccccaccgcccugcugaccagccaguuccugcccuacuucgugcccggcuucagccccuacuacgccccccagauccccggcgcccugcagagcggcuaccugcagcccauguacggcauggagggccuguuccccuacagccccgcccugagccaggcccugaugggccugagccccggcagccugcugcagcaguaccagcaguaccagcagagccugcaggaggccauccagcagcagcagcagagacagcugcagcagcagcagcagcagaaggugcagcagcagcagcccaaggccagccagacccccgugccccccggcgcccccagccccgacaaggaccccgccaaggagagccccaagcccgaggagcagaagaacacccccagagaggugagcccccugcugcccaagcugcccgaggagcccgaggccgagagcaagagcgccgacagccuguacgaccccuucaucgugcccaaggugcaguacaagcuggugugcagaaagugccaggccggcuucagcgacgaggaggccgccagaagccaccugaagagccugugcuucuucggccagagcguggugaaccugcaggagauggugcugcacgugcccaccggcggcggcggcggcggcagcggcggcggcggcggcggcggcggcggcggcggcggcggcggcagcuaccacugccuggccugcgagagcgcccugugcggcgaggaggcccugagccagcaccuggagagcgcccugcacaagcacagaaccaucaccagagccgccagaaacgccaaggagcaccccagccugcugccccacagcgccugcuuccccgaccccagcaccgccagcaccagccagagcgccgcccacagcaacgacagcccccccccccccagcgccgccgcccccagcagcgccagcccccacgccagcagaaagagcuggccccagguggugagcagagccagcgccgccaagccccccagcuuccccccccugagcagcagcagcaccgugaccagcagcagcugcagcaccagcggcgugcagcccagcaugcccaccgacgacuacagcgaggagagcgacaccgaccugagccagaagagcgacggccccgccagccccguggagggccccaaggaccccagcugccccaaggacagcggccugaccagcgugggcaccgacaccuucagacuguaa

SEQ ID NO: 25860 - RNA, 10851 nt, Artificial Sequence
  ZFHX4__Homo_sapiens__XP_011515897
auggagaccugcgacagcccccccaucagcagacaggagaacggccagagcaccagcaagcugugcggcaccacccagcuggacaacgaggugcccgagaagguggccggcauggagcccgacagagagaacagcagcaccgacgacaaccugaagaccgacgagagaaagagcgaggcccugcugggcuucagcguggagaacgccgccgccacccaggugaccagcgccaaggagauccccugcaacgagugcgccaccagcuuccccagccugcagaaguacauggagcaccacugccccaacgccagacugcccgugcugaaggacgacaacgagagcgagaucagcgagcuggaggacagcgacguggagaaccugaccggcgagaucguguaccagcccgacggcagcgccuacaucaucgaggacagcaaggagagcggccagaacgcccagaccggcgccaacagcaagcuguucagcaccgccauguuccuggacagccuggccagcgccggcgagaagagcgaccagagcgccagcgcccccaugagcuucuacccccagaucaucaacaccuuccacaucgccagcagccugggcaagcccuucaccgccgaccaggccuuccccaacaccagcgcccuggccggcgugggccccgugcugcacagcuucagaguguacgaccugagacacaagagagagaaggacuaccugaccagcgacggcagcgccaagaacagcugcgugagcaaggacgugcccaacaacguggaccugagcaaguucgacggcugcgugagcgacggcaagagaaagcccgugcugaugugcuuccugugcaagcugagcuucggcuacaucagaagcuucgugacccacgccgugcacgaccacagaaugacccugaacgacgaggagcagaagcugcugagcaacaagugcgugagcgccaucauccagggcaucggcaaggacaaggagccccugaucagcuuccuggagcccaagaagagcaccagcguguacccccacuucagcaccaccaaccugaucggccccgaccccaccuucagaggccuguggagcgccuuccacguggagaacggcgacagccugcccgccggcuucgccuuccugaagggcagcgccagcaccagcagcagcgccgagcagccccugggcaucacccagaugcccaaggccgaggugaaccugggcggccugagcagccugguggugaacacccccaucaccagcgugagccugagccacagcagcagcgagagcagcaagaugagcgagagcaaggaccaggagaacaacugcgagagacccaaggagagcaacgugcugcaccccaacggcgagugccccgugaagagcgagcccaccgagcccggcgacgaggacgaggaggacgccuacagcaacgagcuggacgacgaggaggugcugggcgagcugaccgacagcaucggcaacaaggacuucccccugcugaaccagagcaucagcccccugagcagcagcgugcugaaguucaucgagaagggcaccagcagcagcagcgccaccgugagcgacgacaccgagaagaagaagcagaccgccgccgugagagccagcggcagcguggccagcaacuacggcaucagcggcaaggacuucgccgacgccagcgccagcaaggacagcgccaccgccgcccaccccagcgagaucgccagaggcgacgaggacagcagcgccaccccccaccagcacggcuucacccccagcacccccggcacccccggccccggcggcgacggcagccccggcagcggcaucgagugccccaagugcgacaccgugcugggcagcagcagaagccugggcggccacaugaccaugaugcacagcagaaacagcugcaagacccugaagugccccaagugcaacuggcacuacaaguaccagcagacccuggaggcccacaugaaggagaagcaccccgagcccggcggcagcugcguguacugcaagaccggccagccccaccccagacuggccagaggcgagagcuacaccugcggcuacaagcccuucagaugcgaggugugcaacuacagcaccaccaccaagggcaaccugagcauccacaugcagagcgacaagcaccugaacaacgugcagaaccugcagaacggcaacggcgagcagguguucggccacagcgcccccgcccccaacaccagccugagcggcugcggcacccccagccccagcaagcccaagcagaagcccaccuggagaugcgaggugugcgacuacgagaccaacguggccagaaaccugagaauccacaugaccagcgagaagcacaugcacaacaugaugcugcugcagcagaacaugaagcagauccagcacaaccugcaccugggccuggcccccgccgaggccgagcuguaccaguacuaccuggcccagaacaucggccugaccggcaugaagcuggagaaccccgccgacccccagcugaugaucaaccccuuccagcuggaccccgccaccgccgccgcccuggcccccggccuggugaacaacgagcugccccccgagaucagacuggccagcggccagcugaugggcgacgaccugagccugcugaccgccggcgagcugagccccuacaucagcgaccccgcccugaagcuguuccagugcgccgugugcaacaaguucaccagcgacagccuggaggcccugagcgugcacgugagcagcgagagaagccugcccgaggaggaguggagagccgugaucggcgacaucuaccagugcaagcugugcaacuacaacacccagcugaaggccaacuuccagcugcacugcaagaccgacaagcacaugcagaaguaccagcugguggcccacaucaaggagggcggcaagagcaacgaguggagacugaagugcaucgccaucggcaaccccgugcaccugaagugcaacgccugcgacuacuacaccaacagcguggacaagcugagacugcacaccaccaaccacagacacgaggccgcccugaagcuguacaagcaccugcagaagcaggagggcgccgugaaccccgagagcugcuacuacuacugcgccgugugcgacuacaccaccaaggugaagcugaaccuggugcagcacgugagaagcgugaagcaccagcagaccgagggccugagaaagcugcagcugcaccagcagggccuggcccccgaggaggacaaccugagcgagaucuucuucgugaaggacugcccccccaacgagcuggagaccgccagccugggcgccagaaccugcgacgacgaccugaccgagcagcagcugagaagcaccagcgaggagcagagcgaggaggccgagggcgccaucaagcccaccgccguggccgaggacgacgagaaggacaccagcgagagagacaacagcgagggcaagaacagcaacaaggacagcggcaucaucacccccgagaaggagcugaaggugagcguggccggcggcacccagccccugcugcuggccaaggaggaggacguggccaccaagagaagcaagcccaccgaggacaacaaguucugccacgagcaguucuaccagugccccuacugcaacuacaacagcagagaccagagcagaauccagaugcacgugcugagccagcacagcgugcagcccgugaucugcugcccccugugccaggacgugcugagcaacaagaugcaccugcagcugcaccugacccaccugcacagcgugagccccgacugcguggagaagcugcugaugaccgugcccgugcccgacgugaugaugcccaacagcaugcugcugcccgccgccgccagcgagaagagcgagagagacacccccgccgccgugaccgccgagggcagcggcaaguacagcggcgagagccccauggacgacaagagcauggccggccuggaggacagcaaggccaacguggaggugaagaacgaggagcagaagcccaccaaggagccccuggaggugagcgaguggaacaagaacagcagcaaggacgugaagauccccgacacccugcaggaccagcugaacgagcagcagaagagacagccccugagcgugagcgacagacacguguacaaguacagaugcaaccacugcagccuggccuucaagaccaugcagaagcugcagauccacagccaguaccacgccaucagagccgccaccaugugcaaccugugccagagaagcuucagaaccuuccaggcccugaagaagcaccuggaggccggccaccccgagcugagcgaggccgagcugcagcagcuguacgccagccugcccgugaacggcgagcugugggccgagagcgagaccaugagccaggacgaccacggccuggagcaggagauggagagagaguacgagguggaccacgagggcaaggccagccccgugggcagcgacagcagcagcauccccgacgacaugggcagcgagcccaagagaacccugcccuucagaaagggccccaacuucaccauggagaaguuccuggaccccagcagacccuacaagugcaccgugugcaaggagagcuucacccagaagaacauccugcuggugcacuacaacagcgugagccaccugcacaagcugaagaaggugcugcaggaggccagcagccccgugccccaggagaccaacagcaacaccgacaacaagcccuacaagugcagcaucugcaacguggccuacagccagagcagcacccuggagauccacaugagaagcgugcugcaccagaccaaggccagagccgccaagcuggagcccagcggccacguggccggcggccacagcaucgccgccaacgugaacagccccggccagggcaugcuggacagcaugagccuggccgccgugaacagcaaggacacccaccuggacgccaaggagcugaacaagaagcagacccccgaccugaucagcgcccagcccgcccaccaccccccccagagccccgcccagauccagaugcagcugcagcacgagcugcagcagcaggccgccuucuuccagccccaguuccugaaccccgccuuccugccccacuuccccaugacccccgaggcccugcugcaguuccagcagccccaguuccuguuccccuucuacauccccggcaccgaguucagccugggccccgaccugggccugcccggcagcgccaccuucggcaugcccggcaugaccggcauggccggcagccugcuggaggaccugaagcagcagauccagacccagcaccacgugggccagacccagcugcagauccugcagcagcaggcccagcaguaccaggccacccagccccagcugcagccccagaagcagcagcagcagcccccccccccccagcagcagcagcagcagcaggccagcaagcugcugaagcaggagcagagcaacaucgugagcgccgacugccagaucaugaaggacgugcccagcuacaaggaggccgaggacaucagcgagaagcccgagaagcccaagcaggaguucaucagcgagggcgagggccugaaggagggcaaggacaccaagaagcagaagagccuggagcccagcauccccccccccagaaucgccagcggcgccagaggcaacgccgccaaggcccugcuggagaacuucggcuucgagcuggugauccaguacaacgagaacagacagaaggugcagaagaagggcaagagcggcgagggcgagaacaccgacaagcuggagugcggcaccugcggcaagcuguucagcaacgugcugauccugaagagccaccaggagcacgugcacggccaguucuuccccuacgccgcccuggagaaguucgccagacaguacagagaggccuacgacaagcuguaccccaucagccccagcagccccgagaccccccccccccccccccccccccccccccugccccccgcccccccccagcccagcagcaugggccccgugaagauccccaacaccgugagcaccccccugcaggcccccccccccaccccccccccccccccccccccccccccccccccccccccccccccccccccccccccccccagcgcccccccccaggugcagcugcccgugagccuggaccugccccuguuccccagcaucaugaugcagcccgugcagcaccccgcccugcccccccagcuggcccugcagcugccccagauggacgcccugagcgccgaccugacccagcugugccagcagcagcugggccuggaccccaacuuccugagacacagccaguucaagagacccagaaccagaaucaccgacgaccagcugaagauccugagagccuacuucgacaucaacaacagccccagcgaggagcagauccaggagauggccgagaagagcggccugagccagaaggugaucaagcacugguucagaaacacccuguucaaggagagacagagaaacaaggacagccccuacaacuucagcaacccccccaucaccgugcuggaggacaucagaaucgacccccagcccaccagccuggagcacuacaagagcgacgccagcuucagcaagagaagcagcagaaccagauucaccgacuaccagcugagagugcugcaggacuucuucgacaccaacgccuaccccaaggacgacgagaucgagcagcugagcaccgugcugaaccugcccaccagagugaucguggugugguuccagaacgccagacagaaggccagaaagagcuacgagaaccaggccgagaccaaggacaacgagaagagagagcugaccaacgagagauacaucagaaccagcaacaugcaguaccagugcaagaagugcaacgugguguuccccagaaucuucgaccugaucacccaccagaagaagcagugcuacaaggacgaggacgacgacgcccaggacgagagccagaccgaggacagcauggacgccaccgaccaggugguguacaagcacugcaccgugagcggccagaccgacgccgccaagaacgccgccgcccccgccgccagcagcggcagcggcaccagcaccccccugauccccagccccaagcccgagcccgagaagaccagccccaagcccgaguaccccgccgagaagcccaagcagagcgaccccagcccccccagccagggcaccaagcccgcccugccccuggccagcaccagcagcgaccccccccaggccagcaccgcccagccccagccccagccccagccccccaagcagccccagcugaucggcagaccccccagcgccagccagacccccgugcccagcagcccccugcagaucagcaugaccagccugcagaacagccugcccccccagcugcugcaguaccagugcgaccagugcaccguggccuuccccacccuggagcuguggcaggagcaccagcacaugcacuuccuggccgcccagaaccaguuccugcacagccccuuccuggagagacccauggacaugcccuacaugaucuucgaccccaacaacccccugaugaccggccagcugcugggcagcagccugacccagaugcccccccaggccagcagcagccacaccaccgcccccaccaccguggccgccagccugaagagaaagcuggacgacaaggaggacaacaacugcagcgagaaggagggcggcaacagcggcgaggaccagcacagagacaagagacugagaaccaccaucacccccgagcagcuggagauccuguacgagaaguaccugcuggacagcaaccccaccagaaagaugcuggaccacaucgccagagaggugggccugaagaagagaguggugcaggugugguuccagaacaccagagccagagagagaaagggccaguucagagccgugggccccgcccagagccacaagagaugccccuucugcagagcccuguucaaggccaagagcgcccuggagagccacaucagaagcagacacuggaacgagggcaagcaggccggcuacagccugccccccagcccccugaucagcaccgaggacggcggcgagagcccccagaaguacaucuacuucgacuaccccagccugccccugaccaagaucgaccugagcagcgagaacgagcuggccagcaccgugagcacccccgugagcaagaccgccgagcugagccccaagaaccugcugagccccagcagcuucaaggccgagugcagcgaggacguggagaaccugaacgccccccccgccgaggccggcuacgaccagaacaagaccgacuucgacgagaccagcagcaucaacaccgccaucagcgacgccaccaccggcgacgagggcaacaccgagauggagagcaccaccggcagcagcggcgacgugaagcccgcccugagccccaaggagcccaagacccuggacacccugcccaagcccgccaccacccccaccaccgaggugugcgacgacaaguuccuguucagccugaccagccccagcauccacuucaacgacaaggacggcgaccacgaccagagcuucuacaucaccgacgaccccgacgacaacgccgacagaagcgagaccagcagcaucgccgaccccagcagccccaaccccuucggcagcagcaaccccuucaagagcaagagcaacgacagacccggccacaagagauucagaacccagaugagcaaccugcagcugaaggugcugaaggccugcuucagcgacuacagaacccccaccaugcaggagugcgagaugcugggcaacgagaucggccugcccaagagaguggugcaggugugguuccagaacgccagagccaaggagaagaaguucaagaucaacaucggcaagcccuucaugaucaaccagggcggcaccgagggcaccaagcccgagugcacccugugcggcgugaaguacagcgccagacugagcaucagagaccacaucuucagcaagcagcacaucagcaaggugagagagaccgugggcagccagcuggacagagagaaggacuaccuggcccccaccaccgugagacagcugauggcccagcaggagcuggacagaaucaagaaggccagcgacgugcugggccugaccgugcagcagcccggcaugauggacagcagcagccugcacggcaucagccugcccaccgccuaccccggccugcccggccugccccccgugcugcugcccggcaugaacggccccagcagccugcccggcuucccccagaacagcaacacccugaccccccccggcgccggcaugcugggcuuccccaccagcgccaccagcagccccgcccugagccugagcagcgcccccaccaagccccugcugcagaccccccccccccccccccccccccccccccccccccccagcagcagccugagcggccagcagaccgagcagcagaacaaggagagcgagaagaagcagaccaagcccaacaaggugaagaagaucaaggaggaggagcuggaggccaccaagcccgagaagcaccccaagaaggaggagaagaucagcagcgcccugagcgugcugggcaagguggugggcgagacccacguggaccccauccagcugcaggcccugcagaacgccaucgccggcgaccccgccagcuucaucggcggccaguuccugcccuacuucauccccggcuucgccagcuacuucaccccccagcugcccggcaccgugcagggcggcuacuucccccccgugugcggcauggagagccuguuccccuacggccccaccaugccccagacccuggccggccugagccccggcgcccugcugcagcaguaccagcaguaccagcagaaccugcaggagagccugcagaagcagcagaagcagcagcaggagcagcagcagaagcccgugcaggccaagaccagcaagguggagagcgaccagccccagaacagcaacgacgccagcgagaccaaggaggacaagagcaccgccaccgagagcaccaaggaggagccccagcuggagagcaagagcgccgacuucagcgacaccuacguggugcccuucgugaaguacgaguucaucugcagaaagugccagaugauguucaccgacgaggacgccgccgugaaccaccagaagagcuucugcuacuucggccagccccugaucgacccccaggagaccgugcugagagugcccgugagcaaguaccagugccuggccugcgacguggccaucagcggcaacgaggcccugagccagcaccugcagagcagccugcacaaggagaagaccaucaagcaggccaugagaaacgccaaggagcacgugagacugcugccccacagcgugugcagccccaaccccaacaccaccagcaccagccagagcgccgccagcagcaacaacaccuacccccaccugagcugcuucagcaugaagagcuggcccaacauccuguuccaggccagcgccagaagagccgccagcccccccagcagcccccccagccugagccugcccagcaccgugaccagcagccugugcagcaccagcggcgugcagaccagccugcccaccgagagcugcagcgacgagagcgacagcgagcugagccagaagcuggaggaccuggacaacagccuggaggugaaggccaagcccgccagcggccuggacggcaacuucaacagcaucagaauggacauguucagcguguaa

SEQ ID NO: 25861 - RNA, 1302 nt, Artificial Sequence
  ZFP1__Homo_sapiens__XP_011521223
augcacugcuacggcgccuucaagauguggcugagcagcgccuucaucgugcugugccugugccccaagcugcagaagaugaacaagagccagggcagcgugagcuucaccgacgugaccguggacuucacccaggaggagugggagcagcuggaccccagccagagaauccuguacauggacgugaugcuggagaacuacagcaaccugcugagcguggagguguggaaggccgacgaccagauggagagagaccacagaaaccccgacgagcaggccagacaguuccugauccugaagaaccagacccccaucgaggagagaggcgaccuguucggcaaggcccugaaccugaacaccgacuucgugagccugagacaggugcccuacaaguacgaccuguacgagaagacccugaaguacaacagcgaccugcugaacagcaacagaagcuacgccggcaagcagaccgacgagugcaacgaguucggcaaggcccugcuguaccugaagcaggagaagacccacagcggcguggaguacagcgaguacaacaagagcggcaaggcccugagccacaaggccgccaucuucaagcaccagaagaucaagaaccuggugcagcccuucaucugcaccuacugcgacaaggccuucagcuucaagagccugcugaucagccacaagagaauccacaccggcgagaagcccuacgagugcaacgugugcaagaagaccuucagccacaaggccaaccugaucaagcaccagagaauccacaccggcgagaagcccuucgagugccccgagugcggcaaggccuucacccaccagagcaaccugaucgugcaccagagagcccacauggagaagaagcccuacgagugcagcgagugcggcaagaccuucgcccagaaguucgagcugaccacccaccagagaauccacaccggcgagagacccuacgagugcaacgagugcgccaagaccuucuucaagaagagcaaccugaucauccaccagaagauccacaccggcgagaagagauacgagugcagcgagugcggcaagagcuucauccagaacagccagcugaucauccacaugagaacccacaccggcgagaagcccuacgagugcaccgagugcggcaagaccuucagccagagaagcacccugagacugcaccugagaauccacaccggcgagaagcccuacgagugcagcgagugcggcaaggccuucagcagaaagagcagacugagcgugcaccagagagugcacaucggcgagaagcccuaa

SEQ ID NO: 25862 - RNA, 1560 nt, Artificial Sequence
  ZFP30__Homo_sapiens__NP_055713
auggccagagaccuggugauguucagagacguggccguggacuucagccaggaggagugggagugccugaacagcuaccagagaaaccuguacagagacgugauccuggagaacuacagcaaccuggugagccuggccggcugcagcaucagcaagcccgacgugaucacccugcuggagcagggcaaggagcccuggaugguggugagagacgagaagagaagauggacccuggaccuggagagcagauacgacaccaagaagcuguuccagggcaaggacaucuacgagaugaaccugagccaguggaaggugauggagagaaucaagagcugcggccuggaggagcaggagagcccccacgaggugugcuucagacaggugaccaagaccaccagcgagaagaugcccaccuacagaaagcugaccagccugccccuguaccagaagagccacaacagagagaagcccuacgagugcggcgagugcggcaaggccuucagagugagacagcagcugaccuuccaccagagaauccacaccggcgagaagcccuacgagugcaaggagugcggcaaggccuucagacagugcgcccaccugagcagacaccagagaauccacaccagcgacaagcuguacgagugcaagaagugcggcaagaucuucaccugcggcagcgaccugagagugcaccagagaauccacaucggcgagaagcccuacgagugcaaggagugcggcaaggccuucagagugagaggccagcugaaccugcaccagagaauccacaccggcgagaagcccuacgagugcaaggagugcggcaaggccuucagacaguacgcccaccugaccagacaccagagacugaacaucgccgagaagugcuacgagugcaaggagugcggccaggccuuccugugcagcaccggccugagacugcaccacaagcugcacaccggcgagaagcccuacgagugcaaggagugcggcaaggccuucagagugagacagcagcugacccugcaccagagaauccacaccggcgagaagcccuacgacugcaaggagugcggcaagaccuucagcagaggcuaccaccugacccugcaccagagaauccacaccggcgagaagcccuacgagugcaaggagugccagaaguucuucagaagauacagcgagcugaucagccaccagggcauccacaucggcgagaagcccuacgagugcaaggagugcggcaaggccuucagacuguucagccagcugacccagcaccagagcauccacuucggcgagaagcccuucaagugcaaggagugcgagaagaccuucagacugcugagccagcugacccagcaccagagcauccacaccggcgagaagcccuacgacugcaaggagugcggcaaggccuucagacugcacagcagccugauccagcaccagagaauccacagcggcgagaagcccuacaagugcaaggagugcaagaaggccuucagacagcacagccaccugaccuaccaccagagaauccacaacgugaccuaa

SEQ ID NO: 25863 - RNA, 999 nt, Artificial Sequence
  ZFP36__Homo_sapiens__NP_003398
auggccaacagauacaccauggaccugaccgccaucuacgagagccugcugagccugagccccgacgugcccgugcccagcgaccacggcggcaccgagagcagccccggcuggggcagcagcggccccuggagccugagccccagcgacagcagccccagcggcgugaccagcagacugcccggcagaagcaccagccugguggagggcagaagcugcggcugggugccccccccccccggcuucgccccccuggcccccagacugggccccgagcugagccccagccccaccagccccaccgccaccagcaccacccccagcagauacaagaccgagcugugcagaaccuucagcgagagcggcagaugcagauacggcgccaagugccaguucgcccacggccugggcgagcugagacaggccaacagacaccccaaguacaagaccgagcugugccacaaguucuaccugcagggcagaugccccuacggcagcagaugccacuucauccacaaccccagcgaggaccuggccgcccccggccacccccccgugcugagacagagcaucagcuucagcggccugcccagcggcagaagaaccagcccccccccccccggccuggccggccccagccugagcagcagcagcuucagccccagcagcagcccccccccccccggcgaccugccccugagccccagcgccuucagcgccgcccccggcaccccccuggccagaagagaccccacccccgugugcugccccagcugcagaagagccacccccaucagcguguggggcccccugggcggccuggugagaacccccagcgugcagagccugggcagcgaccccgacgaguacgccagcagcggcagcagccugggcggcagcgacagccccguguucgaggccggcguguucgcccccccccagcccguggccgcccccagaagacugcccaucuucaacagaaucagcgugagcgaguaa

SEQ ID NO: 25864 - RNA, 1224 nt, Artificial Sequence
  ZFP36L1__Homo_sapiens__NP_001231630
augggcagagccagaaagagcggccugggccagagaagcagacccaccgccagcagaagcgaggccgccgugcagcccggcgugagaaaggccagaggcgccggcaacuggagagugggccugcagaccggcgaggccgcccccagcccccacagagaccugagagacacccccgaccccagacccuggcuggccagaacccacagaaugaccaccacccuggugagcgccaccaucuucgaccugagcgaggugcugugcaagggcaacaagaugcugaacuacagcgcccccagcgccggcggcugccugcuggacagaaaggccgugggcacccccgccggcggcggcuuccccagaagacacagcgugacccugcccagcagcaaguuccaccagaaccagcugcugagcagccugaagggcgagcccgcccccgcccugagcagcagagacagcagauucagagacagaagcuucagcgagggcggcgagagacugcugcccacccagaagcagcccggcggcggccaggugaacagcagcagauacaagaccgagcugugcagacccuucgaggagaacggcgccugcaaguacggcgacaagugccaguucgcccacggcauccacgagcugagaagccugaccagacaccccaaguacaagaccgagcugugcagaaccuuccacaccaucggcuucugccccuacggccccagaugccacuucauccacaacgccgaggagagaagagcccuggccggcgccagagaccugagcgccgacagacccagacugcagcacagcuucagcuucgccggcuuccccagcgccgccgccaccgccgccgccaccggccugcuggacagccccaccagcaucacccccccccccauccugagcgccgacgaccugcugggcagccccacccugcccgacggcaccaacaaccccuucgccuucagcagccaggagcuggccagccuguucgcccccagcaugggccugcccggcggcggcagccccaccaccuuccuguucagacccaugagcgagagcccccacauguucgacagcccccccagcccccaggacagccugagcgaccaggagggcuaccugagcagcagcagcagcagccacagcggcagcgacagccccacccuggacaacagcagaagacugcccaucuucagcagacugagcaucagcgacgacuaa

SEQ ID NO: 25865 - RNA, 1485 nt, Artificial Sequence
  ZFP36L2__Homo_sapiens__NP_008818
augagcaccacccugcugagcgccuucuacgacguggacuuccugugcaagaccgagaagagccuggccaaccugaaccugaacaacaugcuggacaagaaggccgugggcacccccguggccgccgcccccagcagcggcuucgcccccggcuuccugagaagacacagcgccagcaaccugcacgcccuggcccaccccgcccccagccccggcagcugcagccccaaguuccccggcgccgccaacggcagcagcugcggcagcgccgccgccggcggccccaccagcuacggcacccugaaggagcccagcggcggcggcggcaccgcccugcugaacaaggagaacaaguucagagacagaagcuucagcgagaacggcgacagaagccagcaccugcugcaccugcagcagcagcagaagggcggcggcggcagccagaucaacagcaccagauacaagaccgagcugugcagacccuucgaggagagcggcaccugcaaguacggcgagaagugccaguucgcccacggcuuccacgagcugagaagccugaccagacaccccaaguacaagaccgagcugugcagaaccuuccacaccaucggcuucugccccuacggccccagaugccacuucauccacaacgccgacgagagaagacccgcccccagcggcggcgccagcggcgaccugagagccuucggcaccagagacgcccugcaccugggcuuccccagagagcccagacccaagcugcaccacagccugagcuucagcggcuuccccagcggccaccaccagccccccggcggccuggagagcccccugcugcuggacagccccaccagcagaaccccccccccccccagcugcagcagcgccagcagcugcagcagcagcgccagcagcugcagcagcgccagcgccgccagcacccccagcggcgcccccaccugcugcgccagcgccgccgccgccgccgccgccgcccugcuguacggcaccggcggcgccgaggaccugcuggcccccggcgcccccugcgccgccugcagcagcgccagcugcgccaacaacgccuucgccuucggccccgagcugagcagccugaucaccccccuggccauccagacccacaacuucgccgccguggccgccgccgccuacuacagaagccagcagcagcagcagcagcagggccuggccccccccgcccagccccccgccccccccagcgccacccugcccgccggcgccgccgccccccccagcccccccuucagcuuccagcugcccagaagacugagcgacagccccguguucgacgccccccccagcccccccgacagccugagcgacagagacagcuaccugagcggcagccugagcagcggcagccugagcggcagcgagagccccagccuggaccccggcagaagacugcccaucuucagcagacugagcaucagcgacgacuaa

SEQ ID NO: 25866 - RNA, 1938 nt, Artificial Sequence
  ZFP37__Homo_sapiens__NP_001269444
augagcgugagcagcggcgugcagauccugaccaagcccgagaccguggacagaagaagaagcgccgagaccaccaaggaggccggcagaccccuggagauggccgugagcgagcccgaggccagcgccgccgugagcgugaccuucaagcacgugaccauggccuucacccagaaggaguggaagcagcuggaccccgcccagagcaaccuguacaacgacgugaugcuggagaacuacugcaaccaggccagcaugggcugccaggcccccaagcccgacaugaucagcaagcuggagaagggcgaggcccccuggcugggcaagggcaagagacccagccagggcugccccagcaagaucgccagacccaagcagaaggagaccgacggcaaggugcagaaggacgacgaccagcuggagaacauccagaagagccagaacaagcugcugagagagguggccgugaagaagaagacccaggccaagaagaacggcagcgacugcggcagccugggcaagaagaacaaccugcacaagaagcacgugcccagcaagaagagacugcugaaguucgagagcugcggcaagauccugaagcagaaccuggaccugcccgaccacagcagaaacugcgugaagagaaagagcgacgccgccaaggagcacaagaagagcuucaaccacagccugagcgacaccagaaagggcaagaagcagaccggcaagaagcacgagaagcugagcagccacagcagcagcgacaagugcaacaagaccggcaagaagcacgacaagcugugcugccacagcagcagccacaucaagcaggacaagauccagaccggcgagaagcacgagaagagccccagccugagcagcagcaccaagcacgagaagccccaggccugcgugaagcccuacgagugcaaccagugcggcaaggugcugagccacaagcagggccugaucgaccaccagagagugcacaccggcgagaagcccuacgagugcaacgagugcggcaucgccuucagccagaagagccaccugguggugcaccagagaacccacaccggcgagaagcccuacgagugcauccagugcggcaaggcccacggccacaagcacgcccugaccgaccaccugagaauccacaccggcgagaagcccuacgagugcgccgagugcggcaagaccuucagacacagcagcaaccugauccagcacgugagaagccacaccggcgagaagcccuacgagugcaaggagugcggcaagagcuucagauacaacagcagccugaccgagcacgugagaacccacaccggcgagauccccuacgagugcaacgagugcggcaaggccuucaaguacagcagcagccugaccaagcacaugagaauccacaccggcgagaagcccuucgagugcaacgagugcggcaaggccuucagcaagaagagccaccugaucauccaccagagaacccacaccaaggagaagcccuacaagugcaacgagugcggcaaggccuucggccacagcagcagccugaccuaccacaugagaacccacaccggcgagagccccuucgagugcaaccagugcggcaagggcuucaagcagaucgagggccugacccagcaccagagagugcacaccggcgagaagcccuacgagugcaacgagugcggcaaggccuucagccagaagagccaccugaucgugcaccagagaacccacaccggcgagaagcccuacgagugcaacgagugcgagaaggccuucaacgccaagagccagcuggugauccaccagagaagccacaccggcgagaagcccuacgagugcaacgagugcggcaagaccuucaagcagaacgccagccugaccaagcacgugaagacccacagcgaggacaagagccacgaguaa

SEQ ID NO: 25867 - RNA, 933 nt, Artificial Sequence
  ZFP42__Homo_sapiens__NP_001291287
augagccagcagcugaagaagagagccaagaccagacaccagaagggccugggcggcagagcccccagcggcgccaagcccagacagggcaagagcagccaggaccugcaggccgagaucgagcccgugagcgccgugugggcccugugcgacggcuacgugugcuacgagcccggcccccaggcccugggcggcgacgacuucagcgacugcuacaucgagugcgugaucagaggcgaguucagccagcccauccuggaggaggacagccuguucgagagccuggaguaccugaagaagggcagcgagcagcagcugagccagaagguguucgaggccagcagccuggagugcagccuggaguacaugaagaagggcgugaagaaggagcugccccagaagaucgugggcgagaacagccuggaguacagcgaguacaugaccggcaagaagcugccccccggcggcauccccggcaucgaccugagcgaccccaagcagcuggccgaguucgccagaaagaagccccccaucaacaaggaguacgacagccugagcgccaucgccugcccccagagcggcugcaccagaaagcugagaaacagagccgcccugagaaagcaccugcugauccacggccccagagaccacgugugcgccgagugcggcaaggccuucguggagagcagcaagcugaagagacacuuccuggugcacaccggcgagaagcccuucagaugcaccuucgagggcugcggcaagagauucagccuggacuucaaccugagaacccacgugagaauccacaccggcgagaagagauucgugugccccuuccagggcugcaacagaagauucauccagagcaacaaccugaaggcccacauccugacccacgccaacaccaacaagaacgagcaggagggcaaguaa

SEQ ID NO: 25868 - RNA, 1395 nt, Artificial Sequence
  ZFP57__Homo_sapiens__XP_006715150
augagcgagaccuucaagaaccugaccagcguggccagaaucuuccugcacaagcccgagcugaucaccaagcuggagcaggaggaggagcaguggagagaguucgugcaccugcccaacaccgagggccugagcgagggcaagaagaaggagcugagagagcagcaccccagccugagagacgagggcaccagcgacgacaagguguuccuggccugcagaggcgccggccagugcccccugagcgcccccgccggcaccauggacagaaccagagugcugcaggccagccaggccggcccccccuucuucugcuacaccugcggcaagugcuucagcagaagaagcuaccuguacagccaccaguucgugcacaaccccaagcugaccaacagcugcagccagugcggcaagcuguucagaagccccaagagccugagcuaccacagaagaaugcaccugggcgagagacccuucugcugcacccugugcgacaagaccuacugcgacgccagcggccugagcagacacagaagagugcaccugggcuacagaccccacagcugcagcgugugcggcaagagcuucagagaccagagcgagcugaagagacaccagaagauccaccagaaccaggagcccguggacggcaaccaggagugcacccugagaauccccggcacccaggccgaguuccagacccccaucgccagaagccagagaagcauccagggccugcuggacgugaaccacgcccccguggccagaagccaggagcccaucuucagaaccgagggccccauggcccagaaccaggccagcgugcugaagaaccaggcccccgugaccagaacccaggcccccaucaccggcacccugugccaggacgccagaagcaacagccaccccgugaagcccagcagacugaacguguucugcugcccccacugcagccugaccuucagcaagaagagcuaccugagcagacaccagaaggcccaccugaccgagccccccaacuacugcuuccacugcagcaagagcuucagcagcuucagcagacuggugagacaccagcagacccacuggaagcagaagagcuaccugugccccaucugcgaccugagcuucggcgagaaggagggccugauggaccacuggagaggcuacaagggcaaggaccugugccagagcagccaccacaagugcagagugauccugggccaguggcugggcuucagccacgacgugcccaccauggccggcgaggaguggaagcacggcggcgaccagagcccccccagaauccacacccccagaagaagaggccugagagagaaggccugcaagggcgacaagaccaaggaggccgugagcauccugaagcacaaguaa

SEQ ID NO: 25869 - RNA, 2046 nt, Artificial Sequence
  ZFP64__Homo_sapiens__NP_060667
augaacgccagcagcgagggcgagagcuucgccggcagcgugcagauccccggcggcaccaccgugcugguggagcugacccccgacauccacaucugcggcaucugcaagcagcaguucaacaaccuggacgccuucguggcccacaagcagagcggcugccagcugaccggcaccagcgccgccgcccccagcaccgugcaguucgugagcgaggagaccgugcccgccacccagacccagaccaccaccagaaccaucaccagcgagacccagaccaucaccgugagcgcccccgaguucguguucgagcacggcuaccagaccuaccugcccaccgagagcaacgagaaccagaccgccaccgugaucagccugcccgccaagagcagaaccaagaagcccaccaccccccccgcccagaagagacugaacugcugcuaccccggcugccaguucaagaccgccuacggcaugaaggacauggagagacaccugaagauccacaccggcgacaagccccacaagugcgaggugugcggcaagugcuucagcagaaaggacaagcugaagacccacaugagaugccacaccggcgugaagcccuacaagugcaagaccugcgacuacgccgccgccgacagcagcagccugaacaagcaccugagaauccacagcgacgagagacccuucaagugccagaucugccccuacgccagcagaaacagcagccagcugaccgugcaccugagaagccacaccggcgacgcccccuuccagugcuggcugugcagcgccaaguucaagaucagcagcgaccugaagagacacaugagagugcacagcggcgagaagcccuucaagugcgaguucugcaacgugagaugcaccaugaagggcaaccugaagagccacaucagaaucaagcacagcggcaacaacuucaagugcccccacugcgacuuccugggcgacagcaaggccacccugagaaagcacagcagagugcaccagagcgagcaccccgagaagugcagcgagugcagcuacagcugcagcagcaaggccgcccugagaauccacgagagaauccacugcaccgacagacccuucaagugcaacuacugcagcuucgacaccaagcagcccagcaaccugagcaagcacaugaagaaguuccacggcgacauggugaagaccgaggcccuggagagaaaggacaccggcagacagagcagcagacagguggccaagcuggacgccaagaagagcuuccacugcgacaucugcgacgccagcuucaugagagaggacagccugagaagccacaagagacagcacagcgaguacagcgagagcaagaacagcgacgugaccgugcugcaguuccagaucgaccccagcaagcagcccgccaccccccugaccgugggccaccugcaggugccccugcagcccagccaggugccccaguucagcgagggcagagugaagaucaucgugggccaccaggugccccaggccaacaccaucgugcaggccgccgccgccgccgugaacaucgugccccccgcccugguggcccagaaccccgaggagcugcccggcaacagcagacugcagauccugagacaggugagccugaucgcccccccccagagcagcagaugccccagcgaggccggcgccaugacccagcccgccgugcugcugaccacccacgagcagaccgacggcgccacccugcaccagacccugauccccaccgccagcggcggcccccaggagggcagcggcaaccagaccuucaucaccagcagcggcaucaccugcaccgacuucgagggccugaacgcccugauccaggagggcaccgccgaggugaccguggugagcgacggcggccagaacaucgccguggccaccaccgccccccccguguucagcagcagcagccagcaggagcugcccaagcagaccuacagcaucauccagggcgccgcccaccccgcccugcugugccccgccgacagcauccccgacuaa

SEQ ID NO: 25870 - RNA, 1599 nt, Artificial Sequence
  ZFP82__Homo_sapiens__NP_597723
auggcccugagaagcgugauguucagcgacgugagcaucgacuucagccccgaggagugggaguaccuggaccuggagcagaaggaccuguacagagacgugaugcuggagaacuacagcaaccuggugagccugggcugcuucaucagcaagcccgacgugaucagcagccuggagcagggcaaggagcccuggaagguggugagaaagggcagaagacaguaccccgaccuggagaccaaguacgagaccaagaagcugagccuggagaacgacaucuacgagaucaaccugagccaguggaagaucauggagagaaucgagaaccacggccugaagggccugauccugaagaacgacugggagagcaccggcaagaucgagggccaggagagaccccaggagggcuacuucagcagcgugaagaugcccagcgagaaggugagcagcuaccagaagagaaccagcgugaccccccaccagagacugcacuucguggacaagcccuacgagugcaaggagugcggcaaggccuucagagugagacagcagcugaccuuccaccacagaauccacaccggcgagaagcccuacgagugcaaggagugcggcauggccuucagacagaccgcccaccugaccagacaccagagacugcacagcggcgagaagcuguacgagugcaaggagugcggcgaggccuucaucugcggcgccgaccugagagugcaccagaagaugcacaucggcgagaagcccuacgagugcaaggagugcggcaaggccuucagagugagaggccagcugacccugcaccagagaauccacaccggcgagaagcccuacgugugcaaggagugcggcaaggccuucagacaguacgcccaccugaccagacaccagaagcugaacagcgccgacagacuguacgagugcaaggagugcggcaaggccuuccugugcggcagcggccugagagugcaccacaagcugcacaccggcgagaagcccuacgagugcaaggagugcggcaaggccuucagagugagacagcagcugacccugcaccagagaauccacaccggcgagaagcccuacgagugcaaggagugcggcaagaccuucagcagaggcuaccaccugauccugcaccacagaauccacaccggcgagaagcccuacgagugcaaggagugcuggaaggccuucagcagauacagccagcugaucagccaccagagcauccacaucggcgugaagcccuacgacugcaaggagugcggcaaggccuucagacugcugagccagcugacccagcaccagagcauccacaucggcgagaagcccuacaagugcaaggagugcggcaaggccuucagacugagacagaagcugacccugcaccagagcauccacaccggcgagaagcccuucgagugcaaggagugcagaaaggccuucagacugaacagcagccugauccagcaccugagaauccacagcggcgagaagcccuacgagugcaaggagugcaagaaggccuucagacagcacagccaccugacccaccaccugaagauccacaacgugaagaucuaa

SEQ ID NO: 25871 - RNA, 1713 nt, Artificial Sequence
  ZFP91__Homo_sapiens__NP_444251
augcccggcgagaccgaggagcccagaccccccgagcagcaggaccaggagggcggcgaggccgccaaggccgcccccgaggagccccagcagagaccccccgaggccguggccgccgcccccgccggcaccaccagcagcagagugcugagaggcggcagagacagaggcagagccgccgccgccgccgccgccgccgccgugagcagaagaagaaaggccgaguaccccagaagaagaagaagcagccccagcgccagaccccccgacgugcccggccagcagccccaggccgccaagagccccagccccgugcagggcaagaagagccccagacugcugugcaucgagaaggugaccaccgacaaggaccccaaggaggagaaggaggaggaggacgacagcgcccugccccaggaggugagcaucgccgccagcagacccagcagaggcuggagaagcagcagaaccagcgugagcagacacagagacaccgagaacaccagaagcagcagaagcaagaccggcagccugcagcugaucugcaagagcgagcccaacaccgaccagcuggacuacgacgugggcgaggagcaccagagccccggcggcaucagcagcgaggaggaggaggaggaggaggaggagaugcugaucagcgaggaggagauccccuucaaggacgaccccagagacgagaccuacaagccccaccuggagagagagacccccaagcccagaagaaagagcggcaaggugaaggaggagaaggagaagaaggagaucaagguggagguggagguggaggugaaggaggaggagaacgagaucagagaggacgaggagccccccagaaagagaggcagaagaagaaaggacgacaagagccccagacugcccaagagaagaaagaagccccccauccaguacgugagaugcgagauggagggcugcggcaccgugcuggcccaccccagauaccugcagcaccacaucaaguaccagcaccugcugaagaagaaguacgugugcccccaccccagcugcggcagacuguucagacugcagaagcagcugcugagacacgccaagcaccacaccgaccagagagacuacaucugcgaguacugcgccagagccuucaagagcagccacaaccuggccgugcacagaaugauccacaccggcgagaagccccugcagugcgagaucugcggcuucaccugcagacagaaggccagccugaacuggcacaugaagaagcacgacgccgacagcuucuaccaguucagcugcaacaucugcggcaagaaguucgagaagaaggacagcgugguggcccacaaggccaagagccaccccgaggugcugaucgccgaggcccuggccgccaacgccggcgcccugaucaccagcaccgacauccugggcaccaaccccgagagccugacccagcccagcgacggccagggccugccccugcugcccgagccccugggcaacagcaccagcggcgagugccugcugcuggaggccgagggcaugagcaagagcuacugcagcggcaccgagagagugagccugauggccgacggcaagaucuucgugggcagcggcagcagcggcggcaccgagggccuggugaugaacagcgacauccugggcgccaccaccgaggugcugaucgaggacagcgacagcgccggccccuaa

SEQ ID NO: 25872 - RNA, 3021 nt, Artificial Sequence
  ZFPM1__Homo_sapiens__NP_722520
augagcagaagaaagcagagcaaccccagacagaucaagagaagccugggcgacauggaggccagagaggaggugcagcuggugggcgccagccacauggagcagaaggccaccgcccccgaggcccccagcccccccagcgccgacgugaacagcccccccccccugcccccccccaccagccccggcggccccaaggagcuggagggccaggagcccgagcccagacccaccgaggaggagcccggcagccccuggagcggccccgacgagcuggagcccguggugcaggacggccagagaagaaucagagccagacugagccuggccaccggccugagcuggggccccuuccacggcagcgugcagaccagagccagcagccccagacaggccgagcccagccccgcccugacccugcugcugguggacgaggccugcuggcugagaacccugccccaggcccugaccgaggccgaggccaacaccgagauccacagaaaggacgacgcccuguggugcagagugaccaagcccgugcccgccggcggccugcugagcgugcugcugaccgccgagccccacagcacccccggccaccccgugaagaaggagcccgccgagcccaccugccccgcccccgcccacgaccugcagcugcugccccagcaggccggcauggccagcauccuggccaccgccgugaucaacaaggacguguuccccugcaaggacugcggcaucugguacagaagcgagagaaaccugcaggcccaccugcuguacuacugcgccagcagacagggcaccggcagccccgccgccgccgccaccgacgagaagcccaaggagaccuaccccaacgagagagugugccccuucccccagugcagaaagagcugccccagcgccagcagccuggagauccacaugagaagccacagcggcgagagacccuucgugugccugaucugccugagcgccuucaccaccaaggccaacugcgagagacaccugaaggugcacaccgacacccugagcggcgugugccacagcugcggcuucaucagcaccaccagagacauccuguacagccaccuggugaccaaccacauggugugccagcccggcagcaagggcgagaucuacagccccggcgccggccaccccgccaccaagcugccccccgacagccugggcagcuuccagcagcagcacaccgcccugcagggcccccuggccagcgccgaccugggccuggcccccacccccagccccggccuggacagaaaggcccuggccgaggccaccaacggcgaggccagagccgagccccuggcccagaacggcggcagcagcgagccccccgccgcccccagaagcaucaagguggaggccguggaggagcccgaggccgcccccauccugggccccggcgagcccggcccccaggcccccagcagaacccccagccccagaagccccgcccccgccagagugaaggccgagcugagcagccccacccccggcagcagccccgugcccggcgagcugggccuggccggcgcccuguuccugccccaguacguguucggccccgacgccgccccccccgccagcgagauccuggccaagaugagcgagcuggugcacagcagacugcagcagggcgccggcgccggcgccggcggcgcccagaccggccuguuccccggcgcccccaagggcgccaccugcuucgagugcgagaucaccuucagcaacgugaacaacuacuacgugcacaagagacuguacugcagcggcagaagagcccccgaggacgcccccgccgccagaagacccaaggccccccccggccccgccagagccccccccggccagcccgccgagcccgacgcccccagaagcagccccggccccggcgccagagaggagggcgccggcggcgccgccacccccgaggacggcgccggcggcagaggcagcgagggcagccagagccccggcagcagcguggacgacgccgaggacgaccccagcagaacccugugcgaggccugcaacaucagauucagcagacacgagaccuacaccgugcacaagagauacuacugcgccagcagacacgaccccccccccagaagacccgccgccccccccggcccccccggccccgccgccccccccgcccccagccccgccgcccccgugagaaccagaagaagaagaaagcuguacgagcugcacgccgccggcgccccccccccccccccccccggccacgcccccgcccccgagagccccagacccggcagcggcagcggcagcggccccggccuggcccccgccagaagccccggccccgccgccgacggccccaucgaccugagcaagaagcccagaagaccccugcccggcgcccccgcccccgcccuggccgacuaccacgagugcaccgccugcagagugagcuuccacagccuggaggccuaccuggcccacaagaaguacagcugccccgccgcccccccccccggcgcccugggccugcccgccgccgccugccccuacugcccccccaacggccccgugagaggcgaccugcuggagcacuucagacuggcccacggccugcugcugggcgccccccuggccggccccggcguggaggccagaacccccgccgacagaggccccagccccgcccccgcccccgccgccagcccccagcccggcagcagaggccccagagacggccugggccccgagccccaggagcccccccccggccccccccccagccccgccgccgcccccgaggccgugccccccccccccgccccccccagcuacagcgacaagggcgugcagacccccagcaagggcacccccgccccccugcccaacggcaaccacagauacugcagacugugcaacaucaaguucagcagccugagcaccuucaucgcccacaagaaguacuacugcagcagccacgccgccgagcacgugaaguaa

SEQ ID NO: 25873 - RNA, 3456 nt, Artificial Sequence
  ZFPM2__Homo_sapiens__NP_036214
augagcagaagaaagcagagcaagcccagacagaucaagagaccccuggaggacgccaucgaggacgaggaggaggagugccccagcgaggagaccgacaucaucagcaagggcgacuucccccuggaggagagcuucagcaccgaguucggccccgagaaccugagcugcgaggagguggaguacuucugcaacaagggcgacgacgagggcauccaggagaccgccgagagcgacggcgacacccagagcgagaagcccggccagcccggcguggagaccgacgacugggacggccccggcgagcuggagguguuccagaaggacggcgagagaaagauccagagcagacagcagcugcccgugggcaccaccuggggccccuuccccggcaagauggaccugaacaacaacagccugaagaccaaggcccaggugcccauggugcugaccgccggccccaaguggcugcuggacgugaccuggcagggcguggaggacaacaagaacaacugcaucguguacagcaagggcggccagcuguggugcaccaccaccaaggccaucagcgagggcgaggagcugaucgccuucgugguggacuucgacagcagacugcaggccgccagccagaugacccugaccgagggcauguaccccgccagacugcuggacagcauccagcugcugccccagcaggccgccauggccagcauccugcccaccgccaucgugaacaaggacaucuuccccugcaagagcugcggcaucugguacagaagcgagagaaaccugcaggcccaccugauguacuacugcagcggcagacagagagaggccgcccccgugagcgaggagaacgaggacagcgcccaccagaucagcagccugugccccuucccccagugcaccaagagcuucagcaacgccagagcccuggagaugcaccugaacagccacagcggcgugaagauggaggaguuccugccccccggcgccagccugaagugcaccgugugcagcuacaccgccgacagcgugaucaacuuccaccagcaccuguucagccaccugacccaggccgccuucagaugcaaccacugccacuucggcuuccagacccagagagagcugcugcagcaccaggagcugcacgugcccagcggcaagcugcccagagagagcgacauggagcacagccccagcgccaccgaggacagccugcagcccgccaccgaccugcugaccagaagcgagcugccccagagccagaaggccaugcagaccaaggacgccagcagcgacaccgagcuggacaagugcgagaagaagacccagcuguuccugaccaaccagagacccgagauccagcccaccaccaacaagcagagcuucagcuacaccaagaucaagagcgagcccagcagccccagacuggccagcagccccgugcagcccaacaucggccccagcuuccccgugggccccuuccugagccaguucagcuucccccaggacaucaccauggugccccaggccagcgagauccuggccaagaugagcgagcuggugcacagaagacugagacacggcagcagcagcuacccccccgugaucuacagcccccugaugcccaagggcgccaccugcuucgagugcaacaucaccuucaacaaccuggacaacuaccuggugcacaagaagcacuacugcagcagcagauggcagcagauggccaagagccccgaguuccccagcgugagcgagaagaugcccgaggcccugagccccaacaccggccagaccagcaucaaccugcugaaccccgccgcccacagcgccgaccccgagaacccccugcugcagaccagcugcaucaacagcagcaccgugcuggaccugaucggccccaacggcaagggccacgacaaggacuucagcacccagaccaagaagcugagcaccagcagcaacaacgacgacaagaucaacggcaagcccguggacgugaagaaccccagcgugccccugguggacggcgagagcgaccccaacaagaccaccugcgaggccugcaacaucaccuucagcagacacgagaccuacauggugcacaagcaguacuacugcgccaccagacacgaccccccccugaagagaagcgccagcaacaaggugcccgccaugcagagaaccaugagaaccagaaagagaagaaagauguacgagaugugccugcccgagcaggagcagagacccccccuggugcagcagagauuccuggacguggccaaccugaacaaccccugcaccagcacccaggagcccaccgagggccugggcgagugcuaccaccccagaugcgacaucuuccccggcaucgugagcaagcaccuggagaccagccugaccaucaacaagugcgugcccgugagcaagugcgacaccacccacagcagcgugagcugccuggagauggacgugcccaucgaccugagcaagaagugccugagccagagcgagagaaccaccaccagccccaagagacugcuggacuaccacgagugcaccgugugcaagaucagcuucaacaagguggagaacuaccuggcccacaagcagaacuucugccccgugaccgcccaccagagaaacgaccugggccagcuggacggcaagguguuccccaaccccgagagcgagagaaacagccccgacgugagcuacgagagaagcaucaucaagugcgagaagaacggcaaccugaagcagcccagccccaacggcaaccuguucagcagccaccuggccacccugcagggccugaagguguucagcgaggccgcccagcugaucgccaccaaggaggagaacagacaccuguuccugccccagugccuguaccccggcgccaucaagaaggccaagggcgccgaccagcugagccccuacuacggcaucaagcccagcgacuacaucagcggcagccuggugauccacaacaccgacaucgagcagagcagaaacgccgagaacgagagccccaagggccaggccagcagcaacggcugcgccgcccugaagaaggacagccugccccugcugcccaagaacagaggcauggugaucgugaacggcggccugaagcaggacgagagacccgccgccaacccccagcaggagaacaucagccagaacccccagcacgaggacgaccacaagagccccagcuggaucagcgagaacccccuggccgccaacgagaacgugagccccggcauccccagcgccgaggagcagcugagcagcaucgccaagggcgugaacggcagcagccaggcccccaccagcggcaaguacugcagacugugcgacauccaguucaacaaccugagcaacuucaucacccacaagaaguucuacugcagcagccacgccgccgagcacgugaaguaa

SEQ ID NO: 25874 - RNA, 213 nt, Artificial Sequence
  ZFR2__Homo_sapiens__NP_001139112
auggccaccagccaguacuucgacuucgcccagggcggcggcccccaguacagccccgagguggagaccaccccccccgcccuggccagcggccugcccugcgcccugcccuggaccgugggcugcagcggcagcgacgccgugaccgcccugugccccagccugagaggccuggccugcaucugcagcauccugugggaccccgccugguaa

SEQ ID NO: 25875 - RNA, 3225 nt, Artificial Sequence
  ZFR__Homo_sapiens__NP_057191
augauccccaucugccccguggugagcuucaccuacgugcccagcagacugggcgaggacgccaagauggccaccggcaacuacuucggcuucacccacagcggcgccgccgccgccgccgccgccgcccaguacagccagcagcccgccagcggcguggccuacagccaccccaccaccguggccagcuacaccgugcaccaggcccccguggccgcccacaccgugaccgccgccuacgcccccgccgccgccaccguggccguggccagacccgcccccguggccguggccgccgccgccaccgccgccgccuacggcggcuaccccaccgcccacaccgccaccgacuacggcuacacccagagacagcaggaggccccccccccccccccccccgccaccacccagaacuaccaggacagcuacagcuacgugagaagcaccgcccccgccguggccuacgacagcaagcaguacuaccagcagcccaccgccaccgccgccgccguggccgccgccgcccagccccagcccagcguggccgagaccuacuaccagaccgcccccaaggccggcuacagccagggcgccacccaguacacccaggcccagcagaccagacaggugaccgccaucaagcccgccacccccagccccgccaccaccaccuucagcaucuaccccgugagcagcaccgugcagcccguggccgccgccgccaccguggugcccagcuacacccagagcgccaccuacagcaccaccgccgugaccuacagcggcaccagcuacagcggcuacgaggccgccguguacagcgccgccagcagcuacuaccagcagcagcagcagcagcagaagcaggccgccgccgccgccgccgccgccgccgccaccgccgccuggaccggcaccaccuucaccaagaaggcccccuuccagaacaagcagcugaagcccaagcagccccccaagcccccccagauccacuacugcgacgugugcaagaucagcugcgccggcccccagaccuacaaggagcaccuggagggccagaagcacaagaagaaggaggccgcccugaaggccagccagaacaccagcagcagcaacagcagcaccagaggcacccagaaccagcugagaugcgagcugugcgacgugagcugcaccggcgccgacgccuacgccgcccacaucagaggcgccaagcaccagaagguggugaagcugcacaccaagcugggcaagcccauccccagcaccgagcccaacguggugagccaggccaccagcagcaccgccgugagcgccagcaagcccaccgccagccccagcagcaucgccgccaacaacugcaccgugaacaccagcagcguggccaccagcagcaugaagggccugaccaccaccggcaacagcagccugaacagcaccagcaacaccaaggugagcgccgugcccaccaacauggccgccaagaagaccagcacccccaagaucaacuucgugggcggcaacaagcugcagagcaccggcaacaaggccgaggacaucaagggcaccgagugcgugaagagcacccccgugaccagcgccgugcagauccccgaggugaagcaggacaccgugagcgagcccgugacccccgccagccuggccgcccugcagagcgacgugcagcccgugggccacgacuacguggaggaggugagaaacgacgagggcaaggugaucagauuccacugcaagcugugcgagugcagcuucaacgaccccaacgccaaggagaugcaccugaagggcagaagacacagacugcaguacaagaagaaggugaaccccgaccugcagguggaggugaagcccagcaucagagccagaaagauccaggaggagaagaugagaaagcagaugcagaaggaggaguacuggagaagaagagaggaggaggagagauggagaauggagaugagaagauacgaggaggacauguacuggagaagaauggaggaggagcagcaccacugggacgacagaagaagaaugcccgacggcggcuacccccacggcccccccggcccccugggccugcugggcgugagacccggcaugcccccccagccccagggccccgccccccugagaagacccgacagcagcgacgacagauacgugaugaccaagcacgccaccaucuaccccaccgaggaggagcugcaggccgugcagaagaucgugagcaucaccgagagagcccugaagcuggugagcgacagccugagcgagcacgagaagaacaagaacaaggagggcgacgacaagaaggagggcggcaaggacagagcccugaagggcgugcugagagugggcgugcuggccaagggccugcugcugagaggcgacagaaacgugaaccuggugcugcugugcagcgagaagcccagcaagacccugcugagcagaaucgccgagaaccugcccaagcagcuggccgugaucagccccgagaaguacgacaucaagugcgccgugagcgaggccgccaucauccugaacagcugcguggagcccaagaugcaggugaccaucacccugaccagccccaucaucagagaggagaacaugagagagggcgacgugaccagcggcauggugaaggacccccccgacgugcuggacagacagaagugccuggacgcccuggccgcccugagacacgccaagugguuccaggccagagccaacggccugcagagcugcgugaucaucaucagaauccugagagaccugugccagagagugcccaccuggagcgacuuccccagcugggccauggagcugcugguggagaaggccaucagcagcgccagcagcccccagagccccggcgacgcccugagaagaguguucgagugcaucagcagcggcaucauccugaagggcagccccggccugcuggaccccugcgagaaggaccccuucgacacccuggccaccaugaccgaccagcagagagaggacaucaccagcagcgcccaguucgcccugagacugcuggccuucagacagauccacaaggugcugggcauggacccccugccccagaugagccagagauucaacauccacaacaacagaaagagaagaagagacagcgacggcguggacggcuucgaggccgagggcaagaaggacaagaaggacuacgacaacuucuaa

SEQ ID NO: 25876 - RNA, 1731 nt, Artificial Sequence
  ZFX__Homo_sapiens__NP_001171557
augaccauggacaccgagagcgagaucgaccccugcaagguggacggcaccugccccgaggugaucaagguguacaucuucaaggccgaccccggcgaggacgaccugggcggcaccguggacaucguggagagcgagcccgagaacgaccacggcguggagcugcuggaccagaacagcagcaucagagugcccagagagaagaugguguacaugaccgugaacgacagccagcccgaggacgaggaccugaacguggccgagaucgccgacgagguguacauggaggugaucgugggcgaggaggacgccgccgccgccgccgccgccgccgccgugcacgagcagcagauggacgacaacgagaucaagaccuucaugcccaucgccugggccgccgccuacggcaacaacagcgacggcaucgagaacagaaacggcaccgccagcgcccugcugcacaucgacgagagcgccggccugggcagacuggccaagcagaagcccaagaagagaagaagacccgacagcagacaguaccagaccgccaucaucaucggccccgacggccacccccugaccguguaccccugcaugaucugcggcaagaaguucaagagcagaggcuuccugaagagacacaugaagaaccaccccgagcaccuggccaagaagaaguacagaugcaccgacugcgacuacaccaccaacaagaagaucagccugcacaaccaccuggagagccacaagcugaccagcaaggccgagaaggccaucgagugcgacgagugcggcaagcacuucagccacgccggcgcccuguucacccacaagauggugcacaaggagaagggcgccaacaagaugcacaagugcaaguucugcgaguacgagaccgccgagcagggccugcugaacagacaccugcuggccgugcacagcaagaacuucccccacaucugcguggagugcggcaagggcuucagacaccccagcgagcugaagaagcacaugagaauccacaccggcgagaagcccuaccagugccaguacugcgaguacagaagcgccgacagcagcaaccugaagacccacgugaagaccaagcacagcaaggagaugcccuucaagugcgacaucugccugcugaccuucagcgacaccaaggaggugcagcagcacgcccugauccaccaggagagcaagacccaccagugccugcacugcgaccacaagagcagcaacagcagcgaccugaagagacacaucaucagcgugcacaccaaggacuacccccacaagugcgacaugugcgacaagggcuuccacagacccagcgagcugaagaagcacguggccgcccacaagggcaagaagaugcaccagugcagacacugcgacuucaagaucgccgaccccuucgugcugagcagacacauccugagcgugcacaccaaggaccugcccuucagaugcaagagaugcagaaagggcuucagacagcagagcgagcugaagaagcacaugaagacccacagcggcagaaagguguaccagugcgaguacugcgaguacagcaccaccgacgccagcggcuucaagagacacgugaucagcauccacaccaaggacuacccccacagaugcgaguacugcaagaagggcuucagaagacccagcgagaagaaccagcacaucaugagacaccacaaggaggugggccugcccuaa

SEQ ID NO: 25877 - RNA, 2175 nt, Artificial Sequence
  ZFY__Homo_sapiens__NP_001138747
auggacggcgaccagaucgugguggagauccaggaggccguguucgugagcaacaucguggacagcgacaucaccgugcacaacuucgugcccgacgaccccgacagcguggugauccaggacgugguggaggacguggugaucgaggaggacgugcagugcagcgacauccuggaggaggccgacgugagcgagaacgugaucauccccgagcaggugcuggacagcgacgugaccgaggaggugagccugccccacugcaccgugcccgacgacgugcuggccagcgacaucaccagcaccagcaugagcaugcccgagcacgugcugaccagcgagagcaugcacgugugcgacaucggccacguggagcacauggugcacgacagcgugguggaggccgagaucaucaccgacccccugaccagcgacaucgugagcgaggaggugcugguggccgacugcgcccccgaggccgugaucgacgccagcggcaucagcguggaccagcaggacaacgacaaggccagcugcgaggacuaccugaugaucagccuggacgacgccggcaagaucgagcacgacggcagcaccggcgugaccaucgacgccgagagcgagauggaccccugcaagguggacagcaccugccccgaggugaucaagguguacaucuucaaggccgaccccggcgaggacgaccugggcggcaccguggacaucguggagagcgagcccgagaacgaccacggcguggagcugcuggaccagaacagcagcaucagagugcccagagagaagaugguguacaugaccgugaacgacagccagcaggaggacgaggaccugagcaacaacagcgacggcaucgagaacagaaacggcaccgccagcgcccugcugcacaucgacgagagcgccggccugggcagacuggccaagcagaagcccaagaagaagagaagacccgacagcagacaguaccagaccgccaucaucaucggccccgacggccacccccugaccguguaccccugcaugaucugcggcaagaaguucaagagcagaggcuuccugaagagacacaugaagaaccaccccgagcaccuggccaagaagaaguaccacugcaccgacugcgacuacaccaccaacaagaagaucagccugcacaaccaccuggagagccacaagcugaccagcaaggccgagaaggccaucgagugcgacgagugcggcaagcacuucagccacgccggcgcccuguucacccacaagauggugcacaaggagaagggcgccaacaagaugcacaagugcaaguucugcgaguacgagaccgccgagcagggccugcugaacagacaccugcuggccgugcacagcaagaacuucccccacaucugcguggagugcggcaagggcuucagacaccccagcgagcugagaaagcacaugagaauccacaccggcgagaagcccuaccagugccaguacugcgaguacagaagcgccgacagcagcaaccugaagacccacaucaagaccaagcacagcaaggagaugcccuucaagugcgacaucugccugcugaccuucagcgacaccaaggaggugcagcagcacacccuggugcaccaggagagcaagacccaccagugccugcacugcgaccacaagagcagcaacagcagcgaccugaagagacacgugaucagcgugcacaccaaggacuacccccacaagugcgagaugugcgagaagggcuuccacagacccagcgagcugaagaagcacguggccgugcacaagggcaagaagaugcaccagugcagacacugcgacuucaagaucgccgaccccuucgugcugagcagacacauccugagcgugcacaccaaggaccugcccuucagaugcaagagaugcagaaagggcuucagacagcagaacgagcugaagaagcacaugaagacccacagcggcagaaagguguaccagugcgaguacugcgaguacagcaccaccgacgccagcggcuucaagagacacgugaucagcauccacaccaaggacuacccccacagaugcgaguacugcaagaagggcuucagaagacccagcgagaagaaccagcacaucaugagacaccacaaggaggugggccugcccuaa

SEQ ID NO: 25878 - RNA, 1416 nt, Artificial Sequence
  ZFYVE19__Homo_sapiens__NP_001070736
augaacuacgacagccagcagcccccccugcccccccugcccuacgccggcugcagaagagccagcggcuuccccgcccugggcagaggcggcaccgugcccgugggcguguggggcggcgccggccagggcagagagggcagaagcuggggcgagggccccagaggccccggccugggcagaagagaccugagcagcgccgaccccgccgugcugggcgccaccauggagagcagaugcuacggcugcgccgugaaguucacccuguucaagaaggaguacggcugcaagaacugcggcagagccuucugcagcggcugccugagcuucagcgccgccgugcccagaaccggcaacacccagcagaaggugugcaagcagugccacgaggugcugaccagaggcagcagcgccaacgccagcaaguggagccccccccagaacuacaagaagagaguggccgcccuggaggccaagcagaagcccagcaccagccagagccagggccugaccagacaggaccagaugaucgccgagagacuggccagacugagacaggagaacaagcccaagcuggugcccagccaggccgagaucgaggccagacuggccgcccugaaggacgagagacagggcagcauccccagcacccaggagauggaggccagacuggccgcccugcagggcagagugcugcccagccagaccccccagcccgcccaccacacccccgacaccagaacccaggcccagcagacccaggaccugcugacccagcuggccgccgagguggccaucgacgagagcuggaagggcggcggccccgccgccagccugcagaacgaccugaaccagggcggccccggcagcaccaacagcaagagacaggccaacuggagccuggaggaggagaagagcagacugcuggccgaggccgcccuggagcugagagaggagaacaccagacaggagagaauccuggcccuggccaagagacuggccaugcugagaggccaggaccccgagagagugacccugcaggacuacagacugcccgacagcgacgacgacgaggacgaggagaccgccauccagagagugcugcagcagcugaccgaggaggccagccuggacgaggccagcggcuucaacauccccgccgagcaggccagcagacccuggacccagcccagaggcgccgagcccgaggcccaggacguggaccccagacccgaggccgaggaggaggagcugcccuggugcugcaucugcaacgaggacgccacccugagaugcgccggcugcgacggcgaccuguucugcgccagaugcuucagagagggccacgacgccuucgagcugaaggagcaccagaccagcgccuacagcccccccagagccggccaggagcacuaa

SEQ ID NO: 25879 - RNA, 759 nt, Artificial Sequence
  ZFYVE21__Homo_sapiens__NP_001185882
augagcagcgaggugagcgccagaagagacgccaagaagcuggugagaagccccagcggccugagaauggugcccgagcacagagccuucggcagccccuucggccuggaggagccccagugggugcccgacaaggagugcagaagaugcaugcagugcgacgccaaguucgacuuccugaccagaaagcaccacugcagaagaugcggcaagugcuucugcgacagaugcugcagccagaaggugccccugagaagaaugugcuucguggaccccgugagacagugcgccgagugcgcccuggugagccugaaggaggccgaguucuacgacaagcagcugaaggugcugcugagcggcgccaccuuccuggugaccuucggcaacagcgagaagcccgagaccaugaccugcagacugagcaacaaccagagauaccuguuccuggacggcgacagccacuacgagaucgagaucgugcacaucagcaccgugcagauccugaccgagggcuucccccccggcgagaaggacauccacgccuacaccagccugagaggcagccagcccgccagcgagggcggcaacgccagagccaccggcauguuccugcaguacaccgugcccggcaccgagggcgugacccagcugaagcugaccgugguggaggacgugaccgugggcagaagacaggccguggccuggcugguggccaugcacaaggccgccaagcugcuguacgagagcagagaccaguaa

SEQ ID NO: 25880 - RNA, 7620 nt, Artificial Sequence
  ZFYVE26__Homo_sapiens__NP_056161
augaaccaccccuucggcaaggaggaggccgccagccagaagcagcuguucggcuucuucugcgagugccugagaagaggcgagugggagcuggcccaggccugcgugccccagcugcaggagggccagggcgacauccccaagagaguggaggacauccugcaggcccugguggugugccccaaccugcugagaugcggccaggacaucaacccccagagaguggccuggguguggcugcuggugcuggagaaguggcuggccagagagaagaagcugcugcccgugguguucagaagaaagcuggaguuccugcugcugagcgaggaccugcagggcgacauccccgagaacauccuggaggagcuguacgagacccugacccagggcgccgugggccacgugcccgacggcaaccccagaagagagagcuggacccccagacugagcagcgaggccgugagcgugcugugggaccugcugagacagagcccccagcccgcccaggcccugcuggagcugcugcuggaggaggacgacggcaccggccugugccacuggccccugcagaacgcccugguggaccugaucagaaaggcccugagagcccugcagggccccgacagcgugccccccggcgugguggacgccaucuacggcgcccugagaacccugagaugccccgccgagccccugggcguggagcugcaccugcugugcgaggagcugcuggaggccugcagaaccgagggcagcccccugagagaggagagacugcugagcugccugcugcacaaggccagcagaggccugcugagccuguacggccacaccuacgccgagaaggugaccgagaagccccccagagccaccgccagcggcaaggugagccccgaccaccuggaccccgagagagccaugcuggcccuguucagcaaccccaaccccgccgaggccuggaagguggccuacuucuacugccugagcaacaacaagcacuuccuggagcagauccuggugaccgcccugacccugcugaaggaggaggacuuccccaaccugggcugccugcuggacagagaguucagaccccugagcugccugcuggugcugcugggcuggacccacugccagagccuggagagcgccaagagacugcugcagacccugcacagaacccagggccccggcugcgacgagcugcugagagacgccugcgacggccugugggcccaccuggaggugcuggaguggugcauccagcagagcagcaaccccauccccaagagagaccugcuguaccaccugcacggcggcgacagccacagcgugcuguacacccugcaccaccugaccaaccugcccgcccugagagaggaggacgugcugaagcugcugcagaaggugcccgccaaggacccccagcaggagcccgacgccguggacgcccccgugcccgagcaccugagccagugccagaaccugacccuguaccagggcuucugcgccaugaaguacgccaucuacgcccugugcgugaacagccaccagcacagccagugccaggacugcaaggacagccugagcgaggaccuggccagcgccaccgagcccgccaacgacagccugagcagccccggcgccgccaaccuguucagcaccuaccuggccagaugccagcaguaccugugcagcauccccgacagccugugccuggagcugcuggagaacaucuucagccugcugcugaucaccagcgccgaccugcaccccgagccccaccugcccgaggacuacgccgaggacgacgacaucgagggcaagagccccagcggccugagaagccccagcgagagcccccagcacaucgcccaccccgagagaaagagcgagagaggcagccugggcgugcccaagacccuggccuacaccaugcccagccacgugaaggccgagcccaaggacagcuaccccggcccccacagacacagcuuccuggaccugaagcacuucaccagcggcaucagcggcuuccuggccgacgaguucgccaucggcgccuuccugagacugcugcaggagcagcuggacgagaucagcagcagaagcccccccgagaagcccaagcaggagagccagagcugcagcggcagcagagacggccugcagagcagacugcacagacugagcaagguggugagcgaggcccaguggagacacaagguggugaccagcaaccacagaagcgaggagcagcccagcagaagauaccagcccgccaccagacaccccagccugagaagaggcagaagaaccagaagaagccaggccgacggcagagacagaggcagcaaccccagccuggagagcaccagcagcgagcugagcaccagcaccagcgagggcagccugagcgccaugagcggcagaaacgagcugcacagcagacugcacccccacccccagagcagccugauccccaugauguucagcccccccgagagccugcuggccagcugcauccugagaggcaacuucgccgaggcccaccaggugcuguucaccuucaaccugaagagcagccccagcagcggcgagcugauguucauggagagauaccaggaggugauccaggagcuggcccagguggagcacaagaucgagaaccagaacagcgacgccggcagcagcaccaucagaagaaccggcagcggcagaagcacccugcaggccaucggcagcgccgccgccgccggcaugguguucuacagcaucagcgacgugaccgacaagcugcugaacaccagcggcgaccccauccccaugcugcaggaggacuucuggaucagcaccgcccugguggagcccaccgccccccugagagaggugcuggaggaccugagcccccccgccauggccgccuucgaccuggccugcagccagugccagcuguggaagaccugcaagcagcugcuggagaccgccgagagaagacugaacagcagccuggagagaagaggcagaagaaucgaccacgugcugcugaacgccgacggcaucagaggcuuccccguggugcugcagcagaucagcaagagccugaacuaccugcugaugagcgccagccagaccaagagcgagagcguggaggagaagggcggcggcccccccagaugcagcaucaccgagcugcugcagaugugcuggcccagccugagcgaggacugcguggccagccacaccacccugagccagcagcuggaccaggugcugcagagccugagagaggcccuggagcugcccgagcccagaacccccccccugagcagccugguggagcaggccgcccagaaggcccccgaggccgaggcccaccccgugcagauccagacccagcugcugcagaagaaccugggcaagcagacccccagcggcagcagacagauggacuaccugggcaccuucuucagcuacugcagcacccuggccgccgugcugcugcagagccugagcagcgagcccgaccacguggaggugaaggugggcaaccccuucgugcugcugcagcagagcagcagccagcuggugagccaccugcuguucgagagacaggugccccccgagagacuggccgcccugcuggcccaggagaaccugagccugagcgugccccaggugaucgugagcugcugcugcgagccccuggcccugugcagcagcagacagagccagcagaccagcagccugcugaccagacugggcacccuggcccagcugcacgccagccacugccuggacgaccugccccugagcacccccagcagccccagaaccaccgagaaccccacccuggagagaaagcccuacagcagccccagagacagcagccugcccgcccugaccagcagcgcccuggccuuccugaagagcagaagcaagcugcuggccaccguggccugccugggcgccagccccagacugaaggugagcaagcccagccugagcuggaaggagcugagaggcagaagagaggugccccuggccgccgagcagguggccagagagugcgagagacugcuggagcaguucccccuguucgaggccuuccugcuggccgccugggagccccugagaggcagccugcagcagggccagagccuggccgugaaccugugcggcugggccagccugagcaccgugcugcugggccugcacagccccaucgcccuggacgugcugagcgaggccuucgaggagagccugguggccagagacuggagcagagcccugcagcugaccgagguguacggcagagacguggacgaccugagcagcaucaaggacgccgugcugagcugcgccguggccugcgacaaggagggcuggcaguaccuguuccccgugaaggacgccagccugagaagcagacuggcccugcaguucguggacagauggccccuggagagcugccuggagauccuggccuacugcaucagcgacaccgccgugcaggagggccugaagugcgagcugcagagaaagcuggccgagcugcagguguaccagaagauccugggccugcagagcccccccguguggugcgacuggcagacccugagaagcugcugcguggaggaccccagcaccgugaugaacaugauccuggaggcccaggaguacgagcugugcgaggaguggggcugccuguaccccauccccagagagcaccugaucagccugcaccagaagcaccugcugcaccugcuggagagaagagaccacgacaaggcccugcagcugcugagaagaauccccgaccccaccaugugccuggaggugaccgagcagagccuggaccagcacaccagccuggccaccagccacuuccuggccaacuaccugaccacccacuucuacggccagcugaccgccgugagacacagagagauccaggcccuguacgugggcagcaagauccugcugacccugcccgagcagcacagagccagcuacagccaccugagcagcaacccccuguucaugcuggagcagcugcugaugaacaugaagguggacugggccaccguggccgugcagacccugcagcagcugcuggugggccaggagaucggcuucaccauggacgagguggacagccugcugagcagauacgccgagaaggcccuggacuuccccuacccccagagagagaagagaagcgacagcgugauccaccugcaggagaucgugcaccaggccgccgaccccgagacccugcccagaagccccagcgccgaguucagccccgccgccccccccggcaucagcagcauccacagccccagccugagagagagaagcuucccccccacccagcccagccaggaguucgugccccccgccaccccccccgccagacaccagugggugcccgacgagaccgagagcaucugcauggugugcugcagagagcacuucaccauguucaacagaagacaccacugcagaagaugcggcagacuggugugcagcagcugcagcaccaagaagauggugguggagggcugcagagagaaccccgccagagugugcgaccagugcuacagcuacugcaacaaggacgugcccgaggagcccagcgagaagcccgaggcccuggacagcagcaagaacgagagcccccccuacagcuucguggugagagugcccaaggccgacgagguggaguggauccuggaccugaaggaggaggagaacgagcuggugagaagcgaguucuacuacgagcaggcccccagcgccagccugugcaucgccauccugaaccugcacagagacagcaucgccugcggccaccagcugaucgagcacugcugcagacugagcaagggccugaccaaccccgagguggacgccggccugcugaccgacaucaugaagcagcugcuguucagcgccaagaugauguucgugaaggccggccagagccaggaccuggcccugugcgacagcuacaucagcaagguggacgugcugaacauccugguggccgccgccuacagacacgugcccagccuggaccagauccugcagcccgccgccgugaccagacugagaaaccagcugcuggaggccgaguacuaccagcugggcguggaggugagcaccaagaccggccuggacaccaccggcgccuggcacgccuggggcauggccugccugaaggccggcaaccugaccgccgccagagagaaguucagcagaugccugaagccccccuucgaccugaaccagcugaaccacggcagcagacuggugcaggacgugguggaguaccuggagagcaccgugagacccuucgugagccugcaggacgacgacuacuucgccacccugagagagcuggaggccacccugagaacccagagccugagccuggccgugauccccgagggcaagaucaugaacaacaccuacuaccaggagugccuguucuaccugcacaacuacagcaccaaccuggccaucaucagcuucuacgugagacacagcugccugagagaggcccugcugcaccugcugaacaaggagagcccccccgagguguucaucgagggcaucuuccagcccagcuacaagagcggcaagcugcacacccuggagaaccugcuggagagcaucgaccccacccuggagagcuggggcaaguaccugaucgccgccugccagcaccugcagaagaagaacuacuaccacauccuguacgagcugcagcaguucaugaaggaccaggugagagccgccaugaccugcaucagauucuucagccacaaggccaagagcuacaccgagcugggcgagaagcugagcuggcugcugaaggccaaggaccaccugaagaucuaccugcaggagaccagcagaagcagcggcagaaagaagaccaccuucuucagaaagaagaugaccgccgccgacgugagcagacacaugaacacccugcagcugcagauggaggugaccagauuccugcacagaugcgagagcgccggcaccagccagaucaccacccugccccugcccacccuguucggcaacaaccacaugaagauggacguggccugcaaggugaugcugggcggcaagaacguggaggacggcuucggcaucgccuucagagugcugcaggacuuccagcuggacgccgccaugaccuacugcagagccgccagacagcugguggagaaggagaaguacagcgagauccagcagcugcugaagugcgugagcgagagcggcauggccgccaagagcgacggcgacaccauccugcugaacugccuggaggccuucaagagaauccccccccaggagcuggagggccugauccaggccauccacaacgacgacaacaaggugagagccuaccugaucugcugcaagcugagaagcgccuaccugaucgccgugaagcaggagcacagcagagccaccgcccuggugcagcaggugcagcaggccgccaagagcagcggcgacgccguggugcaggacaucugcgcccaguggcugcugaccagccaccccagaggcgcccacggccccggcagcagaaaguaa

SEQ ID NO: 25881 - RNA, 1251 nt, Artificial Sequence
  ZFYVE27__Homo_sapiens__NP_001002261
augcagaccagcgagagagagggcagcggccccgagcugagccccagcgugaugcccgaggccccccuggagagcccccccuuccccaccaagagccccgccuucgaccuguucaaccuggugcugagcuacaagagacuggagaucuaccuggagccccugaaggacgccggcgacggcgugagauaccugcugagauggcagaugccccugugcagccugcugaccugccugggccugaacgugcuguuccugacccugaacgagggcgccugguacagcgugggcgcccugaugaucagcgugcccgcccugcugggcuaccugcaggaggugugcagagccagacugcccgacagcgagcugaugagaagaaaguaccacagcgugagacaggaggaccugcagagaggcagacugagcagacccgaggccguggccgaggugaagagcuuccugauccagcuggaggccuuccugagcagacugugcugcaccugcgaggccgccuacagagugcugcacugggagaaccccguggugagcagccaguucuacggcgcccugcugggcaccgugugcaugcuguaccugcugccccugugcugggugcugacccugcugaacagcacccuguuccugggcaacguggaguucuucagaguggugagcgaguacagagccagccugcagcagagaaugaaccccaagcaggaggagcacgccuucgagagcccccccccccccgacgugggcggcaaggacggccugauggacagcacccccgcccugacccccaccgagagccugagcagccaggaccugacccccggcagcguggaggaggccgaggaggccgagcccgacgaggaguucaaggacgccaucgaggagacccaccugguggugcuggaggacgacgagggcgcccccugccccgccgaggacgagcuggcccugcaggacaacggcuuccugagcaagaacgaggugcugagaagcaaggugagcagacugaccgagagacugagaaagagauaccccaccaacaacuucggcaacugcaccggcugcagcgccaccuucagcgugcugaagaagagaagaagcugcagcaacugcggcaacagcuucugcagcagaugcugcagcuucaaggugcccaagagcagcaugggcgccaccgcccccgaggcccagagagagaccguguucgugugcgccagcugcaaccagacccugagcaaguaa

SEQ ID NO: 25882 - RNA, 2574 nt, Artificial Sequence
  ZFYVE28__Homo_sapiens__NP_001166127
augaugaacagauucagaaaguggcuguacaagcccaagagaagcgacccccagcugcuggccagauucuacuacgccgacgaggagcugaaccagguggccgccgagcuggacagccuggacggcagaaaggacccccagagaugcacccugcuggugagccaguucagaagcugccaggacaacgugcugaacaucaucaaccagaucauggacgagugcaucccccaggacagagcccccagagacuucugcgugaaguuccccgaggagaucagacacgacaaccuggccggccagcugugguucggcgccgagugccuggccgccggcagcaucaucaugaacagagagcuggagagcauggccaugagaccccuggccaaggagcugaccagaagccuggaggacgugagaggcgcccugagagaccaggcccugagagaccugaacaccuacaccgagaagaugagagaggcccugagacacuucgacgugcuguucgccgaguucgagcugagcuacgugagcgccauggugcccgugaagagccccagagaguacuacgugcagcaggaggugaucgugcuguucugcgagaccguggagagcggccuggugguguacgccgacggcccccugaaccuggacagaaagguggaggacaugagcgagcuguucagacccuuccacacccugcugagaaagaucagagaccugcugcagacccugaccgaggaggagcugcacacccuggagagaaaccugugcaucagccaggacguggaguuccccaucagagccgacgugcagggccccgccgcccuggcccccgcccugagcgccccccugccccccgagggcccccugagcgccaaggccaaggaccccgacgccgagcuggccugcagcaugcaguacgacgaccaggagcuggagcagcugagcagaauggugcacagagccggcgacgagaugagcagccugcugagcccccccaucgccugccagagccccgcccacagacccggcgccgagggcagccccggcggcgaggccagccccggcagacccagacugagaagcggcagcgacgaggaggagagaguguucuucauggacgacguggagggcaccgccgaggcccuggccagacccgagagccccgccggccccuucggcugggccggcagcaccugggccgacccccaggagaagggccagggcggccccggcggcgccgccggcaucagccugcccgccagcgagaaggaggaggaccugagcaacaacaaccuggaggccgagggcaccgacggcgccagccuggccggcaccagcagcugcagcugccuggacagcagacugcaccuggacggcugggaggugggcgccgacgacgccgagaccgccgagaugaucgcccacagaaccggcggcaugaagcugagcgccaccgugaucuucaaccccaagagccccaccagccuggacagcgccguggccacccaggaggccgccagcgagcccguggccgagggcauggacggcggcccccacaagcugagcaccggcgccaccaacugccugcugcacagcugcgugugcugcggcagcugcggcgacagcagagaggacgugguggagagacugagagagaagugcagccccggcggcgugaucggcgccagcuacgccgccggccuggccaaggccagcgacagagcccccgagagacaggaggaggcccccccccccagcgaggacgccagcaacggcagagagcccaaggcccccaccagcgacaagugccugccccacaccagcggcagccagguggacaccgccagcggccugcagggcgaggccggcguggccggccagcaggagcccgaggccagagagcugcacgccggcagccccagcgcccacgaggccccccaggcccugagcggcagcagcagcagcaccgccggcagcugcagcagcgacaagaugggccccgaggccgcccccgccgccacccacgccgccccccaggccaccagagagaagaucagaagcagauuccacggcagccacgaccugauccacagacuguucgugugcaucagcggcguggccgaccagcugcagaccaacuacgccagcgaccugagaagcauccugaagacccuguucgaggugauggccaccaagcccgagaccgacgacaaggagaagcugagaaaggugacccagacccugagaagcgccgcccuggaggacugcgcccugugccaggagacccugagcagcagcgagcuggccgccaagaccagagacggcgacuucgaggacccccccgagugggugcccgacgaggccugcggcuucugcaccgccugcaaggcccccuucaccgugaucagaagaaagcaccacugcagaagcugcggcaagaucuucugcagcagaugcagcagccacagcgccccccugcccagauacggccaggugaagcccgugagagugugcacccacugcuacauguuccacgugacccccuucuacagcgacaaggccggccuguaa

SEQ ID NO: 25883 - RNA, 4278 nt, Artificial Sequence
  ZFYVE9__Homo_sapiens__XP_011540739
auggagaacuacuuccaggccgaggccuacaaccuggacaaggugcuggacgaguucgagcagaacgaggacgagaccgugagcagcacccugcuggacaccaaguggaacaagauccuggacccccccagccacagacugagcuucaaccccacccuggccagcgugaacgagagcgccgugagcaacgagagccagccccagcugaagguguucagccuggcccacagcgccccccugaccaccgaggaggaggaccacugcgccaacggccaggacugcaaccugaaccccgagaucgccaccauguggaucgacgagaacgccguggccgaggaccagcugaucaagagaaacuacagcugggacgaccagugcagcgccguggaggugggcgagaagaagugcggcaaccuggccugccugcccgacgagaagaacgugcuggugguggccgugaugcacaacugcgacaagagaacccugcagaacgaccugcaggacugcaacaacuacaacagccagagccugauggacgccuucagcugcagccuggacaacgagaacagacagaccgaccaguucagcuucagcaucaacgagagcaccgagaaggacaugaacagcgagaagcagauggacccccugaacagacccaagaccgagggcagaagcgugaaccaccugugccccaccagcagcgacagccuggccagcgugugcagccccagccagcugaaggacgacggcagcaucggcagagaccccagcaugagcgccaucaccagccugaccguggacagcgugaucagcagccagggcaccgacggcugccccgccgugaagaagcaggagaacuacauccccgacgaggaccugaccggcaagaucagcagccccagaaccgaccugggcagccccaacagcuucagccacaugagcgagggcauccugaugaagaaggagcccgccgaggagagcaccaccgaggagagccugagaagcggccugccccugcugcugaagcccgacaugcccaacggcagcggcagaaacaacgacugcgagagaugcagcgacugccuggugcccaacgaggugagagccgacgagaacgagggcuacgagcacgaggagacccugggcaccaccgaguuccugaacaugaccgagcacuucagcgagagccaggacaugaccaacuggaagcugaccaagcugaacgagaugaacgacagccaggugaacgaggagaaggagaaguuccugcagaucagccagcccgaggacaccaacggcgacagcggcggccagugcgugggccuggccgacgccggccuggaccugaagggcaccugcaucagcgagagcgaggagugcgacuucagcaccgugaucgacacccccgccgccaacuaccugagcaacggcugcgacagcuacggcaugcaggaccccggcgugagcuucgugcccaagacccugcccagcaaggaggacagcgugaccgaggagaaggagaucgaggagagcaagagcgagugcuacagcaacaucuacgagcagagaggcaacgaggccaccgagggcagcggccugcugcugaacagcaccggcgaccugaugaagaagaacuaccugcacaacuucugcagccaggugcccagcgugcugggccagagcagccccaaggugguggccagccugcccagcaucagcgugcccuucggcggcgccagacccaagcagcccagcaaccugaagcugcagauccccaagccccugagcgaccaccugcagaacgacuuccccgccaacagcggcaacaacaccaagaacaagaacgacauccugggcaaggccaagcugggcgagaacagcgccaccaacgugugcagccccagccugggcaacaucagcaacguggacaccaacggcgagcaccuggagagcuacgaggccgagaucagcaccagacccugccuggcccuggcccccgacagccccgacaacgaccugagagccggccaguucggcaucagcgccagaaagcccuucaccacccugggcgagguggcccccgugugggugcccgacagccaggcccccaacugcaugaagugcgaggccagauucaccuucaccaagagaagacaccacugcagagccugcggcaagguguucugcgccagcugcugcagccugaagugcaagcugcuguacauggacagaaaggaggccagagugugcgugaucugccacagcgugcugaugaacgcccaggccugggagaacaugaugagcgccagcagccagagccccaaccccaacaaccccgccgaguacugcagcaccauccccccccugcagcaggcccaggccagcggcgcccugagcagccccccccccaccgugauggugcccgugggcgugcugaagcaccccggcgccgagguggcccagcccagagagcagagaagagugugguucgccgacggcauccugcccaacggcgagguggccgacgccgccaagcugaccaugaacggcaccagcagcgccggcacccuggccgugagccacgaccccgugaagcccgugaccaccagcccccugcccgccgagaccgacaucugccuguucagcggcagcaucacccaggugggcagccccgugggcagcgccaugaaccugauccccgaggacggccugccccccauccugaucagcaccggcgugaagggcgacuacgccguggaggagaagcccagccagaucagcgugaugcagcagcuggaggacggcggccccgacccccugguguucgugcugaacgccaaccugcugagcauggugaagaucgugaacuacgugaacagaaagugcuggugcuucaccaccaagggcaugcacgccgugggccagagcgagaucgugauccugcugcagugccugcccgacgagaagugccugcccaaggacaucuucaaccacuucgugcagcuguacagagacgcccuggccggcaacguggugagcaaccugggccacagcuucuucagccagagcuuccugggcagcaaggagcacggcggcuuccuguacgugaccagcaccuaccagagccugcaggaccuggugcugcccaccccccccuaccuguucggcauccugauccagaagugggagacccccugggccaagguguuccccaucagacugaugcugagacugggcgccgaguacagacuguaccccugcccccuguucagcgugagauucagaaagccccuguucggcgagaccggccacaccaucaugaaccugcuggccgacuucagaaacuaccaguacacccugcccguggugcagggccuggugguggacauggaggugagaaagaccagcaucaagauccccagcaacagauacaacgagaugaugaaggccaugaacaagagcaacgagcacgugcuggccggcggcgccugcuucaacgagaaggccgacagccaccuggugugcgugcagaacgacgacggcaacuaccagacccaggccaucagcauccacaaccagcccagaaaggugaccggcgccagcuucuucguguucagcggcgcccugaagagcagcagcggcuaccuggccaagagcagcaucguggaggacggcgugauggugcagaucaccgccgagaacauggacagccugagacaggcccugagagagaugaaggacuucaccaucaccugcggcaaggccgacgccgaggagccccaggagcacauccacauccaguggguggacgacgacaagaacgugagcaagggcguggugagccccaucgacggcaagagcauggagaccaucaccaacgugaagaucuuccacggcagcgaguacaaggccaacggcaaggugaucagauggaccgagguguucuuccuggagaacgacgaccagcacaacugccugagcgaccccgccgaccacagcagacugaccgagcacguggccaaggccuucugccuggcccugugcccccaccugaagcugcugaaggaggacggcaugaccaagcugggccugagagugacccuggacagcgaccaggugggcuaccaggccggcagcaacggccagccccugcccagccaguacaugaacgaccuggacagcgcccuggugcccgugauccacggcggcgccugccagcugagcgagggccccguggugauggagcugaucuucuacauccuggagaacaucguguaa

SEQ ID NO: 25884 - RNA, 627 nt, Artificial Sequence
  ZG16B__Homo_sapiens__NP_660295
augggcgcccagggcgcccaggagagcaucaaggccauguggagagugcccggcaccaccagaagacccgugaccggcgagagccccggcaugcacagacccgaggccaugcugcugcugcugacccuggcccugcugggcggccccaccugggccggcaagauguacggccccggcggcggcaaguacuucagcaccaccgaggacuacgaccacgagaucaccggccugagagugagcgugggccugcugcuggugaagagcgugcaggugaagcugggcgacagcugggacgugaagcugggcgcccugggcggcaacacccaggaggugacccugcagcccggcgaguacaucaccaagguguucguggccuuccaggccuuccugagaggcauggugauguacaccagcaaggacagauacuucuacuucggcaagcuggacggccagaucagcagcgccuaccccagccaggagggccaggugcuggugggcaucuacggccaguaccagcugcugggcaucaagagcaucggcuucgaguggaacuacccccuggaggagcccaccaccgagccccccgugaaccugaccuacagcgccaacagccccgugggcagauaa

SEQ ID NO: 25885 - RNA, 816 nt, Artificial Sequence
  ZGLP1__Homo_sapiens__NP_001096637
augaccgagccccaggugggcugcguggccugccccagagugcacaaggagcccgcccaggugggcacccccuggcccgccaagcccagaagccaccccagaaagagagaccccaccgcccugcugcccagaagccuguggcccgccugccaggagagcgugaccgcccugugcuuccugcaggagaccguggagagacugggccagagccccgcccaggacacccccgugcugggccccugcugggaccccauggcccugggcacccagggcagacugcugcuggacagagacagcaaggacacccagaccagaaucagccagaagggcagaagacugcagccccccggcacccccagcgcccccccccagagaagacccagaaagcagcugaaccccugcagaggcaccgagagaguggaccccggcuucgagggcgugacccugaaguuccagaucaagcccgacagcagccugcagaucauccccaccuacagccugcccugcagcagcagaagccaggagagccccgccgacgccgugggcggccccgccgcccaccccggcggcaccgaggcccacagcgccggcagcgaggcccuggagcccagaagaugcgccagcugcagaacccagagaaccccccuguggagagacgccgaggacggcaccccccugugcaacgccugcggcaucagauacaagaaguacggcaccagaugcagcagcugcuggcuggugcccagaaagaacgugcagcccaagagacugugcggcagaugcggcgugagccuggaccccauccaggagggcuaa

SEQ ID NO: 25886 - RNA, 1536 nt, Artificial Sequence
  ZGPAT__Homo_sapiens__NP_001076582
auggacgaggagagccuggagagcgcccugcagaccuacagagcccagcugcagcagguggagcuggcccugggcgccggccuggacagcagcgagcaggccgaccugagacagcugcagggcgaccugaaggagcugaucgagcugaccgaggccagccuggugagcgugagaaagagcagccugcuggccgcccuggacgaggagagacccggcagacaggaggacgccgaguaccaggccuucagagaggccaucaccgaggccguggaggcccccgccgccgccagaggcagcggcagcgagaccgugcccaaggccgaggccggccccgagagcgccgccggcggccaggaggaggaggagggcgaggacgaggaggagcugagcggcaccaaggugagcgcccccuacuacagcagcuggggcacccuggaguaccacaacgccaugguggugggcaccgaggaggccgaggacggcagcgccggcgugagagugcuguaccuguaccccacccacaagagccugaagcccugccccuucuuccuggagggcaagugcagauucaaggagaacugcagauucagccacggccagguggugagccuggacgagcugagacccuuccaggaccccgaccugagcagccugcaggccggcagcgccugccuggccaagcaccaggacggccuguggcacgccgccagaaucaccgacguggacaacggcuacuacaccgugaaguucgacagccugcugcugagagaggccgugguggagggcgacggcauccugcccccccugagaaccgaggccaccgagagcgacagcgacagcgacggcaccggcgacagcagcuacgccagaguggugggcagcgacgccguggacagcggcaccugcagcagcgccuucgccggcugggaggugcacaccagaggcaucggcagcagacugcugaccaagaugggcuacgaguucggcaagggccugggcagacacgccgagggcagaguggagcccauccacgccguggugcugcccagaggcaagagccuggaccagugcguggagacccugcagaagcagaccagagugggcaaggccggcaccaacaagccccccagaugcagaggcagaggcgccagacccggcggcagacccgcccccagaaacguguucgacuuccugaacgagaagcugcagggccaggcccccggcgcccuggaggccggcgccgcccccgccggcagaagaagcaaggacauguaccacgccagcaagagcgccaagagagcccugagccugagacuguuccagaccgaggagaagaucgagagaacccagagagacaucagaagcauccaggaggcccuggccagaaacgccggcagacacagcguggccagcgcccagcugcaggagaagcuggccggcgcccagagacagcugggccagcugagagcccaggaggccggccugcagcaggagcagagaaaggccgacacccacaagaagaugaccgaguucuaa

SEQ ID NO: 25887 - RNA, 2622 nt, Artificial Sequence
  ZHX1__Homo_sapiens__NP_009153
auggccagcagaagaaagagcaccacccccugcauggugcuggccagcgagcaggaccccgaccuggagcugaucagcgaccuggacgagggcccccccgugcugacccccguggagaacaccagagccgagagcaucagcagcgacgaggaggugcacgagagcguggacagcgacaaccagcagaacaagaagguggagggcggcuacgagugcaaguacugcaccuuccagacccccgaccugaacauguucaccuuccacguggacagcgagcaccccaacguggugcugaacagcagcuacgugugcguggagugcaacuuccugaccaagagauacgacgcccugagcgagcacaaccugaaguaccaccccggcgaggagaacuucaagcugaccauggugaagagaaacaaccagaccaucuucgagcagaccaucaacgaccugaccuucgacggcagcuucgugaaggaggagaacgccgagcaggccgagagcaccgaggugagcagcagcggcaucagcaucagcaagacccccaucaugaagaugaugaagaacaagguggagaacaagagaaucgccgugcaccacaacagcguggaggacgugcccgaggagaaggagaacgagaucaagcccgacagagaggagaucguggagaaccccagcagcagcgccagcgagagcaacaccagcaccagcaucgugaacagaauccaccccagcaccgccagcaccguggugacccccgccgccgugcugcccggccuggcccaggugaucaccgccgugagcgcccagcagaacagcaaccugauccccaaggugcugauccccgugaacagcauccccaccuacaacgccgcccuggacaacaacccccugcugcugaacaccuacaacaaguuccccuaccccaccaugagcgagaucaccgugcugagcgcccaggccaaguacaccgaggagcagaucaagaucugguucagcgcccagagacugaagcacggcgugagcuggacccccgaggagguggaggaggccagaagaaagcaguucaacggcaccgugcacaccgugccccagaccaucaccgugauccccacccacaucagcaccggcagcaacggccugcccagcauccugcagaccugccagaucgugggccagcccggccuggugcugacccagguggccggcaccaacacccugcccgugaccgcccccaucgcccugaccguggccggcgugcccagccagaacaacauccagaagagccaggugcccgccgcccagcccaccgccgagaccaagcccgccaccgccgccgugcccaccagccagagcgugaagcacgagaccgcccuggugaaccccgacagcuucggcaucagagccaagaagaccaaggagcagcuggccgagcugaaggugagcuaccugaagaaccaguucccccacgacagcgagaucaucagacugaugaagaucaccggccugaccaagggcgagaucaagaagugguucagcgacaccagauacaaccagagaaacagcaagagcaaccagugccugcaccugaacaacgacagcagcaccaccaucaucaucgacagcagcgacgagaccaccgagagccccaccgugggcaccgcccagcccaagcagagcuggaaccccuuccccgacuucaccccccagaaguucaaggagaagaccgccgagcagcugagagugcugcaggccagcuuccugaacagcagcgugcugaccgacgaggagcugaacagacugagagcccagaccaagcugaccagaagagagaucgacgccugguucaccgagaagaagaagagcaaggcccugaaggaggagaagauggagaucgacgagagcaacgccggcagcagcaaggaggaggccggcgagaccagccccgccgacgagagcggcgcccccaagagcggcagcaccggcaagaucugcaagaagacccccgagcagcugcacaugcugaagagcgccuucgugagaacccaguggcccagccccgaggaguacgacaagcuggccaaggagagcggccuggccagaaccgacaucgugagcugguucggcgacaccagauacgccuggaagaacggcaaccugaagugguacuacuacuaccagagcgccaacagcagcagcaugaacggccugagcagccugagaaagagaggcagaggcagacccaagggcagaggcagaggcagacccagaggcagacccagaggcagcaagagaaucaacaacugggacagaggccccagccugaucaaguucaagaccggcaccgccauccugaaggacuacuaccugaagcacaaguuccugaacgagcaggaccuggacgagcuggugaacaagagccacaugggcuacgagcaggugagagagugguucgccgagagacagagaagaagcgagcugggcaucgagcuguucgaggagaacgaggaggaggacgaggugaucgacgaccaggaggaggacgaggaggagaccgacgacagcgacaccugggagccccccagacacgugaagagaaagcugagcaagagcgacgacuaa

SEQ ID NO: 25888 - RNA, 2514 nt, Artificial Sequence
  ZHX2__Homo_sapiens__XP_011515234
auggccagcaagagaaagagcaccacccccugcauggugagaaccagccaggugguggagcaggacgugcccgaggagguggacagagccaaggagaagggcaucggcaccccccagcccgacguggccaaggacagcugggccgccgagcuggagaacagcagcaaggagaacgaggugaucgaggugaagagcaugggcgagagccagagcaagaagcugcagggcggcuacgagugcaaguacugccccuacagcacccagaaccugaacgaguucaccgagcacguggacaugcagcaccccaacgugauccugaacccccuguacgugugcgccgagugcaacuucaccaccaagaaguacgacagccugagcgaccacaacagcaaguuccaccccggcgaggccaacuucaagcugaagcugaucaagagaaacaaccagaccgugcuggagcagagcaucgagaccaccaaccacguggugagcaucaccaccagcggccccggcaccggcgacagcgacagcggcaucagcgugagcaagacccccaucaugaagcccggcaagcccaaggccgacgccaagaaggugcccaagaagcccgaggagaucacccccgagaaccacguggagggcaccgccagacuggugaccgacaccgccgagauccugagcagacugggcggcguggagcugcugcaggacacccugggccacgugaugcccagcgugcagcugccccccaacaucaaccuggugcccaaggugcccgugccccugaacaccaccaaguacaacagcgcccuggacaccaacgccaccaugaucaacagcuucaacaaguuccccuaccccacccaggccgagcugagcuggcugaccgccgccagcaagcaccccgaggagcacaucagaaucugguucgccacccagagacugaagcacggcaucagcuggagccccgaggagguggaggaggccagaaagaagauguucaacggcaccauccagagcgugccccccaccaucaccgugcugcccgcccagcuggcccccaccaaggugacccagcccauccugcagaccgcccugcccugccagauccugggccagaccagccuggugcugacccaggugaccagcggcagcaccaccgugagcugcagccccaucacccuggccguggccggcgugaccaaccacggccagaagagaccccuggugaccccccaggccgcccccgagcccaagagaccccacaucgcccaggugcccgagcccccccccaagguggccaaccccccccugacccccgccagcgacagaaagaagaccaaggagcagaucgcccaccugaaggccagcuuccugcagagccaguuccccgacgacgccgagguguacagacugaucgaggugaccggccuggccagaagcgagaucaagaagugguucagcgaccacagauacagaugccagagaggcaucgugcacaucaccagcgagagccuggccaaggaccagcuggccaucgccgccagcagacacggcagaaccuaccacgccuaccccgacuucgccccccagaaguucaaggagaagacccagggccaggugaagauccuggaggacagcuuccugaagagcagcuuccccacccaggccgagcuggacagacugagaguggagaccaagcugagcagaagagagaucgacagcugguucagcgagagaagaaagcugagagacagcauggagcaggccgugcuggacagcaugggcagcggcaagaagggccaggacgugggcgcccccaacggcgcccugagcagacuggaccagcugagcggcgcccagcugaccagcagccugcccagccccagccccgccaucgccaagagccaggagcaggugcaccugcugagaagcaccuucgccagaacccaguggcccaccccccaggaguacgaccagcuggccgccaagaccggccuggugagaaccgagaucgugagaugguucaaggagaacagaugccugcugaagaccggcaccgugaaguggauggagcaguaccagcaccagcccauggccgacgaccacggcuacgacgccguggccagaaaggccaccaagcccauggccgagagccccaagaacggcggcgacguggugccccaguacuacaaggaccccaagaagcugugcgaggaggaccuggagaagcuggugaccagagugaaggugggcagcgagcccgccaaggacugccugcccgccaagcccagcgaggccaccagcgacagaagcgagggcagcagcagagacggccagggcagcgacgagaacgaggagagcagcgugguggacuacguggaggugaccgugggcgaggaggacgccaucagcgacagaagcgacagcuggagccaggccgccgccgagggcgugagcgagcuggccgagagcgacagcgacugcgugcccgccgaggccggccaggccuaa

SEQ ID NO: 25889 - RNA, 1344 nt, Artificial Sequence
  ZIC1__Homo_sapiens__NP_003403
augcugcuggacgccggcccccaguaccccgccaucggcgugaccaccuucggcgccagcagacaccacagcgccggcgacguggccgagagagacgugggccugggcaucaaccccuucgccgacggcaugggcgccuucaagcugaaccccagcagccacgagcuggccagcgccggccagaccgccuucaccagccaggcccccggcuacgccgccgccgccgcccugggccaccaccaccaccccggccacgugggcagcuacagcagcgccgccuucaacagcaccagagacuuccuguucagaaacagaggcuucggcgacgccgccgccgccgccagcgcccagcacagccuguucgccgccagcgccggcggcuucggcggcccccacggccacaccgacgccgccggccaccugcuguuccccggccugcacgagcaggccgccggccacgccagccccaacguggugaacggccagaugagacugggcuucagcggcgacauguaccccagacccgagcaguacggccaggugaccagccccagaagcgagcacuacgccgccccccagcugcacggcuacggccccaugaacgugaacauggccgcccaccacggcgccggcgccuucuucagauacaugagacagcccaucaagcaggagcugaucugcaaguggaucgagcccgagcagcuggccaaccccaagaagagcugcaacaagaccuucagcaccaugcacgagcuggugacccacgugaccguggagcacgugggcggccccgagcagagcaaccacaucugcuucugggaggagugccccagagagggcaagcccuucaaggccaaguacaagcuggugaaccacaucagagugcacaccggcgagaagcccuuccccugccccuuccccggcugcggcaagguguucgccagaagcgagaaccugaagauccacaagagaacccacaccggcgagaagcccuucaagugcgaguucgagggcugcgacagaagauucgccaacagcagcgacagaaagaagcacaugcacgugcacaccagcgacaagcccuaccugugcaagaugugcgacaagagcuacacccaccccagcagccugagaaagcacaugaaggugcacgagagcagcagccagggcagccagcccagccccgccgccagcagcggcuacgagagcagcaccccccccaccaucgugagccccagcaccgacaaccccaccaccagcagccugagccccagcagcagcgccgugcaccacaccgccggccacagcgcccugagcagcaacuucaacgagugguacguguaa

SEQ ID NO: 25890 - RNA, 1599 nt, Artificial Sequence
  ZIC2__Homo_sapiens__NP_009060
augcugcuggacgccggcccccaguuccccgccaucggcgugggcagcuucgccagacaccaccaccacagcgccgccgccgccgccgccgccgccgccgagaugcaggacagagagcugagccuggccgccgcccagaacggcuucguggacagcgccgccgcccacaugggcgccuucaagcugaaccccggcgcccacgagcugagccccggccagagcagcgccuucaccagccagggccccggcgccuaccccggcagcgccgccgccgccgccgccgccgccgcccugggcccccacgccgcccacgugggcagcuacagcggcccccccuucaacagcaccagagacuuccuguucagaagcagaggcuucggcgacagcgcccccggcggcggccagcacggccuguucggccccggcgccggcggccugcaccacgcccacagcgacgcccagggccaccugcuguuccccggccugcccgagcagcacggcccccacggcagccagaacgugcugaacggccagaugagacugggccugcccggcgagguguucggcagaagcgagcaguacagacagguggccagccccagaaccgaccccuacagcgccgcccagcugcacaaccaguacggccccaugaacaugaacaugggcaugaacauggccgccgccgccgcccaccaccaccaccaccaccaccaccaccccggcgccuucuucagauacaugagacagcagugcaucaagcaggagcugaucugcaaguggaucgaccccgagcagcugagcaaccccaagaagagcugcaacaagaccuucagcaccaugcacgagcuggugacccacgugagcguggagcacgugggcggccccgagcagagcaaccacgugugcuucugggaggagugccccagagagggcaagcccuucaaggccaaguacaagcuggugaaccacaucagagugcacaccggcgagaagcccuuccccugccccuuccccggcugcggcaagguguucgccagaagcgagaaccugaagauccacaagagaacccacaccggcgagaagcccuuccagugcgaguucgagggcugcgacagaagauucgccaacagcagcgacagaaagaagcacaugcacgugcacaccagcgacaagcccuaccugugcaagaugugcgacaagagcuacacccaccccagcagccugagaaagcacaugaaggugcacgagagcagcccccagggcagcgagagcagccccgccgccagcagcggcuacgagagcagcaccccccccggccuggugagccccagcgccgagccccagagcagcagcaaccugagccccgccgccgccgccgccgccgccgccgccgccgccgccgccgccgccgugagcgccgugcacagaggcggcggcagcggcagcggcggcgccggcggcggcagcggcggcggcagcggcagcggcggcggcggcggcggcgccggcggcggcggcggcggcagcagcggcggcggcagcggcaccgccggcggccacagcggccugagcagcaacuucaacgagugguacguguaa

SEQ ID NO: 25891 - RNA, 1404 nt, Artificial Sequence
  ZIC3__Homo_sapiens__NP_003404
augaccaugcugcuggacggcggcccccaguuccccggccugggcgugggcagcuucggcgcccccagacaccacgagaugcccaacagagagcccgccggcaugggccugaaccccuucggcgacagcacccacgccgccgccgccgccgccgccgccgccgccuucaagcugagccccgccgccgcccacgaccugagcagcggccagagcagcgccuucaccccccagggcagcggcuacgccaacgcccugggccaccaccaccaccaccaccaccaccaccaccacaccagccaggugcccagcuacggcggcgccgccagcgccgccuucaacagcaccagagaguuccuguucagacagagaagcagcggccugagcgaggccgccagcggcggcggccagcacggccuguucgccggcagcgccagcagccugcacgcccccgccggcauccccgagccccccagcuaccugcuguuccccggccugcacgagcagggcgccggccaccccagccccaccggccacguggacaacaaccaggugcaccugggccugagaggcgagcuguucggcagagccgaccccuacagacccguggccagccccagaaccgaccccuacgccgccggcgcccaguuccccaacuacagccccaugaacaugaacaugggcgugaacguggccgcccaccacggccccggcgccuucuucagauacaugagacagcccaucaagcaggagcugagcugcaaguggaucgacgaggcccagcugagcagacccaagaagagcugcgacagaaccuucagcaccaugcacgagcuggugacccacgugaccauggagcacgugggcggccccgagcagaacaaccacgugugcuacugggaggagugccccagagagggcaagagcuucaaggccaaguacaagcuggugaaccacaucagagugcacaccggcgagaagcccuuccccugccccuuccccggcugcggcaagaucuucgccagaagcgagaaccugaagauccacaagagaacccacaccggcgagaagcccuucaagugcgaguucgagggcugcgacagaagauucgccaacagcagcgacagaaagaagcacaugcacgugcacaccagcgacaagcccuacaucugcaaggugugcgacaagagcuacacccaccccagcagccugagaaagcacaugaaggugcacgagagccagggcagcgacagcagccccgccgccagcagcggcuacgagagcagcaccccccccgccaucgccagcgccaacagcaaggacaccaccaagacccccagcgccgugcagaccagcaccagccacaaccccggccugccccccaacuucaacgagugguacguguaa

SEQ ID NO: 25892 - RNA, 1155 nt, Artificial Sequence
  ZIC4__Homo_sapiens__NP_001161850
augccccccuucugcagaaacgccaagcugggccugcugagcuuccugaucugcgccggcagaagccugcugccccugggcaagaacgccuucuggcuggagagaaucgagaacaacaacacccugugggagaaggcccagagccagaagaugagauacaagaccagccuggugaugagaaagagacugagacuguacagaaacacccugaaggagagcagcagcagcagcggccaccacggcccccagcugaccgccgccagcagccccagcguguuccccggccugcacgaggagcccccccaggccagccccagcagaccccugaacggccugcugagacugggccugcccggcgacauguacgccagacccgagcccuucccccccggccccgccgccagaagcgacgcccuggccgccgccgccgcccugcacggcuacggcggcaugaaccugaccgugaaccuggccgccccccacggccccggcgccuucuucagauacaugagacagcccaucaagcaggagcugaucugcaaguggcuggccgccgacggcaccgccacccccagccugugcagcaagaccuucagcaccaugcacgagcuggugacccacgugaccguggagcacgugggcggccccgagcaggccaaccacaucugcuucugggaggagugccccagacagggcaagcccuucaaggccaaguacaagcuggugaaccacaucagagugcacaccggcgagaagcccuuccccugccccuuccccggcugcggcaagguguucgccagaagcgagaaccugaagauccacaagagaacccacaccggcgagaagcccuucagaugcgaguucgagggcugcgagagaagauucgccaacagcagcgacagaaagaagcacagccacgugcacaccagcgacaagcccuacaccugcaaggugagaggcugcgacaagugcuacacccaccccagcagccugagaaagcacaugaaggugcacggcagaagccccccccccagcagcggcuacgacagcgccacccccagcgcccuggugagccccagcagcgacugcggccacaagagccagguggccagcagcgccgccguggccgccagaaccgccgaccugagcgaguaa

SEQ ID NO: 25893 - RNA, 1992 nt, Artificial Sequence
  ZIC5__Homo_sapiens__NP_149123
auguuccugaaggccggcagaggcaacaaggugccccccgugagaguguacggccccgacugcguggugcugauggagcccccccugagcaagagaaacccccccgcccugagacuggccgaccuggccaccgcccaggugcagccccugcagaacaugaccggcuuccccgcccuggccggcccccccgcccacagccagcugagagccgccguggcccaccugagacugagagaccugggcgccgaccccggcguggccaccaccccccugggccccgagcacauggcccaggccagcacccugggccugagcccccccagccaggccuuccccgcccaccccgaggcccccgccgccgccgccagagccgccgcccugguggcccaccccggcgccggcagcuaccccugcggcggcggcagcagcggcgcccagcccagcgccccccccccccccgcccccccccugccccccacccccagccccccccccccccccccccccccccccccccccgcccugagcggcuacaccaccaccaacagcggcggcggcggcagcagcggcaagggccacagcagagacuucgugcugagaagagaccugagcgccaccgcccccgccgccgccaugcacggcgccccccugggcggcgagcagagaagcggcaccggcagcccccagcaccccgccccccccccccacagcgccggcauguucaucagcgccagcggcaccuacgccggccccgacggcagcggcggccccgcccuguuccccgcccugcacgacacccccggcgcccccggcggccacccccacccccugaacggccagaugagacugggccuggccgccgccgccgccgccgccgccgccgagcuguacggcagagccgagccccccuucgcccccagaagcggcgacgcccacuacggcgccguggccgccgccgccgccgccgcccugcacggcuacggcgccgugaaccugaaccugaaccuggccgccgccgccgccgccgccgccgccggccccggcccccaccugcagcaccacgcccccccccccgcccccccccccccccccgcccccgcccagcacccccaccagcaccacccccaccugcccggcgccgccggcgccuuccugagauacaugagacagcccaucaagcaggagcugaucugcaaguggaucgaccccgacgagcuggccggccugcccccccccccccccccccccccccccccccccccccccccccccgccggcggcgccaagcccugcagcaagaccuucggcaccaugcacgagcuggugaaccacgugaccguggagcacgugggcggccccgagcagagcagccacgugugcuucugggaggacugccccagagagggcaagcccuucaaggccaaguacaagcugaucaaccacaucagagugcacaccggcgagaagcccuuccccugccccuuccccggcugcggcaagguguucgccagaagcgagaaccugaagauccacaagagaacccacaccggcgagaagcccuucaagugcgaguucgacggcugcgacagaaaguucgccaacagcagcgacagaaagaagcacagccacgugcacaccagcgacaagcccuacuacugcaagaucagaggcugcgacaagagcuacacccaccccagcagccugagaaagcacaugaagauccacugcaagagccccccccccagccccggcccccugggcuacagcagcgugggcacccccgugggcgccccccugagccccgugcuggaccccgccagaagccacagcagcacccugagcccccaggugaccaaccugaacgagugguacgugugccaggccagcggcgcccccagccaccugcacacccccagcagcaacggcaccaccagcgagaccgaggacgaggagaucuacggcaaccccgagguggugagaaccauccacuaa

SEQ ID NO: 25894 - RNA, 1464 nt, Artificial Sequence
  ZIK1__Homo_sapiens__NP_001010879
auggccgccgccgcccugagagcccccacccaggugaccgugagccccgagacccacauggaccugaccaagggcugcgugaccuucgaggacaucgccaucuacuucagccaggacgaguggggccugcuggacgaggcccagagacugcuguaccuggaggugaugcuggagaacuucgcccugguggccagccugggcugcggccacggcaccgaggacgaggagacccccagcgaccagaacgugagcgugggcgugagccagagcaaggccggcagcagcacccagaagacccagagcugcgagaugugcgugcccgugcugaaggacauccugcaccuggccgaccugcccggccagaagcccuaccuggugggcgagugcaccaaccaccaccagcaccagaagcaccacagcgccaagaagagccugaagagagacauggacagagccagcuacgugaagugcugccuguucugcaugagccugaagcccuucagaaagugggaggugggcaaggaccugcccgccaugcugagacugcugagaagccugguguuccccggcggcaagaagcccggcaccaucaccgagugcggcgaggacaucagaagccagaagagccacuacaagagcggcgagugcggcaaggccagcagacacaagcacacccccguguaccaccccagaguguacaccggcaagaagcuguacgagugcagcaagugcggcaaggccuucagaggcaaguacagccuggugcagcaccagagagugcacaccggcgagagacccugggagugcaacgagugcggcaaguucuucagccagaccagccaccugaacgaccacagaagaauccacaccggcgagagacccuacgagugcagcgagugcggcaagcuguucagacagaacagcagccugguggaccaccagaagauccacaccggcgccagacccuacgagugcagccagugcggcaagagcuucagccagaaggccacccuggugaagcaccagagagugcacaccggcgagagacccuacaagugcggcgagugcggcaacagcuucagccagagcgccauccugaaccagcacagaagaauccacaccggcgccaagcccuacgagugcggccagugcggcaagagcuucagccagaaggccacccugaucaagcaccagagagugcacaccggcgagagacccuacaagugcggcgacugcggcaagagcuucagccagagcagcauccugauccagcacagaagaauccacaccggcgccagacccuacgagugcggccagugcggcaagagcuucagccagaagagcggccugauccagcaccagguggugcacaccggcgagagacccuacgagugcaacaagugcggcaacagcuucagccagugcagcagccugauccaccaccagaagugccacaacaccuaa

SEQ ID NO: 25895 - RNA, 1584 nt, Artificial Sequence
  ZIM2__Homo_sapiens__NP_001139799
auguaccagcccgaggacgacaacaacagcgacgugaccagcgacgacgacaugaccagaaacagaagagagagcagccccccccacagcgugcacagcuucagcggcgacagagacugggacagaagaggcagaagcagagacauggagcccagagacagauggagccacaccagaaaccccagaagcagaaugccccccagagaccugagccugcccgugguggccaagaccagcuucgagauggacagagaggacgacagagacagcagagccuacgagagcagaagccaggacgccgagagcuaccagaacgugguggaccuggccgaggacagaaagccccacaacaccauccaggacaacauggagaacuacagaaagcugcugagccugggcuuccuggcccaggacagcgugcccgccgagaagagaaacaccgagaugcuggacaaccugcccagcgccggcagccaguuccccgacuucaagcaccugggcaccuuccugguguucgaggagcuggugaccuucgaggacgugcugguggacuucagccccgaggagcugagcagccugagcgccgcccagagaaaccuguacagagaggugaugcuggagaacuacagaaaccuggugagccugggccaccaguucagcaagcccgacaucaucagcagacuggaggaggaggagagcuacgccauggagaccgacagcagacacaccgugaucugccagggcgagagccacgacgacccccuggagccccaccagggcaaccaggagaagcugcugacccccaucaccaugaacgaccccaagacccugacccccgagagaagcuacggcagcgacgaguucgagagaagcagcaaccugagcaagcagagcaaggacccccugggcaaggacccccaggagggcaccgcccccggcaucugcaccagcccccagagcgccagccaggagaacaagcacaacagaugcgaguucugcaagagaaccuucagcacccagguggcccugagaagacacgagagaauccacaccggcaagaagcccuacgagugcaagcagugcgccgaggccuucuaccugaugccccaccugaacagacaccagaagacccacagcggcagaaagaccagcggcugcaacgagggcagaaagcccagcgugcagugcgccaaccugugcgagagagugagaauccacagccaggaggacuacuucgagugcuuccagugcggcaaggccuuccugcagaacgugcaccugcugcagcaccugaaggcccacgaggccgccagagugcugccccccggccugagccacagcaagaccuaccugaucagauaccagagaaagcacgacuacgugggcgagagagccugccagugcugcgacugcggcagaguguucagcagaaacagcuaccugauccagcacuacagaacccacacccaggagagacccuaccagugccagcugugcggcaagugcuucggcagacccagcuaccugacccagcacuaccagcugcacagccaggagaagaccguggagugcgaccacugcuaa

SEQ ID NO: 25896 - RNA, 1584 nt, Artificial Sequence
  ZKSCAN1__Homo_sapiens__NP_001273983
auguggggccaggacagcacccugcaggacacccccccccccgaccccgagaucuucagacagagauucagaagauucugcuaccagaacaccuucggccccagagaggcccugagcagacugaaggagcugugccaccaguggcugagacccgagaucaacaccaaggagcagauccuggagcugcuggugcuggagcaguuccugagcauccugcccaaggagcugcagguguggcugcaggaguacagacccgacagcggcgaggaggccgugacccugcuggaggaccuggagcuggaccugagcggccagcaggugcccggccaggugcacggccccgagaugcuggccagaggcauggugccccuggaccccgugcaggagagcagcagcuucgaccugcaccacgaggccacccagagccacuucaagcacagcagcagaaagcccagacugcugcagagcagagcccugcccgccgcccacauccccgcccccccccacgagggcagccccagagaccaggccauggccagcgcccuguucaccgccgacagccaggccauggugaagaucgaggacauggccgugagccugauccuggaggaguggggcugccagaaccuggccagaagaaaccugagcagagacaacagacaggagaacuacggcagcgccuucccccagggcggcgagaacagaaacgagaacgaggagagcaccagcaaggccgagaccagcgaggacagcgccagcagaggcgagaccaccggcagaagccagaaggaguucggcgagaagagagaccaggagggcaagaccggcgagagacagcagaagaaccccgaggagaagaccagaaaggagaagagagacagcggccccgccaucggcaaggacaagaagaccaucaccggcgagagaggccccagagagaagggcaagggccugggcagaagcuucagccugagcagcaacuucaccacccccgaggaggugcccaccggcaccaagagccacagaugcgacgagugcggcaagugcuucaccagaagcagcagccugaucagacacaagaucauccacaccggcgagaagcccuacgagugcagcgagugcggcaaggccuucagccugaacagcaaccuggugcugcaccagagaauccacaccggcgagaagccccacgagugcaacgagugcggcaaggccuucagccacagcagcaaccugauccugcaccagagaauccacagcggcgagaagcccuacgagugcaacgagugcggcaaggccuucagccagagcagcgaccugaccaagcaccagagaauccacaccggcgagaagcccuacgagugcagcgagugcggcaaggccuucaacagaaacagcuaccugauccugcacagaagaauccacaccagagagaagcccuacaagugcaccaagugcggcaaggccuucaccagaagcagcacccugacccugcaccacagaauccacgccagagagagagccagcgaguacagccccgccagccuggacgccuucggcgccuuccugaagagcugcguguaa

SEQ ID NO: 25897 - RNA, 1173 nt, Artificial Sequence
  ZKSCAN3__Homo_sapiens__NP_001229824
auggcccugcugacccccgcccccggcagccagagcagccaguuccagcugaugaaggcccugcugaagcacgagagcgugggcagccagccccugcaggacagagugcugcaggugcccgugcuggcccacggcggcugcugcagagaggacaaggugguggccagcagacugacccccgagagccagggccugcugaagguggaggacguggcccugacccugacccccgaguggacccagcaggacagcagccagggcaaccugugcagagacgagaagcaggagaaccacggcagccuggugagccugggcgacgagaagcagaccaagagcagagaccugccccccgccgaggagcugcccgagaaggagcacggcaagaucagcugccaccugagagaggacaucgcccagauccccaccugcgccgaggccggcgagcaggagggcagacugcagagaaagcagaagaacgccaccggcggcagaagacacaucugccacgagugcggcaagagcuucgcccagagcagcggccugagcaagcacagaagaauccacaccggcgagaagcccuacgagugcgaggagugcggcaaggccuucaucggcagcagcgcccuggugauccaccagagagugcacaccggcgagaagcccuacgagugcgaggagugcggcaaggccuucagccacagcagcgaccugaucaagcaccagagaacccacaccggcgagaagcccuacgagugcgacgacugcggcaagaccuucagccagagcugcagccugcuggagcaccacagaauccacaccggcgagaagcccuaccagugcagcaugugcggcaaggccuucagaagaagcagccaccugcugagacaccagagaauccacaccggcgacaagaacgugcaggagcccgagcagggcgaggccuggaagagcagaauggagagccagcuggagaacguggagacccccaugagcuacaagugcaacgagugcgagagaagcuucacccagaacaccggccugaucgagcaccagaagauccacaccggcgagaagcccuaccagugcaacgccugcggcaagggcuucaccagaaucagcuaccuggugcagcaccagagaagccacgugggcaagaacauccugagccaguaa

SEQ ID NO: 25898 - RNA, 831 nt, Artificial Sequence
  ZKSCAN7__Homo_sapiens__NP_001275520
augaccaccgccggcagaggcaaccugggccugauccccagaagcaccgccuuccagaagcaggagggcagacugaccgugaagcaggagcccgccaaccagaccuggggccagggcagcagccugcagaagaacuacccccccgugugcgagaucuucagacugcacuucagacagcugugcuaccacgagaugagcggcccccaggaggcccugagcagacugagagagcugugcagaugguggcugaugcccgaggugcacaccaaggagcagauccuggagcugcuggugcuggagcaguuccugagcauccugcccggcgagcugagaaccugggugcagcugcaccaccccgagagcggcgaggaggccguggccgugguggaggacuuccagagacaccugagcggcagcgaggaggugagcgcccccgcccagaagcaggagaugcacuucgaggagaccaccgcccugggcaccaccaaggagagcccccccaccagcccccugagcggcggcagcgcccccggcgcccaccuggagccccccuacgaccccggcacccaccaccugcccagcggcgacuucgcccagugcaccagccccgugcccacccugccccaggugggcaacagcggcgaccaggccggcgccaccgugcugagaauggugagaccccaggacaccguggccuacgaggaccugagcguggacuacacccagaagaaguggaagagccugacccugagccagagagcccugcaguggaacaugaugcccgagaaccaccacagcauggccagccugggcuggagcaccauggccuaa

SEQ ID NO: 25899 - RNA, 867 nt, Artificial Sequence
  ZMAT3__Homo_sapiens__XP_005247763
augauccugcugcagcacgccgugcugcccccccccaagcagcccagccccagcccccccaugagcguggccaccagaagcaccggcacccugcagcugcccccccagaagcccuucggccaggaggccagccugccccuggccggcgaggaggagcugagcaagggcggcgagcaggacugcgcccuggaggagcugugcaagccccuguacugcaagcugugcaacgugacccugaacagcgcccagcaggcccaggcccacuaccagggcaagaaccacggcaagaagcugagaaacuacuacgccgccaacagcugccccccccccgccagaaugagcaacgugguggagcccgccgccacccccguggugcccgugcccccccagaugggcagcuucaagcccggcggcagagugauccuggccaccgagaacgacuacugcaagcugugcgacgccagcuucagcagccccgccguggcccaggcccacuaccagggcaagaaccacgccaagagacugagacuggccgaggcccagagcaacagcuucagcgagagcagcgagcugggccagagaagagccagaaaggagggcaacgaguucaagaugaugcccaacagaagaaacauguacaccgugcagaacaacagcggccccuacuucaaccccagaagcagacagagaauccccagagaccuggccaugugcgugacccccagcggccaguucuacugcagcaugugcaacgugggcgccggcgaggagauggaguucagacagcaccuggagagcaagcagcacaagagcaaggugagcgagcagagauacagaaacgagauggagaaccugggcuacguguaa

SEQ ID NO: 25900 - RNA, 462 nt, Artificial Sequence
  ZMAT4__Homo_sapiens__NP_001129203
augaagagcagcgacaucgaccaggaccuguucaccgacagcuacugcaaggugugcagcgcccagcugaucagcgagagccagagaguggcccacuacgagagcagaaagcacgccagcaaggugagacuguacuacaugcugcaccccagagacggcggcugccccgccaagagacugagaagcgagaacggcagcgacgccgacaugguggacaagaacaagugcugcacccugugcaacaugagcuucaccagcgccgugguggccgacagccacuaccagggcaagauccacgccaagagacugaagcugcugcugggcgagaagaccccccugaagaccaccggccugagaagaaacuacagaugcaccaucugcagcgugagccugaacagcaucgagcaguaccacgcccaccugaagggcagcaagcaccagaccaaccugaagaacaaguaa

SEQ ID NO: 25901 - RNA, 3204 nt, Artificial Sequence
  ZMIZ1__Homo_sapiens__NP_065071
augaacagcauggacagacacauccagcagaccaacgacagacugcagugcaucaagcagcaccugcagaaccccgccaacuuccacaacgccgccaccgagcugcuggacuggugcggcgaccccagagccuuccagagacccuucgagcagagccugaugggcugccugaccguggugagcagaguggccgcccagcagggcuucgaccuggaccugggcuacagacugcuggccgugugcgccgccaacagagacaaguucacccccaagagcgccgcccugcugagcagcuggugcgaggagcugggcagacugcugcugcugagacaccagaagagcagacagagcgacccccccggcaagcugcccaugcagcccccccugagcagcaugagcagcaugaagcccacccugagccacagcgacggcagcuuccccuacgacagcgugcccuggcagcagaacaccaaccagccccccggcagccugagcguggugaccaccguguggggcgugaccaacaccagccagagccaggugcugggcaaccccauggccaacgccaacaaccccaugaaccccggcggcaaccccauggccagcggcaugaccaccagcaaccccggccugaacagcccccaguucgccggccagcagcagcaguucagcgccaaggccggccccgcccagcccuacauccagcagagcauguacggcagacccaacuaccccggcagcggcggcuucggcgccagcuaccccggcggccccaacgcccccgccggcaugggcauccccccccacaccagaccccccgccgacuucacccagcccgccgccgccgccgccgccgccgccguggccgccgccgccgccaccgccaccgccaccgccaccgccaccguggccgcccugcaggagacccagaacaaggacaucaaccaguacggccccaugggccccacccaggccuacaacagccaguucaugaaccagcccggccccagaggccccgccagcaugggcggcagcaugaaccccgccagcauggccgccggcaugacccccagcggcaugagcggcccccccaugggcaugaaccagcccagaccccccggcaucagccccuucggcacccacggccagagaaugccccagcagaccuaccccggccccagaccccagagccugcccauccagaacaucaagagacccuaccccggcgagcccaacuacggcaaccagcaguacggccccaacagccaguuccccacccagcccggccaguaccccgcccccaacccccccagaccccugaccagccccaacuaccccggccagagaaugcccagccagcccagcagcggccaguaccccccccccaccgugaacaugggccaguacuacaagcccgagcaguucaacggccagaacaacaccuucagcggcagcagcuacagcaacuacagccagggcaacgugaacagaccccccagacccgugcccguggccaacuacccccacagccccgugcccggcaaccccaccccccccaugacccccggcagcagcaucccccccuaccugagccccagccaggacgugaagccccccuucccccccgacaucaagcccaacaugagcgcccugccccccccccccgccaaccacaacgacgagcugagacugaccuuccccgugagagacggcguggugcuggagcccuucagacuggagcacaaccuggccgugagcaaccacguguuccaccugagacccaccgugcaccagacccugauguggagaagcgaccuggagcugcaguucaagugcuaccaccacgaggacagacagaugaacaccaacuggcccgccagcgugcaggugagcgugaacgccaccccccugaccaucgagagaggcgacaacaagaccagccacaagccccugcaccugaagcacgugugccagcccggcagaaacaccauccagaucaccgugaccgccugcugcugcagccaccuguucgugcugcagcuggugcacagacccagcgugagaagcgugcugcagggccugcugaagaagagacugcugcccgccgagcacugcaucaccaagaucaagagaaacuucagcagcguggccgccagcagcggcaacaccacccugaacggcgaggacggcguggagcagaccgccaucaaggugagccugaagugccccaucaccuucagaagaauccagcugcccgccagaggccacgacugcaagcacgugcagugcuucgaccuggagagcuaccugcagcugaacugcgagagaggcaccuggagaugccccgugugcaacaagaccgcccugcuggagggccuggagguggaccaguacauguggggcauccugaacgccauccagcacagcgaguucgaggaggugaccaucgaccccaccugcagcuggagacccgugcccaucaagagcgaccugcacaucaaggacgaccccgacggcauccccagcaagagauucaagaccaugagccccagccagaugaucaugcccaacgugauggagaugaucgccgcccugggccccggccccagccccuacccccugccccccccccccggcggcaccaacagcaacgacuacagcagccagggcaacaacuaccagggccacggcaacuucgacuucccccacggcaaccccggcggcaccagcaugaacgacuucaugcacggccccccccagcugagccacccccccgacaugcccaacaacauggccgcccuggagaagccccugagccaccccaugcaggagaccaugccccacgccggcagcagcgaccagccccaccccagcauccagcagggccugcacgugccccaccccagcagccagagcggccccccccugcaccacagcggcgcccccccccccccccccagccagccccccagacagcccccccaggccgcccccagcagccacccccacagcgaccugaccuucaaccccagcagcgcccuggagggccaggccggcgcccagggcgccagcgacaugcccgagcccagccuggaccugcugcccgagcugaccaaccccgacgagcugcugagcuaccuggacccccccgaccugcccagcaacagcaacgacgaccugcugagccuguucgagaacaacuaa

SEQ ID NO: 25902 - RNA, 4200 nt, Artificial Sequence
  ZMYM2__Homo_sapiens__XP_011533519
augugcauccugcugagcgccguggugaccuggauccccagccuggaccugcugguguucuucggcauggacaccagcagcgugggcggccuggagcugaccgaccagacccccgugcugcugggcagcaccgccauggccaccagccugaccaacgugggcaacagcuucagcggccccgccaacccccuggugagcagaagcaacaaguuccagaacagcagcguggaggacgacgacgacgugguguucaucgagcccgugcagccccccccccccagcgugcccgugguggccgaccagagaaccaucaccuucaccagcagcaagaacgaggagcugcagggcaacgacagcaagaucacccccagcagcaaggagcuggccagccagaagggcagcgugagcgagaccaucgugaucgacgacgaggaggacauggagaccaaccagggccaggagaagaacagcagcaacuucaucgagagaagaccccccgagaccaagaacagaaccaacgacguggacuucagcaccagcagcuucagcagaagcaaggugaacgccggcaugggcaacagcggcaucaccaccgagcccgacagcgagauccagaucgccaacgugaccacccuggagaccggcgugagcagcgugaacgacggccagcuggagaacaccgacggcagagacaugaaccugaugaucacccacgugaccagccugcagaacaccaaccugggcgacgugagcaacggccugcagagcagcaacuucggcgugaacauccagaccuacacccccagccugaccagccagaccaagaccggcgugggccccuucaaccccggcagaaugaacguggccggcgacguguuccagaacggcgagagcgccacccaccacaaccccgacagcuggaucagccagagcgccagcuuccccagaaaccagaagcagcccggcguggacagccugagccccguggccagccugcccaagcagaucuuccagcccagcgugcagcagcagcccaccaagcccgugaaggugaccugcgccaacugcaagaagccccugcagaagggccagaccgccuaccagagaaagggcagcgcccaccuguucugcagcaccaccugccugagcagcuucagccacaagcccgcccccaagaagcugugcgugaugugcaagaaggacaucaccaccaugaagggcaccaucguggcccagguggacagcagcgagagcuuccaggaguucugcagcaccagcugccugagccuguacgaggacaagcagaaccccaccaagggcgcccugaacaagagcagaugcaccaucugcggcaagcugaccgagaucagacacgaggugagcuucaagaacaugacccacaagcugugcagcgaccacugcuucaacagauacagaauggccaacggccugaucaugaacugcugcgagcagugcggcgaguaccugcccagcaagggcgccggcaacaacgugcuggugaucgacggccagcagaagagauucugcugccagagcugcgugagcgaguacaagcaggugggcagccaccccagcuuccugaaggaggugagagaccacaugcaggacagcuuccugaugcagcccgagaaguacggcaagcugaccaccugcaccggcugcagaacccagugcagauucuucgacaugacccagugcaucggccccaacggcuacauggagcccuacugcagcaccgccugcaugaacagccacaagaccaaguacgccaagagccagagccugggcaucaucugccacuucugcaagagaaacagccugccccaguaccaggccaccaugcccgacggcaagcuguacaacuucugcaacagcagcugcguggccaaguuccaggcccugagcaugcagagcagccccaacggccaguucguggcccccagcgacauccagcugaagugcaacuacugcaagaacagcuucugcagcaagcccgagauccuggagugggagaacaaggugcaccaguucugcagcaagaccugcagcgacgacuacaagaagcugcacugcaucgugaccuacugcgaguacugccaggaggagaagacccugcacgagaccgugaacuucagcggcgugaagagacccuucugcagcgagggcugcaagcugcuguacaagcaggacuucgccagaagacugggccugagaugcgugaccugcaacuacugcagccagcugugcaagaagggcgccaccaaggagcuggacggcguggugagagacuucugcagcgaggacugcugcaagaaguuccaggacugguacuacaaggccgccagaugcgacugcugcaagagccagggcacccugaaggagagagugcaguggagaggcgagaugaagcacuucugcgaccagcacugccugcugagauucuacugccagcagaacgagcccaacaugaccacccagaagggccccgagaaccugcacuacgaccagggcugccagaccagcagaaccaagaugaccggcagcgcccccccccccagccccacccccaacaaggagaugaagaacaaggccgugcugugcaagccccugaccaugaccaaggccaccuacugcaagccccacaugcagaccaagagcugccagaccgacgacaccuggagaaccgaguacgugcccgugcccauccccgugcccguguacauccccgugcccaugcacauguacagccagaacauccccgugcccaccaccgugcccgugcccgugcccgugcccguguuccugcccgccccccuggacagcagcgagaagauccccgccgccaucgaggagcugaagagcaaggugagcagcgacgcccuggacaccgagcugcugaccaugaccgacaugaugagcgaggacgagggcaagaccgagaccaccaacaucaacagcgugaucaucgagaccgacaucaucggcagcgaccugcugaagaacagcgaccccgagacccagagcagcaugcccgacgugcccuacgagcccgaccuggacaucgagaucgacuuccccagagccgccgaggagcuggacauggagaacgaguuccugcugccccccguguucggcgaggaguacgaggagcagcccagacccagaagcaagaagaagggcgccaagagaaaggccgugagcggcuaccagagccacgacgacagcagcgacaacagcgagugcagcuuccccuucaaguacaccuacggcgugaacgccuggaagcacugggugaagaccagacagcuggacgaggaccugcuggugcuggacgagcugaagagcagcaagagcgugaagcugaaggaggaccugcugagccacaccaccgccgagcugaacuacggccuggcccacuucgugaacgagaucagaagacccaacggcgagaacuacgcccccgacagcaucuacuaccugugccugggcauccaggaguaccugugcggcagcaacagaaaggacaacaucuucaucgaccccggcuaccagaccuucgagcaggagcugaacaagauccugagaagcuggcagcccagcauccugcccgacggcagcaucuucagcagaguggaggaggacuaccuguggagaaucaagcagcugggcagccacagccccguggcccugcugaacacccuguucuacuucaacaccaaguacuucggccugaagaccguggagcagcaccugagacugagcuucggcaccguguucagacacuggaagaagaacccccugaccauggagaacaaggccugccugagauaccaggugagcagccugugcggcaccgacaacgaggacaagaucaccaccggcaagagaaagcacgaggacgacgagcccguguucgagcagaucgagaacaccgccaaccccagcagaugccccgugaagauguucgagugcuaccugagcaagagcccccagaaccugaaccagagaauggacguguucuaccugcagcccgagugcagcagcagcaccgacagccccgugugguacaccagcaccagccuggacagaaacacccuggagaacaugcuggugagagugcugcuggugaaggacaucuacgacaaggacaacuacgagcuggacgaggacaccgacuaa

SEQ ID NO: 25903 - RNA, 4077 nt, Artificial Sequence
  ZMYM3__Homo_sapiens__NP_001164633
auggaccccagcgacuuccccagccccuucgacccccugacccugcccgagaagccccuggccggcgaccugcccguggacauggaguucggcgaggaccugcuggagagccagaccgcccccaccagaggcugggccccccccggccccagccccagcagcggcgcccuggaccugcuggacacccccgccggccuggagaaggaccccggcgugcuggacggcgccaccgagcugcugggccugggcggccugcuguacaaggcccccagcccccccgagguggaccacggccccgagggcacccuggccugggacgccggcgaccagacccuggagcccggccccggcggccagacccccgagguggugccccccgaccccggcgccggcgccaacagcugcagccccgagggccugcuggagccccuggcccccgacagccccaucacccugcagagcccccacaucgaggaggaggagaccaccagcaucgccaccgccagaagaggcagccccggccaggaggaggagcugccccagggccagccccagagccccaacgccccccccagccccagcgugggcgagacccugggcgacggcaucaacagcagccagaccaagcccggcggcagcagcccccccgcccaccccagccugcccggcgacggccugaccgccaaggccagcgagaagccccccgagagaaagagaagcgagagagugagaagagccgagccccccaagcccgaggugguggacagcaccgagagcauccccgugagcgacgaggacagcgacgccaugguggacgaccccaacgacgaggacuucgugcccuucagacccagaagaagccccagaaugagccugagaagcagcgugagccagagagccggcagaagcgccgugggcaccaagaugaccugcgcccacugcagaaccccccugcagaagggccagaccgccuaccagagaaagggccugccccagcuguucugcagcagcagcugccugaccaccuucagcaagaagcccagcggcaagaagaccugcaccuucugcaagaaggagaucuggaacaccaaggacagcgugguggcccagaccggcagcggcggcagcuuccacgaguucugcaccagcgugugccugagccuguacgaggcccagcagcagagacccaucccccagagcggcgaccccgccgacgccaccagaugcagcaucugccagaagaccggcgaggugcugcacgaggugagcaacggcagcguggugcacagacugugcagcgacagcugcuucagcaaguucagagccaacaagggccugaagaccaacugcugcgaccagugcggcgccuacaucuacaccaagaccggcagccccggccccgagcugcuguuccacgagggccagcagaagagauucugcaacaccaccugccugggcgccuacaagaagaagaacaccagaguguaccccugcguguggugcaagacccugugcaagaacuucgagaugcugagccacguggacagaaacggcaagaccagccuguucugcagccugugcugcaccaccagcuacaaggugaagcaggccggccugaccggcccccccagacccugcagcuucugcagaagaagccugagcgaccccugcuacuacaacaagguggacagaaccguguaccaguucugcagccccagcugcuggaccaaguuccagagaaccagccccgagggcggcauccaccugagcugccacuacugccacagccuguucagcggcaagcccgaggugcuggacuggcaggaccagguguuccaguucugcugcagagacugcugcgaggacuucaagagacugagaggcguggugagccagugcgagcacugcagacaggagaagcugcugcacgagaagcugagauucagcggcguggagaagagcuucugcagcgagggcugcgugcugcuguacaagcaggacuucaccaagaagcugggccugugcugcaucaccugcaccuacugcagccagaccugccagagaggcgugaccgagcagcuggacggcagcaccugggacuucugcagcgaggacugcaagagcaaguaccugcugugguacugcaaggccgccagaugccacgccugcaagagacagggcaagcugcuggagaccauccacuggagaggccagaucagacacuucugcaaccagcagugccugcugagauucuacagccagcagaaccagcccaaccuggacacccagagcggccccgagagccugcugaacagccagagccccgagagcaagccccagacccccagccagaccaagguggagaacagcaacaccauccccgugaagaccagaagcgcccccaccgcccccacccccccccccccccccccccccgccacccccagaaagaacaaggccgccaugugcaagccccugaugcagaacagaggcgugagcugcaagguggagaugaagagcaagggcagccagaccgaggaguggaagccccaggugaucgugcugcccauccccgugcccaucuucgugcccgugcccaugcaccuguacugccagaaggugcccgugcccuucagcaugcccauccccgugcccgugcccauguuccugcccaccacccuggagagcaccgacaagaucguggagaccaucgaggagcugaaggugaagauccccagcaacccccuggaggccgacauccuggccauggccgagaugaucgccgaggccgaggagcuggacaaggccagcagcgaccugugcgaccuggugagcaaccagagcgccgagggccugcuggaggacugcgaccuguucggccccgccagagacgacgugcuggccauggccgugaagauggccaacgugcuggacgagcccggccaggaccuggaggccgacuuccccaagaacccccuggacaucaaccccagcguggacuuccuguucgacugcggccuggugggccccgaggacgugagcaccgagcaggaccugcccagaaccaugagaaagggccagaagagacuggugcugagcgagagcugcagcagagacagcaugagcagccagcccagcugcaccggccugaacuacagcuacggcgugaacgccuggaagugcugggugcagagcaaguacgccaacggcgagaccagcaagggcgacgagcugagauucggccccaagcccaugagaaucaaggaggacauccuggccugcagcgccgccgagcugaacuacggccuggcccaguucgugagagagaucaccagacccaacggcgagagauacgagcccgacagcaucuacuaccugugccugggcauccagcaguaccugcuggagaacaacagaauggugaacaucuucaccgaccuguacuaccugaccuucgugcaggagcugaacaagagccugagcaccuggcagcccacccugcugcccaacaacaccguguucagcagaguggaggaggagcaccugugggagugcaagcagcugggcguguacagccccuucgugcugcugaacacccugauguucuucaacaccaaguucuucggccugcagaccgccgaggagcacaugcagcugagcuucaccaacguggugagacagagcagaaagugcaccacccccagaggcaccaccaagguggugagcaucagauacuacgcccccgugagacagagaaagggcagagacaccggccccggcaagagaaagagagaggacgaggcccccauccuggagcagagagagaacagaaugaacccccugagaugccccgugaaguucuacgaguucuaccugagcaagugccccgagagccugagaaccagaaacgacguguucuaccugcagcccgagagaagcugcaucgccgagagcccccugugguacagcgugauccccauggacagaagcaugcuggagagcaugcugaacagaauccuggccgugagagagaucuacgaggagcugggcagacccggcgaggaggaccuggacuaa

SEQ ID NO: 25904 - RNA, 4551 nt, Artificial Sequence
  ZMYM4__Homo_sapiens__XP_011540726
auggacaccgagaugagcgaggacaucgaccacaaccugacccccacccuggacagcaugagcuacggcaugcccaaccagaccggcagcgagaacagccugcuggacgaggacgacuacuuccugaacagcggcgaccuggccggcauccccguggugggcagcgacaacgaggacgagcaggacuucagcagcaaggacaaccuggugagcagcauccacaccgacgacagccuggagguggagagaagagugacccagcacgagagcgacaacgagaacgagauccagauccagaacaagcugaagaaggacuuccccaagcaguucgaccaggugagcguguucaagagcaucagaaaggacuucagccuggugagagagaacagcaaggagaccuucagcggcaaggagaagaacagagaccugaccuacgagagagagaagagacuggacaagccccacaaggaccuggacagcagacugaagagcagcuucuucgacaaggccgccaaccagguggaggagacccugcacacccaccugccccagacccccgagaccaacuucagagacagcagcuaccccuucgccaacaaggagagcaucggcagcgagcugggcaacagcuucgccagcaacaucagaaucaaggaggagccccuggacgacgaguacgacaaggccauggccccccagcagggccugcuggacaagaucaaggacgagcccgacaacgcccaggaguacagccacggccagcagcagaagacccaggagggcgagcugaagaucagcgccguguucagcgugagcggcagcccccuggccccccagcugaccaccggcuuccagcccagccuggccagcagcggcaugaacaagaugcugcccagcgugcccgccaccgccgugagagugagcugcagcggcugcaagaagauccugcagaagggccagaccgccuaccagagaaagggcagcacccagcuguucugcagcacccugugccugaccggcuacaccgugccccccgccagacccccccccccccugaccaagaagaccugcagcagcugcagcaaggacauccugaaccccaaggacgugaucagcgcccaguucgagaacaccaccaccagcaaggacuucugcagccagagcugccugagcaccuacgagcugaagaagaagcccaucgugaccaucaacaccaacagcaucagcaccaagugcagcaugugccagaagaacgccgugaucagacacgaggugaacuaccagaacguggugcacaagcugugcagcgacgccugcuucagcaaguucagaagcgccaacaaccugaccaugaacugcugcgagaacugcggcggcuacugcuacagcggcagcggccagugccacaugcugcagaucgagggccagagcaagaaguucugcagcagcagcugcaucaccgccuacaagcagaagagcgccaagaucacccccugcgcccugugcaagagccugagaagcagcgccgagaugaucgagaacaccaacagccugggcaagaccgagcuguucugcagcgugaacugccugagcgccuacagagugaagauggugaccagcgccggcgugcaggugcagugcaacagcugcaagaccagcgccaucccccaguaccaccuggccaugagcgacggcagcaucagaaacuucugcagcuacagcugcgugguggccuuccagaaccuguucaacaagcccaccggcaugaacagcagcguggugccccugagccagggccaggugaucgugagcauccccaccggcagcaccgugagcgccggcggcggcagcaccagcgccgugagccccaccagcaucagcagcagcgccgccgccggccugcagagacuggccgcccagagccagcacgugggcuucgccagaagcguggugaagcugaagugccagcacugcaacagacuguucgccaccaagcccgagcugcuggacuacaagggcaagauguuccaguucugcggcaagaacugcagcgacgaguacaagaagaucaacaacgugauggccaugugcgaguacugcaagaucgagaagaucgugaaggagaccgugagauucagcggcgccgacaagagcuucugcagcgagggcugcaagcugcuguacaagcacgaccuggccaagagauggggcaaccacugcaagaugugcagcuacugccugcagaccagccccaagcuggugcagaacaaccugggcggcaagguggaggaguucugcugcgaggagugcaugagcaaguacaccgugcuguucuaccagauggccaagugcgacgccugcaagagacagggcaagcugagcgagagccugaaguggagaggcgagaugaagcacuucugcaaccugcugugcauccugauguucugcaaccagcagagcgugugcgacccccccagccagaacaacgccgccaacaucagcauggugcaggccgccagcgccggcccccccagccugagaaaggacagcacccccgugaucgccaacguggugagccuggccagcgcccccgccgcccagcccaccgugaacagcaacagcgugcugcagggcgccgugcccaccgugaccgccaagaucaucggcgacgccagcacccagaccgacgcccugaagcugccccccagccagccccccagacugcugaagaacaaggcccugcugugcaagcccaucacccagaccaaggccaccagcugcaagccccacacccagaacaaggagugccagaccgaggacacccccagccagccccagaucaucguggugcccgugcccgugcccguguucgugcccaucccccugcaccuguacacccaguacgcccccgugcccuucggcauccccgugcccaugcccgugcccaugcugauccccagcagcauggacagcgaggacaaggugaccgagagcaucgaggacaucaaggagaagcugcccacccaccccuucgaggccgaccugcuggagauggccgagaugaucgccgaggacgaggagaagaagacccugagccagggcgagagccagaccagcgagcacgagcuguuccuggacaccaagaucuucgagaaggaccagggcagcaccuacagcggcgaccuggagagcgaggccgugagcaccccccacagcugggaggaggagcugaaccacuacgcccugaagagcaacgccgugcaggaggccgacagcgagcugaagcaguucagcaagggcgagaccgagcaggaccuggaggccgacuuccccagcgacagcuucgacccccugaacaagggccagggcauccaggccagaagcagaaccagaagaagacacagagacggcuucccccagcccagaagaagaggcagaaagaagagcaucguggccguggagcccagaagccugauccagggcgccuuccagggcugcagcgugagcggcaugacccugaaguacauguacggcgugaacgccuggaagaacugggugcaguggaagaacgccaaggaggagcagggcgaccugaagugcggcggcguggagcaggccagcagcagccccagaagcgacccccugggcagcacccaggaccacgcccugagccaggagagcagcgagcccggcugcagagugagaagcaucaagcugaaggaggacauccugagcugcaccuucgccgagcugagccugggccugugccaguucauccaggaggugagaagacccaacggcgagaaguacgaccccgacagcauccuguaccugugccugggcauccagcaguaccuguucgagaacggcagaaucgacaacaucuucaccgagcccuacagcagauucaugaucgagcugaccaagcugcugaagaucugggagcccaccauccugcccaacggcuacauguucagcagaaucgaggaggagcaccugugggagugcaagcagcugggcgccuacagccccaucgugcugcugaacacccugcuguucuucaacaccaaguacuuccagcugaagaacgugaccgagcaccugaagcugagcuucgcccacgugaugagaagaaccagaacccugaaguacagcaccaagaugaccuaccugagauucuuccccccccugcagaagcaggagagcgagcccgacaagcugaccgugggcaagagaaagagaaacgaggacgacgaggugcccgugggcguggagauggccgagaacaccgacaacccccugagaugccccgugagacuguacgaguucuaccugagcaagugcagcgagagcgugaagcagagaaacgacguguucuaccugcagcccgagagaagcugcgugcccaacagccccaugugguacagcaccuuccccaucgaccccggcacccuggacaccaugcugaccagaauccugauggugagagaggugcacgaggagcuggccaaggccaagagcgaggacagcgacguggagcugagcgacuaa

SEQ ID NO: 25905 - RNA, 627 nt, Artificial Sequence
  ZMYM5__Homo_sapiens__NP_001034738
auggagaagugcagcgugggcggccuggagcugaccgagcagacccccgcccugcugggcaacauggccauggccaccagccugauggacaucggcgacagcuucggccaccccgccugcccccuggugagcagaagcagaaacagccccguggaggacgacgacgacgacgacgacgugguguucaucgagagcauccagccccccagcaucagcgcccccgccaucgccgaccagagaaacuucaucuucgccagcagcaagaacgagaagccccagggcaacuacagcgugaucccccccagcagcagagaccuggccagccagaagggcaacaucagcgagaccaucgugaucgacgacgaggaggacaucgagaccaacggcggcgccgagaagaagagcagcugcuucaucgaguggggccugcccggcaccaagaacaagaccaacgaccuggacuucagcaccagcagccugagcagaagcaagaccaagaccggcgugagacccuucaaccccggcagaaugaacguggccggcgaccuguuccagaacggcgaguucgccacccaccacagccccgagaugcaccugcagagaagacugaugagcuucuuccaguaa

SEQ ID NO: 25906 - RNA, 1323 nt, Artificial Sequence
  ZMYND10__Homo_sapiens__NP_056980
augggcgaccuggagcugcugcugcccggcgaggccgaggugcuggugagaggccugagaagcuucccccugagagagaugggcagcgagggcuggaaccagcagcacgagaaccuggagaagcugaacaugcaggccauccuggacgccaccgugagccagggcgagcccauccaggagcugcuggugacccacggcaaggugcccacccugguggaggagcugaucgccguggagauguggaagcagaagguguuccccguguucugcagaguggaggacuucaagccccagaacaccuuccccaucuacaugguggugcaccacgaggccagcaucaucaaccugcuggagaccguguucuuccacaaggaggugugcgagagcgccgaggacaccgugcuggaccugguggacuacugccacagaaagcugacccugcugguggcccagagcggcugcggcggcccccccgagggcgagggcagccaggacagcaaccccaugcaggagcugcagaagcaggccgagcugauggaguucgagaucgcccugaaggcccugagcgugcugagauacaucaccgacugcguggacagccugagccugagcacccugagcagaaugcugagcacccacaaccugcccugccugcugguggagcugcuggagcacagccccuggagcagaagagagggcggcaagcugcagcaguucgagggcagcagauggcacaccguggcccccagcgagcagcagaagcugagcaagcuggacggccagguguggaucgcccuguacaaccugcugcugagccccgaggcccaggccagauacugccugaccagcuucgccaagggcagacugcugaagcugagagccuuccugaccgacacccugcuggaccagcugcccaaccuggcccaccugcagagcuuccuggcccaccugacccugaccgagacccagccccccaagaaggaccuggugcuggagcagauccccgagaucugggagagacuggagagagagaacagaggcaaguggcaggccaucgccaagcaccagcugcagcacguguucagccccagcgagcaggaccugagacugcaggccagaagaugggccgagaccuacagacuggacgugcuggaggccguggcccccgagagacccagaugcgccuacugcagcgccgaggccagcaagagaugcagcagaugccagaacgagugguacugcugcagagagugccaggugaagcacugggagaagcacggcaagaccugcgugcuggccgcccagggcgacagagccaaguaa

SEQ ID NO: 25907 - RNA, 1554 nt, Artificial Sequence
  ZMYND11__Homo_sapiens__NP_001189394
auggccagacugaccaagagaagacaggccgacaccaaggccauccagcaccugugggccgccaucgagaucaucagaaaccagaagcagaucgccaacaucgacagaaucaccaaguacaugagcagagugcacggcaugcaccccaaggagaccaccagacagcugagccuggccgugaaggacggccugaucguggagacccugaccgugggcugcaagggcagcaaggccggcaucgagcaggagggcuacuggcugcccggcgacgagaucagcaucaagaagaagaacaccaacaagcaggagaugggcaccuaccugagauucaucgugagcagaaugaaggagagaaaggugaacgagggcaaguacagaagcuacgaggaguucaaggccgacgcccagcugcugcugcacaacaccgugaucuucuacggcgccgacagcgagcaggccgacaucgccagaaugcuguacaaggacaccugccacgagcuggacgagcugcagcugugcaagaacugcuucuaccugagcaacgccagacccgacaacugguucugcuaccccugcauccccaaccacgagcuggugugggccaagaugaagggcuucggcuucuggcccgccaaggugaugcagaaggaggacaaccagguggacgugagauucuucggccaccaccaccagagagccuggauccccagcgagaacauccaggacaucaccgugaacauccacagacugcacgugaagagaagcaugggcuggaagaaggccugcgacgagcuggagcugcaccagagauuccugagagagggcagauucuggaagagcaagaacgaggacagaggcgaggaggaggccgagagcagcaucagcagcaccagcaacgagcagcugaaggugacccaggagcccagagccaagaagggcagaagaaaccagagcguggagcccaagaaggaggagcccgagcccgagaccgaggccgugagcagcagccaggagauccccaccaugccccagcccaucgagaaggugagcgugagcacccagaccaagaagcugagcgccagcagccccagaaugcugcacagaagcacccagaccaccaacgacggcgugugccagagcaugugccacgacaaguacaccaagaucuucaacgacuucaaggacagaaugaagagcgaccacaagagagagaccgagagaguggugagagaggcccuggagaagcugagaagcgagauggaggaggagaagagacaggccgugaacaaggccguggccaacaugcagggcgagauggacagaaagugcaagcaggugaaggagaagugcaaggaggaguucguggaggagaucaagaagcuggccacccagcacaagcagcugaucagccagaccaagaagaagcaguggugcuacaacugcgaggaggaggccauguaccacugcugcuggaacaccagcuacugcagcaucaagugccagcaggagcacuggcacgccgagcacaagagaaccugcagaagaaagagauaa

SEQ ID NO: 25908 - RNA, 465 nt, Artificial Sequence
  ZMYND8__Homo_sapiens__NP_001268698
augcacccccagagccuggccgaggaggagaucaagaccgagcaggaggugguggagggcauggacaucagcaccagaagcaaggaccccggcagcgccgagagaaccgcccagaagagaaaguuccccagccccccccacagcagcaacggccacagcccccaggacaccagcaccagccccaucaagaagaagaagaagcccggccugcugaacagcaacaacaaggagcagagcgagcugagacacggccccuucuacuacaugaagcagccccugaccaccgaccccguggacguggugccccaggacggcagaaacgacuucuacugcugggugugccacagagagggccaggugcugugcugcgagcugugccccagaguguaccacgccaagugccugagacugaccagcgagcccgagggcgacugguucugccccgagugcgaggugagcagcuaa

SEQ ID NO: 25909 - RNA, 3336 nt, Artificial Sequence
  ZNF106__Homo_sapiens__NP_001271236
auggugagagagagaaagugcauccugugccacaucguguacagcagcaagaaggagauggacgagcacaugagaagcaugcugcaccacagagagcuggagaaccugaagggcagauucggcaucgagauggugccccuggugcagaacgagcaggaggcccuggaccuggacggcgagcccgaccugagcagccuggagggcuuccagugggagggcgugagcaucagcagcagccccggccuggccagaaagagaagccugagcgagagcagcgugaucauggacagagcccccagcguguacagcuucuucagcgaggagggcaccggcaaggagaacgagccccagcagauggugagccccagcaacagccugagagccggccagagccagaaggccaccaugcaccugaagcaggaggugacccccagagccgccagccugagaaccggcgagagagccgagaacguggccacccagagaagacacagcgcccagcugagcagcgaccacaucaucccccugaugcaccuggccaaggaccugaacagccaggagagaagcaucccccccagcgagaaccagaacagccaggagagcaacggcgagggcaacugccugagcagcagcgccagcagcgcccuggccaucagcagccuggccgacgccgccaccgacagcagcugcaccagcggcgccgagcagaacgacggccagagcaucagaaagaagagaagagccaccggcgacggcagcagccccgagcugcccagccuggagagaaagaacaagagaagaaagaucaagggcaagaaggagagaagccagguggaccagcugcugaacaucagccugagagaggaggagcugagcaagagccugcagugcauggacaacaaccugcugcaggccagagccgcccugcagaccgccuacguggaggugcagagacugcugaugcugaagcagcagaucaccauggagaugagcgcccugagaacccacagaauccagauccugcagggccugcaggagaccuacgagcccagcgagcaccccgaccaggugcccugcagccugaccagagagagaagaaacagcagaagccagaccagcaucgacgccgcccugcugcccacccccuucuucccccuguuccuggagccccccagcagccacgugagccccagccccaccggcgccagccugcagaucaccaccagccccaccuuccagacccacggcagcgugcccgcccccgacagcagcgugcagaucaagcaggagcccaugagccccgagcaggacgagaacgugaacgccgugccccccagcagcgccugcaacgugagcaaggagcugcuggaggccaacagagagaucagcgacagcugccccguguaccccgugaucaccgccagacugagccugcccgagagcaccgagagcuuccacgagcccagccaggagcugaaguucagcguggagcagagaaacaccagaaacagagagaacagccccagcagccagagcgccggccugagcagcaucaacaaggagggcgaggagcccaccaagggcaacagcggcagcgaggccugcaccagcagcuuccugagacugagcuucgccagcgagaccccccuggagaaggagccccacagccccgccgaccagcccgagcagcaggccgagagcacccugaccagcgccgagaccagaggcagcaagaagaagaagaagcugagaaagaagaagagccugagagccgcccacgugcccgagaacagcgacaccgagcaggacgugcugaccgugaagcccgugagaaaggugaaggccggcaagcugaucaagggcggcaaggugaccaccagcaccugggaggacagcagaaccggcagagagcaggagagcgugagagacgagcccgacagcgacagcagccuggaggugcuggagauccccaacccccagcuggaggugguggccaucgacagcagcgagagcggcgaggagaagcccgacagccccagcaagaaggacaucuggaacagcaccgagcagaacccccuggagaccagcagaagcggcugcgacgaggugagcagcaccagcgagaucggcaccagauacaaggacggcauccccgugagcguggccgagacccagaccgugaucagcagcaucaagggcagcaagaacagcagcgagaucagcagcgagcccggcgacgacgacgagcccaccgagggcagcuucgagggccaccaggccgccgugaacgccauccagaucuucggcaaccugcuguacaccugcagcgccgacaagaccgugagaguguacaaccuggugagcagaaagugcaucggcguguucgagggccacaccagcaaggugaacugccugcuggugacccagaccagcggcaagaacgccgcccuguacaccggcagcagcgaccacaccaucagaugcuacaacgugaagagcagagagugcguggagcagcugcagcuggaggacagagugcugugccugcacagcagauggagaauccuguacgccggccuggccaacggcaccguggugaccuucaacaucaagaacaacaagagacuggagaucuucgagugccacggccccagagccgugagcugccuggccaccgcccaggagggcgccagaaagcugcugguggugggcagcuacgacugcaccaucagcgugagagacgccagaaacggccugcugcugagaacccuggagggccacagcaagaccauccugugcaugaagguggugaacgaccugguguucagcggcagcagcgaccagagcgugcacgcccacaacauccacaccggcgagcuggugagaaucuacaagggccacaaccacgccgugaccguggugaacauccugggcaaggugauggugaccgccugccuggacaaguucgugagaguguacgagcugcagagccacgacagacugcagguguacggcggccacaaggacaugaucaugugcaugaccauccacaagagcaugaucuacaccggcugcuacgacggcagcauccaggccgugagacugaaccugaugcagaacuacagaugcugguggcacggcugcagccugaucuucggcgugguggaccaccugaagcagcaccugcugaccgaccacaccaaccccaacuuccagacccugaagugcagauggaagaacugcgacgccuucuucaccgccagaaagggcagcaagcaggacgccgccggccacaucgagagacacgccgaggacgacagcaagaucgacagcuaa

SEQ ID NO: 25910 - RNA, 2352 nt, Artificial Sequence
  ZNF107__Homo_sapiens__NP_001013768
augguggccaagccccccgugaugagcuuccacuucgcccaggaccuguggcccgagcagaacaucaaggacagcuuccagaaggugacccugagaagauacggcaagugcgaguacgagaaccugcagcugagaaagggcugcaagcacguggacgagugcaccggccacaagggcggccacaacaccgugaaccagugccugaccgccacccccagcaagaucuuccagugcaacaaguacgugaagguguucgacaaguucagcaacagcaacagauacaagagaagacacaccggcaacaagcacuucaagugcaaggagugcagcaagagcuucugcgugcugagccagcugacccagcacagaagaauccacaccagagugaacagcuacaagugcgaggagugcggcaaggccuucaacugguucagcacccugaccaagcacaagagaauccacaccggcgagaagcccuacaagugcgaggagugcggcaaggccuucaaccagagcagccagcugaccagacacaagaucauccacaccgaggagaagcccaacaagugcgaggagugcggcaaggccuucaagcaggccagccaccugaccauccacaagaucauccacaccggcgagaagcccuacaaguacgaggagugcggcaagguguucagccagagcagccaccugaccacccagaagauccugcacaccggcgagaaccuguacaagugcaaggagugcggcaaggccuucaaccuguucagcaaccugaccaaccacaagagaauccacgccggcgagaagcccuacaagugcaaggagugcggcagagccuucaacaucagcagcaaccugaacaagcaggagaagauccacaccggcggcaagcugaacaagugcgaggagugcgacaaggccuucaacagaagccugaagcugaccgcccacaagaagauccugauggaggagaagcccuacaagugcgaggagugcggcaagguguucaaccaguucagcacccugaccagacacaagaucauccacaccggcgagaagcccuacaagugcaaggagugcggcaaggccuucaaccagagcagcaaccugaccgagcacaagaagauccacaccgccgagaagagcuacaagugcgaggagugcggcaaggccuucaaccagcacagcaaccugaucaaccacagaaagaucuacagcggcgagaagcccuacaagugcgaggagugcggcaaggccuucaacagaagcagcacccugaccagacacaagaagauccacaccggcgagaagcccuacaagugcgaggagugcgacagagccuucagccagagcagcaaccugaccgagcacaagaagauccacaccggcgagaagcccuacaagugcgaggagugcggcaaggccuucaacagauucagcacccugaccaagcacaagagaauccacaccggcgagaagcccuacaagugcgaggagugcggcaaggccuucaaccagagcuaccagcugaccagacacaagaucgugcacaccaaggagaagcugaacaagugcgaggaguucggcaaggccuucaagcagagcagccacagaaccauccacaagaucauccacaccggcgagaagcccuacaagugcgaggagcacggcaagguguucaaccagagcagcaaccugaccacccagaagaucauccacaccggcgagaaccuguacaaguucgaggagcacggcaaggccuucaaccuguucagcaacaucaccaaccacaagaucaucuacaccggcgagaagccccacaagugcgaggagugcggcaaggccuacaacagauucagcaaccugaccauccacaagagaauccacaccggcgagaagcccuaccagugcgccgagugcggcaaggccuucaacugcagcagcacccugaacagacacaagaucauccacaccggcgagaagcccuacaagugcaaggagugcggcaaggccuucaaccugagcagcacccugaccgcccacaagaagauccacaccggcgagaagcccuacaagugcgaggagugcggcaaggccuucaaccagagcagcaaccugaccacccacaagaagauccacaccagcgagaagcccuacaagugcgaggagugcggcaagagcuucaaccaguucagcagccugaacauccacaagaucauccacaccggcgagaagcccuacaagugcggcgacuacggcagagccuucaaccugagcagcaaccugaccacccacaagaagauccacaccggcgagaagcccuacaagugcgaguacggcaagaccuaa

SEQ ID NO: 25911 - RNA, 1722 nt, Artificial Sequence
  ZNF10__Homo_sapiens__NP_056209
auggacgccaagagccugaccgccuggagcagaacccuggugaccuucaaggacguguucguggacuucaccagagaggaguggaagcugcuggacaccgcccagcagaucguguacagaaacgugaugcuggagaacuacaagaaccuggugagccugggcuaccagcugaccaagcccgacgugauccugagacuggagaagggcgaggagcccuggcugguggagagagagauccaccaggagacccaccccgacagcgagaccgccuucgagaucaagagcagcgugagcagcagaagcaucuucaaggacaagcagagcugcgacaucaagauggagggcauggccagaaacgaccugugguaccugagccuggaggagguguggaagugcagagaccagcuggacaaguaccaggagaaccccgagagacaccugagacagguggccuucacccagaagaaggugcugacccaggagagagugagcgagagcggcaaguacggcggcaacugccugcugcccgcccagcuggugcugagagaguacuuccacaagagagacagccacaccaagagccugaagcacgaccuggugcugaacggccaccaggacagcugcgccagcaacagcaacgagugcggccagaccuucugccagaacauccaccugauccaguucgccagaacccacaccggcgacaagagcuacaagugccccgacaacgacaacagccugacccacggcagcagccugggcaucagcaagggcauccacagagagaagcccuacgagugcaaggagugcggcaaguucuucagcuggagaagcaaccugaccagacaccagcugauccacaccggcgagaagcccuacgagugcaaggagugcggcaagagcuucagcagaagcagccaccugaucggccaccagaagacccacaccggcgaggagcccuacgagugcaaggagugcggcaagagcuucagcugguucagccaccuggugacccaccagagaacccacaccggcgacaagcuguacaccugcaaccagugcggcaagagcuucgugcacagcagcagacugaucagacaccagagaacccacaccggcgagaagcccuacgagugccccgagugcggcaagagcuucagacagagcacccaccugauccugcaccagagaacccacgugagagugagacccuacgagugcaacgagugcggcaagagcuacagccagagaagccaccugguggugcaccacagaauccacaccggccugaagcccuucgagugcaaggacugcggcaagugcuucagcagaagcagccaccuguacagccaccagagaacccacaccggcgagaagcccuacgagugccacgacugcggcaagagcuucagccagagcagcgcccugaucgugcaccagagaauccacaccggcgagaagcccuacgagugcugccagugcggcaaggccuucaucagaaagaacgaccugaucaagcaccagagaauccacgugggcgaggagaccuacaagugcaaccagugcggcaucaucuucagccagaacagccccuucaucgugcaccagaucgcccacaccggcgagcaguuccugaccugcaaccagugcggcaccgcccuggugaacaccagcaaccugaucggcuaccagaccaaccacaucagagagaacgccuacuaa

SEQ ID NO: 25912 - RNA, 2742 nt, Artificial Sequence
  ZNF112__Homo_sapiens__NP_001076804
augaccaaguuccaggagauggugaccuucaaggacguggccgugguguucaccgaggaggagcugggccugcuggacagcgugcagagaaagcuguacagagacgugaugcuggagaacuucagaaaccugcugcugguggcccaccagcccuucaagcccgaccugaucagccagcuggagagagaggagaagcugcugaugguggagaccgagacccccagagacggcugcagcggcagaaagaaccagcagaagauggagagcauccaggaggugaccgugagcuacuucagccccaaggagcugagcagcagacagaccuggcagcagagcgccggcggccugaucagaugccaggacuuccugaagguguuccagggcaagaacagccagcugcaggagcagggcaacagccugggccaggugugggccggcauccccgugcagaucagcgaggacaagaacuacaucuucacccacaucggcaacggcagcaacuacaucaagagccagggcuaccccagcuggagagcccaccacagcuggagaaagauguaccugaaggagagccacaacuaccagugcagaugccagcagaucagcaugaagaaccacuucugcaagugcgacagcgugagcuggcugagccaccacaacgacaagcuggaggugcacagaaaggagaacuacagcugccacgacugcggcgaggacaucaugaaggugagccugcugaaccaggagagcauccagaccgaggagaagcccuaccccugcaccggcuacagaaaggccuucagcaacgacagcagcagcgaggugcaccagcaguuccaccuggagggcaagcccuacaccuacagcagcugcggcaagggcugcaacuacagcagccugcugcacauccaccagaacaucgagagagaggacgacaucgagaacagccaccugaagagcuaccagagagugcacaccgaggagaagcccugcaagugcggcgaguacggcgagaacuucaaccacugcagcccccugaacaccuacgagcugauccacaccggcgagaugagcuacagacacaacaucuacgagaaggccuucagccacagccuggaccugaacagcaucuucagagugcacaccagagacgagccccacgaguacgaggagaacgagaacguguucaaccagagcagcugccugcaggugcaccagaagauccacaccgaggagaagcuguacaccgacaucgaguacggcaagagcuucaucugcagcagcaaccuggacauccagcacagagugcacauggaggagaacagcuacaacagcgaggagugcggcaacggcuucagccuggccagccacuuccaggaccugcagaucgugcacaccaaggagcagcccuacaagagauacgugugcagcaacagcuucagccacaaccuguaccugcagggccaccccaagauccacaucggcgagaagcccagaaaggagcacggcaacggcuucaacuggagcagcaagcugaaggaccaccagagagugcacaccggccagaagcccuacaagugcaacaucugcggcaagggcuucaaccacagaagcgugcugaacgugcaccagagagugcacaccggcgagaagcccuacaagugcgaggagugcgacaagggcuucagcagaagcagcuaccugcaggcccaccagagagugcacaccggcgagaagcccuacaagugcgaggagugcggcaagggcuucagcagaaacagcuaccugcagggccaccagagagugcacaccggcgagaagcccuacaagugcgaggagugcggcaagggcuucagcagaagcagccaccugcagggccaccagagagugcacaccggcgagaagcccuucaagugcgaggagugcggcaagggcuucagcuggagcuucaaccugcagauccaccagagagugcacaccggcgagaagcccuacaagugcgaggagugcggcaagggcuucagcaaggccagcacccugcuggcccaccagagagugcacaccggcgagaagcccuaccagugcgacgagugcggcaagagcuucagccagagaagcuaccugcagagccaccagagcgugcacagcggcgagagacccuacaucugcgaggugugcggcaagggcuucagccagagagccuaccugcagggccaccagagagugcacaccagagugaagcccuacaagugcgagaugugcggcaagggcuucagccagagcagcagacuggaggcccacagaagagugcacaccggcggcaagcccuacaagugcgaggugugcaccaagggcuucagcgagagcagcagacugcaggcccaccagagagugcacguggagggcagacccuacaagugcgagcagugcggcaagggcuucagcggcuacagcagccugcaggcccaccacagagugcacaccggcgagaagcccuacaagugcgaggugugcggcaagggcuucagccagagaagcaaccugcaggcccaccagagagugcacaccggcgagaagcccuacaagugcgacgccugcggcaagggcuucagauggagcagcggccugcugauccaccagagagugcacagcagcgacaaguucuacaagagcgaggacuacggcaaggacuaccccagcagcgagaaccugcacagaaacgaggacagcgugcuguucuaa

SEQ ID NO: 25913 - RNA, 1299 nt, Artificial Sequence
  ZNF121__Homo_sapiens__XP_011526569
auguacuucgugaccgagcacggcgccaucggccugggcagcuucagaaacggcaagcugaagcccaagugccagcaccugaacaacaucuucuucuggcugaacaagaccagcaacggcauccagauggccgagauccacaacggcggcgagcugugcgacuucauggagaacggcgagaucuucagcgagcacagcugccugaacgcccacaugggcaccgagaacaccggcgacaccuacgacugcgacgaguacggcgagaacuuccccaugcugcacaacagcgcccccgccggcgagacccugagcgugcugaaccagugcagaaaggccuucagccugccccccaacgugcaccagagaaccuggaucggcgacaagagcuucgaguacagcgacugcgaggaggccuucguggaccagagccaccugcaggccaacagaaucacccacaacggcgagacccuguacgagcagaagcagugcggcagagccuucaccuacagcaccagccacgccgugagcgugaagaugcacaccguggagaagcccuacgagugcaaggagugcggcaaguucuucagauacagcagcuaccugaacagccacaugagaacccacaccggcgagaagcccuacgagugcaaggagugcggcaagugcuucaccgugagcagccaccugguggagcacgugagaauccacaccggcgagaagcccuaccagugcaaggagugcggcagagccuucgccggcagaagcggccugaccaagcacgugagaauccacaccggcgagaagcccuacgagugcaacgagugcggcaaggccuacaacagauucuaccugcugaccgagcacuucaagacccacaccgaggagaagcccuucgagugcaaggugugcggcaagagcuucagaagcagcagcugccugaagaaccacuucagaauccacaccggcaucaagcccuacaagugcaaggagugcggcaaggccuucaccgugagcagcagccugcacaaccacgugaagauccacaccggcgagaagcccuacgagugcaaggacugcggcaaggccuucgccaccagcagccagcugaucgagcacaucagaacccacaccggcgagaagcccuacaucugcaaggagugcggcaagaccuucagagccagcagccaccugcagaagcacgugagaauccacaccggcgagaagcccuacaucugcaacgagugcggcaaggccuacaacagauucuaccugcugaccaagcaccugaagacccacuaa

SEQ ID NO: 25914 - RNA, 1872 nt, Artificial Sequence
  ZNF131__Homo_sapiens__NP_001284477
auggaggccgaggagaccauggagugccugcaggaguuccccgagcaccacaagaugauccuggacagacugaacgagcagagagagcaggacagauucaccgacaucacccugaucguggacggccaccacuucaaggcccacaaggccgugcuggccgccugcagcaaguucuucuacaaguucuuccaggaguucacccaggagccccugguggagaucgagggcgugagcaagauggccuucagacaccugaucgaguucaccuacaccgccaagcugaugauccagggcgaggaggaggccaacgacguguggaaggccgccgaguuccugcagaugcuggaggccaucaaggcccuggaggugagaaacaaggagaacagcgccccccuggaggagaacaccaccggcaagaacgaggccaagaagagaaagaucgccgagaccagcaacgugaucaccgagagccugcccagcgccgagagcgagcccguggagaucgagguggagaucgccgagggcaccaucgagguggaggacgagggcaucgagacccuggaggagguggccagcgccaagcagagcgugaaguacauccagagcaccggcagcagcgacgacagcgcccuggcccugcuggccgacaucaccagcaaguacagacagggcgacagaaagggccagaucaaggaggacggcugccccagcgaccccaccagcaagcagguggagggcaucgagaucguggagcugcagcugagccacgugaaggaccuguuccacugcgagaagugcaacagaagcuucaagcuguucuaccacuucaaggagcacaugaagagccacagcaccgagagcuucaagugcgagaucugcaacaagagauaccugagagagagcgccuggaagcagcaccugaacugcuaccaccuggaggagggcggcgugagcaagaagcagagaaccggcaagaagauccacgugugccaguacugcgagaagcaguucgaccacuucggccacuucaaggagcaccugagaaagcacaccggcgagaagcccuucgagugccccaacugccacgagagauucgccagaaacagcacccugaagugccaccugaccgccugccagaccggcgugggcgccaagaagggcagaaagaagcuguacgagugccaggugugcaacagcguguucaacagcugggaccaguucaaggaccaccuggugauccacaccggcgacaagcccaaccacugcacccugugcgaccugugguucaugcagggcaacgagcugagaagacaccugagcgacgcccacaacaucagcgagagacuggugaccgaggaggugcugagcguggagaccagagugcagaccgagcccgugaccagcaugaccaucaucgagcaggugggcaaggugcacgugcugccccugcugcaggugcagguggacagcgcccaggugaccguggagcaggugcaccccgaccugcugcaggacagccaggugcacgacagccacaugagcgagcugcccgagcaggugcaggugagcuaccuggaggugggcagaauccagaccgaggagggcaccgaggugcacguggaggagcugcacguggagagagugaaccagaugcccguggaggugcagaccgagcugcuggaggccgaccuggaccacgugacccccgagaucaugaaccaggaggagagagagagcagccaggccgacgccgccgaggccgccagagaggaccacgaggacgccgaggaccuggagaccaagcccaccguggacagcgaggccgagaaggccgagaacgaggacagaaccgcccugcccgugcuggaguaa

SEQ ID NO: 25915 - RNA, 2121 nt, Artificial Sequence
  ZNF132__Homo_sapiens__NP_003424
auggcccugcccagcccccaggugcugaugggccugcccgcccugcugaugggccccgcccagcacaccagcuggcccugcggcagcgccgugcccacccugaagagcauggugaccuucgaggacguggccguguacuucagccaggaggagugggagcugcuggacgccgcccagagacaccuguaccacagcgugaugcuggagaaccuggagcuggugaccagccugggcagcuggcacggcguggagggcgagggcgcccaccccaagcagaacgugagcguggaggugcugcaggugagaauccccaacgccgaccccagcaccaagaaggccaacagcugcgacaugugcggccccuuccugaaggacauccugcaccuggccgagcaccagggcacccagagcgaggagaagcccuacaccugcggcgccugcggcagagacuucuggcugaacgccaaccugcaccagcaccagaaggagcacagcggcggcaagcccuucagaugguacaaggacagagacgcccugaugaagagcagcaaggugcaccugagcgagaaccccuucaccugcagagagggcggcaaggugauccugggcagcugcgaccugcugcagcugcaggccguggacagcggccagaagcccuacagcaaccugggccagcugcccgaggugugcaccacccagaagcuguucgagugcagcaacugcggcaaggccuuccugaagagcagcacccugcccaaccaccugagaacccacagcgaggagauccccuucaccugccccaccggcggcaacuuccuggaggagaagagcauccugggcaacaagaaguuccacaccggcgagaucccccacgugugcaaggagugcggcaaggccuucagccacagcagcaagcugagaaagcaccagaaguuccacaccgaggugaaguacuacgagugcaucgccugcggcaagaccuucaaccacaagcugaccuucgugcaccaccagagaauccacagcggcgagagacccuacgagugcgacgagugcggcaaggccuucagcaacagaagccaccugaucagacacgagaaggugcacaccggcgagagacccuucgagugccugaagugcggcagagccuucagccagagcagcaacuuccugagacaccagaaggugcacacccaggugagacccuacgagugcagccagugcggcaagagcuucagcagaagcagcgcccugauccagcacuggagagugcacaccggcgagagacccuacgagugcagcgagugcggcagagccuucaacaacaacagcaaccuggcccagcaccagaaggugcacaccggcgagagacccuucgagugcagcgagugcggcagagacuucagccagagcagccaccugcugagacaccagaaggugcacaccggcgagagacccuucgagugcugcgacugcggcaaggccuucagcaacagcagcacccugauccagcaccagaaggugcacaccggccagagacccuacgagugcagcgagugcagaaagagcuucagcagaagcagcagccugauccagcacuggagaauccacaccggcgagaagcccuacgagugcagcgagugcggcaaggccuucgcccacagcagcacccugaucgagcacuggagagugcacaccaaggagagacccuacgagugcaacgagugcggcaaguucuucagccagaacagcauccugaucaagcaccagaaggugcacaccggcgagaagcccuacaagugcagcgagugcggcaaguucuucagcagaaagagcagccugaucugccacuggagagugcacaccggcgagagacccuacgagugcagcgagugcggcagagccuucagcagcaacagccaccuggugagacaccagagagugcacacccaggagagacccuacgagugcauccagugcggcaaggccuucagcgagagaagcacccuggugagacaccagaaggugcacaccagagagagaaccuacgagugcagccagugcggcaagcuguucagccaccugugcaaccuggcccagcacaagaagauccacaccuaa

SEQ ID NO: 25916 - RNA, 2016 nt, Artificial Sequence
  ZNF133__Homo_sapiens__NP_001269925
auggcccacauggccuucagagacguggccguggacuucacccaggacgaguggagacugcugagccccgcccagagaacccuguacagagaggugaugcuggagaacuacagcaaccuggugagccugggcaucagcuucagcaagcccgagcugaucacccagcuggagcagggcaaggagaccuggagagaggagaagaagugcagccccgccaccugccccgaccaccaggaguacggcaacaacugcgaccugcagaaggaggccgaccccgagcccgagcuguaccuggaccccuucugcccccccggcuucagcagccagaaguuccccaugcagcacgugcugugcaaccacccccccuggaucuucaccugccugugcgccgagggcaacauccagcccggcgaccccggccccggcgaccaggagaagcagcagcaggccagcgagggcagacccuggagcgaccaggccgagggccccgagggcgagggcgccaugccccuguucggcagaaccaagaagagaacccugggcgccuucagcagacccccccagagacagcccgugagcagcagaaacggccugagaggcguggagcuggaggccagccccgcccagaccggcaaccccgaggagaccgacaagcugcugaagagaaucgaggugcugggcuucggcaccgugaacugcggcgagugcggccugagcuucagcaagaugaccaaccugcugagccaccagagaauccacagcggcgagaagcccuacgugugcggcgugugcgagaagggcuucagccugaagaagagccuggccagacaccagaaggcccacagcggcgagaagcccaucgugugcagagagugcggcagaggcuucaacagaaagagcacccugaucauccacgagagaacccacagcggcgagaagcccuacaugugcagcgagugcggcagaggcuucagccagaagagcaaccugaucauccaccagagaacccacagcggcgagaagcccuacgugugcagagagugcggcaagggcuucagccagaagagcgccguggugagacaccagagaacccaccuggaggagaagaccaucgugugcagcgacugcggccugggcuucagcgacagaagcaaccugaucagccaccagagaacccacagcggcgagaagcccuacgccugcaaggagugcggcagaugcuucagacagagaaccacccuggugaaccaccagagaacccacagcaaggagaagcccuacgugugcggcgugugcggccacagcuucagccagaacagcacccugaucagccacagaagaacccacaccggcgagaagcccuacgugugcggcgugugcggcagaggcuucagccugaagagccaccugaacagacaccagaacauccacagcggcgagaagcccaucgugugcaaggacugcggcagaggcuucagccagcagagcaaccugaucagacaccagagaacccacagcggcgagaagcccauggugugcggcgagugcggcagaggcuucagccagaagagcaaccugguggcccaccagagaacccacagcggcgagagacccuacgugugcagagagugcggcagaggcuucagccaccaggccggccugaucagacacaagagaaagcacagcagagagaagcccuacaugugcagacagugcggccugggcuucggcaacaagagcgcccugaucacccacaagagagcccacagcgaggagaagcccugcgugugcagagagugcggccagggcuuccugcagaagagccaccugacccugcaccagaugacccacaccggcgagaagcccuacgugugcaagaccugcggcagaggcuucagccugaagagccaccugagcagacacagaaagaccaccagcgugcaccacagacugcccgugcagcccgaccccgagcccugcgccggccagcccagcgacagccuguacagccuguaa

SEQ ID NO: 25917 - RNA, 1425 nt, Artificial Sequence
  ZNF141__Homo_sapiens__NP_003432
auggagcugcugaccuucagagacguggccaucgaguucagccccgaggaguggaagugccuggaccccgaccagcagaaccuguacagagacgugaugcuggagaacuacagaaaccuggugagccugggcguggccaucagcaaccccgaccuggugaccugccuggagcagagaaaggagcccuacaacgugaagauccacaagaucguggccagaccccccgccaugugcagccacuucacccaggaccacuggcccgugcagggcaucgaggacagcuuccacaagcugauccugagaagauacgagaagugcggccacgacaaccugcagcugagaaagggcugcaagagccugaacgagugcaagcugcagaagggcggcuacaacgaguucaacgagugccugagcaccacccagagcaagauccugcagugcaaggccagcgugaagguggugagcaaguucagcaacagcaacaagagaaagaccagacacaccggcgagaagcacuucaaggagugcggcaagagcuuccagaaguucagccaccugacccagcacaaggugauccacgccggcgagaagcccuacaccugcgaggagugcggcaaggccuucaaguggagccugaucuucaacgagcacaagagaauccacaccggcgagaagcccuucaccugcgaggagugcggcagcaucuucaccaccagcagccacuucgccaagcacaagaucauccacaccggcgagaagcccuacaagugcgaggagugcggcaaggccuucaacagauucaccacccugaccaagcacaagagaauccacgccggcgagaagcccaucaccugcgaggagugcagaaagaucuucaccagcagcagcaacuucgccaagcacaagagaauccacaccggcgagaagcccuacaagugcgaggagugcggcaaggccuucaacagaagcaccacccugaccaagcacaagagaauccacaccggcgagaagcccuacaccugcgaggagugcggcaaggccuucagacagagcagcaagcugaacgagcacaagaaggugcacaccggcgagagacccuacaagugcgacgagugcggcaaggccuucggcagaagcagagugcugaacgagcacaagaagauccacaccggcgagaagcccuacaagugcgaggagugcggcaaggccuucagaagaagcaccgacagaagccagcacaagaagauccacagcgccgacaagcccuacaagugcaaggagugcgacaaggccuucaagcaguucagccugcugagccagcacaagaagauccacaccguggacaagcccuacaagugcaaggacugcgacaaggccuucaagagauucagccaccugaacaagcacaagaagauccacaccuaa

SEQ ID NO: 25918 - RNA, 1914 nt, Artificial Sequence
  ZNF143__Homo_sapiens__NP_001269585
augcugcuggcccagaucaacagagacagccagggcaugaccgaguuccccggcggcggcauggaggcccagcacgugacccugugccugaccgaggccgugaccguggccgacggcgacaaccuggagaacauggagggcgugagccugcaggccgugacccuggccgacggcagcaccgccuacauccagcacaacagcaaggacgccaagcugaucgacggccaggugauccagcuggaggacggcagcgccgccuacgugcagcacgugcccauccccaagagcagagacagccugagacuggaggacggccaggccgugcagcuggaggacggcaccaccgccuucauccaccacaccagcaaggacagcuacgaccagagcgcccugcaggccgugcagcuggaggacggcaccaccgccuacauccaccacgccgugcaggugccccagagcgacaccauccuggccauccaggccgacggcaccguggccggccugcacaccggcgacgccaccaucgaccccgacaccaucagcgcccuggagcaguacgccgccaaggugagcaucgacggcagcgagagcguggccggcaccggcaugaucggcgagaacgagcaggagaagaagaugcagaucgugcugcagggccacgccaccagagugaccgccaagagccagcagagcggcgagaaggccuucagaugcgaguacgacggcugcggcaagcuguacaccaccgcccaccaccugaaggugcacgagagaagccacaccggcgacagacccuaccagugcgagcacgccggcugcggcaaggccuucgccaccggcuacggccugaagagccacgugagaacccacaccggcgagaagcccuacagaugcagcgaggacaacugcaccaagagcuucaagaccagcggcgaccugcagaagcacaucagaacccacaccggcgagagacccuucaagugccccuucgagggcugcggcagaagcuucaccaccagcaacaucagaaaggugcacgugagaacccacaccggcgagagacccuacuacugcaccgagcccggcugcggcagagccuucgccagcgccaccaacuacaagaaccacgugagaauccacaccggcgagaagcccuacgugugcaccgugcccggcugcgacaagagauucaccgaguacagcagccuguacaagcaccacguggugcacacccacagcaagcccuacaacugcaaccacugcggcaagaccuacaagcagaucagcacccuggccaugcacaagagaaccgcccacaacgacaccgagcccaucgaggaggagcaggaggccuucuucgagcccccccccggccagggcgaggacgugcugaagggcagccagaucaccuacgugaccggcguggagggcgacgacguggugagcacccagguggccaccgugacccagagcggccugagccagcaggugacccugaucagccaggacggcacccagcacgugaacaucagccaggccgacaugcaggccaucggcaacaccaucaccauggugacccaggacggcacccccaucaccgugcccgcccacgacgccgugaucagcagcgccggcacccacagcguggccauggugaccgccgagggcaccgagggcgagcagguggccaucguggcccaggaccuggccgccuuccacaccgccagcagcgagaugggccaccagcagcacagccaccaccuggugaccaccgagaccagaccccugacccugguggccaccagcaacggcacccagaucgccgugcagcugggcgagcagcccagccuggaggaggccaucagaaucgccagcagaauccagcagggcgagacccccggccuggacgacuaa

SEQ ID NO: 25919 - RNA, 879 nt, Artificial Sequence
  ZNF146__Homo_sapiens__XP_005259271
augagccaccugagccagcagagaaucuacagcggcgagaaccccuucgccugcaaggugugcggcaagguguucagccacaagagcaaccugaccgagcacgagcacuuccacaccagagagaagcccuucgagugcaacgagugcggcaaggccuucagccagaagcaguacgugaucaagcaccagaacacccacaccggcgagaagcuguucgagugcaacgagugcggcaagagcuucagccagaaggagaaccugcugacccaccagaagauccacaccggcgagaagcccuucgagugcaaggacugcggcaaggccuucauccagaagagcaaccugaucagacaccagagaacccacaccggcgagaagcccuucgugugcaaggagugcggcaagaccuucagcggcaagagcaaccugaccgagcacgagaagauccacaucggcgagaagcccuucaagugcagcgagugcggcaccgccuucggccagaagaaguaccugaucaagcaccagaacauccacaccggcgagaagcccuacgagugcaacgagugcggcaaggccuucagccagagaaccagccugaucgugcacgugagaauccacagcggcgacaagcccuacgagugcaacgugugcggcaaggccuucagccagagcagcagccugaccgugcacgugagaagccacaccggcgagaagcccuacggcugcaacgagugcggcaaggccuucagccaguucagcacccuggcccugcaccugagaauccacaccggcaagaagcccuaccagugcagcgagugcggcaaggccuucagccagaagagccaccacaucagacaccagaagauccacacccacuaa

SEQ ID NO: 25920 - RNA, 2385 nt, Artificial Sequence
  ZNF148__Homo_sapiens__NP_068799
augaacaucgacgacaagcuggagggccuguuccugaagugcggcggcaucgacgagaugcagagcagcagaaccaugguggugaugggcggcgugagcggccagagcaccgugagcggcgagcugcaggacagcgugcugcaggacagaagcaugccccaccaggagauccuggccgccgacgaggugcugcaggagagcgagaugagacagcaggacaugaucagccacgacgagcugauggugcacgaggagaccgugaagaacgacgaggagcagauggagacccacgagagacugccccagggccugcaguacgcccugaacgugcccaucagcgugaagcaggagaucaccuucaccgacgugagcgagcagcugaugagagacaagaagcagaucagagagcccguggaccugcagaagaagaagaagagaaagcagagaagccccgccaagauccugaccaucaacgaggacggcagccugggccugaagacccccaagagccacgugugcgagcacugcaacgccgccuucagaaccaacuaccaccugcagagacacguguucauccacaccggcgagaagcccuuccagugcagccagugcgacaugagauucauccagaaguaccugcugcagagacacgagaagauccacaccggcgagaagcccuucagaugcgacgagugcggcaugagauucauccagaaguaccacauggagagacacaagagaacccacagcggcgagaagcccuaccagugcgaguacugccugcaguacuucagcagaaccgacagagugcugaagcacaagagaaugugccacgagaaccacgacaagaagcugaacagaugcgccaucaagggcggccugcugaccagcgaggaggacagcggcuucagcaccagccccaaggacaacagccugcccaagaagaagagacagaagaccgagaagaagagcagcggcauggacaaggagagcgcccuggacaagagcgaccugaagaaggacaagaacgacuaccugccccuguacagcagcagcaccaaggugaaggacgaguacaugguggccgaguacgccguggagaugccccacagcagcgugggcggcagccaccuggaggacgccagcggcgagauccacccccccaagcuggugcugaagaagaucaacagcaagagaagccugaagcagccccuggagcagaaccagaccaucagcccccugagcaccuacgaggagagcaaggugagcaaguacgccuucgagcugguggacaagcaggcccugcuggacagcgagggcaacgccgacaucgaccagguggacaaccugcaggagggccccagcaagcccgugcacagcagcaccaacuacgacgacgccaugcaguuccugaagaagaagagauaccugcaggccgccagcaacaacagcagagaguacgcccugaacgugggcaccaucgccagccagcccagcgugacccaggccgccguggccagcgugaucgacgagagcaccaccgccagcauccuggagagccaggcccugaacguggagaucaagagcaaccacgacaagaacgugauccccgacgaggugcugcagacccugcuggaccacuacagccacaaggccaacggccagcacgagaucagcuucagcguggccgacaccgaggugaccagcagcaucagcaucaacagcagcgaggugcccgaggugacccccagcgagaacgugggcagcagcagccaggccagcagcagcgacaaggccaacaugcugcaggaguacagcaaguuccugcagcaggcccuggacagaaccagccagaacgacgccuaccugaacagccccagccugaacuucgugaccgacaaccagacccugcccaaccagcccgccuucagcagcaucgacaagcagguguacgccaccaugcccaucaacagcuucagaagcggcaugaacagcccccugagaaccacccccgacaagagccacuucggccugaucgugggcgacagccagcacagcuuccccuucagcggcgacgagaccaaccacgccagcgccaccagcacccaggacuuccuggaccaggugaccagccagaagaaggccgaggcccagcccgugcaccaggccuaccagaugagcagcuucgagcagcccuucagagcccccuaccacggcagcagagccggcaucgccacccaguucagcaccgccaacggccaggugaaccugagaggccccggcaccagcgccgaguucagcgaguucccccuggugaacgugaacgacaacagagccggcaugaccagcagccccgacgccaccaccggccagaccuucggcuaa

SEQ ID NO: 25921 - RNA, 1314 nt, Artificial Sequence
  ZNF154__Homo_sapiens__NP_001078853
auggccgccgccacccugagaacccccacccagggcaccgugaccuucgaggacguggccgugcacuucagcugggaggaguggggccugcuggacgaggcccagagaugccuguacagagacgugaugcuggagaaccuggcccugcugaccagccuggacgugcaccaccagaagcagcaccugggcgagaagcacuucagaagcaacgugggcagagcccuguucgugaagaccugcaccuuccacgugagcggcgagcccagcaccugcagagaggugggcaaggacuuccuggccaagcugggcuuccugcaccagcaggccgcccacaccggcgagcagagcaacagcaagagcgacggcggcgccaucagccacagaggcaagacccacuacaacugcggcgagcacaccaaggccuucagcggcaagcacacccuggugcagcagcagagaacccugaccaccgagagaugcuacaucugcagcgagugcggcaagagcuucagcaagagcuacagccugaacgaccacuggagacugcacaccggcgagaagcccuacgagugcagagagugcggcaagagcuucagacagagcagcagccugauccagcacagaagagugcacaccgccgugagaccccacgagugcgacgagugcggcaagcuguucagcaacaagagcaaccugaucaagcacagaagagugcacaccggcgagagacccuacgagugcagcgagugcggcaagagcuucagccagagaagcgcccugcugcagcacagaggcgugcacaccggcgagagacccuacgagugcagcgagugcggcaaguucuucaccuaccacagcagccugaucaagcaccagaaggugcacagcggcagcagacccuacgagugcagcgagugcggcaagagcuucagccagaacagcagccugaucgagcaccacagagugcacaccggcgagagacccuacaagugcagcgagugcggcaagagcuucagccagagaagcgcccugcugcagcacagaggcgugcacaccggcgagagacccuacgagugcagcgagugcggcaaguucuuccccuacagcagcagccugagaaagcaccagagagugcacaccggcagcagacccuacgagugcagcgagugcggcaagagcuucacccagaacagcggccugaucaagcacagaagagugcacaccggcgagaagcccuacgagugcaccgagugcggcaagagcuucagccacaacagcagccugaucaagcaccagagaauccacagcagauaa

SEQ ID NO: 25922 - RNA, 2349 nt, Artificial Sequence
  ZNF160__Homo_sapiens__XP_005259436
augcuggagaacuacuggaaccuggugagccugggccugugccacuucgacaugaacaucaucagcaugcuggaggagggcaaggagcccuggaccgugaagagcugcgugaagaucgccagaaagcccagaacccccgagugcgugaagggcguggugaccgacaucccccccaagugcaccaucaaggaccugcugcccaaggagaagagcagcaccgaggccguguuccacaccguggugcuggagagacacgagagccccgacaucgaggacuucagcuucaaggagccccagaagaacgugcacgacuucgagugccaguggagagacgacaccggcaacuacaagggcgugcugauggcccagaaggagggcaagagagaccagagagacagaagagacaucgagaacaagcugaugaacaaccagcugggcgugagcuuccacagccaccugcccgagcugcagcuguuccagggcgagggcaagauguacgagugcaaccagguggagaagagcaccaacaacggcagcagcgugagcccccugcagcagauccccagcagcgugcagacccacagaagcaagaaguaccacgagcugaaccacuucagccugcugacccagagaagaaaggccaacagcugcggcaagcccuacaagugcaacgagugcggcaaggccuucacccagaacagcaaccugaccagccacagaagaauccacagcggcgagaagcccuacaagugcagcgagugcggcaagaccuucaccgugagaagcaaccugaccauccaccaggugauccacaccggcgagaagcccuacaagugccacgagugcggcaagguguucagacacaacagcuaccuggccacccacagaagaauccacaccggcgagaagcccuacaagugcaacgagugcggcaaggccuucagaggccacagcaaccugaccacccaccagcugauccacaccggcgagaagcccuucaagugcaacgagugcggcaagcuguucacccagaacagccaccugaucagccacuggagaauccacaccggcgagaagcccuacaagugcaacgagugcggcaaggccuucagcgugagaagcagccuggccauccaccagaccauccacaccggcgagaagcccuacaagugcaacgagugcggcaagguguucagauacaacagcuaccugggcagacacagaagagugcacaccggcgagaagcccuacaagugcaacgagugcggcaaggccuucagcaugcacagcaaccuggccacccaccaggugauccacaccggcaccaagcccuucaagugcaacgagugcagcaagguguucacccagaacagccagcuggccaaccacagaagaauccacaccggcgagaagcccuacaagugcaacgagugcggcaaggccuucagcgugagaagcagccugaccacccaccaggccauccacagcggcgagaagcccuacaagugcaucgagugcggcaagagcuucacccagaagagccaccugagaagccacagaggcauccacagcggcgagaagcccuacaagugcaacgagugcggcaagguguucgcccagaccagccagcuggccagacacuggagagugcacaccggcgagaagcccuacaagugcaacgacugcggcagagccuucagcgacagaagcagccugaccuuccaccaggccauccacaccggcgagaagcccuacaagugccacgagugcggcaagguguucagacacaacagcuaccuggccacccacagaagaauccacaccggcgagaagcccuacaagugcaacgagugcggcaaggccuucagcaugcacagcaaccugaccacccacaaggugauccacaccggcgagaagcccuacaagugcaaccagugcggcaagguguucacccagaacagccaccuggccaaccaccagagaacccacaccggcgagaagcccuacagaugcaacgagugcggcaaggccuucagcgugagaagcagccugaccacccaccaggccauccacaccggcaagaagcccuacaagugcaacgagugcggcaagguguucacccagaacgcccaccuggccaaccacagaagaauccacaccggcgagaagcccuacagaugcaccgagugcggcaaggccuucagagugagaagcagccugaccacccacauggccauccacaccggcgagaagagauacaagugcaacgagugcggcaagguguucagacagagcagcaaccuggccagccaccacagaaugcacaccggcgagaagcccuacaaguaa

SEQ ID NO: 25923 - RNA, 1815 nt, Artificial Sequence
  ZNF169__Homo_sapiens__NP_003439
augagccccggccugcugaccaccagaaaggaggcccugauggccuucagagacguggccguggccuucacccagaaggaguggaagcugcugagcagcgcccagagaacccuguacagagaggugaugcuggagaacuacagccaccuggugagccugggcaucgccuucagcaagcccaagcugaucgagcagcuggagcagggcgacgagcccuggagagaggagaacgagcaccugcuggaccugugccccgccgagcccagaaccgaguuccagcccagcuucccccaccugguggccuucagcagcagccagcugcugagacaguacgcccugagcggccaccccacccagaucuuccccagcagcagcgccggcggcgacuuccagcuggaggcccccagaugcagcagcgagaagggcgagagcggcgagaccgagggccccgacagcagccugagaaagagacccagcagaaucagcagaaccuucuucagcccccaccagggcgaccccguggaguggguggagggcaacagagagggcggcaccgaccugagacuggcccagagaaugagccugggcggcagcgacaccaugcugaagggcgccgacaccagcgagagcggcgccgugaucagaggcaacuacagacugggccugagcaagaagagcagccuguucagccaccagaagcaccacgugugccccgagugcggcagaggcuucugccagagaagcgaccugaucaagcaccagagaacccacaccggcgagaagcccuaccugugccccgagugcggcagaagauucagccagaaggccagccugagcauccaccagagaaagcacagcggcgagaagcccuacgugugcagagagugcggcagacacuucagauacaccagcagccugaccaaccacaagagaauccacagcggcgagagacccuucgugugccaggagugcggcagaggcuucagacagaagaucgcccugcugcugcaccagagaacccaccuggaggagaagcccuucgugugccccgagugcggcagaggcuucugccagaaggccagccugcugcagcaccagagcagccacaccggcgagagacccuuccugugccuggagugcggcagaagcuucagacagcagagccugcugcugagccaccaggugacccacagcggcgagaagcccuacgugugcgccgagugcggccacagcuucagacagaaggugacccugaucagacaccagagaacccacaccggcgagaagcccuaccugugcccccagugcggcagaggcuucagccagaaggugacccugaucggccaccagagaacccacaccggcgagaagcccuaccugugccccgacugcggcagaggcuucggccagaaggugacccugaucagacaccagagaacccacaccggcgagaagcccuaccugugccccaagugcggcagagccuucggcuucaagagccugcugaccagacaccagagaacccacagcgaggaggagcuguacguggacagagugugcggccagggccugggccagaagagccaccugaucagcgaccagagaacccacagcggcgagaagcccugcaucugcgacgagugcggcagaggcuucggcuucaagagcgcccugaucagacaccagagaacccacagcggcgagaagcccuacgugugcagagagugcggcagaggcuucagccagaagagccaccugcacagacacagaagaaccaagagcggccaccagcugcugccccaggagguguucuaa

SEQ ID NO: 25924 - RNA, 2136 nt, Artificial Sequence
  ZNF175__Homo_sapiens__NP_009078
augcccgccgacgugaaccugagccagaagccccaggugcugggccccgagaagcaggacggcagcugcgaggccagcgugagcuucgaggacgugaccguggacuucagcagagaggaguggcagcagcuggaccccgcccagagaugccuguacagagacgugaugcuggagcuguacagccaccuguucgccgugggcuaccacauccccaaccccgaggugaucuucagaaugcugaaggagaaggagcccagaguggaggaggccgaggugagccaccagagaugccaggagagagaguucggccuggagaucccccagaaggagaucagcaagaaggccagcuuccagaaggacauggugggcgaguucaccagagacggcagcuggugcagcauccuggaggagcugagacuggacgccgacagaaccaagaaggacgagcagaaccagauccagcccaugagccacagcgccuucuucaacaagaagacccugaacaccgagagcaacugcgaguacaaggaccccggcaagaugaucagaaccagaccccaccuggccagcagccagaagcagccccagaagugcugccuguucaccgagagccugaagcugaaccuggaggugaacggccagaacgagagcaacgacaccgagcagcuggacgacguggugggcagcggccagcuguucagccacagcagcagcgacgccugcagcaagaacauccacaccggcgagaccuucugcaagggcaaccagugcagaaaggugugcggccacaagcagagccugaagcagcaccagauccacacccagaagaagcccgacggcugcagcgagugcggcggcagcuucacccagaagagccaccuguucgcccagcagagaauccacagcgugggcaaccugcacgagugcggcaagugcggcaaggccuucaugccccagcugaagcugagcguguaccugaccgaccacaccggcgacauccccugcaucugcaaggagugcggcaagguguucauccagagaagcgagcugcugacccaccagaagacccacaccagaaagaagcccuacaagugccacgacugcggcaaggccuucuuccagaugcugagccuguucagacaccagagaacccacagcagagagaagcuguacgagugcagcgagugcggcaagggcuucagccagaacagcacccugaucauccaccagaagauccacaccggcgagagacaguacgccugcagcgagugcggcaaggccuucacccagaagagcacccugagccugcaccagagaauccacagcggccagaagagcuacgugugcaucgagugcggccaggccuucauccagaaggcccaccugaucgugcaccagagaagccacaccggcgagaagcccuaccagugccacaacugcggcaagagcuucaucagcaagagccagcuggacauccaccacagaauccacaccggcgagaagcccuacgagugcagcgacugcggcaagaccuucacccagaagagccaccugaacauccaccagaagauccacaccggcgagagacaccacgugugcagcgagugcggcaaggccuucaaccagaagagcauccugagcaugcaccagagaauccacaccggcgagaagcccuacaagugcagcgagugcggcaaggccuucaccagcaagagccaguucaaggagcaccagagaauccacaccggcgagaagcccuacgugugcaccgagugcggcaaggccuucaacggcagaagcaacuuccacaagcaccagaucacccacaccagagagagacccuucgugugcuacaagugcggcaaggccuucgugcagaagagcgagcugaucacccaccagagaacccacaugggcgagaagcccuacgagugccuggacugcggcaagagcuucagcaagaagccccagcugaaggugcaccagagaauccacaccggcgagagacccuacgugugcagcgagugcggcaaggccuucaacaacagaagcaacuucaacaagcaccagaccacccacaccagagacaagagcuacaagugcagcuacagcgugaagggcuucaccaagcaguaa

SEQ ID NO: 25925 - RNA, 1446 nt, Artificial Sequence
  ZNF177__Homo_sapiens__NP_001166122
auggccgccggcuggcugaccaccuggagccagaacagcgugaccuuccaggagguggccguggacuucagccaggaggagugggcccugcuggaccccgcccagaagaaccuguacaaggacgugaugcuggagaacuucagaaaccuggccagcgugggcuaccagcugugcagacacagccugaucagcaagguggaccaggagcagcugaagaccgacgagagaggcauccugcagggcgacugcgccgacugggagacccagcugaagcccaaggacaccaucgccaugcagaacauccccggcggcaagaccagcaacggcaucaacaccgccgagaaccagcccggcgagcacagccuggagugcaaccacugcggcaaguucagaaagaacaccagauucaucugcaccagauacugcaagggcgagaagugcuacaaguacaucaaguacagcaagguguucaaccaccccagcacccugagaagccacgugagcauccacaucggcgagaagacccuggaguucaccgacugcagaaaggccuucaaccaggagagcagccugagaaagcaccugagaacccccaccggccagaaguuccaggaguacgagcagugcgacaugagcuucagccugcacagcagcugcagcgugagagagcagauccccaccggcgagaagggcgacgagugcagcgacuacggcaagaucagcccccugagcgugcacaccaagaccggcagcguggaggagggccuggagugcaacgagcacgagaagaccuucaccgacccccugagccugcagaacugcgugagaacccacagcggcgagaugcccuacgagugcagcgacugcggcaaggccuucaucuuccagagcagccugaagaagcacaugagaagccacaccggcgagaagcccuacgagugcgaccacugcggcaagagcuucagccagagcagccaccugaacgugcacaagagaacccacaccggcgagaagcccuacgacugcaaggagugcggcaaggccuucaccgugcccagcagccugcagaagcacgugagaacccacaccggcgagaagcccuacgagugcagcgacugcggcaaggccuucaucgaccagagcagccugaagaagcacaccagaagccacaccggcgagaagcccuacgagugcaaccagugcggcaagagcuucagcaccggcagcuaccugaucgugcacaagagaacccacaccggcgagaagaccuacgagugcaaggagugcggcaaggccuucagaaacagcagcugccugagagugcacgugagaacccacaccggcgagaagcccuacaagugcauccagugcgagaaggccuucagcaccagcaccaaccugaucaugcacaagagaauccacaacggccagaagcugcacgaguaa

SEQ ID NO: 25926 - RNA, 1863 nt, Artificial Sequence
  ZNF182__Homo_sapiens__NP_001007089
auggccaagccccagggccuggugaccuucgaggacguggccguggacuucacccaggaggaguggcaguaccugaaccccccccagagaacccuguacagagacgugaugcuggagaccuacagcaaccugguguucgugggccagcaggugaccaagcccaaccugauccugaagcuggagguggaggagugccccgccgagggcaagauccccuucuggaacuuccccgaggugugccagguggacgagcagaucgagagacagcaccaggacgaccaggacaagugccugcugaugcaggugggcuucagcgacaagaagaccaucaucaccaagagcgccagagacugccacgaguucggcaacauccugcaccugagcaccaaccugguggccagcauccagagacccgacaagcacgagagcuucggcaacaacaugguggacaaccuggaccuguucagcagaagcagcgccgagaacaaguacgacaacggcugcgccaagcuguucuuccacaccgaguacgagaagaccaaccccggcaugaagcccuacggcuacaaggagugcggcaagggccugagaagaaagaagggccugagccugcaccagagaaucaagaacggcgagaagcccuucgagugcaccgccugcagaaagaccuucagcaagaagagccaccugaucgugcacuggagaacccacaccggcgagaagcccuucggcugcaccgagugcggcaaggccuucagccagaagagccagcugaucauccaccugagaacccacaccggcgagagacccuucgagugccccgagugcggcaaggccuucagagagaagagcaccgugaucauccacuacagaacccacaccggcgagaagcccuacgagugcaacgagugcggcaaggccuucacccagaagagcaaccugaucgugcaccagaagacccacaccggcgagaagaccuacgagugcaccaagugcggcgagagcuucauccagaagcuggaccugaucauccaccacagcacccacaccggcaagaagccccacgagugcaacgagugcaagaagaccuucagcgacaagagcacccugaucauccaccagagaacccacaccggcgagaagccccacaagugcaccgagugcggcaagagcuucaacgagaagagcacccugaucgugcaccagagaacccacaccggcgagaagcccuacgagugcgacgugugcggcaagaccuucacccagaagagcaaccugggcgugcaccagagaacccacagcggcgagaagcccuucgagugcaacgagugcgagaaggccuucagccagaagagcuaccugaugcugcaccagagaggccacaccggcgagaagcccuacgagugcaacgagugcgagaaggccuucagccagaagagcuaccugaucauccaccagagaacccacaccgaggagaagcccuacaagugcaacgagugcggcaaggccuucagagagaagagcaagcugaucauccaccagagaauccacaccggcgagaagcccuacgagugccccgugugcuggaaggccuucagccagaagagccagcugaucauccaccagagaacccacaccggcgagaagcccuacgccugcaccgagugcggcaaggccuucagagagaagagcaccuucaccgugcaccagagaacccacaccggcgagaagcccuacaagugcaccgagugcggcaaggccuucacccagaagagcaaccugaucgugcaccagagaacccacgccggcaagaaggcccacggcagaggccacaccagaaagagcaaguucauggcccacuaa

SEQ ID NO: 25927 - RNA, 2256 nt, Artificial Sequence
  ZNF184__Homo_sapiens__NP_009080
auggaggaccugagcagccccgacagcacccugcugcagggcggccacaaccugcugagcagcgccagcuuccaggaggccgugaccuucaaggacgugaucguggacuucacccaggaggaguggaagcagcuggaccccggccagagagaccuguucagagacgugacccuggagaacuacacccaccuggugagcaucggccugcaggugagcaagcccgacgugaucagccagcuggagcagggcaccgagcccuggaucauggagcccagcauccccgugggcaccugcgccgacugggagaccagacuggagaacagcgugagcgcccccgagcccgacaucagcgaggaggagcugagccccgaggugaucguggagaagcacaagagagacgacagcuggagcagcaaccugcuggagagcugggaguacgagggcagccuggagagacagcaggccaaccagcagacccugcccaaggagaucaaggugaccgagaagaccauccccagcugggagaagggccccgugaacaacgaguucggcaagagcgugaacgugagcagcaaccuggugacccaggagcccagccccgaggagaccagcaccaagagaagcaucaagcagaacagcaaccccgugaagaaggagaagagcugcaagugcaacgagugcggcaaggccuucagcuacugcagcgcccugaucagacaccagagaacccacaccggcgagaagcccuacaagugcaacgagugcgagaaggccuucagcagaagcgagaaccugaucaaccaccagagaauccacaccggcgacaagcccuacaagugcgaccagugcggcaagggcuucaucgagggccccagccugacccagcaccagagaauccacaccggcgagaagcccuacaagugcgacgagugcggcaaggccuucagccagagaacccaccuggugcagcaccagagaauccacaccggcgagaagcccuacaccugcaacgagugcggcaaggccuucagccagagaggccacuucauggagcaccagaagauccacaccggcgagaagcccuucaagugcgacgagugcgacaagaccuucaccagaagcacccaccugacccagcaccagaagauccacaccggcgagaagaccuacaagugcaacgagugcggcaaggccuucaacggccccagcaccuucaucagacaccacaugauccacaccggcgagaagcccuacgagugcaacgagugcggcaaggccuucagccagcacagcaaccugacccagcaccagaagacccacaccggcgagaagcccuacgacugcgccgagugcggcaagagcuucagcuacuggagcagccuggcccagcaccugaagauccacaccggcgagaagcccuacaagugcaacgagugcggcaaggccuucagcuacugcagcagccugacccagcacagaagaauccacaccagagagaagcccuucgagugcagcgagugcggcaaggccuucagcuaccugagcaaccugaaccagcaccagaagacccacacccaggagaaggccuacgagugcaaggagugcggcaaggccuucaucagaagcagcagccuggccaagcacgagagaauccacaccggcgagaagcccuaccagugccacgagugcggcaagaccuucagcuacggcagcagccugauccagcacagaaagauccacaccggcgagagacccuacaagugcaacgagugcggcagagccuucaaccagaacauccaccugacccagcacaagagaauccacaccggcgccaagcccuacgagugcgccgagugcggcaaggccuucagacacugcagcagccuggcccagcaccagaagacccacaccgaggagaagcccuaccagugcaacaagugcgagaagaccuucagccagagcagccaccugacccagcaccagagaauccacaccggcgagaagcccuacaagugcaacgagugcgacaaggccuucagcagaagcacccaccugaccgagcaccagaacacccacaccggcgagaagcccuacaacugcaacgagugcagaaagaccuucagccagagcaccuaccugauccagcaccagagaauccacagcggcgagaagcccuucggcugcaacgacugcggcaagagcuucagauacagaagcgcccugaacaagcaccagagacugcaccccggcaucuaa

SEQ ID NO: 25928 - RNA, 984 nt, Artificial Sequence
  ZNF185__Homo_sapiens__NP_001171586
auggccgccagagacgagcugggccugggcggcgacagccuggaggccaugcccgugcccgccgccagaggcagacccagaaucaccaacggccccgaggagcuggccgcccccagccccgccgcccuggccgacuacgagggcaaggacguggccaccagagugggcgaggccuggcaggagagacccggcgcccccagaggcggccagggcgaccccgccgugcccgcccagcagcccgccgaccccagcacccccgagagacagagcagccccagcggcagcgagcagcuggugagaagagagagcugcggcagcagcgugcugaccgacuucgagggcaaggacguggccaccaaggugggcgaggccuggcaggacagacccggcgcccccagaggcggccagggcgaccccgccgugcccacccagcagcccgccgaccccagcacccccgagcagcagaacagccccagcggcagcgagcaguucgugagaagagagagcugcaccagcagagugagaagccccagcagcugcauggugaccgugaccgugaccgccaccagcgagcagccccacaucuacauccccgcccccgccagcgagcuggacagcagcagcaccaccaagggcauccuguucgugaaggaguacgugaacgccagcgaggugagcagcggcaagcccgugagcgccagauacagcaacgugagcagcaucgaggacagcuucgccauggagaagaagccccccugcggcagcacccccuacagcgagagaaccaccggcggcaucugcaccuacugcaacagagagaucagagacugccccaagaucacccuggagcaccugggcaucugcugccacgaguacugcuucaagugcggcaucugcagcaagcccaugggcgaccugcuggaccagaucuucauccacagagacaccauccacugcggcaagugcuacgagaagcuguucuaa

SEQ ID NO: 25929 - RNA, 1839 nt, Artificial Sequence
  ZNF189__Homo_sapiens__NP_001265160
auggccagccccagccccccccccgagagcaaggaggagugggacuaccuggaccccgcccagagaagccuguacaaggacgugaugauggagaacuacggcaaccuggugagccuggacgugcugaacagagacaaggacgaggagcccaccgugaagcaggagaucgaggagaucgaggaggagguggagccccagggcgugaucgugaccagaaucaagagcgagaucgaccaggaccccaugggcagagagaccuucgagcuggugggcagacuggacaagcagagaggcaucuuccugugggagauccccagagagagccugacccaggagcagagaauguucagagagaacaccaacaucaucagaaagagacccaacagcgaggagaagugccacaagugcgaggagugcggcaagggcuucgugagaaaggcccacuucauccagcaccagagagugcacaccggcgagaagcccuuccagugcaacgagugcggcaagagcuucagcagaagcagcuucgugaucgagcaccagagaauccacaccggcgagagacccuacgagugcaacuacugcggcaagaccuucagcgugagcagcacccugaucagacaccagagaauccacaccggcgagagacccuaccagugcaaccagugcaagcagagcuucagccagagaagaagccuggugaagcaccagagaauccacaccggcgagaagccccacaagugcagcgacugcggcaaggccuucagcuggaagagccaccugaucgagcaccagagaacccacaccggcgagaagcccuaccacugcaccaagugcaagaagagcuucagcagaaacagccugcugguggagcaccagagaauccacaccggcgagagaccccacaagugcggcgagugcggcaaggccuucagacugagcaccuaccugauccagcaccagaagauccacaccggcgagaagcccuuccugugcaucgagugcggcaagagcuucagcagaagcagcuuccugaucgagcaccagagaauccacaccggcgagagacccuaccagugcaaggagugcggcaagagcuucagccagcugugcaaccugaccagacaccagagaauccacaccggcgacaagccccacaagugcgaggagugcggcaaggccuucagcagaagcagcggccugauccagcaccagagaauccacaccagagagaagaccuaccccuacaacgagaccaaggagagcuucgaccccaacugcagccuggugauccagcaggagguguaccccaaggagaagagcuacaagugcgacgagugcggcaagaccuucagcgugagcgcccaccuggugcagcaccagagaauccacaccggcgagaagcccuaccugugcaccgugugcggcaagagcuucagcagaagcagcuuccugaucgagcaccagagaauccacaccggcgagagacccuaccugugcagacagugcggcaagagcuucagccagcugugcaaccugaucagacaccagggcgugcacaccggcaacaagccccacaagugcgacgagugcggcaaggccuucagcagaaacagcggccugauccagcaccagagaauccacaccggcgagaagcccuacaagugcgagaagugcgacaagagcuucagccagcagagaagccuggugaaccaccagaagauccacgccgaggugaagacccaggagacccacgagugcgacgccugcggcgaggccuucaacugcagaaucagccugauccagcaccagaagcugcacaccgccuggaugcaguaa

SEQ ID NO: 25930 - RNA, 804 nt, Artificial Sequence
  ZNF197__Homo_sapiens__NP_001020026
augaccagagagaacguggcccacaacgcccugagacaggagggccuggugaagggcaaggacgacaccuggaaguggggcaccagcuuccagggcagcagcagcagcgugugggagaccagccaccugcacuucagacagcugagauaccacgagaccagcggcccccaggaggcccugagcagacugagagagcugugcagaagauggcugagacccgaggccagaaccaaggcccagauccuggagcugcuggugcuggagcaguuccugagcauccugcccggcgagaucagaaccugggugcagcugcaccaccccggcagcggcgaggaggccguggcccugguggaggagcugcagaaggaccuggacggccccgccauccaggugcccgugcuggugaaggaccaggacacccugcagaagguggugagcgcccccggcaccacccugccccccgugcugcccggcagccacaucgccgccgagaucugcccccacccccccaccgaccugguggccuucaaccugcaggacccccagcacgacagccccgcccccgaggccagcgcccugagccaggaggagaaccccagaaaccagcugauggcccugaugcugcugaccgcccagccccaggagcuggugauguucgaggaggugagcgugugcuucaccagcgaggagugggccugccugggccccauccagagagcccuguacugggacgugaugcuggagaacuacggcaacgugaccagccugggcuacagaaaguacagaagacagagaaacaaguaa

SEQ ID NO: 25931 - RNA, 1947 nt, Artificial Sequence
  ZNF202__Homo_sapiens__NP_001288709
auggccaccgccguggagcccgaggaccaggaccugugggaggaggagggcauccugauggugaagcuggaggacgacuucaccugcagacccgagagcgugcugcagagagacgaccccgugcuggagaccagccaccagaacuucagaagauucagauaccaggaggccgccagccccagagaggcccugaucagacugagagagcugugccaccaguggcugagacccgagagaagaaccaaggagcagauccuggagcugcuggugcuggagcaguuccugaccgugcugcccggcgagcugcagagcugggugagaggccagagacccgagagcggcgaggaggccgugacccugguggagggccugcagaagcagcccagaagacccagaagaugggugaccgugcacgugcacggccaggaggugcugagcgaggagaccgugcaccugggcguggagcccgagagccccaacgagcugcaggaccccgugcagagcagcacccccgagcagagccccgaggagaccacccagagccccgaccugggcgcccccgccgagcagagaccccaccaggaggaggagcugcagacccugcaggagagcgaggugcccgugcccgaggaccccgaccugcccgccgagagaagcagcggcgacagcgagaugguggcccugcugaccgcccugagccagggccuggugaccuucaaggacguggccgugugcuucagccaggaccaguggagcgaccuggaccccacccagaaggaguucuacggcgaguacgugcuggaggaggacugcggcaucguggugagccugagcuuccccauccccagacccgacgagaucagccaggugagagaggaggagcccugggugcccgacauccaggagccccaggagacccaggagcccgagauccugagcuucaccuacaccggcgacagaagcaaggacgaggaggagugccuggagcaggaggaccugagccuggaggacauccacagacccgugcugggcgagcccgagauccaccagacccccgacugggagaucguguucgaggacaaccccggcagacugaacgagagaagauucggcaccaacaucagccaggugaacagcuucgugaaccugagagagaccacccccgugcacccccugcugggcagacaccacgacugcagcgugugcggcaagagcuucaccugcaacagccaccuggugagacaccugagaacccacaccggcgagaagcccuacaagugcauggagugcggcaagagcuacaccagaagcagccaccuggccagacaccagaaggugcacaagaugaacgcccccuacaaguacccccugaacagaaagaaccuggaggagaccagccccgugacccaggccgagagaacccccagcguggagaagcccuacagaugcgacgacugcggcaagcacuucagauggaccagcgaccuggugagacaccagagaacccacaccggcgagaagcccuucuucugcaccaucugcggcaagagcuucagccagaagagcgugcugaccacccaccagagaauccaccugggcggcaagcccuaccugugcggcgagugcggcgaggacuucagcgagcacagaagauaccuggcccacagaaagacccacgccgccgaggagcuguaccugugcagcgagugcggcagaugcuucacccacagcgccgccuucgccaagcaccugagaggccacgccagcgugagacccugcagaugcaacgagugcggcaagagcuucagcagaagagaccaccuggugagacaccagagaacccacaccggcgagaagcccuucaccugccccaccugcggcaagagcuucagcagaggcuaccaccugaucagacaccagagaacccacagcgagaagaccagcuaa

SEQ ID NO: 25932 - RNA, 1665 nt, Artificial Sequence
  ZNF205__Homo_sapiens__XP_005255615
augagcgccgacggcggcggcauccaggacacccaggacaaggagaccccccccgaggugcccgacagaggccacccccaccaggagaugcccagcaagcugggcgaggccgugcccagcggcgacacccaggagagccugcacaucaagauggagcccgaggagccccacagcgagggcgccagccaggaggacggcgcccagggcgccuggggcugggccccccugagccacggcagcaaggagaaggcccuguuccugcccggcggcgcccugcccagccccagaauccccgugcugagcagagagggcagaaccagagacagacagauggccgccgcccugcugaccgccuggagccagaugcccgugaccuucgaggacguggcccuguaccugagcagagaggaguggggcagacuggaccacacccagcagaacuucuacagagacgugcugcagaagaagaacggccugagccugggcuuccccuucagcagacccuucugggccccccaggcccacggcaagggcgaggccagcggcagcagcagacaggccggcgacgagaaggaguggagaggcgccugcaccggcgccguggaggugggccagagagugcagaccagcagcguggccgcccugggcaacgugaagcccuucagaaccagagccggcagagugcaguggggcgugccccagugcgcccaggaggccgccugcggcagaagcagcggccccgccaaggacagcggccagcccgccgagcccgacagaacccccgacgccgccccccccgaccccagccccaccgagccccaggaguacagagugcccgagaagcccaacgaggaggagaagggcgcccccgagagcggcgaggagggccuggcccccgacagcgaggugggcagaaagagcuacagaugcgagcagugcggcaagggcuucagcuggcacagccaccuggugacccacagaagaacccacaccggcgagaagcccuacgccugcaccgacugcggcaagagauucggcagaagcagccaccugauccagcaccagaucauccacaccggcgagaagcccuacaccugccccgccugcagaaagagcuucagccaccacagcacccugauccagcaccagagaauccacaccggcgagaagcccuacgugugcgacagaugcgccaagagauucaccagaagaagcgaccuggugacccaccagggcacccacaccggcgccaagccccacaagugccccaucugcgccaagugcuucacccagagcagcgcccuggugacccaccagagaacccacaccggcgugaagcccuaccccugccccgagugcggcaagugcuucagccagagaagcaaccugaucgcccacaacagaacccacaccggcgagaagcccuaccacugccuggacugcggcaagagcuucagccacagcagccaccugaccgcccaccagagaacccacagaggcgugagacccuacgccugcccccugugcggcaagagcuucagcagaagaagcaaccugcacagacacgagaagauccacaccaccggccccaaggcccuggccaugcugaugcugggcgccgccgccgccggcgcccuggccacccccccccccgcccccaccuaa

SEQ ID NO: 25933 - RNA, 1599 nt, Artificial Sequence
  ZNF20__Homo_sapiens__NP_066966
augauguuccaggacagcguggccuucgaggacguggccgugagcuucacccaggaggagugggcccugcuggaccccagccagaagaaccuguacagagacgugaugcaggagaccuucaagaaccugaccagcgugggcaagaccuggaaggugcagaacaucgaggacgaguacaagaaccccagaagaaaccugagccugaugagagagaagcugugcgagagcaaggagagccaccacugcggcgagagcuucaaccagaucgccgacgacaugcugaacagaaagacccugcccggcaucacccccugcgagagcagcgugugcggcgaggugggcaccggccacagcagccugaacacccacaucagagccgacaccggccacaagagcagcgaguaccaggaguacggcgagaaccccuacagaaacaaggagugcaagaaggccuucagcuaccuggacagcuuccagagccacgacaaggccugcaccaaggagaagcccuacgacggcaaggagugcaccgagaccuucaucagccacagcugcauccagagacacagagugaugcacagcggcgacggccccuacaagugcaaguucugcggcaaggccuucuacuuccugaaccugugccugauccacgagagaauccacaccggcgugaagcccuacaagugcaagcagugcggcaaggccuucaccagaagcaccacccugcccgugcacgagagaacccacaccggcgugaacgccgacgagugcaaggagugcggcaacgccuucagcuuccccagcgagaucagaagacacaagagaagccacaccggcgagaagcccuacgagugcaagcagugcggcaagguguucaucagcuucagcagcauccaguaccacaagaugacccacaccggcgagaagcccuacgagugcaagcagugcggcaaggccuucagaugcggcagccaccugcagaagcacggcagaacccacaccggcgagaagcccuacgagugcagacagugcggcaaggccuucagaugcaccagcgaccugcagagacacgagaagacccacaccgaggacaagcccuacggcugcaagcagugcggcaagggcuucagaugcgccagccagcugcagauccacgagagaacccacagcggcgagaagccccacgagugcaaggagugcggcaagguguucaaguacuucagcagccugagaauccacgagagaacccacaccggcgagaagccccacgagugcaagcagugcggcaaggccuucagauacuucagcagccugcacauccacgagagaacccacaccggcgacaagcccuacgagugcaaggugugcggcaaggccuucaccugcagcagcagcaucagauaccacgagagaacccacaccggcgagaagcccuacgagugcaagcacugcggcaaggccuucaucagcaacuacaucagauaccacgagagaacccacaccggcgagaagcccuaccagugcaagcagugcggcaaggccuucaucagagccagcagcugcagagagcacgagagaacccacaccaucaacagauaa

SEQ ID NO: 25934 - RNA, 1488 nt, Artificial Sequence
  ZNF212__Homo_sapiens__NP_036388
auggccgagagcgcccccgccagacacagaagaaagagaagaagcaccccccugaccagcagcacccugcccagccaggccaccgagaagagcagcuacuuccagaccaccgagaucagccuguggaccgugguggccgccauccaggccguggagaagaagauggagagccaggccgccagacugcagagccuggagggcagaaccggcaccgccgagaagaagcuggccgacugcgagaagauggccguggaguucggcaaccagcuggagggcaagugggccgugcugggcacccugcugcaggaguacggccugcugcagagaagacuggagaacguggagaaccugcugagaaacagaaacuucuggauccugagacugccccccggcagcaagggcgaggcccccaaggugagcagaagccuggagaacgacggcgugugcuucaccgagcaggagugggagaaccuggaggacuggcagaaggagcuguacagaaacgugauggagagcaacuacgagacccuggugagccugaaggugcugggccagaccgagggcgaggccgagcugggcaccgagaugcugggcgaccuggaggaggagggccccggcggcgcccaccccgccggcggcgugaugaucaagcaggagcugcaguacacccaggagggccccgccgaccugcccggcgaguucagcugcaucgccgaggagcaggccuuccugagccccgagcagaccgagcuguggggcggccagggcagcagcgugcugcuggagaccggccccggcgacagcacccuggaggagcccgugggcagcagagugcccagcagcagcagaaccgugggcugccccaagcagaagagccacagacaggugcagcuggaccaggagugcggccagggccugaagcugaagaaggacaccagcagacccuacgagugcagcgagugcgagaucaccuucagauacaagcagcagcuggccacccaccugagaagccacagcggcuggggcagcugcacccccgaggagcccgaggagagccugagacccagacccagacugaagccccagaccaagaaggccaagcugcaccagugcgacgugugccugagaagcuucagcugcaaggugagccuggugacccaccagagaugccaccugcaggagggccccagcgccggccagcacgugcaggagagauucagccccaacagccugguggcccugcccggccacauccccuggagaaagagcagaagcagccugaucugcggcuacugcggcaagagcuucagccaccccagcgaccuggugagacaccagagaauccacaccggcgagagacccuacagcugcaccgagugcgagaagagcuucgugcagaagcagcaccugcugcagcaccagaagauccaccagagagagagaggcggccuggcccuggagcccggcagacccaacggccugcuguaa

SEQ ID NO: 25935 - RNA, 1821 nt, Artificial Sequence
  ZNF214__Homo_sapiens__XP_006718371
auggccgugaccuucgaggacgugaccaucaucuucaccugggaggaguggaaguuccuggacagcagccagaagagacuguacagagaggugaugugggagaacuacaccaacgugaugagcguggagaacuggaacgagagcuacaagagccaggaggagaaguucagauaccuggaguacgagaacuucagcuacuggcagggcugguggaacgccggcgcccagauguacgagaaccagaacuacggcgagaccgugcagggcaccgacagcaaggaccugacccagcaggacagaagccagugccaggaguggcugauccugagcacccaggugcccggcuacggcaacuacgagcugaccuucgagagcaagagccugagaaaccugaaguacaagaacuucaugcccuggcagagccuggagaccaagaccacccaggacuacggcagagagaucuacaugagcggcagccacggcuuccagggcggcagauacagacugggcaucagcagaaagaaccugagcauggagaaggagcagaagcugaucgugcagcacagcuacauccccguggaggaggcccugccccaguacgugggcgugaucugccaggaggaccugcugagagacagcauggaggagaaguacugcggcugcaacaagugcaagggcaucuacuacuggaacagcagaugcguguuccacaagagaaaccagcccggcgagaaccugugccagugcagcaucugcaaggccugcuucagccagagaagcgaccuguacagacaccccagaaaccacaucggcaagaagcuguacggcugcgacgagguggacggcaacuuccaccagagcagcggcgugcacuuccaccagagagugcacaucggcgaggugcccuacagcugcaacgccugcggcaagagcuucagccagaucagcagccugcacaaccaccagagagugcacaccgaggagaaguucuacaagaucgagugcgacaaggaccugagcagaaacagccugcugcacauccaccagagacugcacaucggcgagaagcccuucaagugcaaccagugcggcaagagcuucaacagaagcagcgugcugcacgugcaccagagagugcacaccggcgagaagcccuacaagugcgacgagugcggcaagggcuucagccagagcagcaaccugagaauccaccagcuggugcacaccggcgagaagagcuacaagugcgaggacugcggcaagggcuucacccagagaagcaaccugcagauccaccagagagugcacaccggcgagaagcccuacaagugcgacgacugcggcaaggacuucagccacagcagcgaccugagaauccaccagagagugcacaccggcgagaagcccuacaccugccccgagugcggcaagggcuucagcaagagcagcaagcugcacacccaccagagagugcacaccggcgagaagcccuacaagugcgaggagugcggcaagggcuucagccagagaagccaccugcugauccaccagagagugcacaccggcgagaagcccuacaagugccacgacugcggcaagggcuucagccacagcagcaaccugcacauccaccagagagugcacaccggcgagaagcccuaccagugcgccaagugcggcaagggcuucagccacagcagcgcccugagaauccaccagagagugcacgccggcgagaagcccuacaagugcagagaguacuacaagggcuucgaccacaacagccaccugcacaacaaccacagaagaggcaaccuguaa

SEQ ID NO: 25936 - RNA, 1554 nt, Artificial Sequence
  ZNF215__Homo_sapiens__NP_037382
augcagccccugagcaagcugauggccaucagcaagcccagaaaccugagccugagagagcagagagaggugcugagagccgacaugagcuggcagcaggagaccaaccccgugguggagacccacgacagcgaggccagcagacagaaguucagacacuuccaguaccugaaggugagcggcccccacgaggcccugagccagcugugggagcugugccugcaguggcugagacccgagauccacaccaagaagcagaucaucgagcugcuggugcuggagcaguuccuggccauccugcccgaggaggugagaaccugggugaaccugcagcaccccaacaacagcaaggacauggugacccugaucgaggacgugaucgagaugcuggaggacgaggacaugcccugcaaggacagcgcccugcagaugggcagcaucaaggagaagaugaaggccggcagcagaaccggcaagccccaggagcccgugaccuucaaggacguggugguggaguucagcaaggaggaguggggccagcuggacagcgccgugaagaaccuguacagaaacgugaugcuggagaacuucagaaaccugaacagccugagaaaggcccaccugcugagcaagcccuucgagagccugaagcuggagagcaagaagaagagauggaucauggagaaggagauccccagaaagaccaucuucgacaugaagagcaucagcggcgaggagagcagccacggcgugaucaugaccagacugaccgagagcggccaccccagcagcgacgccuggaagggcgagaacuggcuguacagaaaccagaagaagugggacaucaaccugccccaggaggccuucauccccgagaccaucuacaccgaggaggaggacuucgagugcagcgagaacaagaagagcuucgacaucaacagcgugagcagcaucugcgccauccaggugggcauccccagcagaaagggcagccccaagugcgacaaguucaagaccuacuucaaguucaaccuggacagcgugggcaagcagcacagcgaguacgaguacggcaacgaccugagccugagcaccgacaucagacaccagaagagccacaccaccaugaacagcuacgagugcuaccagugcggcaaggccuucugcagaagcagcagccugaucagacaccagaucauccacaccggcgagaagcccuacaagugcagcgagugcggcagauucuucaacagaagaaccaaccugaccaagcaccagaagcugcacgccgaggccaaggccugcaccagcaacaagugcggcaaggccuucagcaagagcgaggacagcaacaaccccacccugcacuucggcaacaacuucuaccagugcgugaacugcggcaagagcuucaacagaagcagcagccugaucagacaccagaugauccacaccggcgagaagcccuucaagugcaaggagugcagcaaggccuucaacagaagcagcaaccuggugaagcaccagaagcugcacaccagagacaagagcuaa

SEQ ID NO: 25937 - RNA, 3147 nt, Artificial Sequence
  ZNF217__Homo_sapiens__NP_006517
augcagagcaaggugaccggcaacaugcccacccagagccugcugauguacauggacggccccgaggugaucggcagcagccugggcagccccauggagauggaggacgcccugagcaugaagggcaccgccguggugcccuucagagccacccaggagaagaacgugauccagaucgagggcuacaugccccuggacugcauguucugcagccagaccuucacccacagcgaggaccugaacaagcacgugcugaugcagcacagacccacccugugcgagcccgccgugcugagaguggaggccgaguaccugagcccccuggacaagagccaggugagaaccgagccccccaaggagaagaacugcaaggagaacgaguucagcugcgaggugugcggccagaccuucagaguggccuucgacguggagauccacaugagaacccacaaggacagcuucaccuacggcugcaacaugugcggcagaagauucaaggagcccugguuccugaagaaccacaugagaacccacaacggcaagagcggcgccagaagcaagcugcagcagggccuggagagcagccccgccaccaucaacgagguggugcaggugcacgccgccgagagcaucagcagccccuacaagaucugcauggugugcggcuuccuguuccccaacaaggagagccugaucgagcacagaaaggugcacaccaagaagaccgccuucggcaccagcagcgcccagaccgacagcccccagggcggcaugcccagcagcagagaggacuuccugcagcuguucaaccugagacccaagagccaccccgagaccggcaagaagcccgugagaugcaucccccagcuggaccccuucaccaccuuccaggccuggcagcuggccaccaagggcaagguggccaucugccaggaggugaaggagagcggccaggagggcagcaccgacaacgacgacagcagcagcgagaaggagcugggcgagaccaacaagggcagcugcgccggccugagccaggagaaggagaagugcaagcacagccacggcgaggcccccagcguggacgccgaccccaagcugcccagcagcaaggagaagcccacccacugcagcgagugcggcaaggccuucagaaccuaccaccagcuggugcugcacagcagagugcacaagaaggacagaagagccggcgccgagagccccaccaugagcguggacggcagacagcccggcaccugcagccccgaccuggccgccccccuggacgagaacggcgccguggacagaggcgagggcggcagcgaggacggcagcgaggacggccugcccgagggcauccaccuggacaagaacgacgacggcggcaagaucaagcaccugaccagcagcagagagugcagcuacugcggcaaguucuucagaagcaacuacuaccugaacauccaccugagaacccacaccggcgagaagcccuacaagugcgaguucugcgaguacgccgccgcccagaagaccagccugagauaccaccuggagagacaccacaaggagaagcagaccgacguggccgccgaggugaagaacgacggcaagaaccaggacaccgaggacgcccugcugaccgccgacagcgcccagaccaagaaccugaagagauucuucgacggcgccaaggacgugaccggcagcccccccgccaagcagcugaaggagaugcccagcguguuccagaacgugcugggcagcgccgugcugagccccgcccacaaggacacccaggacuuccacaagaacgccgccgacgacagcgccgacaaggugaacaagaaccccacccccgccuaccuggaccugcugaagaagagaagcgccguggagacccaggccaacaaccugaucugcagaaccaaggccgacgugacccccccccccgacggcagcaccacccacaaccuggaggugagccccaaggagaagcagaccgagaccgccgccgacugcagauacagacccagcguggacugccacgagaagccccugaaccugagcgugggcgcccugcacaacugccccgccaucagccugagcaagagccugauccccagcaucaccugccccuucugcaccuucaagaccuucuaccccgaggugcugaugaugcaccagagacuggagcacaaguacaaccccgacgugcacaagaacugcagaaacaagagccugcugagaagcagaagaaccggcugcccccccgcccugcugggcaaggacgugcccccccugagcagcuucugcaagcccaagcccaagagcgccuuccccgcccagagcaagagccugcccagcgccaagggcaagcagagcccccccggccccggcaaggccccccugaccagcggcaucgacagcagcacccuggcccccagcaaccugaagagccacagaccccagcagaacgugggcgugcagggcgccgccaccagacagcagcagagcgagauguuccccaagaccagcgugagccccgcccccgacaagaccaagagacccgagaccaagcugaagccccugcccguggcccccagccagcccacccugggcagcagcaacaucaacggcagcaucgacuaccccgccaagaacgacagccccugggccccccccggcagagacuacuucugcaacagaagcgccagcaacaccgccgccgaguucggcgagccccugcccaagagacugaagagcagcgugguggcccuggacguggaccagcccggcgccaacuacagaagaggcuacgaccugcccaaguaccacauggugagaggcaucaccagccugcugccccaggacugcguguaccccagccaggcccugccccccaagcccagauuccugagcagcagcgagguggacagccccaacgugcugaccgugcagaagcccuacggcggcagcggcccccuguacaccugcgugcccgccggcagccccgccagcagcagcacccuggagggcaagagacccgugagcuaccagcaccugagcaacagcauggcccagaagagaaacuacgagaacuucaucggcaacgcccacuacagacccaacgacaagaagaccuaa

SEQ ID NO: 25938 - RNA, 2124 nt, Artificial Sequence
  ZNF224__Homo_sapiens__XP_005259278
augaccaccuucaaggaggccaugaccuucaaggacguggccgugguguucaccgaggaggagcugggccugcuggaccuggcccagagaaagcuguacagagacgugaugcuggagaacuucagaaaccugcugagcgugggccaccaggccuuccacagagacaccuuccacuuccugagagaggagaagaucuggaugaugaagaccgccauccagagagagggcaacagcggcgacaagauccagaccgagauggagaccgugagcgaggccggcacccaccaggaguggagcuuccagcagaucugggagaagaucgccagcgaccugaccagaagccaggaccugaugaucaacagcagccaguucagcaaggagggcgacuuccccugccagaccgaggccggccugagcgugauccacaccagacagaagagcagccagggcaacggcuacaagcccagcuucagcgacgugagccacuucgacuuccaccagcagcugcacagcggcgagaagagccacaccugcgacgagugcggcaagaacuucugcuacaucagcgcccugagaauccaccagagagugcacaugggcgagaagugcuacaagugcgacgugugcggcaaggaguucagccagagcagccaccugcagacccaccagagagugcacaccggcgagaagcccuucaagugcguggagugcggcaagggcuucagcagaagaagcgcccugaacgugcaccacaagcugcacaccggcgagaagcccuacaacugcgaggagugcggcaaggccuucauccacgacagccagcugcaggagcaccagagaauccacaccggcgagaagcccuucaagugcgacaucugcggcaagagcuucugcggcagaagcagacugaacagacacagcauggugcacaccgccgagaagcccuucagaugcgacaccugcgacaagagcuucagacagagaagcgcccugaacagccacagaaugauccacaccggcgagaagcccuacaagugcgaggagugcggcaagggcuucaucugcagaagagaccuguacacccaccacauggugcacaccggcgagaagcccuacaacugcaaggagugcggcaagagcuucagaugggccagcugccugcugaagcaccagagagugcacagcggcgagaagcccuucaagugcgaggagugcggcaagggcuucuacaccaacagccagugcuacagccaccagagaagccacagcggcgagaagcccuacaagugcguggagugcggcaagggcuacaagagaagacuggaccuggacuuccaccagagagugcacaccggcgagaagcuguacaacugcaaggagugcggcaagagcuucagcagagcccccugccugcugaagcacgagagacugcacagcggcgagaagcccuuccagugcgaggagugcggcaagagauucacccagaacagccaccugcacagccaccagagagugcacaccggcgagaagcccuacaagugcgagaagugcggcaagggcuacaacagcaaguucaaccuggacaugcaccagaaggugcacaccggcgagagacccuacaacugcaaggagugcggcaagagcuucggcugggccagcugccugcugaagcaccagagacugcacagcggcgagaagcccuucaagugcgaggagugcggcaagagauucacccagaacagccagcugcacagccaccagagagugcacaccggcgagaagcccuacaagugcgacgagugcggcaagggcuucagcuggagcagcaccagacugacccaccagagaagacacagcagagagaccccccugaagugcgagcagcacggcaagaacaucgugcagaacagcuucagcaaggugcaggagaaggugcacagcguggagaagcccuacaagugcgaggacugcggcaagggcuacaacagaagacugaaccuggacaugcaccagagagugcacaugggcgagaagaccuggaagugcagagagugcgacaugugcuucagccaggccagcagccugagacugcaccagaacgugcacgugggcgagaagcccuaa

SEQ ID NO: 25939 - RNA, 675 nt, Artificial Sequence
  ZNF22__Homo_sapiens__NP_008894
augagacuggccaagcccaaggccggcaucagcagaagcagcagccagggcaaggccuacgagaacaagagaaagaccggcagacagagacagaaguggggcaugaccaucagauucgacagcagcuucagcagacugagaagaagccuggacgacaagcccuacaagugcaccgagugcgagaagagcuucagccagagcagcacccuguuccagcaccagaagauccacaccggcaagaagagccacaagugcgccgacugcggcaagagcuucuuccagagcagcaaccugauccagcacagaagaauccacaccggcgagaagcccuacaagugcgacgagugcggcgagagcuucaagcagagcagcaaccugauccagcaccagagaauccacaccggcgagaagcccuaccagugcgacgagugcggcagaugcuucagccagagcagccaccugauccagcaccagagaacccacaccggcgagaagcccuaccagugcagcgagugcggcaagugcuucagccagagcagccaccugagacagcacaugaaggugcacaaggaggagaagcccagaaagaccagaggcaagaacaucagagugaagacccaccugcccagcuggaaggccggcaccggcagaaagagcguggccggccugagauaa

SEQ ID NO: 25940 - RNA, 1425 nt, Artificial Sequence
  ZNF230__Homo_sapiens__XP_011525595
augaccaccuucaaggaggccgugaccuucaaggacguggccguguucuucaccgaggaggagcugggccugcuggaccccgcccagagaaagcuguaccaggacgugaugcuggagaacuucaccaaccugcugagcgugggccaccagcccuuccaccccuuccacuuccugagagaggagaaguucuggaugauggagaccgccacccagagagagggcaacagcggcggcaagaccaucgccgaggccggcccccacgaggacugccccugccagcagaucugggagcagaccgccagcgaccugacccagagccaggacagcaucaucaacaacagccacuucuucgagcagggcgacgugcccagccagguggaggccggccugagcaucauccacaccggccagaagcccagccagaacggcaagugcaagcagagcuucagcgacguggccaucuucgaccccccccagcaguuccacagcggcgagaagagccacaccugcaacgagugcggcaagagcuucugcuacaucagcgcccugagaauccaccagagagugcaccugagagagaagcugagcaagugcgacaugagaggcaaggaguucagccagagcagcugccugcagaccagagagagagugcacaccggcgagaagcccuucaagugcgagcagugcggcaagggcuucagaugcagagccauccugcaggugcacugcaagcugcacaccggcgagaagcccuacaucugcgagaagugcggcagagccuucauccacgacuuccagcugcagaagcaccagaucauccacaccggcgagaagcccuucaagugcgagaucugcggcaagagcuucugccugagaagcagccugaacagacacugcauggugcacaccgccgagaagcuguacaagagcgaggagugcggcaagggcuucaccgacagccuggaccugcacaagcaccagaucauccacaccggccagaagcccuacaacugcaaggagugcggcaagagcuucagauggagcagcuaccugcugauccaccagagaauccacagcggcgagaagcccuacagaugcgaggagugcggcaagggcuacaucagcaagagcggccugaaccugcaccagagagugcacaccggcgagagacccuacaacugcaaggagugcggcaagagcuucagcagagccagcagcauccugaaccacaagaagcugcacugcagaaagaagcccuucaagugcgaggacugcggcaagagacuggugcacagaagcuucugcaaggaccagcagggcgaccacaacggcgagaacagcagcaagugcgaggacugcggcaagagauacaagagaagacugaaccuggacaucauccugagccuguuccugaacgacauguaa

SEQ ID NO: 25941 - RNA, 5538 nt, Artificial Sequence
  ZNF236__Homo_sapiens__NP_031371
augggccugugcggccugcuggagagaugcuggcugcaccacgaccccgacggcgugcugacccugaacgccgagaacaccaacuacgccuaccaggugcccaacuuccacaagugcgagaucugccugcugagcuuccccaaggagagccaguuccagagacacaugagagaccacgagagaaacgacaagccccacagaugcgaccagugcccccagaccuucaacguggaguucaaccugacccugcacaagugcacccacagcggcgaggaccccaccugccccgugugcaacaagaaguucagcagaguggccagccugaaggcccacaucaugcugcacgagaaggaggagaaccugaucugcagcgagugcggcgacgaguucacccugcagagccagcuggccgugcacauggaggagcacagacaggagcuggccggcaccagacagcacgccugcaaggccugcaagaaggaguucgagaccagcagcgagcugaaggagcacaugaagacccacuacaagaucagagugagcagcaccagaagcuacaacagaaacaucgacagaagcggcuucaccuacagcugcccccacugcggcaagaccuuccagaagcccagccagcugaccagacacaucagaauccacaccggcgagagacccuucaagugcagcgagugcggcaaggccuucaaccagaagggcgcccugcagacccacaugaucaagcacaccggcgagaagccccacgccugcgccuucugccccgccgccuucagccagaagggcaaccugcagagccacgugcagagagugcacagcgaggugaagaacggccccaccuacaacugcaccgagugcagcugcguguucaagagccugggcagccugaacacccacaucagcaagaugcacaugggcggcccccagaacagcaccagcagcaccgagaccgcccacgugcugaccgccacccuguuccagacccugccccugcagcagaccgaggcccaggccaccagcgccagcagccagcccagcagccaggccgugagcgacgugauccagcagcugcuggagcugagcgagcccgcccccguggagagcggccagagcccccagcccggccagcagcugagcaucaccgugggcaucaaccaggacauccugcagcaggcccuggagaacagcggccugagcagcauccccgccgccgcccaccccaacgacagcugccacgccaagaccagcgccccccacgcccagaaccccgacgugagcagcgugagcaacgagcagaccgaccccaccgacgccgagcaggagaaggagcaggagagccccgagaagcuggacaagaaggagaagaagaugaucaagaagaagagccccuuccugcccggcagcaucagagaggagaacggcgugagauggcacgugugccccuacugcgccaaggaguucagaaagcccagcgaccuggugagacacaucagaauccacacccacgagaagcccuucaagugcccccagugcuucagagccuucgccgugaagagcacccugaccgcccacaucaagacccacaccggcaucaaggccuucaagugccaguacugcaugaagagcuucagcaccagcggcagccugaaggugcacaucagacugcacaccggcgugagacccuucgccugcccccacugcgacaagaaguucagaaccagcggccacagaaagacccacaucgccagccacuucaagcacaccgagcugagaaagaugagacaccagagaaagcccgccaaggugagagugggcaagaccaacauccccgugcccgacaucccccugcaggagcccauccugaucaccgaccugggccugauccagcccauccccaagaaccaguucuuccagagcuacuucaacaacaacuucgugaacgaggccgacagacccuacaagugcuucuacugccacagagccuacaagaagagcugccaccugaagcagcacaucagaagccacaccggcgagaagcccuucaagugcagccagugcggcagaggcuucgugagcgccggcgugcugaaggcccacaucagaacccacaccggccugaagagcuucaagugccugaucugcaacggcgccuucaccaccggcggcagccugagaagacacaugggcauccacaacgaccugagacccuacaugugccccuacugccagaagaccuucaagaccagccugaacugcaagaagcacaugaagacccacagauacgagcuggcccagcagcugcagcagcaccagcaggccgccagcaucgacgacagcaccguggaccagcagagcaugcaggccagcacccagaugcagguggagaucgagagcgacgagcugccccagaccgccgaggugguggccgccaaccccgaggccaugcuggaccuggagccccagcacguggugggcaccgaggaggccggccugggccagcagcuggccgaccagccccuggaggccgacgaggacggcuucguggccccccaggacccccugagaggccacguggaccaguucgaggagcagagccccgcccagcagagcuucgagcccgccggccugccccagggcuucaccgugaccgacaccuaccaccagcagccccaguucccccccgugcagcagcugcaggacagcagcacccuggagagccaggcccugagcaccagcuuccaccagcagagccugcugcaggcccccagcagcgacggcaugaacgugaccaccagacugauccaggagagcagccaggaggagcuggaccugcaggcccagggcagccaguuccuggaggacaacgaggaccagagcagaagaagcuacagaugcgacuacugcaacaagggcuucaagaagagcagccaccugaagcagcacgugagaagccacaccggcgagaagcccuacaagugcaagcugugcggcagaggcuucgugagcagcggcgugcugaagagccacgagaagacccacaccggcgugaaggccuucagcugcagcgugugcaacgccagcuucaccaccaacggcagccugaccagacacauggccacccacaugagcaugaagcccuacaagugccccuucugcgaggagggcuucagaaccaccgugcacugcaagaagcacaugaagagacaccagaccgugcccagcgccgugagcgccaccggcgagaccgagggcggcgacaucugcauggaggaggaggaggagcacagcgacagaaacgccagcagaaagagcagacccgaggugaucaccuucaccgaggaggagaccgcccagcuggccaagaucagaccccaggagagcgccaccgugagcgagaaggugcuggugcagagcgccgccgagaaggacagaaucagcgagcugagagacaagcaggccgagcugcaggacgagcccaagcacgccaacugcugcaccuacugccccaagagcuucaagaagcccagcgaccuggugagacacgugagaauccacaccggcgagaagcccuacaagugcgacgagugcggcaagagcuucaccgugaagagcacccuggacugccacgugaagacccacaccggccagaagcuguucagcugccacgugugcagcaacgccuucagcaccaagggcagccugaaggugcacaugagacugcacaccggcgccaagcccuucaagugcccccacugcgagcugagauucagaaccagcggcagaagaaagacccacaugcaguuccacuacaagcccgaccccaagaaggccagaaagcccaugaccagaagcagcagcgagggccugcagcccgugaaccugcugaacagcagcagcaccgaccccaacguguucaucaugaacaacagcgugcugaccggccaguucgaccagaaccugcugcagcccggccuggugggccaggccauccugcccgccagcgugagcgccggcggcgaccugaccgugagccugaccgacggcagccuggccacccuggagggcauccagcugcagcuggccgccaaccuggugggccccaacgugcagaucagcggcaucgacgccgccagcaucaacaacaucacccugcagaucgaccccagcauccugcagcagacccugcagcagggcaaccugcuggcccagcagcugaccggcgagcccggccuggccccccagaacagcagccugcagaccagcgacagcaccgugcccgccagcguggugauccagcccaucagcggccugagccugcagcccaccgugaccagcgccaaccugaccaucggcccccugagcgagcaggacagcgugcugaccaccaacagcagcggcacccaggaccugacccaggugaugaccagccagggccuggugagccccagcggcggcccccacgagaucacccugaccaucaacaacagcagccugagccaggugcuggcccaggccgccggccccaccgccaccagcagcagcggcagcccccaggagaucacccugaccaucagcgagcugaacaccaccagcggcagccugcccagcaccacccccaugagccccagcgccaucagcacccagaaccuggugaugagcagcagcggcgugggcggcgacgccagcgugacccugacccuggccgacacccagggcaugcugagcggcggccuggacaccgugacccugaacaucaccagccagggccagcaguuccccgcccugcugaccgaccccagccugagcggccagggcggcgccggcagcccccaggugauccuggugagccacaccccccagagcgccagcgccgccugcgaggagaucgccuaccagguggccggcgugagcggcaaccuggcccccggcaaccagcccgagaaggagggcagagcccaccagugccuggagugcgacagagccuucagcagcgccgccgugcugaugcaccacagcaaggaggugcacggcagagagagaauccacggcugccccgugugcagaaaggccuucaagagagccacccaccugaaggagcacaugcagacccaccaggccggccccagccugagcagccagaagcccagaguguucaagugcgacaccugcgagaaggccuucgccaagcccagccagcuggagagacacagcagaauccacaccggcgagagacccuuccacugcacccugugcgagaaggccuucaaccagaagagcgcccugcaggugcacaugaagaagcacaccggcgagagacccuacaagugcgccuacugcgugaugggcuucacccagaagagcaacaugaagcugcacaugaagagagcccacagcuacgccggcgcccugcaggagagcgccggccaccccgagcaggacggcgaggagcugagcagaacccugcaccuggaggagguggugcaggaggccgccggcgaguggcaggcccugacccacguguucuaa

SEQ ID NO: 25942 - RNA, 1809 nt, Artificial Sequence
  ZNF239__Homo_sapiens__XP_011538534
augggccacgcccugcugaaggacguggugauggagcuggagggcagcaaccugugcuucugccuguucgugcccccccugcugagaggccugagccugcuguuccagcccagcagcagcgaguggagacccgugacccugaacagaaagcugggcagacagcaccccagccugcccagcagccugcccagcagcuuccccaccggcgacaagcugggcaccagcuacauccagggcugccugugcggccugcacagaggcggcgugagaagccccggccugugcagccaggaggccgugagaagcugcgacgccggccagcugcagaagcugggccugggcgaccugaacgagaacagcguggagaaccugcagcagaagacccugcaggaccugcugcacgagcugagcagcuggcuggugcuggagggcauggccagcaccaucaccggcagccaggacugcaucgugaaccacagaggcgagguggacggcgagcccgagcuggacaucagccccugccagcaguggggcgaggccagcagccccaucagcagaaacagagacagcgugaugacccugcagagcggcugcuucgagaacaucgagagcgagaccuaccugccccugaaggugagcagccagaucgacacccaggacagcagcgugaaguucugcaagaacgagccccaggaccaccaggagagcagaagacuguucgugauggaggagagcaccgagagaaaggugaucaagggcgagagcugcagcgagaaccugcaggugaagcuggugagcgacggccaggagcuggccagcccccugcugaacggcgaggccaccugccagaacggccagcugaaggagagccuggaccccaucgacugcaacugcaaggacauccacggcuggaagagccagguggugagcugcagccagcagagagcccacaccgaggagaagcccugcgaccacaacaacugcggcaagauccugaacaccagccccgacggccaccccuacgagaagauccacaccgccgagaagcaguacgagugcagccagugcggcaagaacuucagccagagcagcgagcugcugcugcaccagagagaccacaccgaggagaagcccuacaagugcgagcagugcggcaagggcuucaccagaagcagcagccugcugauccaccaggccgugcacaccgacgagaagcccuacaagugcgacaagugcggcaagggcuucaccagaagcagcagccugcugauccaccacgccgugcacaccggcgagaagcccuacaagugcgacaagugcggcaagggcuucagccagagcagcaagcugcacauccaccagagagugcacaccggcgagaagcccuacgagugcgaggagugcggcaugagcuucagccagagaagcaaccugcacauccaccagagagugcacaccggcgagagacccuacaagugcggcgagugcggcaagggcuucagccagagcagcaaccugcacauccacagaugcauccacaccggcgagaagcccuaccagugcuacgagugcggcaagggcuucagccagagcagcgaccugagaauccaccugagagugcacaccggcgagaagcccuaccacugcggcaagugcggcaagggcuucagccagagcagcaagcugcugauccaccagagagugcacaccggcgagaagcccuacgagugcagcaagugcggcaagggcuucagccagagcagcaaccugcacauccaccagagagugcacaagaaggaccccagauaa

SEQ ID NO: 25943 - RNA, 1932 nt, Artificial Sequence
  ZNF23__Homo_sapiens__NP_001291421
augcuggagaacuacggcaacguggccagccugggcuucccccugcugaagcccgccgugaucagccagcuggagggcggcagcgagcugggcggcagcagcccccuggccgccggcaccggccugcagggccugcagaccgacauccagaccgacaacgaccugaccaaggagauguacgagggcaaggagaacgugagcuucgagcugcagagagacuucagccaggagaccgacuucagcgaggccagccugcuggagaagcagcaggaggugcacagcgccggcaacaucaagaaggagaagagcaacaccaucgacggcaccgugaaggacgagaccagccccguggaggagugcuucuucagccagagcagcaacagcuaccagugccacaccaucaccggcgagcagcccagcggcugcaccggccugggcaagagcaucagcuucgacaccaagcuggugaagcacgagaucaucaacagcgaggagagacccuucaagugcgaggagcugguggagcccuucagaugcgacagccagcugauccagcaccaggagaacaacaccgaggagaagcccuaccagugcagcgagugcggcaaggccuucagcaucaacgagaagcugaucuggcaccagagacugcacagcggcgagaagcccuucaagugcguggagugcggcaagagcuucagcuacagcagccacuacaucacccaccagaccauccacagcggcgagaagcccuaccagugcaagaugugcggcaaggccuucagcgugaacggcagccugagcagacaccagagaauccacaccggcgagaagcccuaccagugcaaggagugcggcaacggcuucagcugcagcagcgccuacaucacccaccagagagugcacaccggcgagaagcccuacgagugcaacgacugcggcaaggccuucaacgugaacgccaagcugauccagcaccagagaauccacaccggcgagaagcccuacgagugcaacgagugcggcaagggcuucagaugcagcagccagcugagacagcaccagagcauccacaccggcgagaagcccuaccagugcaaggagugcggcaagggcuucaacaacaacaccaagcugauccagcaccagagaauccacaccggcgagaagcccuacgagugcaccgagugcggcaaggccuucagcgugaagggcaagcugauccagcaccagagaauccacaccggcgagaagcccuacgagugcaacgagugcggcaaggccuucagaugcaacagccaguucagacagcaccugagaauccacaccggcgagaagcccuacgagugcaacgagugcggcaaggccuucagcgugaacggcaagcugaugagacaccagagaauccacaccggcgagaagcccuucgagugcaacgagugcggcagaugcuucaccagcaagagaaaccugcuggaccaccacagaauccacaccggcgagaagcccuaccagugcaaggagugcggcaaggccuucagcaucaacgccaagcugaccagacaccagagaauccacaccggcgagaagcccuucaagugcauggagugcgagaaggccuucagcugcagcagcaacuacaucgugcaccagagaauccacaccggcgagaagcccuuccagugcaaggagugcggcaaggccuuccacgugaacgcccaccugaucagacaccagagaagccacaccggcgagaagcccuucagaugcguggagugcggcaagggcuucagcuucagcagcgacuacaucauccaccagaccgugcacaccuggaagaagcccuacaugugcagcgugugcggcaaggccuucagauucagcuuccagcugagccagcaccagagcgugcacagcgagggcaagagcuaa

SEQ ID NO: 25944 - RNA, 1740 nt, Artificial Sequence
  ZNF248__Homo_sapiens__XP_011517899
augaacaagagccaggagcaggugagcuucaaggacgugugcguggacuucacccaggaggagugguaccugcuggaccccgcccagaagauccuguacagagacgugauccuggagaacuacagcaaccuggugagcgugggcuacugcaucaccaagcccgaggugaucuucaagaucgagcagggcgaggagcccuggauccuggagaagggcuuccccagccagugccaccccgagagaaaguggaagguggacgacgugcuggagagcagccaggagaacgaggacgaccacuucugggagcugcuguuccacaacaacaagaccgugagcguggagaacggcgacagaggcagcaagaccuucaaccugggcaccgaccccgugagccugagaaacuaccccuacaagaucugcgacagcugcgagaugaaccugaagaacaucagcggccugaucaucagcaagaagaacugcagcagaaagaagcccgacgaguucaacgugugcgagaagcugcugcuggacaucagacacgagaagauccccaucggcgagaagagcuacaaguacgaccagaagagaaacgccaucaacuaccaccaggaccugagccagcccagcuucggccagagcuucgaguacagcaagaacggccagggcuuccacgacgaggccgccuucuucaccaacaagagaagccagaucggcgagaccgugugcaaguacaacgagugcggcagaaccuucaucgagagccugaagcugaacaucagccagagaccccaccuggagauggagcccuacggcugcagcaucugcggcaagagcuucugcaugaaccugagauucggccaccagagagcccugaccaaggacaaccccuacgaguacaacgaguacggcgagaucuucugcgacaacagcgccuucaucauccaccagggcgccuacaccagaaagauccugagagaguacaaggugagcgacaagaccugggagaagagcgcccugcugaagcaccagaucgugcacaugggcggcaagagcuacgacuacaacgagaacggcagcaacuucagcaagaagagccaccugacccagcugagaagagcccacaccggcgagaagaccuucgagugcggcgagugcggcaagaccuucugggagaagagcaaccugacccagcaccagagaacccacaccggcgagaagcccuacgagugcaccgagugcggcaaggccuucugccagaagccccaccugaccaaccaccagagaacccacaccggcgagaagcccuacgagugcaagcagugcggcaagaccuucugcgugaagagcaaccugaccgagcaccagagaacccacaccggcgagaagcccuacgagugcaacgccugcggcaagagcuucugccacagaagcgcccugaccgugcaccagagaacccacaccggcgagaagcccuucaucugcaacgagugcggcaagagcuucugcgugaagagcaaccugaucgugcaccagagaacccacaccggcgagaagcccuacaagugcaacgagugcggcaagaccuucugcgagaagagcgcccugaccaagcaccagagaacccacaccggcgagaagcccuacgagugcaacgccugcggcaagaccuucagccagagaagcgugcugaccaagcaccagagaauccacaccagagugaaggcccugagcaccagcuaa

SEQ ID NO: 25945 - RNA, 1107 nt, Artificial Sequence
  ZNF24__Homo_sapiens__NP_008896
augagcgcccagagcguggaggaggacagcauccugaucauccccacccccgacgaggaggagaagauccugagagugaagcuggaggaggaccccgacggcgaggagggcagcagcauccccuggaaccaccugcccgaccccgagaucuucagacagagauucagacaguucggcuaccaggacagccccggccccagagaggccgugagccagcugagagagcugugcagacuguggcugagacccgagacccacaccaaggagcagauccuggagcugguggugcuggagcaguucguggccauccugcccaaggagcugcagaccugggugagagaccaccaccccgagaacggcgaggaggccgugaccgugcuggaggaccuggagagcgagcuggacgaccccggccagcccgugagccugagaagaagaaagagagaggugcugguggaggacauggugagccaggaggaggcccagggccugcccagcagcgagcuggacgccguggagaaccagcugaagugggccagcugggagcugcacagccugagacacugcgacgacgacggcagaaccgagaacggcgcccuggcccccaagcaggagcugcccagcgcccuggagagccacgaggugcccggcacccugaacaugggcgugccccagaucuucaaguacggcgagaccugcuuccccaagggcagauucgagagaaagagaaaccccagcagaaagaagcagcacaucugcgacgagugcggcaagcacuucagccagggcagcgcccugauccugcaccagagaauccacagcggcgagaagcccuacggcugcguggagugcggcaaggccuucagcagaagcagcauccuggugcagcaccagagagugcacaccggcgagaagcccuacaagugccuggagugcggcaaggccuucagccagaacagcggccugaucaaccaccagagaauccacaccggcgagaagcccuacgagugcgugcagugcggcaagagcuacagccagagcagcaaccuguucagacaccagagaagacacaacgccgagaagcugcugaacguggugaagguguaa

SEQ ID NO: 25946 - RNA, 1500 nt, Artificial Sequence
  ZNF253__Homo_sapiens__NP_066385
augggcccccugcaguucagagacguggccaucgaguucagccuggaggaguggcacugccuggacaccgcccagagaaaccuguacagagacgugaugcuggagaacuacagaaaccugguguuccugggcaucguggugagcaagcccgaccuggugaccugccuggagcagggcaagaagccccugaccauggagagacacgagaugaucgccaagccccccgugaugagcagccacuucgcccaggaccuguggcccgagaacauccagaacagcuuccagaucggcaugcugagaagauacgaggagugcagacacgacaaccugcagcugaagaagggcugcaagagcgugggcgagcacaaggugcacaagggcggcuacaacggccugaaccagugccugaccaccacccagaaggagaucuuccagugcgacaaguacggcaagguguuccacaaguucagcaacagcaacaccuacaagaccagacacaccggcaucaaccuguucaagugcaucaucugcggcaaggccuucaagagaagcagcacccugaccacccacaagaagauccacaccggcgagaagcccuacagaugcgaggagugcggcaaggccuucaaccagagcgccaaccugaccacccacaagagaauccacaccggcgagaagcccuacagaugcgaggagugcggcaaggccuucaagcagagcagcaaccugaccacccacaagaagauccacaccggcgagaagcccuacaagugcgaggagugcggcaaggccuucaacagaagcaccgaccugaccacccacaagaucgugcacaccggcgagaagcccuacaagugcgaggagugcggcaaggccuucaagcaccccagccacgugaccacccacaagaagauccacaccagaggcaagcccuacaacugcgaggagugcggcaagagcuucaagcacugcagcaaccugaccauccacaagagaauccacaccggcgagaagcccuacaagugcgaggagugcggcaaggccuuccaccugagcagccaccugaccacccacaagauccugcacaccggcgagaagcccuacagaugcagagagugcggcaaggccuucaaccacagcaccacccuguucagccacgagaagauccacaccggcgagaagcccuacaagugcgacgagugcggcaagaccuucaccuggcccagcauccugagcaagcacaagagaacccacaccggcgagaagcccuacaagugcgaggagugcggcaagagcuucaccgccagcagcacccugaccacccacaagagaauccacaccggcgagaagcccuacaagugcgaggagugcggcaaggccuucaacuggagcagcgaccugaacaagcacaagaagauccacaucgagagaaagcccuacaucgugaagaacgugaccgaccugcugaacgugcccccccugcugaucagcaucagauaa

SEQ ID NO: 25947 - RNA, 1239 nt, Artificial Sequence
  ZNF260__Homo_sapiens__NP_001012774
augaucggcaugcuggagagccugcagcacgagagcgaccugcugcagcacgaccagauccacaccggcgagaagcccuacgagugcaacgagugcagaaagaccuucagccugaagcagaaccugguggagcacaagaagaugcacaccggcgagaagagccacgagugcaccgagugcggcaaggugugcagcagagugagcagccugacccugcaccugagaagccacaccggcaagaaggccuacaagugcaacaagugcggcaaggccuucagccagaaggagaacuuccugagccaccagaagcaccacaccggcgagaagcccuacgagugcgagaaggugagcauccagaugcccaccaucaucagacaccagaagaaccacaccggcaccaagcccuacgccugcaaggagugcggcaaggccuucaacggcaaggccuaccugaccgagcacgagaagauccacaccggcgagaagcccuucgagugcaaccagugcggcagagccuucagccagaagcaguaccugaucaagcaccagaacauccacaccggcaagaagcccuucaagugcagcgagugcggcaaggccuucagccagaaggagaaccugaucauccaccagagaauccacaccggcgagaagcccuacgagugcaagggcugcggcaaggccuucauccagaagagcagccugaucagacaccagagaagccacaccggcgagaagcccuacaccugcaaggagugcggcaaggccuucagcggcaagagcaaccugaccgagcacgagaagauccacaucggcgagaagcccuacaagugcaacgagugcggcaccaucuucagacagaagcaguaccugaucaagcaccacaacauccacaccggcgagaagcccuacgagugcaacaagugcggcaaggccuucagcagaaucaccagccugaucgugcacgugagaauccacaccggcgacaagcccuacgagugcaaggugugcggcaaggccuucugccagagcagcagccugaccgugcacaugagaagccacaccggcgagaagcccuacggcugcaacgagugcggcaaggccuucagccaguucagcacccuggcccugcacaugagaauccacaccggcgagaagcccuaccagugcagcgagugcggcaaggccuucagccagaagagccaccacaucagacaccagagaauccacacccacuaa

SEQ ID NO: 25948 - RNA, 2052 nt, Artificial Sequence
  ZNF263__Homo_sapiens__NP_005732
auggccagcggccccggcagccaggagagagagggccugcugaucgugaagcuggaggaggacugcgccuggagccaggagcugcccccccccgaccccggccccagccccgaggccagccaccugagauucagaagauucagauuccaggaggccgccggccccagagaggcccugagcagacugcaggagcugugccacggcuggcugagacccgagaugagaaccaaggagcagauccuggagcugcuggugcuggagcaguuccugaccauccugccccaggagauccagagcagagugcaggagcugcaccccgagagcggcgaggaggccgugacccugguggaggacaugcagagagagcugggcagacugagacagcaggugaccaaccacggcagaggcaccgaggugcugcuggaggagccccugccccuggagaccgccagagagagccccagcuucaagcuggagcccauggagaccgagagaagccccggccccagacugcaggagcugcugggccccagcccccagagagacccccaggccgugaaggagagagcccugagcgcccccuggcugagccuguucccccccgagggcaacauggaggacaaggagaugaccggcccccagcugcccgagagccuggaggacguggccauguacaucagccaggaggaguggggccaccaggaccccagcaagagagcccugagcagagacaccgugcaggagagcuacgagaacguggacagccuggagagccacauccccagccaggaggugcccggcacccaggugggccagggcggcaagcugugggaccccagcgugcagagcugcaaggagggccugagccccagaggccccgcccccggcgaggagaaguucgagaaccuggagggcgugcccagcgugugcagcgagaacauccacccccaggugcugcugcccgaccaggccagaggcgaggugcccuggagccccgagcugggcagaccccacgacagaagccagggcgacugggcccccccccccgagggcggcauggagcaggcccuggccggcgccagcagcggcagagagcugggcagacccaaggagcugcagcccaagaagcugcaccugugcccccugugcggcaagaacuucagcaacaacagcaaccugaucagacaccagagaauccacgccgccgagagacugugcaugggcguggacugcaccgagaucuucggcggcaaccccagauuccugagccugcacagagcccaccugggcgaggaggcccacaagugccuggagugcggcaagugcuucagccagaacacccaccugaccagacaccagagaacccacaccggcgagaagcccuaccagugcaacaucugcggcaagugcuucagcugcaacagcaaccugcacagacaccagagaacccacaccggcgagaagcccuacaagugccccgagugcggcgagaucuucgcccacagcagcaaccugcugagacaccagagaauccacaccggcgagagacccuacaagugccccgagugcggcaagagcuucagcagaagcagccaccuggugauccacgagagaacccacgagagagagagacuguaccccuucagcgagugcggcgaggccgugagcgacagcacccccuuccugaccaaccacggcgcccacaaggccgagaagaagcuguucgagugccugaccugcggcaagagcuucagacagggcaugcaccugaccagacaccagagaacccacaccggcgagaagcccuacaagugcacccugugcggcgagaacuucagccacagaagcaaccugaucagacaccagagaauccacaccggcgagaagcccuacaccugccacgagugcggcgacagcuucagccacagcagcaacagaaucagacaccugagaacccacaccggcgagagacccuacaagugcagcgagugcggcgagagcuucagcagaagcagcagacugaugagccaccagagaacccacaccggcuaa

SEQ ID NO: 25949 - RNA, 1884 nt, Artificial Sequence
  ZNF264__Homo_sapiens__NP_003408
auggccgccgccgugcugaccgacagagcccaggugagcgugaccuucgacgacguggccgugaccuucaccaaggaggaguggggccagcuggaccuggcccagagaacccuguaccaggaggugaugcuggagaacugcggccugcuggugagccugggcugccccgugcccaaggccgagcugaucugccaccuggagcacggccaggagcccuggaccagaaaggaggaccugagccaggacaccugccccggcgacaagggcaagcccaagaccaccgagcccaccaccugcgagcccgcccugagcgagggcaucagccugcagggccaggugacccagggcaacagcguggacagccagcugggccaggccgaggaccaggacggccugagcgagaugcaggagggccacuucagacccggcaucgacccccaggagaagagccccggcaagaugagccccgagugcgacggccugggcaccgccgacggcgugugcagcagaaucggccaggagcaggugagccccggcgacagagugagaagccacaacagcugcgagagcggcaaggaccccaugauccaggaggaggagaacaacuucaagugcagcgagugcggcaagguguucaacaagaagcaccugcuggccggccacgagaagauccacagcggcgugaagcccuacgagugcaccgagugcggcaagaccuucaucaagagcacccaccugcugcagcaccacaugauccacaccggcgagagacccuacgagugcauggagugcggcaaggccuucaacagaaagagcuaccugacccagcaccagagaauccacagcggcgagaagcccuacaagugcaacgagugcggcaaggccuucacccacagaagcaacuucgugcugcacaacagaagacacaccggcgagaagagcuucgugugcaccgagugcggccagguguucagacacagacccggcuuccugagacacuacguggugcacagcggcgagaaccccuacgagugccuggagugcggcaagguguucaagcacagaagcuaccugauguggcaccagcagacccacaccggcgagaagcccuacgagugcagcgagugcggcaagguguuccuggagagcgccgcccugauccaccacuacgugauccacaccggcgagaagcccuucgagugccuggagugcggcaaggccuucaaccacagaagcuaccugaagagacaccagagaauccacaccggcgagaagcccuucgugugcagcgagugcggcaaggccuucacccacugcagcaccuucauccugcacaagagagcccacaccggcgagaagcccuucgagugcaaggagugcggcaaggccuucagcaacagaaaggaccugaucagacacuucagcauccacaccggcgagaagcccuacgagugcguggagugcggcaaggccuucaccagaaugagcggccugaccagacacaagagaauccacagcggcgagaagcccuacgagugcguggagugcggcaagagcuucugcuggagcaccaaccugaucagacacgccaucauccacaccggcgagaagcccuacaagugcagcgagugcggcaaggccuucagcagaagcagcagccugacccagcaccagagaaugcacaccggcaagaaccccaucagcgugaccgacgugggcagacccuucaccagcggccagaccagcgugacccugagagagcugcugcugggcaaggacuuccugaacgugaccaccgaggccaacauccugcccgaggagaccagcagcagcgccagcgaccagcccuaccagagagagaccccccaggugagcagccuguaa

SEQ ID NO: 25950 - RNA, 1650 nt, Artificial Sequence
  ZNF266__Homo_sapiens__NP_006622
augcuggagaacuacaagaaccuggccaccgugggcuaccagcuguucaagcccagccugaucagcuggcuggagcaggaggagagcagaaccgugcagagaggcgacuuccaggccagcgaguggaaggugcagcugaagaccaaggagcuggcccugcagcaggacgugcugggcgagcccaccagcagcggcauccagaugaucggcagccacaacggcggcgaggugagcgacgugaagcagugcggcgacgugagcagcgagcacagcugccugaagacccacgugagaacccagaacagcgagaacaccuucgagugcuaccuguacggcguggacuuccugacccugcacaagaagaccagcaccggcgagcagagaagcguguucagccagugcggcaaggccuucagccugaaccccgacguggugugccagagaaccugcaccggcgagaaggccuucgacugcagcgacagcggcaagagcuucaucaaccacagccaccugcagggccaccugagaacccacaacggcgagagccugcacgaguggaaggagugcggcagaggcuucauccacagcaccgaccuggccgugagaauccagacccacagaagcgagaagcccuacaagugcaaggagugcggcaagggcuucagauacagcgccuaccugaacauccacaugggcacccacaccggcgacaaccccuacgagugcaaggagugcggcaaggccuucaccagaagcugccagcugacccagcacagaaagacccacaccggcgagaagcccuacaagugcaaggacugcggcagagccuucaccgugagcagcugccugagccagcacaugaagauccacgugggcgagaagcccuacgagugcaaggagugcggcaucgccuucaccagaagcagccagcugaccgagcaccugaagacccacaccgccaaggaccccuucgagugcaagaucugcggcaagagcuucagaaacagcagcugccugagcgaccacuucagaauccacaccggcaucaagcccuacaagugcaaggacugcggcaaggccuucacccagaacagcgaccugaccaagcacgccagaacccacagcggcgagagacccuacgagugcaaggagugcggcaaggccuucgccagaagcagcagacugagcgagcacaccagaacccacaccggcgagaagcccuucgagugcgugaagugcggcaaggccuucgccaucagcagcaaccugagcggccaccugagaauccacaccggcgagaagcccuucgagugccuggagugcggcaaggccuucacccacagcagcagccugaacaaccacaugagaacccacagcgccaagaagcccuucaccugcauggagugcggcaaggccuucaaguuccccaccugcgugaaccugcacaugagaauccacaccggcgagaagcccuacaagugcaagcagugcggcaagagcuucagcuacagcaacagcuuccagcugcacgagagaacccacaccggcgagaagcccuacgagugcaaggagugcggcaaggccuucagcagcagcagcagcuucagaaaccacgagagaagacacgccgacgagagacugagcgccuaa

SEQ ID NO: 25951 - RNA, 2136 nt, Artificial Sequence
  ZNF267__Homo_sapiens__NP_001252517
augcuggagaacuacagaaaccuggugagccugggccugguggugagcaagcccgaccugaucaccuuccuggagcagagaaaggagcccuggaacgugaagagcgaggagaccguggccauccagcccgacguguucagccacuacaacaaggaccugcugaccgagcacugcaccgaggccagcuuccagaaggugaucagcagaagacacggcagcugcgaccuggagaaccugcaccugagaaagagauggaagagagaggagugcgagggccacaacggcugcuacgacgagaagaccuucaaguacgaccaguucgacgagagcagcguggagagccuguuccaccagcagauccugagcagcugcgccaagagcuacaacuucgaccaguacagaaagguguucacccacagcagccugcugaaccagcaggaggagaucgacaucuggggcaagcaccacaucuacgacaagaccagcgugcuguucagacaggugagcacccugaacagcuacagaaacguguucaucggcgagaagaacuaccacugcaacaacagcgagaagacccugaaccagagcagcagccccaagaaccaccaggagaacuacuuccuggagaagcaguacaagugcaaggaguucgaggagguguuccugcagagcaugcacggccaggagaagcaggagcagagcuacaagugcaacaagugcguggaggugugcacccagagccugaagcacauccagcaccagaccauccacaucagagagaacagcuacagcuacaacaaguacgacaaggaccugagccagagcagcaaccugagaaagcagaucauccacaacgaggagaagcccuacaagugcgagaagugcggcgacagccugaaccacagccugcaccugacccagcaccagaucauccccaccgaggagaagcccuacaaguggaaggagugcggcaagguguucaaccugaacugcagccuguaccugaccaagcagcagcagaucgacaccggcgagaaccuguacaagugcaaggccugcagcaagagcuucaccagaagcagcaaccugaucgugcaccagagaauccacaccggcgagaagcccuacaagugcaaggagugcggcaaggccuucagaugcagcagcuaccugaccaagcacaagagaauccacaccggcgagaagcccuacaagugcaaggagugcggcaaggccuucaacagaagcagcugccugacccagcaccagaccacccacaccggcgagaagcuguacaagugcaaggugugcagcaagagcuacgccagaagcagcaaccugaucaugcaccagagagugcacaccggcgagaagcccuacaagugcaaggagugcggcaagguguucagcagaagcagcugccugacccagcacagaaagauccacaccggcgagaaccuguacaagugcaaggugugcgccaagcccuucaccugcuucagcaaccugaucgugcacgagagaauccacaccggcgagaagcccuacaagugcaaggagugcggcaaggccuuccccuacagcagccaccugaucagacaccacagaauccacaccggcgagaagcccuacaagugcaaggccugcagcaagagcuucagcgacagcagcggccugaccgugcacagaagaacccacaccggcgagaagcccuacaccugcaaggagugcggcaaggccuucagcuacagcagcgacgugauccagcacagaagaauccacaccggccagagacccuacaagugcgaggagugcggcaaggccuucaacuacagaagcuaccugaccacccaccagagaagccacaccggcgagagacccuacaagugcgaggagugcggcaaggccuucaacagcagaagcuaccugaccacccacagaagaagacacaccggcgagagacccuacaagugcgacgagugcggcaaggccuucagcuacagaagcuaccugaccacccacagaagaagccacagcggcgagagacccuacaagugcgaggagugcggcaaggccuucaacagcagaagcuaccugaucgcccaccagagaagccacaccagagagaagcuguaa

SEQ ID NO: 25952 - RNA, 2844 nt, Artificial Sequence
  ZNF268__Homo_sapiens__NP_001159353
auggccaccagagugagaaccgccagcaucugggugcccccccugcaggagagaaacagcagcugggacagaaucagaaagcugcagggccaggagagcauccugggccagggcacccccggccugcagccccugcccggcacccccagacagaagcagaagagcagaagaaucgagaaggugcuggaguggcuguucaucagccaggagcagcccaagaucaccaagagcuggggcccccugagcuucauggacguguucguggacuucaccugggaggaguggcagcugcuggaccccgcccagaagugccuguacagaagcgugaugcuggagaacuacagcaaccuggugagccugggcuaccagcacaccaagcccgacaucaucuucaagcuggagcagggcgaggagcugugcauggugcaggcccaggugcccaaccagaccugccccaacaccguguggaagaucgacgaccugauggacuggcaccaggagaacaaggacaagcugggcagcaccgccaagagcuucgagugcaccaccuucggcaagcugugccugcugagcaccaaguaccugagcagacagaagccccacaagugcggcacccacggcaagagccugaaguacaucgacuucaccagcgacuacgccagaaacaaccccaacggcuuccaggugcacggcaagagcuucuuccacagcaagcacgagcagaccgugaucggcaucaaguacugcgagagcaucgagagcggcaagaccgugaacaagaagagccagcugaugugccagcagauguacaugggcgagaagcccuucggcugcagcugcugcgagaaggccuucagcagcaagagcuaccugcuggugcaccagcagacccacgccgaggagaagcccuacggcugcaacgagugcggcaaggacuucagcagcaagagcuaccugaucgugcaccagagaauccacaccggcgagaagcugcacgagugcagcgagugcagaaagaccuucagcuuccacagccagcuggugauccaccagagaauccacaccggcgagaaccccuacgagugcugcgagugcggcaagguguucagcagaaaggaccagcuggugagccaccagaagacccacagcggccagaagcccuacgugugcaacgagugcggcaaggccuucggccugaagagccagcugaucauccacgagagaauccacaccggcgagaagcccuacgagugcaacgagugccagaaggccuucaacaccaagagcaaccugauggugcaccagagaacccacaccggcgagaagcccuacgugugcagcgacugcggcaaggccuucaccuucaagagccagcugaucgugcaccagggcauccacaccggcgugaagcccuacggcugcauccagugcggcaagggcuucagccugaagagccagcugaucgugcaccagagaagccacaccggcaugaagcccuacgugugcaacgagugcggcaaggccuucagaagcaagagcuaccugaucauccacaccagaacccacaccggcgagaagcugcacgagugcaacaacugcggcaaggccuucagcuucaagagccagcugaucauccaccagagaauccacaccggcgagaaccccuacgagugccacgagugcggcaaggccuucagcagaaaguaccagcugaucagccaccagagaacccacgccggcgagaagcccuacgagugcaccgacugcggcaaggccuucggccugaagagccagcugaucauccaccagagaacccacaccggcgagaagcccuucgagugcagcgagugccagaaggccuucaacaccaagagcaaccugaucgugcaccagagaacccacaccggcgagaagcccuacagcugcaacgagugcggcaaggccuucaccuucaagagccagcugaucgugcacaagggcgugcacaccggcgugaagcccuacggcugcagccagugcgccaagaccuucagccugaagagccagcugaucgugcaccagagaagccacaccggcgugaagcccuacggcugcagcgagugcggcaaggccuucagaagcaagagcuaccugaucauccacaugagaacccacaccggcgagaagccccacgagugcagagagugcggcaagagcuucagcuucaacagccagcugaucgugcaccagagaauccacaccggcgagaaccccuacgagugcagcgagugcggcaaggccuucaacagaaaggaccagcugaucagccaccagagaacccacgccggcgagaagcccuacggcugcagcgagugcggcaaggccuucagcagcaagagcuaccugaucauccacaugagaacccacagcggcgagaagcccuacgagugcaacgagugcggcaaggccuucaucuggaagagccugcugaucgugcacgagagaacccacgccggcgugaaccccuacaagugcagccagugcgagaagagcuucagcggcaagcugagacugcuggugcaccagagaaugcacaccagagagaagcccuacgagugcagcgagugcggcaaggccuucaucagaaacagccagcugaucgugcaccagagaacccacagcggcgagaagcccuacggcugcaacgagugcggcaagaccuucagccagaagagcauccugagcgcccaccagagaacccacaccggcgagaagcccugcaagugcaccgagugcggcaaggccuucugcuggaagagccagcugaucaugcaccagagaacccacguggacgacaagcacuaa

SEQ ID NO: 25953 - RNA, 1710 nt, Artificial Sequence
  ZNF273__Homo_sapiens__NP_066971
augagcagcgcccccagaggcccccccagcguggccccccugcccgccggcaucggcagaagcaccgccaagacccccggccugcccggcagccuggagaugggcccccugaccuucagagacguggccaucgaguucagccuggaggaguggcagugccuggacaccagccagcagaaccuguacagaaacgugaugcuggacaacuacagaaaccugguguuccugggcaucgccgugagcaagcccgaccugaucaccugccuggagcagggcaaggagcccugcaacaugaagagacacgccaugguggccaagccccccguggugugcagccacuucgcccaggaccuguggcccaagcagggccugaaggacagcuuccagaaggugauccugagaagauacggcaaguacggccacgagaaccugcagcugagaaagggcugcaagagcgccgacgagcacaaggugcacaagagaggcuacaacggccugaaccagugccugaccaccacccagagcaagaucuuccagugcgacaaguacgugaaggugcugcacaaguucagcaacagcaacauccacaagaagagacagaccggcaagaagcccuucaagugcaaggagugcggcaagagcugcugcauccugagccagcugacccagcacaagaagaccgccaccagagugaacuucuacaagugcaagaccugcggcaaggccuucaaccaguucagcaaccugaccaagcacaagaucauccaccccgaggugaaccccuacaagugcgaggagugcggcaaggccuucaaccagagccugacccugaccaagcacaagaagauccacaccgaggagaagcccuacaagugcgaggacugcggcaagguguucagcguguucagcgugcugaccaagcacaagaucauccacaccggcaccaagcccuacaacugcgaggagugcggcaagggcuucagcaucuucagcacccugaccaagcacaagaucauccacaccggcgagaagcccuacaagugcaacgagugcggcaaggccuucaacuggagcagcacccugaccaagcacaagagaauccacaccggcgagaagcccuacaagugcgaggagugcggcaaggccuucaaccagagcagcacccugaccagacacaagaucgugcacaccggcgagaagcccuacaagugcgaggagugcggcaaggccuucaagagaagcaccacccugaccaagcacaagagaaucuacaccaaggagaagcccuacaagugcgaggagugcggcaaggccuucagcguguucagcacccugaccaagcacaagaucauccacaccggcgccaagcccuacaagugcgaggagugcggcagcgccuucagagccuucagcacccugaccgagcacaagagagugcacaccggcgagaagcccuacaagugcaacgagugcggcaaggccuucaacuggagcagcacccugaccaagcacaagagaauccacaccggcgagaagcccuacaagugcgaggagugcggcaaggccuucaacagaagcagcaaccugaccagacacaagaagauccacaccggcgagaagcccuacaagcccaagagaugcgacagcgccuucgacaacacccccaacuucagcagacacaagagaaaccacaugggcgagaagagcuaa

SEQ ID NO: 25954 - RNA, 1866 nt, Artificial Sequence
  ZNF274__Homo_sapiens__NP_057409
auggccagcagacugcccaccgccuggagcugcgagcccgugaccuucgaggacgugacccugggcuucacccccgaggaguggggccugcuggaccugaagcagaagagccuguacagagaggugaugcuggagaacuacagaaaccuggugagcguggaguaccccgagcugcagcuggaccccaagcuggacccccugcccgccgagagcccccugaugaacaucgaggugguggaggugcugacccugaaccaggagguggccggccccagaaacgcccagauccaggcccuguacgccgaggacggcagccugagcgccgacgcccccagcgagcaggugcagcagcagggcaagcaccccggcgaccccgaggccgccagacagagauucagacaguucagauacaaggacaugaccggccccagagaggcccuggaccagcugagagagcugugccaccaguggcugcagcccaaggccagaagcaaggagcagauccuggagcugcuggugcuggagcaguuccugggcgcccugcccgugaagcugagaaccuggguggagagccagcaccccgagaacugccaggaggugguggcccugguggagggcgugaccuggaugagcgaggaggaggugcugcccgccggccagcccgccgagggcaccaccugcugccuggaggugaccgcccagcaggaggagaagcaggaggacgccgccaucugccccgugaccgugcugcccgaggagcccgugaccuuccaggacguggccguggacuucagcagagaggaguggggccugcugggccccacccagagaaccgaguacagagacgugaugcuggagaccuucggccaccuggugagcgugggcugggagaccacccuggagaacaaggagcuggcccccaacagcgacauccccgaggaggagcccgcccccagccugaaggugcaggagagcagcagagacugcgcccugagcagcacccuggaggacacccugcagggcggcgugcaggaggugcaggacaccgugcugaagcagauggagagcgcccaggagaaggaccugccccagaagaagcacuucgacaacagagagagccaggccaacagcggcgcccuggacaccaaccaggugagccugcagaagaucgacaaccccgagagccaggccaacagcggcgcccuggacaccaaccaggugcugcugcacaagaucccccccagaaagagacugagaaagagagacagccaggugaagagcaugaagcacaacagcagagugaagauccaccagaagagcugcgagagacagaaggccaaggagggcaacggcugcagaaagaccuucagcagaagcaccaagcagaucaccuucaucagaauccacaagggcagccaggugugcagaugcagcgagugcggcaagaucuucagaaaccccagauacuucagcgugcacaagaagauccacaccggcgagagacccuacgugugccaggacugcggcaagggcuucgugcagagcagcagccugacccagcaccagagagugcacagcggcgagagacccuucgagugccaggagugcggcagaaccuucaacgacagaagcgccaucagccagcaccugagaacccacaccggcgccaagcccuacaagugccaggacugcggcaaggccuucagacagagcagccaccugaucagacaccagagaacccacaccggcgagagacccuacgccugcaacaagugcggcaaggccuucacccagagcagccaccugaucggccaccagagaacccacaacagaaccaagagaaagaagaagcagcccaccagcuaa

SEQ ID NO: 25955 - RNA, 1845 nt, Artificial Sequence
  ZNF276__Homo_sapiens__NP_001106997
augaagagagacagacugggcagauuccugagccccggcagcagcagacagugcggcgccagcgacggcggcggcggcgugagcagaaccagaggcagacccagccugagcggcggccccagaguggacggcgccaccgccagaagagccuggggccccgugggcagcugcggcgacgccggcgaggacggcgccgacgaggccggcgccggcagagcccuggccaugggccacugcagacugugccacggcaaguucagcagcagaagccugagaagcaucagcgagagagcccccggcgccagcauggagagacccagcgccgaggagagagugcuggugagagacuuccagagacugcugggcguggccgugagacaggaccccacccugagccccuucgugugcaagagcugccacgcccaguucuaccagugccacagccugcugaagagcuuccugcagagagugaacgccagccccgccggcagaagaaagcccugcgccaaggugggcgcccagccccccaccggcgccgaggagggcgccugccugguggaccugaucaccagcagcccccagugccugcacggccuggugggcugggugcacggccacgccgccagcugcggcgcccugccccaccugcagagaacccugagcagcgaguacugcggcgugauccaggugguguggggcugcgaccagggccacgacuacaccauggacaccagcagcagcugcaaggccuuccugcuggacagcgcccuggccgugaaguggcccugggacaaggagaccgcccccagacugccccagcacagaggcuggaaccccggcgacgccccccagaccagccagggcagaggcaccggcacccccgugggcgccgagaccaagacccugcccagcaccgacguggcccagccccccagcgacagcgacgccgugggccccagaagcggcuuccccccccagcccagccugccccugugcagagcccccggccagcugggcgagaagcagcugcccagcagcaccagcgacgacagagugaaggacgaguucagcgaccugagcgagggcgacgugcugagcgaggacgagaacgacaagaagcagaacgcccagagcagcgacgagagcuucgagcccuaccccgagagaaaggugagcggcaagaagagcgagagcaaggaggccaagaagagcgaggagcccagaaucagaaagaagcccggccccaagcccggcuggaagaagaagcugagaugcgagagagaggagcugcccaccaucuacaagugccccuaccagggcugcaccgccguguacagaggcgccgacggcaugaagaagcacaucaaggagcaccacgaggaggugagagagagacccugcccccaccccggcugcaacaagguguucaugaucgacagauaccugcagagacacgugaagcugauccacaccgaggugagaaacuacaucugcgacgagugcggccagaccuucaagcagagaaagcaccugcuggugcaccagaugagacacagcggcgccaagccccugcagugcgaggugugcggcuuccagugcagacagagagccagccugaaguaccacaugaccaagcacaaggccgagaccgagcuggacuucgccugcgaccagugcggcagaagauucgagaaggcccacaaccugaacgugcacaugagcauggugcacccccugacccagacccaggacaaggcccugccccuggaggccgagcccccccccggcccccccagccccagcgugaccaccgagggccaggccgugaagcccgagcccaccuaa

SEQ ID NO: 25956 - RNA, 1353 nt, Artificial Sequence
  ZNF277__Homo_sapiens__NP_068834
auggccgccagcaagacccagggcgccguggccagaaugcaggaggacagagacggcagcugcagcaccgugggcggcgugggcuacggcgacagcaaggacugcauccuggagccccugagccugcccgagagccccggcggcaccaccacccuggagggcagccccagcgugcccugcaucuucugcgaggagcacuuccccguggccgagcaggacaagcugcugaagcacaugaucaucgagcacaagaucgugaucgccgacgugaagcugguggccgacuuccagagauacauccuguacuggagaaagagauucaccgagcagcccaucaccgacuucugcagcgugaucagaaucaacagcaccgcccccuucgaggagcaggagaacuacuuccugcugugcgacgugcugcccgaggacagaauccugagagaggagcugcagaagcagagacugagagagauccuggagcagcagcagcaggagagaaacgacaccaacuuccacggcgugugcauguucugcaacgaggaguuccugggcaacagaagcgugauccugaaccacauggccagagagcacgccuucaacaucggccugcccgacaacaucgugaacugcaacgaguuccugugcacccugcagaagaagcuggacaaccugcagugccuguacugcgagaagaccuucagagacaagaacacccugaaggaccacaugagaaagaagcagcacagaaagaucaaccccaagaacagagaguacgacagauucuacgugaucaacuaccuggagcugggcaagagcugggaggaggugcagcuggaggacgacagagagcugcuggaccaccaggaggacgacuggagcgacugggaggagcaccccgccagcgccgugugccuguucugcgagaagcaggccgagaccaucgagaagcuguacgugcacauggaggacgcccacgaguucgaccugcugaagaucaagagcgagcugggccugaacuucuaccagcaggugaagcuggugaacuucaucagaagacaggugcaccagugcagaugcuacggcugccacgugaaguucaagagcaaggccgaccugagaacccacauggaggagaccaagcacaccagccugcugcccgacagaaagaccugggaccagcuggaguacuacuuccccaccuacgagaacgacacccugcugugcacccugagcgacagcgagagcgaccugaccgcccaggagcagaacgagaacgugcccaucaucagcgaggacaccagcaagcuguacgcccugaagcagagcagcauccugaaccagcugcugcuguaa

SEQ ID NO: 25957 - RNA, 1632 nt, Artificial Sequence
  ZNF280B__Homo_sapiens__XP_011545198
auggagcagagcugcgaggaggagaaggagcccgagccccagaagaacauccaggagaccaagcagguggacgacgaggacgccgagcugaucuucgugggcguggagcacgugaacgaggacgccgagcugaucuucgugggcgugaccagcaacagcaagcccguggugagcaacauccugaacagagugacccccggcagcuggagcagaagaaagaaguacgaccaccugagaaaggacaccgccagaaagcugcagcccaagagccacgagaccgugaccagcgaggccgugaccgugcugcccgccagccagcuggagagcagaagcaccgacagccccaucaucaucgagccccugagcaagcccgacuacagaaacagcagcccccagguggugcccaacaacagcagcgagcugcccagcccccugaucaccuucaccgacagccugcaccaccccgugagcaccgcccugagcgugggcggcaucaacgagagccccagagugagcaagcagcugagcaccuucgaggugaacagcaucaaccccaagagagccaagcugagagacggcaucaucgagggcaacagcagcgccagcuuccccagcgacaccuuccacaccaugaacacccagcagagcacccccagcaacaacgugcacaccagccugagccacgugcagaacggcgcccccuuccccgccgccuuccccaaggacaacauccacuucaagcccaucaacaccaaccuggacagagccaacgagcuggccaagaccgacauccugagccugaccagccagaacaagaccuucgaccccaagaaggagaaccccaucgugcugcugagcgacuucuacuacggccagcacaagggcgagggccagcccgagcagaagacccacaccaccuucaagugccugagcugcgugaaggugcugaagaacgugaaguucaugaaccacgugaagcaccaccuggaguucgagaagcagagaaacgacagcugggagaaccacaccaccugccagcacugccacagacaguuccccacccccuuccagcugcagugccacaucgagaacgugcacaccgcccaggagcccagcaccgugugcaagaucugcgagcugagcuucgagaccgaccaggugcugcugcagcacaugaaggaccaccacaagcccggcgagaugcccuacgugugccaggugugccacuacagaagcagcguguucgccgacguggagacccacuucagaaccugccacgagaacaccaagaaccugcugugccccuucugccugaagaucuucaagaccgccacccccuacaugugccacuacagaggccacuggggcaagagcgcccaccagugcagcaagugcagacugcaguuccugaccuucaaggagaagauggagcacaagacccagugccaccagauguucaagaagcccaagcagcuggagggccugccccccgagaccaaggugaccauccaggugagccuggagccccugcagcccggcagcguggacguggccagcaucaccgugagcaccagcgacagcgagcccagccugcccagaagcaagagcaagaucagcaagaagagccacuaa

SEQ ID NO: 25958 - RNA, 2901 nt, Artificial Sequence
  ZNF280D__Homo_sapiens__NP_001002843
auggccgagcuguucauggagugcgaggaggaggagcuggagcccuggcagaagaaggugaaggagguggaggacgacgacgacgacgagcccaucuucgugggcgagaucagcagcagcaagcccgccaucagcaacauccugaacagagugaaccccagcagcuacagcagaggccugaagaacggcgcccugagcagaggcaucaccgccgccuucaagcccaccagccagcacuacaccaaccccaccagcaaccccgugcccgccagccccaucaacuuccaccccgagagcagaagcagcgacagcagcgugaucgugcagcccuucagcaagcccggcuacaucaccaacagcagcagaguggugagcaacaagagcagcgagcugcuguucgaccugacccaggacaccggccugagccacuaccagggcggccccacccugagcauggccggcaugagcgagagcagcuuccugagcaagagacccagcaccagcgaggugaacaacgugaaccccaagaagcccaagcccagcgagagcgugagcggcgccaacagcagcgccgugcugcccagcgugaagagccccagcgugaccagcagccaggccaugcuggccaagggcaccaacaccagcagcaaccagagcaagaacggcacccccuuccccagagccugccccaagugcaacauccacuucaaccugcuggacccccugaagaaccacaugaaguacugcugccccgacaugaucaacaacuuccugggccuggccaagaccgaguucagcagcaccgugaacaagaacaccaccaucgacagcgagaagggcaagcugaucaugcuggugaacgacuucuacuacggcaagcacgagggcgacgugcaggaggagcagaagacccacaccaccuucaagugcuucagcugccugaagauccugaagaacaacaucagauucaugaaccacaugaagcaccaccuggagcuggagaagcagagcagcgagagcugggagaaccacaccaccugccagcacugcuacagacaguuccccacccccuuccagcugcagugccacaucgagagcacccacaccccccacgaguucagcaccaucugcaagaucugcgagcugagcuucgagaccgagcacgugcugcugcagcacaugaaggacaaccacaagcccggcgagaugcccuacgugugccaggugugcaacuacagaagcagcagcuucagcgacguggagacccacuucagaaccagccacgagaacaccaagaaccugcugugccccuucugccugaaggugaucaagaucgccacccccuacaugcaccacuacaugaagcaccagaagaagggcauccacagaugcaccaagugcagacugcaguuccugaccugcaaggagaagauggaccacaagacccagcaccacagaaccuucaucaagcccaagcagcuggagggccugccccccggcaccaaggugaccaucagagccagcgugggcccccugcagagcggcgccagccccacccccagcaucagcgccagcgccagcacccugcagcugagcccccccagaaccaagaacaucaccgccaagaaccccgccaagagcaacaccagcaagcccaacaccgugaagagcaacgccagcaagcccaacaccagcaagcccaacggcagcaagagcaaguacaagcccaagaucagcaacaugcagaagaagcagagcacccuggccagcagcaacaagaagagcaaggugaacaccgcccugagaaaccugagauacagaagaggcauccacaagugcaucgagugcugcagcgagaucaaggacuucgccaaccacuuccccaccuacgugcacugcagcuucugcagauacaacaccagcugcagcaaggccuacgugaaccacaugaugagcuuccacagcaacagacccagcaagagauucugcaucuucaagaagcacagcgagaaccugagaggcaucacccuggugugccugaacugcgacuuccugagcgacgugagcggccuggacaacauggccacccaccugagccagcacaagacccacaccugccagguggugaugcagaaggugagcgugugcauccccaccagcgagcaccugagcgagcugaagaaggaggcccccgccaaggagcaggagcccgugagcaaggagaucgccagacccaacauggccgagagagagaccgagaccagcaacagcgagagcaagcaggacaaggccgccagcagcaaggagaagaacggcugcaacgccaacagcuucgagggcagcagcaccaccaagagcgaggagagcaucaccgugagcgacaaggagaacgagaccugccuggccgaccaggagaccggcagcaagaacaucgugagcugcgacagcaacaucggcgccgacaagguggagaagaagaagcagauccagcacgugugccaggagauggagcugaagaugugccagagcagcgagaacaucauccugagcgaccagaucaaggaccacaacagcagcgaggccagauucagcagcaagaacaucaaggaccugagacuggccagcgacaacgugagcaucgaccaguuccugagaaagagacacgagcccgagagcgugagcagcgacgugagcgagcagggcagcauccaccuggagccccugacccccagcgaggugcuggaguacgaggccaccgagauccugcagaagggcagcggcgaccccagcgccaagaccgacgagguggugagcgaccagaccgacgacauccccggcggcaacaaccccagcaccaccgaggccaccguggaccuggaggacgagaaggagagaagcuaa

SEQ ID NO: 25959 - RNA, 2688 nt, Artificial Sequence
  ZNF281__Homo_sapiens__NP_001268222
augaagaucggcagcggcuuccugagcggcggcggcggcaccggcagcagcggcggcagcggcagcggcggcggcggcagcggcggcggcggcggcggcggcagcagcggcagaagagccgagauggagcccaccuucccccagggcauggugauguucaaccacagacugccccccgugaccagcuucaccagacccgccggcagcgccgccccccccccccagugcgugcugagcagcagcaccagcgccgcccccgccgccgagcccccccccccccccgcccccgacaugaccuucaagaaggagcccgccgccagcgccgccgccuuccccagccagagaaccagcuggggcuuccugcagagccuggugagcaucaagcaggagaagcccgccgaccccgaggagcagcagagccaccaccaccaccaccaccaccacuacggcggccuguucgccggcgccgaggagagaagccccggccugggcggcggcgagggcggcagccacggcgugauccaggaccugagcauccugcaccagcacgugcagcagcagcccgcccagcaccacagagacgugcugcugagcagcagcagcagaaccgacgaccaccacggcaccgaggagcccaagcaggacaccaacgugaagaaggccaagagacccaagcccgagagccagggcaucaaggccaagagaaagcccagcgccagcagcaagcccagccuggugggcgacggcgagggcgccauccugagccccagccagaagccccacaucugcgaccacugcagcgccgccuucagaagcagcuaccaccugagaagacacgugcugauccacaccggcgagagacccuuccagugcagccagugcagcaugggcuucauccagaaguaccugcugcagagacacgagaagauccacagcagagagaagcccuucggcugcgaccagugcagcaugaaguucauccagaaguaccacauggagagacacaagagaacccacagcggcgagaagcccuacaagugcgacaccugccagcaguacuucagcagaaccgacagacugcugaagcacagaagaaccugcggcgaggugaucgugaagggcgccaccagcgccgagcccggcagcagcaaccacaccaacaugggcaaccuggccgugcugagccagggcaacaccagcagcagcagaagaaagaccaagagcaagagcaucgccaucgagaacaaggagcagaagaccggcaagaccaacgagagccagaucagcaacaacaucaacaugcagagcuacagcguggagaugcccaccgugagcagcagcggcggcaucaucggcaccggcaucgacgagcugcagaagagagugcccaagcugaucuucaagaagggcagcagaaagaacaccgacaagaacuaccugaacuucgugagcccccugcccgacaucgugggccagaagagccugagcggcaagcccagcggcagccugggcaucgugagcaacaacagcguggagaccaucggccugcugcagagcaccagcggcaagcagggccagaucagcagcaacuacgacgacgccaugcaguucagcaagaagagaagauaccugcccaccgccagcagcaacagcgccuucagcaucaacgugggccacauggugagccagcagagcgugauccagagcgccggcgugagcgugcuggacaacgaggccccccugagccugaucgacagcagcgcccugaacgccgagaucaagagcugccacgacaagagcggcauccccgacgaggugcugcagagcauccuggaccaguacagcaacaagagcgagagccagaaggaggaccccuucaacaucgccgagcccagaguggaccugcacaccagcggcgagcacagcgagcuggugcaggaggagaaccugagccccggcacccagacccccagcaacgacaaggccagcaugcugcaggaguacagcaaguaccugcagcaggccuucgagaagagcaccaacgccagcuucacccugggccacggcuuccaguucgugagccugagcagcccccugcacaaccacacccuguuccccgagaagcagaucuacaccaccagcccccuggagugcggcuucggccagagcgugaccagcgugcugcccagcagccugcccaagccccccuucggcaugcuguucggcagccagcccggccuguaccugagcgcccuggacgccacccaccagcagcugacccccagccaggagcuggacgaccugaucgacagccagaagaaccuggagaccagcagcgccuuccagagcagcagccagaagcugaccagccagaaggagcagaagaaccuggagagcagcaccggcuuccagauccccagccaggagcuggccagccagaucgacccccagaaggacaucgagcccagaaccaccuaccagaucgagaacuucgcccaggccuucggcagccaguucaagagcggcagcagagugcccaugaccuucaucaccaacagcaacggcgagguggaccacagagugagaaccagcgugagcgacuucagcggcuacaccaacaugaugagcgacgugagcgagcccugcagcaccagagugaagacccccaccagccagagcuacagauaa

SEQ ID NO: 25960 - RNA, 1392 nt, Artificial Sequence
  ZNF282__Homo_sapiens__NP_001290410
augcaguucgugagcaccagaccccagccccagcagcugggcauccagggccugggccuggacagcggcagcuggagcugggcccaggcccugccccccgaggaggugugccaccaggagcccgcccugagaggcgagauggccgagggcaugccccccaugcaggcccaggagugggacauggacgccagaagacccaugcccuuccaguucccccccuuccccgacagagcccccguguuccccgacagaaugaugagagagccccagcugcccaccgccgagaucagccuguggaccgugguggccgccauccaggccguggagagaaagguggacgcccaggccagccagcugcugaaccuggagggcagaaccggcaccgccgagaagaagcuggccgacugcgagaagaccgccguggaguucggcaaccacauggagagcaagugggccgugcugggcacccugcugcaggaguacggccugcugcagagaagacuggagaaccuggagaaccugcugagaaacagaaacuucugggugcugagacugccccccggcagcaagggcgaggcccccaaggugcccgugaccuucguggacaucgccguguacuucagcgaggacgaguggaagaaccuggacgaguggcagaaggagcuguacaacaaccuggugaaggagaacuacaagacccugaugagccuggacgccgagggcagcgugcccaagcccgacgcccccgugcaggccgagcccagagaggagcccugcgugugggagcagagacaccccgaggagagagagauccccauggaccccgaggccggcgccgagccccuggugcccgcccaggacgccagcagccaggugaagagagaggacacccugugcgugagaggccagagaggccuggaggagagagccauccccaccgagagcaucaccgacagccccaucagcgcccaggaccugcugagcagaaucaagcaggaggagcaccagugcgugugggaccagcaggaccuggccgacagagacauccccaccgaccccaacagcgagagccugaucagcgcccacgacauccugagcuggaucaagcaggaggagcagcccuaccccuggggccccagagacagcauggacggcgagcugggccuggacagcggccccagcgacagccugcugauggugaagaaccccccccccgcccccccccagccccagccccagccccagcccccccagccccagcugcagagccagccccagccccagagccugccccccaucgccguggccgagaaccccggcggcccccccagcagaggccugcuggacgacggcuuccagccccaccagggcgccgcccugagagugagauaa

SEQ ID NO: 25961 - RNA, 1569 nt, Artificial Sequence
  ZNF286B__Homo_sapiens__NP_001138517
auggagaccgaccuggccgagaugcccgagaagggcgugcugagcagccaggacagcccccacuuccaggagaagagcaccgaggagggcgagguggccgcccugagacugaccgccagaagccaggccgccgccgccgccgccgcccccggcagcagaagccugagaggcgugcacgugccccccccccugcaccccgcccccgccagagaggagaucaagagcaccugcagccugaaggccugcuucagccugagccugacccugaccuacuacagaaccgccuuccugcugagcaccgagaacgagggcaaccugcacuuccagugccccagcgacguggagaccagaccccagagcaaggacagcaccagcgugcaggacuucagcaaggccgagagcugcaagguggccaucaucgacagacugaccagaaacagcguguacgacagcaaccuggaggccgcccuggagugcgagaacuggcuggagaagcagcagggcaaccaggagagacaccugagagagauguucacccacaugaacagccugagcgaggagaccgaccacgagcacgacguguacuggaagagcuucaaccagaagagcgugcugaucaccgaggacagagugcccaagggcagcuacgccuuccacacccuggagaagagccugaagcagaagagcaaccugaugaagaagcagagaaccuacaaggagaagaagccccacaagugcaacgacugcggcgagcuguucaccugccacagcgugcacauccagcaccagagagugcacaccggcgagaagcccuacaccugcaacgagugcggcaagagcuucagccacagagccaaccugaccaagcaccagagaacccacaccagaauccuguucgagugcagagagugcaagaagaccuucaccgagagcagcagccuggccacccaccagagaauccacgugggcgagagacccuacgagugcaacgagugcggcaagggcuucaacagaagcacccaccuggugcagcaccagcugauccacaccggcgugagacccuacgagugcaacgagugcgacaaggccuucauccacagcagcgcccugaucaagcaccagagaacccacaccggcgagaagcccuacaagugccaggagugcggcaaggccuucagccacugcagcagccugaccaagcaccagagagugcacaccggcgagaagcccuacgagugcagcgagugcggcaagaccuucagccagagcacccaccuggugcagcaccagagaauccacaccggcgagaagcccuacgagugcagcgagugcggcaagaccuucagccagagcagcaacuucgccaagcaccagagaauccacaucggcaagaagcccuacaagugcagcgagugcggcaaggccuucauccacagcagcgcccugauccagcaccagagaacccacaccggcgagaagcccuucagaugcaacgagugcggcaagagcuucaagugcagcagcagccugaucagacaccagagagugcacaccgaggagcagcccuaa

SEQ ID NO: 25962 - RNA, 1428 nt, Artificial Sequence
  ZNF296__Homo_sapiens__NP_660331
augagcagaagaaaggccggcagcgcccccagaagaguggagcccgcccccgccgccaaccccgacgacgagauggagaugcaggaccuggugaucgagcugaagcccgagcccgacgcccagccccagcaggcccccagacugggccccuucagccccaaggaggugagcagcgccggcagauucggcggcgagccccaccacagccccggccccaugcccgccggcgccgcccugcuggcccugggccccagaaaccccuggacccuguggaccccccugacccccaacuaccccgacagacagcccuggaccgacaagcaccccgaccugcugaccugcggcagaugccugcagaccuucccccuggaggccaucaccgccuucauggaccacaagaagcugggcugccagcuguucagaggccccagcagaggccagggcagcgagagagaggagcugaaggcccugagcugccugagaugcggcaagcaguucaccguggccuggaagcugcugagacacgcccagugggaccacggccugagcaucuaccagaccgagagcgaggcccccgaggccccccugcugggccuggccgagguggccgccgccgugagcgccguggugggccccgccgccgaggccaagagccccagagccagcggcagcggccugaccagaagaagccccaccugccccgugugcaagaagacccugagcagcuucagcaaccugaaggugcacaugagaagccacaccggcgagagacccuacgccugcgaccagugccccuacgccugcgcccagagcagcaagcugaacagacacaagaagacccacagacaggugcccccccagagcccccugauggccgacaccagccaggagcaggccagcgccgccccccccgagcccgccgugcacgccgccgcccccaccagcacccugcccugcagcggcggcgagggcgccggcgccgccgccaccgccggcgugcaggagcccggcgcccccggcagcggcgcccaggccggccccggcggcgacaccuggggcgccaucaccaccgagcagagaaccgaccccgccaacagccagaaggccagccccaagaagaugcccaagagcggcggcaagagcagaggccccggcggcagcugcgaguucugcggcaagcacuucaccaacagcagcaaccugaccgugcacagaagaagccacaccggcgagagacccuacaccugcgaguucugcaacuacgccugcgcccagagcagcaagcugaacagacacagaagaaugcacggcaugacccccggcagcaccagauucgagugcccccacugccacgugcccuucggccugagagccacccuggacaagcaccugagacagaagcaccccgaggccgccggcgaggccuaa

SEQ ID NO: 25963 - RNA, 1152 nt, Artificial Sequence
  ZNF2__Homo_sapiens__NP_001017396
augcuggagaacuacaacagcaucgugagccugggccugcccgugccccagcccgacgugaucuuccagcugaagagaggcgacaagcccuggaugguggaccugcacggcagcgaggagagagaguggcccgagagcgugagccuggacugggagaccaagcccgagauccacgacgccagcgacaagaagagcgagggcagccugagagagugccugggcagacagagcccccugugccccaaguucgaggugcacacccccaacggcagaaugggcaccgagaagcagagccccagcggcgagaccagaaagaagagccugagcagagacaagggccugagaagaagaagcgcccugagcagagagauccugaccaaggagagacaccaggagugcagcgacugcggcaagaccuucuucgaccacagcagccugaccagacaccagagaacccacaccggcgagaagcccuacgacugcagagagugcggcaaggccuucagccacagaagcagccugagcagacaccugaugagccacaccggcgagagccccuacgagugcagcgugugcagcaaggccuucuucgacagaagcagccugaccgugcaccagagaauccacaccggcgagaagcccuuccagugcaacgagugcggcaaggccuucuucgacagaagcagccugaccagacaccagagaauccacaccggcgagagccccuacgagugccaccagugcggcaaggccuucagccagaagagcauccugaccagacaccagcugauccacaccggcagaaagcccuacgagugcaacgagugcggcaaggccuucuacggcgugagcagccugaacagacaccagaaggcccacgccggcgaccccagauaccagugcaacgagugcggcaaggccuucuucgacagaagcagccugacccagcaccagaagauccacaccggcgacaagcccuacgagugcagcgagugcggcaaggccuucagccagagaugcagacugaccagacaccagagagugcacaccggcgagaagcccuucgagugcaccgugugcggcaagguguucagcagcaagagcagcgugauccagcaccagagaagauacgccaagcagggcaucgacuaa

SEQ ID NO: 25964 - RNA, 1863 nt, Artificial Sequence
  ZNF300__Homo_sapiens__NP_001166302
auggugcccgccgagaccagcagcagcggccugcuggaggagcagaagaugaugaagagccagggccuggugagcuucaaggacguggccguggacuucacccaggaggaguggcagcagcuggaccccagccagagaacccuguacagagacgugaugcuggagaacuacagccaccuggugagcaugggcuaccccgugagcaagcccgacgugaucagcaagcuggagcagggcgaggagcccuggaucaucaagggcgacaucagcaacuggaucuaccccgacgaguaccaggccgacggcagacaggacagaaagagcaaccugcacaacagccagagcugcauccugggcaccgugagcuuccaccacaagauccugaagggcgugaccagagacggcagccugugcagcauccugaaggugugccagggcgacggccagcugcagagauuccuggagaaccaggacaagcuguucagacaggugaccuucgugaacagcaagaccgugaccgaggccagcggccacaaguacaacccccugggcaagaucuuccaggagugcaucgagaccgacaucagcauccagagauuccacaaguacgacgccuucaagaagaaccugaagcccaacaucgaccugcccagcugcuacaagagcaacagcagaaagaagcccgaccagagcuucggcggcggcaagagcagcagccagagcgagcccaacagcaaccuggagaagauccacaacggcgugauccccuucgacgacaaccagugcggcaacguguucagaaacacccagagccugauccaguaccagaacguggagaccaaggagaagagcugcgugugcgugaccugcggcaaggccuucgccaagaagagccagcugaucgugcaccagagaauccacaccggcaagaagcccuacgacugcggcgccugcggcaaggccuucagcgagaaguuccaccugguggugcaccagagaacccacaccggcgagaagcccuacgacugcagcgagugcggcaaggccuucagccagaagagcagccugaucauccaccagagagugcacaccggcgagaagcccuacgagugcagcgagugcggcaaggccuucagccagaagagcccccugaucauccaccagagaauccacaccggcgagaagcccuacgagugcagagagugcggcaaggccuucagccagaagagccagcugaucauccaccacagagcccacaccggcgagaagcccuacgagugcaccgagugcggcaaggccuucugcgagaagagccaccugaucauccacaagagaauccacaccggcgagaagcccuacaagugcgcccagugcgaggaggccuucagcagaaagaccgagcugaucacccaccagcuggugcacaccggcgagaagcccuacgagugcaccgagugcggcaagaccuucagcagaaagagccagcugaucauccaccagagaacccacaccggcgagaagcccuacaagugcagcgagugcggcaaggccuucugccagaagagccaccugaucggccaccagagaauccacaccggcgagaagcccuacaucugcaccgagugcggcaaggccuucagccagaagagccaccugcccggccaccagagaauccacaccggcgagaagcccuacaucugcgccgagugcggcaaggccuucagccagaagagcgaccuggugcugcaccagagaauccacaccggcgagagacccuaccagugcgccaucugcggcaaggccuucauccagaagagccagcugaccgugcaccagagaauccacaccguggugaagagcuaa

SEQ ID NO: 25965 - RNA, 2001 nt, Artificial Sequence
  ZNF311__Homo_sapiens__NP_001010877
augcaggagguggugcugcuggacgagagcagcggcccccccagccagcugcuguggaccagacaggacacccagcugccccaggagagcgcccugcugcccgcccccuaccccgccuucaccaaggacggcagccagggcaaccugccccaggccgacaucacccugaugagccaggcccaggagagcgugaccuucgaggacguggccgugaacuucaccaacagagaguggcagugccugaccuacgcccagagacaccuguacaaggacgugaugcuggagaacuacggcaacauggugagccugggcuuccccuuccccaagcccccccugaucagccaccuggagagagagguggaccccugcgugcaggacccccaggacagagagagccugagcugcagcuaccccgugagcgccgacaagauguggcccgagaacgagaaggccagcagccagcaggagaucuucgagaacggcgaggccuacuggaugaaguucaacagccugcugaagguggacagcagagaccccaaggugagagaggugugcgugcaggacgugaagcuggagaaccagugggagaccagcaucagagagaagcugagagaggagaaggagggcagcgaggaggugaccugcaagaagggcaagaaccagaaggugcugagcaagaaccugaaccccaacagcaagcacagccagugcaacaaggugcugaucgcccagaagcugcacgagugcgccagaugcggcaagaacuucagcuggcacagcgaccugauccugcacgagcagauccacagcggcgagaagccccacgugugcaacgagugcggcaaggccuucaagaccagaaaccagcugagcaugcacagaaucauccacaccggcgagaagcccuucaacugcacccagugcggcaaggccuucaacagcagaagcgcccugugcagacacaagaagacccacagcggcgagaagccccacgagugcagagacugcggcaaggccuucaagaccagaaacagacugugcaugcaccagcugauccacaccggcgagaagcccuacaagugcaacugcugcggcaaggccuuccaguucaagcacagccugaccauccacggcagaauccacaccggcgagaagcccuacgagugcgaggagugcggcaaggccuucagcggcagcagcgaccugaccaagcacaucagaauccacaccggcgagagacccuacgagugcagcaagugcggcagagccuucagcagaagcagcgaccugagcaagcacaagagaauccacaccagagagaagcacuacggcugcccccagugcggcaaggacuucagcaucaaggccgagcugaccaagcacagaagaauccacaccgaggagaagagauacagaugcgaggagugcggcaaggccuucagacacaacugcaagagaagagcccacgagagagagcacaccggcgagaagcccuaccagugcagagacugcggcaagaccuuccaggacaagcacugccugaccauccaccagagaauccacaccggcgagaagcccuacaagugccuggagugcggcaaggccuucagcggcaagagcaaccugaccaaccacagaagaauccacaccggcgagaagccccacaagugcgaggugugcggcauggccuuccaccacagcagcgugcugagacagcacaagagaauccacaccggcgagaagcccuacaccugcagcgagugcggcaccagcuucagacagggcagcgcccugaucggccacaagagagugcacaccggcgagaagcccuacgagugcgaggagugcggcaaggccuucagagugagcagcaaccugaccggccacaagaagagaaagcaccagguguggagcacccacgagcuggacggcagcagaaagagccugagccccgugaccgugagccagaccagcguggugagcauccugaccagcgccuaa

SEQ ID NO: 25966 - RNA, 6840 nt, Artificial Sequence
  ZNF318__Homo_sapiens__NP_055160
auguacagaagcagcgccagaagcagcgugagcagccacagacccaaggacgacggcggcggcggccccagaagcggcagaagcagcggcagcagcagcggccccgccagaagaagcagccccccccccccccccagcggcagcagcagcagaacccccgccagaagacccagaagccccagcggccacagaggcagaagagccagccccagcccccccagaggcagaagagugagccccagcccccccagagccagaagaggcagccccagcccccccagaggcagaagacuguucccccccggccccgccggcuucagaggcagcagcagaggcgagagcagagccgacuacgccagagacggcagaggcgaccaccccggcgacagcggcagcagaagaagaagccccggccugugcagcgacagccuggagaagagccugagaaucaccgugggcaacgaccacuucugcgugagcacccccgagagaagaagacugagcgacagacugggcagccccguggacaaccuggaggacauggacagagacgaccugaccgacgacagcguguucaccagaagcagccagugcagcagaggccuggagagauacaucagccaggaggagggcccccugagccccuuccugggccagcuggacgaggacuacagaaccaaggagaccuuccugcacagaagcgacuacagcccccacaucagcugccacgacgagcugcugagaggcaccgagagaaacagagagaagcugaagggcuacagcaucagaagcgaggagagaagcagagaggccaagagacccagauacgacgacaccgugaagaucaacagcaugggcggcgaccaccccagcuucaccagcggcaccagaaacuacagacagagaagaagaagccccagccccagauuccuggaccccgaguucagagagcuggaccuggccagaagaaagagagaggaggaggaggagagaagcagaagccugagccaggagcuggugggcguggacggcggcggcaccggcugcagcauccccggccugagcggcgugcugaccgccagcgagcccggcuacagccugcacagacccgaggaggugagcgugaugcccaagaagagcauccugaagaagagaaucgagguggacaucauggagcccagcaugcagcuggagagcuucagcagcagcaccagcagcagccaggaccacccccuguacagcggccaccccagccugccccugagcggcgccaucgccgccuucgccagcgagaucgagaacaagggcaccaugguggagaccgcccugaaggagccccagggcaaccuguaccaguggggcccccugcccggcauccccaaggacaacagcccccugagagagaaguucggcagcuuccugugccacaaggacaaccuggaccugaaggccgagggccccgagagacacaccgacuuccugcugccccacgagagagccagccaggacggcagcggcuucagcagaauccugagcaugcuggccgacagcaccagcacccaggagaagagaagaagaagcuuccccgacaucgaggacgaggagaaguuccuguacggcgacgaggaggaggaccugaaggccgagagcgugcccaagccccugggcagcagcgagagcgaggugaugagacagaaggccagcagccugcccagcagcgcccccgccgugaagcuggagagccuggaggagaccaaccccgaguacgccaagauccacgaccugcugaagaccaucggccuggacaucggcguggccgagaucagccagcuggccgccagaacccaggagagacugcacggcaagaagcccagccugagaagcagcgccgacagaagaagcagcguggacagauacuucagcgccgaccacugcagcagcguggaccacagauucagcgccgacagaugcagcagcguggaccacugcuucagcgccgacagaagaagcagcgacccccacagacuggagagcagagaggcccaccacagcaacacccacagccccgaggugagccacccccacccccccagccccguggaccccuaccugcugaccaagaacagcccccccuuccugaagagcgaccaccccgugggccacaucagcggccccgagguggugggcagcggcuuccagagcagcguggccgugagaugcaugcugcccagcgcccccagcgcccccaucagacugccccacaccgccgcccugagccaguuccacaugcccagagccagccaguucgccgccgccagaaucccccccaacuaccagggccccgccaucccccccgccagcuucgacgccuacagacacuacauggccuacgccgccagcagauggcccauguaccccaccagccagcccagcaaccaccccgugcccgagccccacagaaucaugcccaucaccaagcaggccaccagaagcagacccaaccugagagugauccccaccgugacccccgacaagcccaagcagaaggagagccugagaggcagcauccccgccgcccaggugcccgugcaggugagcauccccagccugaucagauacaaccccgagaagaucagcgacgagaagaacagagccagccagaagcagaaggugaucgaggagagagagaagcugaagaacgacagagaggccagacagaagaagauguacuaccugagaaccgagcuggagagacugcacaagcagcagggcgagaugcugagaaagaagagaagagagaaggacggccacaaggacccccugcugguggaggugagcagacugcaggacaacaucaugaaggacaucgccgagcugagacaggaggccgaggaggccgagaagaagcagagcgagcuggacaagguggcccagauccugggcaucaacaucuucgacaagagccagaagagccugagcgacagcagagagcccaccgagaagcccggcaaggccgagaagagcaagagccccgagaaggugagcagcuucagcaacagcagcagcaacaaggagagcaaggugaacaacgagaaguucagaaccaagagccccaagcccgccgagagcccccagagcgccaccaagcagcuggaccagcccaccgccgccuacgaguacuacgacgccggcaaccacuggugcaaggacugcaacaccaucugcggcaccauguucgacuucuucacccacaugcacaacaagaagcacacccagacccuggaccccuacaacagacccugggccagcaagacccagagcgaggccaagcaggacgccaucaagagaaccgacaagaucaccgugcccgccaagggcagcgaguuccuggugcccaucagcggcuucuacugccagcugugcgaggaguuccugggcgaccccaucagcggcgagcagcacgugaagggccaccagcacaacgagaaguacaagaaguacguggacgagaacccccuguacgaggagagaagaaaccuggacagacaggccggccuggccguggugcuggagaccgagagaagaagacagagcgagcugaagagaaagcugagcgagaagcccaaggaggagaagaaggagaagaaggccaaggccgugaaggaggugaaggaggacgacaaggugagcgagaagcuggaggaccagcugagcgagggcagaaacagccccgagaaggccgagaacaagagaaacaccggcaucaagcugcagcugaaggaggaggugaagaaggagagccccaccagcagcagcuucggcaaguucagcuggaagaagcccgagaaggaggaggagaagagcagccuggugacccccagcaucagcaaggaggagauccuggagagcagcaaggacaaggaggacggcaagaccgaggccggcaaggccaagcccaucaagaucaagcugagcggcaagaccgugguggcccacaccagccccuggaugcccguggugaccaccagcacccagaccaagaucagacccaaccugcccauccccagcaccgugcugagaaagagcugcagcgccaccaugagcaagcccgccccccugaacaccuuccugagcaucaagagcagcggcaccaccgccaagccccugcccguggugaaggagagcagcgccgaccugcugcugccccccgacaucaucagcaaggccuucggcggcgaggaggugauccugaagggcagccccgaggagaagguggugcuggccgagaagagcgagcccagccaccugcccgagcagauccugcccccccccccccccccccccccccccccccccccccccccccccgugaucccccaccccgccgcccccagcgccgcccaggccaacgccauccuggcccccgugaagagcaaccccguggugagccagacccugagccccggcuucgugggccccaacauccugaaccccgugcugcccguggccaucauggccagcgcccagcccgccgccauccccagcgacgagaccgcccccggcgugagcgagagcgacagagaccagacccuguucagcgugcuggugagacccccccccccccugagcagcguguucagcgagcaggccaagaagcuggagaagagaaacagcugccuggccaccgccaacgccaaggaccuguacgacaucuucuacagcagcggcggcaagggcgcccccgagaccaagggcgcccccgagaccaagcugagcggcggcccccuggccaacggcgagaacagcaaccugagcagaaccaagagcagcgacaccagcagcaccagcccccugaacagcagcgccagccaggaggagcugcaccaggacgagggccugguggccgcccccaucgugagcaacagcgagaagcccaucgccaagacccugguggcccugggcaaguggagcgugguggagcacgugggccccaagagcaccggcagcaccuacggcuuccugcagccccugaccagacugugccagagcagacccuacgagaccaucacccccaagaccgacacccuggccaucuggaccagcagcagcuuccagagcgacaccagcagagacaucagccccgagaagagcgagcuggaccugggcgagcccggcccccccggcguggagccccccccccagcugcuggacauccagugcaaggagagccagaagcugguggagauccaccugagagagagcgugaaccaggacaaggagagccaggagcugagaaagagcgaggacugcagagagagcgagaucgagaccaacaccgagcugaaggagagagugaaggagcugagcgagggcaucguggacgagggcgugagcaccagcaucggcccccacagcaucgacgacagcaaccugaaccacggcaacagauacaugugggagggcgaggugaagcagcccaaccugcugaugaucgacaaggaggccgagcagagcaacaagcugaugaccggcagcgagacccccagcaagguggugaucaagcugagcccccaggccugcagcuucaccaaggccaagcuggacagcuuccugagcgaggccagaagccugcugaacccccaggacacccccgugaagaucagcgcccccgagcugcugcugcacagccccgccagaagcgccaugugccugaccggcagcccccaggagcagggcgugagcguggugagcgaggagggccuggagaacagcgcccccgagagcgccagcagaaccagcagauacagaagccugaagcugaagagagagagaagcaaggacuuccaggugaagaagaucuacgagcuggccgugugggacgagaacaagaagagacccgagaccugggagagccccgagaagcccaagaccgaggcccuggagcugcaggacgugcaccccgagcugaccgugaccaucgagagcaaggcccuggaggacuucgaggccaccgaccugaagguggaggagcugaccgcccugggcaaccugggcgacaugcccguggacuucugcaccaccagagugagccccgcccacagaagccccaccgugcugugccagaaggugugcgaggagaacagcgugagccccaucggcugcaacagcagcgaccccgccgacuucgagcccauccccagcuucagcggcuucccccuggacagccccaagacccuggugcuggacuucgagaccgagggcgagagaaacagccccaaccccagaagcgugagaauccccagccccaacauccugaagaccggccugaccgagaacguggacagaggccugggcggccuggagggcacccaccaggcccuggaccugcuggccggcggcaugaugcccgaggaggugaaggagagcagccagcuggacaagcaggagagccugggccuggagcugaagaccaucaacagcgccggccugggccccagccccugccugcccgaccugguggacuucgugaccagaaccagcggcgugcagaaggacaagcugugcagcccccugagcgagcccggcgaccccagcaagugcagcagccuggagcugggcccccugcagcuggagaucagcaacgccagcaccaccgagguggccauccugcagguggacgacgacagcggcgacccccugaaccuggugaaggcccccgugagcagaagcccccccagagagcaggugaucgaggacaacauggugccccagggcaugcccgagcaggagaccaccgugggcgccauccaggaccacaccgagagcagcgugcacaacuaa

SEQ ID NO: 25967 - RNA, 1530 nt, Artificial Sequence
  ZNF320__Homo_sapiens__NP_997216
auggcccugagccagggccugcugaccuucagagacguggccaucgaguucagccaggaggaguggaagugccuggaccccgcccagagaacccuguacagagacgugaugcuggagaacuacagaaaccuggugagccuggacaucagcagcaagugcaugaugaacacccugagcagcaccggccagggcaacaccgaggugauccacaccggcacccugcagagacaggccagcuaccacaucggcgccuucugcagccaggagaucgagaaggacauccacgacuucguguuccaguggcaggaggacgagaccaacgaccacgaggcccccaugaccgagaucaagaagcugaccagcagcaccgacagauacgaccagagacacgccggcaacaagcccaucaagggccagcuggagagcagauuccaccugcaccugagaagacacagaagaauccacaccggcgagaagcccuacaagugcgaggagugcgagaagguguucagcugcaagagccaccuggagauccacagaaucauccacaccggcgagaagcccuacaagugcaaggugugcgacaaggccuucaagcacgacagccaccuggccaagcacaccagaauccacagaggcgacaagcacuacaccugcaacgagugcggcaagguguucgaccagaaggccacccuggccugccaccacagaagccacaccggcgagaagcccuacaagugcaacgagugcggcaagaccuucagccagaccagccaccugguguaccaccacagacugcacaccggcgagaagcccuacaagugcaacgagugcggcaagaccuucgccagaaacagcgugcuggugauccacaaggccgugcacaccgccgagaagcccuacaagugcaacgagugcggcaagguguucaagcagagagccacccuggccggccacagaagagugcacaccggcgagaagcccuacagaugcgaggagugcgacaagguguucagcagaaagagccaccuggagagacacagaagaauccacaccggcgagaagcccuacaagugcaaggugugcgacaaggccuucagaagcgacagcagacuggccgagcaccagagagugcacaccggcgagagacccuacaccugcaacgagugcggcaagguguucagcaccaaggccuaccuggccugccaccagaagcugcacaccggcgagaagcuguacgagugcgaggagugcgacaagguguacaucagaaagagccaccuggagagacacagaagaauccacaccggcgagaagccccacaagugcggcgacugcggcaaggccuucaacagccccagccaccugaucagacaccagagaauccacaccggccagaagagcuacaagugccaccagugcggcaagguguucagccugagaagccugcuggccgagcaccagaagauccccuucggcgacaacugcuucaagugcaacgaguacagcaagcccagcagcaucaacuaa

SEQ ID NO: 25968 - RNA, 1209 nt, Artificial Sequence
  ZNF322__Homo_sapiens__NP_001229728
auguacaccagcgaggagaagugcaaccagagaacccagaagagaaagaucuacaacgugugccccagaaagggcaagaagaucuucauccacaugcacgagaucauccagaucgacggccacaucuaccagugccuggagugcaagcagaacuucugcgagaaccuggcccugaucaugugcgagagaacccacaccggcgagaagcccuacaagugcgacaugugcgagaagaccuucgugcagagcagcgaccugaccagccaccagagaauccacaacuacgagaagcccuacaagugcagcaagugcgagaagagcuucuggcaccaccuggcccugagcggccaccagagaacccacgccggcaagaaguucuacaccugcgacaucugcggcaagaacuucggccagagcagcgaccugcuggugcaccagagaagccacaccggcgagaagcccuaccugugcagcgagugcgacaagugcuucagcagaagcaccaaccugaucagacacagaagaacccacaccggcgagaagcccuucaagugccuggagugcgagaaggccuucagcggcaagagcgaccugaucagccaccagagaacccacaccggcgagagacccuacaagugcaacaagugcgagaagagcuacagacacagaagcgccuucaucgugcacaagagagugcacaccggcgagaagcccuacaagugcggcgccugcgagaagugcuucggccagaagagcgaccugaucgugcaccagagagugcacaccggcgagaagcccuacaagugccuggagugcaugagaagcuucaccagaagcgccaaccugaucagacaccaggccacccacacccacaccuucaagugccuggaguacgagaagagcuucaacugcagcagcgaccugaucgugcaccagagaauccacauggaggagaagccccaccaguggagcgccugcgagagcggcuuccugcugggcauggacuucguggcccagcagaagaugagaacccagaccgaggagcugcacuacaaguacaccgugugcgacaagagcuuccaccagagcagcgcccugcugcagcaccagaccgugcacaucggcgagaagcccuucgugugcaacgugagcgagaagggccuggagcugagccccccccacgccagcgaggccagccagaugagcuaa

SEQ ID NO: 25969 - RNA, 822 nt, Artificial Sequence
  ZNF32__Homo_sapiens__NP_001005368
auguucggcuuccccaccgccacccugcuggacugccacggcagauacgcccagaacguggccuucuucaacgugaugaccgaggcccaccacaaguacgaccacagcgaggccaccggcagcagcagcugggacauccagaacagcuucagaagagagaagcuggagcagaagagccccgacagcaagacccugcaggaggacagccccggcgugagacagagaguguacgagugccaggagugcggcaagagcuucagacagaagggcagccugacccugcacgagagaauccacaccggccagaagcccuucgagugcacccacugcggcaagagcuucagagccaagggcaaccuggugacccaccagagaauccacaccggcgagaagcccuaccagugcaaggagugcggcaagagcuucagccagagaggcagccuggccgugcacgagagacugcacaccggccagaagcccuacgagugcgccaucugccagagaagcuucagaaaccagagcaaccuggccgugcacagaagagugcacagcggcgagaagcccuacagaugcgaccagugcggcaaggccuucagccagaagggcagccugaucgugcacaucagagugcacaccggccugaagcccuacgccugcacccagugcagaaagagcuuccacaccagaggcaacugcauccugcacggcaagauccacaccggcgagacccccuaccugugcggccagugcggcaagagcuucacccagagaggcagccuggccgugcaccagagaagcugcagccagagacugacccuguaa

SEQ ID NO: 25970 - RNA, 783 nt, Artificial Sequence
  ZNF330__Homo_sapiens__NP_001278931
augccccaguggaacgugaccagcgugagaggcaagaccaagugcaugaugaagagcagcgacugcgugaucaagcacgccggcguguacagcaccggccuggccauggugggcgccaucugcgacuucugcgaggccugggugugccacggcagaaagugccugagcacccacgccugcgccugcccccugaccgacgccgagugcguggagugcgagagaggcgugugggaccacggcggcagaaucuucagcugcagcuucugccacaacuuccugugcgaggacgaccaguucgagcaccaggccagcugccaggugcuggaggccgagaccuucaagugcgugagcugcaacagacugggccagcacagcugccugagaugcaaggccugcuucugcgacgaccacaccagaagcaagguguucaagcaggagaagggcaagcagccccccugccccaagugcggccacgagacccaggagaccaaggaccugagcaugagcaccagaagccugaaguucggcagacagaccggcggcgaggagggcgacggcgccagcggcuacgacgccuacuggaagaaccugagcagcgacaaguacggcgacaccagcuaccacgacgaggaggaggacgaguacgaggccgaggacgacgaggaggaggaggacgagggcagaaaggacagcgacaccgagagcagcgaccuguucaccaaccugaaccugggcagaaccuacgccagcggcuacgcccacuacgaggagcaggagaacuaa

SEQ ID NO: 25971 - RNA, 1392 nt, Artificial Sequence
  ZNF331__Homo_sapiens__NP_061025
auggcccagggccuggugaccuucgccgacguggccaucgacuucagccaggaggagugggccugccugaacagcgcccagagagaccuguacugggacgugaugcuggagaacuacagcaaccuggugagccuggaccuggagagcgccuacgagaacaagagccugcccaccgagaagaacauccacgagaucagagccagcaagagaaacagcgacagaagaagcaagagccugggcagaaacuggaucugcgagggcacccuggagagaccccagagaagcagaggcagauacgugaaccagaugaucaucaacuacgugaagagacccgccaccagagagggcaccccccccagaacccaccagagacaccacaaggagaacagcuucgagugcaaggacugcggcaaggccuucagcagaggcuaccagcugagccagcaccagaagauccacaccggcgagaagcccuacgagugcaaggagugcaagaaggccuucagauggggcaaccagcugacccagcaccagaagauccacaccggcgagaagcccuacgagugcaaggacugcggcaaggccuucagauggggcagcagccuggugauccacaagagaauccacaccggcgagaagcccuacgagugcaaggacugcggcaaggccuucagaagaggcgacgagcugacccagcaccagagauuccacaccggcgagaaggacuacgagugcaaggacugcggcaagaccuucagcagaguguacaagcugauccagcacaagagaauccacagcggcgagaagcccuacgagugcaaggacugcggcaaggccuucaucugcggcagcagccugauccagcacaagagaauccacaccggcgagaagcccuacgagugccaggagugcggcaaggccuucaccagagugaacuaccugacccagcaccagaagauccacaccggcgagaagccccacgagugcaaggagugcggcaaggccuucagauggggcagcagccuggugaagcacgagagaauccacaccggcgagaagcccuacaagugcaccgagugcggcaaggccuucaacugcggcuaccaccugacccagcacgagagaauccacaccggcgagacccccuacaagugcaaggagugcggcaaggccuucaucuacggcagcagccuggugaagcacgagagaauccacaccggcgugaagcccuacggcugcaccgagugcggcaagagcuucagccacggccaccagcugacccagcaccagaagacccacagcggcgccaagagcuacgagugcaaggagugcggcaaggccugcaaccaccugaaccaccugagagagcaccagagaauccacaacagcuaa

SEQ ID NO: 25972 - RNA, 2112 nt, Artificial Sequence
  ZNF334__Homo_sapiens__XP_011527196
augugcguguuccugcaccugcugagcuacaucaaggacaccagcuucauccccggccccgacugcgagcugcaccccagaggcauggccgccaccggccccugcagcgaggcccccgugcagggcugcgacgccggcgagcugcagcagcugggccugugcggcgugagcgacgugcagagaagcuggagcaaguucugcaacuucccccugaccggcuaccacgugagcaagcccgacgugaucuucaagcuggagcagggcgaggagcccuggaucguggaggaguucagcaaccagaacuaccccgacaucgacgacgcccuggagaagaacaaggagauccaggacaagcaccugacccagaccguguucuucagcaacaagacccugaucaccgagagagagaacguguucggcaagacccugaaccugggcaugaacagcgugcccagcagaaagaugcccuacaagugcaaccccggcggcaacagccugaagaccaacagcgaggugaucguggccaagaagagcaaggagaacagaaagauccccgacggcuacagcggcuucggcaagcacgagaagagccaccugggcaugaagaaguacagauacaaccccaugagaaaggccagcaaccagaacgagaaccugauccugcaccagaacauccagauccugaagcagcccuucgacuacaacaagugcggcaagaccuucuucaagagagccauccugaucacccagaagggcagacagaccgagagaaagcccaacgagugcaacgagugcagaaagaccuucagcaagagaagcacccugaucgugcaccagagaauccacaccggcgagaagcccuacgugugcagcgacugcagaaagaccuucagagugaagaccagccugaccagacacagaagaauccacaccggcgagagacccuacgagugcagcgagugcagaaagaccuucaucgacaagagcgcccugaucgugcaccagaagauccacggcggcgagaagagcuacgagugcaacgagugcggcaagaccuucuucagaaagagcgcccuggccgagcacuucagaagccacaccggcgagaagcccuacgagugcaaggagugcggcaacgccuucagcaagaagagcuaccugguggugcaccagagaacccacagaggcgagaagcccaacgagugcaaggagugcggcaagaccuucuucugccagagcgcccugaccgcccaccagagaauccacaccggcgagaagcccuacgagugcagcgagugcgagaagaccuucuucugccagagcgcccugaacgugcacagaagaagccacaccggcgagaagcccuacgagugcagccagugcggcaaguuccugugcaccaagagcgcccugaucgcccaccagaucacccacagaggcaagaagagcuacgagugcaacgagugcggcaaguucuucugccacaagagcacccugaccauccaccagagaacccacaccggcgagaagcacggcguguucaacaagugcggcagaaucagcaucgugaagagcaacugcagccagugcaagagaaugaacaccaaggagaaccuguacgagugcagcgagcacggccacgccgugagcaagaacagccaccugaucgugcaccagagaaccaucugggagagacccuacgagugcaacgagugcggcagaaccuacugcagaaagagcgcccugacccaccaccagagaacccacaccggccagagacccuacgagugcaacgagugcggcaagaccuucugccagaaguucagcuucguggagcaccagagaacccacaccggcgagaagcccuacgagugcaacgagugcggcaagagcuucugccacaagagcgccuucagagugcacagaagaauccacaccggcgagaagcccuacgagugcaaccagugcggcaagaccuacagaagacuguggacccugaccgagcaccagaagauccacaccggcgagaagcccuacgagugcaacaagugcgagaagaccuucagacacaagagcaacuuccugcugcaccagaagagccacaaggaguaa

SEQ ID NO: 25973 - RNA, 4029 nt, Artificial Sequence
  ZNF335__Homo_sapiens__NP_071378
auggaggagaacgagguggagagcagcagcgacgccgcccccggccccggcagacccgaggagcccagcgagagcggccugggcgugggcaccagcgaggccgugagcgccgacagcagcgacgccgccgccgcccccggccaggccgaggccgacgacagcggcgugggccagagcagcgacagaggcagcagaagccaggaggaggugagcgagagcagcagcagcgccgacccccugcccaacagcuaccugcccgacagcagcagcgugagccacggccccguggccggcgugaccggcggcccccccgcccuggugcacagcagcgcccugcccgaccccaacaugcuggugagcgacugcaccgccagcagcagcgaccugggcagcgccaucgacaagaucaucgagagcaccaucggccccgaccugauccagaacugcaucaccgugaccagcgccgaggacggcggcgccgagaccaccagauaccugauccugcagggccccgacgacggcgcccccaugaccagccccaugagcagcagcacccuggcccacagccuggccgccaucgaggcccuggccgacggccccaccagcaccagcaccugccuggaggcccagggcggccccagcagccccgugcagcugccccccgccagcggcgccgaggagcccgaccugcagagccuggaggccaugauggagguggugguggugcagcaguucaagugcaagaugugccaguacagaagcagcaccaaggccacccugcugagacacaugagagagagacacuucagacccguggccgccgccgccgccgccgccggcaagaagggcagacugagaaaguggagcaccagcaccaagagccaggaggaggagggccccgaggaggaggacgacgacgacaucguggacgccggcgccaucgacgaccuggaggaggacagcgacuacaaccccgccgaggacgagcccagaggcagacagcugagacugcagagacccacccccagcacccccagacccagaagaagacccggcagacccagaaagcugcccagacuggagaucagcgaccugcccgacggcguggagggcgagccccuggugagcagccagagcggccagagcccccccgagccccaggaccccgaggcccccagcagcagcggccccggccaccugguggccaugggcaaggugagcagaacccccguggaggccggcgugagccagagcgacgccgagaacgccgcccccagcugccccgacgagcacgacacccugcccagaagaagaggcagacccagcagaagauuccugggcaagaaguacagaaaguacuacuacaagagccccaagccccugcugagacccuuccugugcagaaucugcggcagcagauuccugagccacgaggaccugagauuccacgugaacagccacgaggccggcgacccccagcuguucaagugccugcagugcagcuacagaagcagaagauggagcagccugaaggagcacauguucaaccacgugggcagcaagcccuacaagugcgacgagugcagcuacaccagcguguacagaaaggacgugaucagacacgccgccgugcacagcagagacagaaagaagagacccgaccccacccccaagcugagcagcuuccccugccccgugugcggcagaguguaccccaugcagaagagacugacccagcacaugaagacccacagcaccgagaagccccacaugugcgacaagugcggcaagagcuucaagaagagauacaccuucaagaugcaccugcugacccacauccaggccguggccaacagaagauucaagugcgaguucugcgaguucgugugcgaggacaagaaggcccugcugaaccaccagcugagccacgugagcgacaagcccuucaagugcagcuucugccccuacagaaccuucagagaggacuuccugcugagccacguggccgugaagcacaccggcgccaagcccuucgccugcgaguacugccacuucagcaccagacacaagaagaaccugagacugcacgugagaugcagacacgccagcagcuucgaggaguggggcagaagacaccccgaggagccccccagcagaagaagacccuucuucagccugcagcagaucgaggagcugaagcagcagcacagcgccgcccccggccccccccccagcagccccggcccccccgagaucccccccgaggccaccaccuuccagagcagcgaggcccccagccugcugugcagcgacacccugggcggcgccaccaucaucuaccagcagggcgccgaggagagcaccgccauggccacccagaccgcccuggaccugcugcugaacaugagcgcccagagagagcugggcggcaccgcccugcagguggccguggugaagagcgaggacguggaggccggccuggccagccccggcggccagcccagccccgagggcgccaccccccagguggugacccugcacguggccgagcccggcggcggcgccgccgccgagagccagcugggcccccccgaccugccccagaucacccuggcccccggccccuucggcggcaccggcuacagcgugaucaccgccccccccauggaggagggcaccagcgcccccggcacccccuacagcgaggagcccgccggcgaggccgcccaggccgugguggugagcgacacccugaaggaggccggcacccacuacaucauggccaccgacggcacccagcugcaccacaucgagcugaccgccgacggcagcaucagcuuccccagccccgacgcccuggccagcggcgccaaguggccccugcugcagugcggcggccugcccagagacggccccgagccccccagccccgccaagacccacugcgugggcgacagccagagcagcgccagcagcccccccgccaccagcaaggcccugggccuggccgugccccccagcccccccagcgccgccaccgccgccagcaagaaguucagcugcaagaucugcgccgaggccuuccccggcagagccgagauggagagccacaagagagcccacgccggccccggcgccuucaagugccccgacugccccuucagcgccagacaguggcccgaggugagagcccacauggcccagcacagcagccugagaccccaccagugcagccagugcagcuucgccagcaagaacaagaaggaccugagaagacacaugcugacccacaccaaggagaagcccuucgccugccaccugugcggccagagauucaacagaaacggccaccugaaguuccacauccagagacugcacagccccgacggcagaaagagcggcacccccaccgccagagcccccacccagacccccacccagaccaucauccugaacagcgacgacgagacccuggccacccugcacaccgcccugcagagcagccacggcgugcugggccccgagagacugcagcaggcccugagccaggagcacaucaucguggcccaggagcagaccgugaccaaccaggaggaggccgccuacauccaggagaucaccaccgccgacggccagaccgugcagcaccuggugaccagcgacaaccaggugcaguacaucaucagccaggacggcgugcagcaccugcugccccaggaguacgugguggugcccgagggccaccacauccaggugcaggagggccagaucacccacauccaguacgagcagggcgcccccuuccugcaggagagccagauccaguacgugcccgugagccccggccagcagcuggugacccaggcccagcuggaggccgccgcccacagcgccgugaccgccguggccgacgccgccauggcccaggcccagggccuguucggcaccgacgagaccgugcccgagcacauccagcagcugcagcaccagggcaucgaguacgacgugaucacccuggccgacgacuaa

SEQ ID NO: 25974 - RNA, 1800 nt, Artificial Sequence
  ZNF343__Homo_sapiens__NP_001269424
augaugcugcccuaccccagcgcccugggcgaccaguacugggaggagauccugcugcccaagaacggcgagaacguggagaccaugaagaagcugacccagaaccacaaggccaagggccugcccagcaacgacaccgacugcccccagaagaaggagggcaaggcccagaucguggugcccgugaccuucagagacgugaccgugaucuucaccgaggccgaguggaagagacugagccccgagcagagaaaccuguacaaggaggugaugcuggagaacuacagaaaccugcugagccuggccgagcccaagcccgagaucuacaccugcagcagcugccugcuggccuucagcugccagcaguuccugagccagcacgugcugcagaucuuccugggccugugcgccgagaaccacuuccaccccggcaacagcagccccggccacuggaagcagcagggccagcaguacagccacgugagcugcugguucgagaacgccgagggccaggagagaggcggcggcagcaagcccuggagcgccagaaccgaggagagagagaccagcagagccuuccccagcccccugcagagacagagcgccagccccagaaagggcaacauggugguggagaccgagcccagcagcgcccagagacccaaccccgugcagcuggacaagggccugaaggagcuggagacccugagauucggcgccaucaacugcagagaguacgagcccgaccacaaccuggagagcaacuucaucaccaaccccagaacccugcugggcaagaagcccuacaucugcagcgacugcggcagaagcuucaaggacagaagcacccugaucagacaccacagaauccacagcauggagaagcccuacgugugcagcgagugcggcagaggcuucagccagaagagcaaccugagcagacaccagagaacccacagcgaggagaagcccuaccugugcagagagugcggccagagcuucagaagcaagagcauccugaacagacaccaguggacccacagcgaggagaagcccuacgugugcagcgagugcggcagaggcuucagcgagaagagcagcuucaucagacaccagagaacccacagcggcgagaagcccuacgugugccuggagugcggcagaagcuucugcgacaagagcacccugagaaagcaccagagaauccacagcggcgagaagcccuacgugugcagagagugcggcagaggcuucagccagaacagcgaccugaucaagcaccagagaacccaccuggacgagaagcccuacgugugcagagagugcggcagaggcuucugcgacaagagcacccugaucauccacgagagaacccacagcggcgagaagcccuacgugugcggcgagugcggcagaggcuucagcagaaagagccugcugcuggugcaccagagaacccacagcggcgagaagcacuacgugugcagagagugcagaagaggcuucagccagaagagcaaccugaucagacaccagagaacccacagcaacgagaagcccuacaucugcagagagugcggcagaggcuucugcgacaagagcacccugaucgugcacgagagaacccacagcggcgagaagcccuacgugugcagcgagugcggcagaggcuucagcagaaagagccugcugcuggugcaccagagaacccacagcggcgagaagcacuacgugugcagagagugcggcagaggcuucagccacaagagcaaccugaucagacaccagagaacccacuaa

SEQ ID NO: 25975 - RNA, 1599 nt, Artificial Sequence
  ZNF350__Homo_sapiens__NP_067645
augauccaggcccaggagagcaucacccuggaggacguggccguggacuucaccugggaggaguggcagcugcugggcgccgcccagaaggaccuguacagagacgugaugcuggagaacuacagcaaccugguggccgugggcuaccaggccagcaagcccgacgcccuguucaagcuggagcagggcgagcagcuguggaccaucgaggacggcauccacagcggcgccugcagcgacaucuggaagguggaccacgugcuggagagacugcagagcgagagccuggugaacagaagaaagcccugccacgagcacgacgccuucgagaacaucgugcacugcagcaagagccaguuccugcugggccagaaccacgacaucuucgaccugagaggcaagagccugaagagcaaccugacccuggugaaccagagcaagggcuacgagaucaagaacagcguggaguucaccggcaacggcgacagcuuccugcacgccaaccacgagagacugcacaccgccaucaaguuccccgccagccagaagcugaucagcaccaagagccaguucaucagccccaagcaccagaagaccagaaagcuggagaagcaccacgugugcagcgagugcggcaaggccuucaucaagaagagcuggcugaccgaccaccaggugaugcacaccggcgagaagccccacagaugcagccugugcgagaaggccuucagcagaaaguucaugcugaccgagcaccagagaacccacaccggcgagaagcccuacgagugccccgagugcggcaaggccuuccugaagaagagcagacugaacauccaccagaagacccacaccggcgagaagcccuacaucugcagcgagugcggcaagggcuucauccagaagggcaaccugaucgugcaccagagaauccacaccggcgagaagcccuacaucugcaacgagugcggcaagggcuucauccagaagaccugccugaucgcccaccagagauuccacaccggcaagacccccuucgugugcagcgagugcggcaagagcugcagccagaagagcggccugaucaagcaccagagaauccacaccggcgagaagcccuucgagugcagcgagugcggcaaggccuucagcaccaagcagaagcugaucgugcaccagagaacccacaccggcgagagacccuacggcugcaacgagugcggcaaggccuucgccuacaugagcugccuggugaagcacaagagaauccacaccagagagaagcaggaggccgccaagguggagaacccccccgccgagagacacagcagccugcacaccagcgacgugaugcaggagaagaacagcgccaacggcgccaccacccaggugcccagcguggccccccagaccagccugaacaucagcggccugcuggccaacagaaacguggugcuggugggccagcccguggugagaugcgccgccagcggcgacaacagaggcuucgcccaggacagaaaccuggugaacgccgugaacgugguggugcccagcgugaucaacuacgugcuguucuacgugaccgagaaccccuaa

SEQ ID NO: 25976 - RNA, 1818 nt, Artificial Sequence
  ZNF354A__Homo_sapiens__NP_005640
auggccgccggccagagagaggccagaccccaggugagccugaccuucgaggacguggccgugcuguucaccagagacgaguggagaaagcuggcccccagccagagaaaccuguacagagacgugaugcuggagaacuacagaaaccuggugagccugggccugcccuucaccaagcccaaggugaucagccugcugcagcagggcgaggaccccugggagguggagaaggacggcagcggcgugagcagccugggcagcaagagcagccacaagaccaccaagagcacccagacccaggacagcagcuuccagggccugauccugaagagaagcaacagaaacgugcccugggaccugaagcuggagaagcccuacaucuacgagggcagacuggagaagaagcaggacaagaagggcagcuuccagaucgugagcgccacccacaagaagauccccaccaucgagagaagccacaagaacaccgagcugagccagaacuucagccccaagagcgugcugaucagacagcagauccugcccagagagaagaccccccccaagugcgagauccagggcaacagccugaagcagaacagccagcugcugaaccagcccaagaucaccgccgacaagagauacaagugcagccugugcgagaagaccuucaucaacaccagcagccugagaaagcacgagaagaaccacagcggcgagaagcuguucaagugcaaggagugcagcaaggccuucagccagagcagcgcccugauccagcaccagaucacccacaccggcgagaagcccuacaucugcaaggagugcggcaaggccuucacccugagcaccagccuguacaagcaccugagaacccacaccguggagaagagcuacagaugcaaggagugcggcaagagcuucagcagaagaagcggccuguucauccaccagaagauccacgccgaggagaaccccugcaaguacaaccccggcagaaaggccagcagcugcagcaccagccugagcggcugccagagaauccacagcagaaagaagagcuaccugugcaacgagugcggcaacaccuucaagagcagcagcagccugagauaccaccagagaauccacaccggcgagaagcccuucaagugcagcgagugcggcagagccuucagccagagcgccagccugauccagcacgagagaauccacaccggcgagaagcccuacagaugcaacgagugcggcaagggcuucaccagcaucagcagacugaacagacacagaaucauccacaccggcgagaaguucuacaacugcaacgagugcggcaaggcccugagcagccacagcacccugaucauccacgagagaauccacaccggcgagaagcccugcaagugcaaggugugcggcaaggccuucagacagagcagcgcccugauccagcaccagagaaugcacaccggcgagagacccuacaagugcaacgagugcggcaagaccuucagaugcaacagcagccugagcaaccaccagagaauccacaccggcgagaagcccuacagaugcgaggagugcggcaucagcuucggccagagcagcgcccugauccagcacagaagaauccacaccggcgagaagcccuucaagugcaacaccugcggcaagaccuucagacagagcagcagcagaaucgcccaccagagaauccacaccggcgagaagcccuacgagugcaacaccugcggcaagcuguucaaccacagaagcagccugaccaaccacuacaagauccacaucgaggaggaccccuaa

SEQ ID NO: 25977 - RNA, 1584 nt, Artificial Sequence
  ZNF35__Homo_sapiens__NP_003411
augaccgccgagcugagagaggccauggcccuggcccccuggggccccgugaaggugaagaaggaggaggaggaggaggagaacuuccccggccaggccagcagccagcaggugcacagcgagaacaucaaggugugggcccccgugcagggccugcagaccggccuggacggcagcgaggaggaggagaagggccagaacaucagcugggacauggccguggugcugaaggccacccaggaggcccccgccgccagcacccugggcagcuacagccugcccggcacccuggccaagagcgagauccuggagacccacggcaccaugaacuuccugggcgccgagaccaagaaccugcagcugcuggugcccaagaccgagaucugcgaggaggccgagaagccccugaucaucagcgagagaauccagaaggccgacccccagggccccgagcugggcgaggccugcgagaagggcaacaugcugaagagacagagaaucaagagagagaagaaggacuucagacaggugaucgugaacgacugccaccugcccgagagcuucaaggaggaggagaaccagaagugcaagaagagcggcggcaaguacagccugaacagcggcgccgugaagaaccccaagacccagcugggccagaagcccuucaccugcagcgugugcggcaagggcuucagccagagcgccaaccugguggugcaccagagaauccacaccggcgagaagcccuucgagugccacgagugcggcaaggccuucauccagagcgccaaccugguggugcaccagagaauccacaccggccagaagcccuacgugugcagcaagugcggcaaggccuucacccagagcagcaaccugaccgugcaccagaagauccacagccuggagaagaccuucaagugcaacgagugcgagaaggccuucagcuacagcagccagcuggccagacaccagaaggugcacaucaccgagaagugcuacgagugcaacgagugcggcaagaccuucaccagaagcagcaaccugaucgugcaccagagaauccacaccggcgagaagcccuucgccugcaacgacugcggcaaggccuucacccagagcgccaaccugaucgugcaccagagaagccacaccggcgagaagcccuacgagugcaaggagugcggcaaggccuucagcugcuucagccaccugaucgugcaccagagaauccacaccgccgagaagcccuacgacugcagcgagugcggcaaggccuucagccagcugagcugccugaucgugcaccagagaauccacagcggcgaccugcccuacgugugcaacgagugcggcaaggccuucaccugcagcagcuaccugcugauccaccagagaauccacaacggcgagaagcccuacaccugcaacgagugcggcaaggccuucagacagagaagcagccugaccgugcaccagagaacccacaccggcgagaagcccuacgagugcgagaagugcggcgccgccuucaucagcaacagccaccugaugagacaccacagaacccaccugguggaguaa

SEQ ID NO: 25978 - RNA, 1224 nt, Artificial Sequence
  ZNF365__Homo_sapiens__NP_055766
augcagcagaaggccuucgaggagagcagauaccccuggcaggagagcuucgagaacguggccgugugccugccccugagaugccccagaugcggcgaccacaccagauucagaagccugagcagccugagagcccaccuggaguucagccacagcuacgaggagagaacccugcugaccaagugcagccuguuccccagccugaaggacaccgaccuggugaccagcagcgagcugcugaagcccggcaagcugcagagcagcggcaacguggugaagcagaagcccagcuacgugaaccuguacagcaucagccacgagcacagcaaggacagaaagcccuucgaggugguggccgagagacccgugagcuacgugcagaccuacaccgccauggaccugcacgccgacagccuggacggcaccagaagcggccccggccugcccaccagcgacaccaaggccagcuucgaggcccacgugagagagaaguucaacagaaugguggaggccguggacagaaccaucgagaagagaaucgacaagcugaccaaggagcuggcccagaagaccgccgagcugcuggaggugagagccgccuucgugcagcugacccagaagaagcaggaggugcagagaagagagagagcccugaacagacagguggacguggccguggagaugaucgccgugcugagacagagacugaccgagagcgaggaggagcugcugagaaaggaggaggagguggugaccuucaaccacuuccuggaggccgccgccgagaaggaggugcagggcaaggccagacugcaggacuucaucgagaaccugcugcagagaguggagcuggccgagaagcagcuggaguacuaccagagccagcaggccagcggcuucgugagagaccugagcggccacgugcugaccgacaucagcagcaacagaaagcccaagugccugagcagaggccacccccacagcgugugcaaccaccccgaccugaaggcccacuuccaccccaagggcagaaaccaccugaagaaggccaaggacgacagagccagcaugcagcccgccaaggccauccacgagcaggccgagagcagcagagaccugugcagaccccccaagaagggcgagcugcugggcuucggcagaaagggcaacaucagacccaagauggccaagaagaagcccaccgccaucgugaacaucaucuaa

SEQ ID NO: 25979 - RNA, 2235 nt, Artificial Sequence
  ZNF366__Homo_sapiens__NP_689838
augcagaaggagaugaagaugaucaaggacgaggacgugcacuucgaccuggccgugaagaagacccccagcuucccccacugccugcagcccguggccagcagaggcaaggccccccagagacaccccuuccccgaggcccugagaggccccuucagccaguucagauacgagcccccccccggcgaccuggacggcuuccccggcguguucgagggcgccggcagcagaaagagaaagagcaugcccaccaagaugcccuacaaccaccccgccgaggaggugacccuggcccugcacagcgaggagaacaagaaccacggccugcccaaccugccccugcuguucccccagccccccagacccaaguacgacagccagaugaucgaccugugcaacgugggcuuccaguucuacagaagccuggagcacuucggcggcaagcccgugaagcaggagcccaucaagcccagcgccguguggccccagcccacccccacccccuuccugcccacccccuaccccuacuaccccaaggugcaccccggccugauguuccccuucuucgugcccagcagcagccccuuccccuucagcagacacaccuuccugcccaagcagccccccgagccccugcugcccagaaaggccgagccccaggagagcgaggagaccaagcagaagguggagagaguggacgugaacgugcagaucgacgacagcuacuacguggacgugggcggcagccagaagagauggcagugccccaccugcgagaagagcuacaccagcaaguacaaccuggugacccacauccugggccacagcggcaucaagccccacgccugcacccacugcggcaagcuguucaagcagcugagccaccugcacacccacaugcugacccaccagggcaccagaccccacaagugccaggugugccacaaggccuucacccagaccagccaccugaagagacacaugaugcagcacagcgaggugaagccccacaacugcagagugugcggcagaggcuucgccuaccccagcgagcugaaggcccacgaggccaagcacgccagcggcagagagaacaucugcguggagugcggccuggacuuccccacccuggcccagcugaagagacaccugaccacccacagaggccccauccaguacaacugcagcgagugcgacaagaccuuccaguaccccagccagcugcagaaccacaugaugaagcacaaggacaucagacccuacaucugcagcgagugcggcauggaguucgugcagccccaccaccugaagcagcacagccugacccacaagggcgugaaggagcacaagugcggcaucugcggcagagaguucacccugcuggccaacaugaagagacacgugcugauccacaccaacaucagagccuaccagugccaccugugcuacaagagcuucgugcagaagcagacccugaaggcccacaugaucgugcacagcgacgugaagcccuucaagugcaagcugugcggcaaggaguucaacagaaugcacaaccugaugggccacaugcaccugcacagcgacagcaagcccuucaagugccuguacugccccagcaaguucacccugaagggcaaccugaccagacacaugaaggugaagcacggcgugauggagagaggccugcacagccagggccugggcagaggcagaaucgcccuggcccagaccgccggcgugcugagaagccuggagcaggaggagcccuucgaccugagccagaagagaagagccaaggugcccguguuccagagcgacggcgagagcgcccagggcagccacugccacgaggaggaggaggaggacaacugcuacgagguggagcccuacagccccggccuggccccccagagccagcagcugugcacccccgaggaccugagcaccaagagcgagcacgcccccgaggugcuggaggaggccugcaaggaggagaaggaggacgccagcaagggcgagugggagaagagaagcaagggcgaccugggcgccgagggcggccaggagagagacugcgccggcagagacgagugccugagccugagagccuuccagagcaccagaagaggccccagcuucagcgacuaccuguacuucaagcacagagacgagagccugaaggagcugcuggagagaaagauggagaagcaggccgugcugcugggcaucuaa

SEQ ID NO: 25980 - RNA, 1053 nt, Artificial Sequence
  ZNF367__Homo_sapiens__NP_710162
augaucagaggcuucgaggcccccauggccgagaaccccccccccccccccccccccgugaucuucugccacgacagccccaagagagugcuggugagcgugaucagaaccacccccaucaagcccaccugcggcggcggcggcgagcccgagcccccccccccccugauccccaccagccccggcuucagcgacuucaugguguaccccuggagauggggcgagaacgcccacaacgugacccugagccccggcgccgccggcgccgccgccagcgccgcccugcccgccgccgccgccgccgagcacagcggccugagaggcagaggcgcccccccccccgccgccagcgccagcgccgccgccagcggcggcgaggacgaggaggaggccagcagccccgacagcggccaccugaaggacggcaucagaagaggcagacccagagccgacaccgugagagaccugaucaacgagggcgagcacagcagcagcagaaucagaugcaacaucugcaacagaguguuccccagagagaagagccugcaggcccacaagagaacccacaccggcgagagacccuaccugugcgacuaccccgacugcggcaaggccuucgugcagagcggccagcugaagacccaccagagacugcacaccggcgagaagcccuucgugugcagcgagaacggcugccugagcagauucacccacgccaacagacacugccccaagcaccccuacgccagacugaagagagaggagcccaccgacacccugagcaagcaccaggccgccgacaacaaggccgccgccgaguggcuggccagauacugggagaugagagagcagagaacccccacccugaagggcaagcuggugcagaaggccgaccaggagcagcaggacccccuggaguaccugcagagcgacgaggaggacgacgagaagagaggcgcccagagaagacugcaggagcagagagagagacugcacggcgcccuggcccugaucgagcuggccaaccugaccggcgccccccugagacaguaa

SEQ ID NO: 25981 - RNA, 1650 nt, Artificial Sequence
  ZNF382__Homo_sapiens__NP_001243767
augagccagggcagcgugagcuucaaggacgugaccguggacuucacccaggaggaguggcagcagcuggaccccgcccagaaggcccuguacagagacgugaugcuggagaacuacugccacuucgugagcgugggcuuccacauggccaagcccgacaugaucagaaagcuggagcagggcgaggagcuguggacccagagaaucuuccccagcuacagcuaccuggaggaggacggcaagaccgaggacgugcuggugaaguucaaggaguaccaggacagacacagcagaccccugaucuucaucaaccacaagaagcugaucaaggagagaagcaacaucuacggcaagaccuucacccugggcaagaacagaaucagcaagaccauccugugcgaguacaagcccgacggcaaggugcugaagaacaucagcgagcuggugaucagaaacaucagccccaucaaggagaaguucggcgacagcaccggcugggagaagagccugcugaacaccaagcacgagaagauccaccccgccgugaaccugcacaagcagaccgagagagugcugagcggcaagcaggagcugauccagcaccagaaggugcaggcccccgagcagcccuucgaccacaacgagugcgagaagagcuuccugaugaagggcaugcuguucacccacaccagagcccacagaggcgagagaaccuucgaguacaacaaggacggcaucgccuucaucgagaagagcagccugagcgugcaccccagcaaccugauggagaagaagcccagcgccuacaacaaguacggcaaguuccugugcagaaagcccguguucaucaugccccagagaccccagaccgaggagaagcccuuccacugccccuacugcggcaacaacuucagaagaaagagcuaccugaucgagcaccagagaauccacaccggcgagaagcccuacgugugcaaccagugcggcaaggccuucagacagaagaccgcccugacccugcacgagaagacccacaucgagggcaagcccuucaucugcaucgacugcggcaagagcuucagacagaaggccacccugaccagacaccacaagacccacaccggcgagaaggccuacgagugcccccagugcggcagcgccuucagaaagaagagcuaccugaucgaccaccagagaacccacaccggcgagaagcccuaccagugcaacgagugcggcaaggccuucauccagaagaccacccugaccgugcaccagagaacccacaccggcgagaagcccuacaucugcaacgagugcggcaagagcuucugccagaagaccacccugacccugcaccagagaauccacaccggcgagaagcccuacaucugcaacgagugcggcaagagcuucagacagaaggccauccugaccgugcaccacagaauccacaccggcgagaagagcaacggcugcccccagugcggcaaggccuucagcagaaagagcaaccugaucagacaccagaagacccacaccggcgagaagcccuacgagugcaagcagugcggcaaguucuucagcugcaagagcaaccugaucgugcaccagaagacccacaagguggagaccaccggcauccaguaa

SEQ ID NO: 25982 - RNA, 1428 nt, Artificial Sequence
  ZNF383__Homo_sapiens__XP_011524892
auggccgagggcagcgugauguucagcgacgugagcaucgacuucagccaggaggagugggacugccuggaccccgugcagagagaccuguacagagacgugaugcuggagaacuacggcaaccuggugagcaugggccuguacacccccaagccccaggugaucagccugcuggagcagggcaaggagcccuggauggugggcagagagcugaccagaggccugugcagcgaccuggagagcaugugcgagaccaagcugcugagccugaagaaggagguguacgagaucgagcugugccagagagagaucaugggccugaccaagcacggccuggaguacagcagcuucggcgacgugcuggaguacagaagccaccuggccaagcagcugggcuaccccaacggccacuucagccaggagaucuucacccccgaguacaugcccaccuucauccagcagaccuuccugacccugcaccagaucaucaacaacgaggacagacccuacgagugcaagaagugcggcaaggccuucagccagaacagccaguucauccagcaccagagaauccacaucggcgagaagagcuacgagugcaaggagugcggcaaguucuucagcugcggcagccacgugaccagacaccugaagauccacaccggcgagaagcccuucgagugcaaggagugcggcaaggccuucagcugcagcagcuaccugagccagcaccagagaauccacaccggcaagaagcccuacgagugcaaggagugcggcaaggccuucagcuacugcagcaaccugaucgaccaccagagaauccacaccggcgagaagcccuacgagugcaaggugugcggcaaggccuucaccaagagcagccagcuguuccagcacgccagaauccacaccggcgagaagcccuacgagugcaaggagugcggcaaggccuucacccagagcagcaagcuggugcagcaccagagaauccacaccggcgagaagcccuacgagugcaaggagugcggcaaggccuucagcagcggcagcgcccugaccaaccaccagagaauccacaccggcgagaagcccuacgacugcaaggagugcggcaaggccuucacccagagcagccagcugagacagcaccagagaauccacgccggcgagaagcccuucgagugccuggagugcggcaaggccuucacccagaacagccagcuguuccagcaccagagaauccacaccgacgagaagcccuacgagugcaacgagugcggcaaggccuucaacaagugcagcaaccugaccagacaccugagaauccacaccggcgagaagcccuacaacugcaaggagugcggcaaggccuucagcagcggcagcgaccugaucagacaccagggcauccacaccaacaaguaa

SEQ ID NO: 25983 - RNA, 1386 nt, Artificial Sequence
  ZNF384__Homo_sapiens__NP_001035009
auggaggagagccacuucaacagcaaccccuacuucuggcccagcauccccaccgugagcggccagaucgagaacaccauguucaucaacaagaugaaggaccagcugcugcccgagaagggcugcggccuggcccccccccacuaccccacccugcugaccgugcccgccagcgugagccugcccagcggcaucagcauggacaccgagagcaagagcgaccagcugaccccccacagccaggccagcgugacccagaacaucaccguggugcccgugcccagcaccggccugaugaccgccgcccugcagguggugcccgaccugagcaagaagguggccagcacccugaccgaggagggcggcggcggcggcggcggcggcggcagcguggcccccaagccccccagaggcagaaagaagaagagaaugcuggagagcggccugcccgagaugaacgaccccuacgugcugagccccgaggacgacgacgaccaccagaaggacggcaagaccuacagaugcagaaugugcagccugaccuucuacagcaagagcgagaugcagauccacagcaagagccacaccgagaccaagccccacaagugcccccacugcagcaagaccuucgccaacagcagcuaccuggcccagcacaucagaauccacagcggcgccaagcccuacagcugcaacuucugcgagaagagcuucagacagcugagccaccugcagcagcacaccagaauccacaccggcgacagacccuacaagugcgcccaccccggcugcgagaaggccuucacccagcugagcaaccugcagagccacagaagacagcacaacaaggacaagcccuucaagugccacaacugccacagagccuacaccgacgccgccagccuggaggugcaccugagcacccacaccgugaagcacgccaagguguacaccugcaccaucugcagcagagccuacaccagcgagaccuaccugaugaagcacaugagaaagcacaacccccccgaccugcagcagcaggugcaggccgccgccgccgccgccgccguggcccaggcccaggcccaggcccaggcccaggcccaggcccaggcccaggcccaggcccaggcccaggccagccaggccagccagcagcagcagcagcagcagcagcagcagcagcagcagcagcagcagccccccccccacuuccagagccccggcgccgccccccagggcggcggcggcggcgacagcaaccccaacccccccccccagugcagcuucgaccugacccccuacaagaccgccgagcaccacaaggacaucugccugaccgugaccaccagcaccauccagguggagcaccuggccagcagcuaa

SEQ ID NO: 25984 - RNA, 1161 nt, Artificial Sequence
  ZNF385A__Homo_sapiens__NP_001124439
augauccugggcagccugagcagagccggcccccugccccugcugagacagccccccaucaugcagcccccccuggaccugaagcagauccugcccuucccccuggagcccgcccccacccugggccuguucagcaacuacagcaccauggaccccgugcagaaggccgugcugagccacaccuucggcggcccccugcugaagaccaagagacccgugaucagcugcaacaucugccagaucagauucaacagccagagccaggccgaggcccacuacaagggcaacagacacgccagaagagugaagggcaucgaggccgccaagaccagaggcagagagcccggcgugagagagcccggcgaccccgccccccccggcagcacccccaccaacggcgacggcguggcccccagacccgugagcauggagaacggccugggccccgcccccggcagccccgagaagcagcccggcagccccagcccccccagcauccccgagaccggccagggcgugaccaagggcgagggcggcacccccgcccccgccagccugcccggcggcagcaaggaggaggaggagaaggccaagagacugcuguacugcgcccugugcaagguggccgugaacagccugagccagcuggaggcccacaacaagggcaccaagcacaagaccauccuggaggccagaagcggccugggccccaucaaggccuaccccagacugggcccccccacccccggcgagcccgaggcccccgcccaggacagaaccuuccacugcgagaucugcaacgugaaggugaacagcgaggugcagcugaagcagcacaucagcagcagaagacacagagacggcguggccggcaagcccaacccccugcugagcagacacaagaagagcagaggcgccggcgagcuggccggcacccugaccuucagcaaggagcugcccaagagccuggccggcggccugcugcccagcccccuggccguggccgccgugauggccgccgccgccggcagcccccugagccugagacccgcccccgccgccccccugcugcagggcccccccaucacccacccccugcugcaccccgcccccggccccaucagaaccgcccacggccccauccuguucagccccuacuaa

SEQ ID NO: 25985 - RNA, 1188 nt, Artificial Sequence
  ZNF385B__Homo_sapiens__NP_001106868
auguggagcggccugcccagcagaggcagcaccugccacaccaccacccugcccgcccuggugagaacccccacccugaugaugcagcccagccuggacaucaagcccuucaugagcuuccccguggacagcagcagcgccgugggccuguuccccaacuucaacaccauggaccccgugcagaaggccgugaucaaccacaccuucggcgugagcaucccccccaagaagaagcaggugaucagcugcaacgugugccagcugagauucaacagcgacagccaggccgaggcccacuacaagggcagcaagcacgccaagaaggugaaggcccuggacgccaccaagaacaagcccaagauggugcccagcaaggacagcgccaaggccaaccccagcugcagcaucacccccaucaccggcaacaacagcgacaagagcgaggacaagggcaagcugaaggccagcagcagcagccagcccagcagcagcgagagcggcagcuuccugcugaagagcggcaccaccccccugccccccggcgccgccaccagccccagcaagagcaccaacggcgcccccggcaccgugguggagagcgaggaggagaaggccaagaagcugcuguacugcagccugugcaagguggccgugaacagccugagccagcuggaggcccacaacaccggcagcaagcacaagaccaugguggaggccagaaacggcgccggccccaucaagagcuaccccagacccggcagcagacugaagaugcagaacggcagcaagggcagcggccugcagaacaagaccuuccacugcgagaucugcgacgugcacgugaacagcgagauccagcugaagcagcacaucagcagcagaagacacaaggacagaguggccggcaagccccugaagcccaaguacagccccuacaacaagcugcagagaagccccagcauccuggccgccaagcuggccuuccagaaggacaugaugaagccccuggcccccgccuuccugagcagcccccuggccgccgccgccgccgugagcagcgcccugagccugccccccagacccagcgccagccuguuccaggcccccgccaucccccccgcccugcugagacccggccacggccccaucagagccacccccgccagcauccuguucgcccccuacuaa

SEQ ID NO: 25986 - RNA, 1188 nt, Artificial Sequence
  ZNF385D__Homo_sapiens__NP_078973
augagaaacaucauguacuucggcggcaccugccagagccccgcccugcccgcccuggugagaccccccgcccccccccugcagcccagccuggacaucaagcccuuccugcccuucccccuggacaccgccgccgccgugaaccuguuccccaacuucaacgccauggaccccauccagaaggccgugaucaaccacaccuucggcgugccccugccccacagaagaaagcagaucaucagcugcaacaucugccagcugagauucaacagcgacagccaggccgccgcccacuacaagggcaccaagcacgccaagaagcugaaggcccuggaggccaugaagaacaagcagaagagcgugaccgccaaggacagcgccaagaccaccuucaccagcaucaccaccaacaccaucaacaccagcagcgacaagaccgacggcaccgccggcacccccgccaucagcaccaccaccaccguggagaucagaaagagcagcgugaugaccaccgagaucaccagcaagguggagaagagccccaccaccgccaccggcaacagcagcugccccagcaccgagaccgaggaggagaaggccaagagacugcuguacugcagccugugcaagguggccgugaacagcgccagccagcuggaggcccacaacagcggcaccaagcacaagaccaugcuggaggccagaaacggcagcggcaccaucaaggccuuccccagagccggcgugaagggcaagggccccgugaacaagggcaacaccggccugcagaacaagaccuuccacugcgagaucugcgacgugcacgugaacagcgagacccagcugaagcagcacaucagcagcagaagacacaaggacagagccgccggcaagccccccaagcccaaguacagccccuacaacaagcugcagaagaccgcccacccccugggcgugaagcugguguucagcaaggagcccagcaagccccuggcccccagaauccugcccaacccccuggccgccgccgccgccgccgccgccguggccgugagcagccccuucagccugagaaccgcccccgccgccacccuguuccagaccagcgcccugccccccgcccugcugagacccgcccccggccccaucagaaccgcccacacccccgugcuguucgcccccuacuaa

SEQ ID NO: 25987 - RNA, 1077 nt, Artificial Sequence
  ZNF391__Homo_sapiens__XP_011512871
auggagagccugagaggcaacaccgcccagggccccaccaacgaggaggacuacaagaacgagggccagcugagcagacagaccaagugccccgcccagaagaagagcagcuucgagaacaccguggugagaaaggugagcgugacccugaaggagaucuucaccggcgaggagggccccgagagcagcgaguucagccugagccccaaccuggacgcccagcagaagauccccaagggccacggcagccccaucagcagaaagaacagcaaggacaacagcgaccugaucaagcaccagagacuguucagccagagaaagcccugcaagugcaacgagugcgagaaggccuucagcuaccagagcgaccugcuggugcacagcagaauccacggcggcgagaagcccuucgagugcaacaagugcggcaagagcuucagcagaagcacccaccugaucgagcaccagagaacccacaccggcgagaagcccuacgagugcaacgagugcggcaaggccuucagcagaagcacccaccugagccugcaccagagaauccacaccggcgagaagcccuacgagugcagcgagugcggcaaggccuucagcagaagcaccaaccugagccagcaccagagaacccacacccaggagagacccuacaagugcaacgagugcggcaaggccuucggcgacagaagcaccaucauccagcaccagagaauccacaccggcgagaaccccuacgagugcagcaagugcggcaaggccuucagcuggaucagcagccugaccgagcaccagagaacccacaccggcgagaaccccuacgagugcagcgagugcggcaagguguucagcagaagcagcagccugaccgagcaccagagaauccacagcggcgagaagccccacgagugcagagugugcggcaagggcuucagcagaagcagcagccugaucauccaccagagaacccacaccggcgagaagcccuacaagugcaacgacugcggcaaggccuucugccagagcagcacccugaucagacaccagcaccugcacaccaaggaguaa

SEQ ID NO: 25988 - RNA, 1542 nt, Artificial Sequence
  ZNF395__Homo_sapiens__NP_061130
auggccagcgugcugagcagaagacugggcaagagaagccugcugggcgccagagugcugggccccagcgccagcgagggccccagcgccgccccccccagcgagccccugcuggagggcgccgccccccagcccuucaccaccagcgacgacacccccugccaggagcagcccaaggaggugcugaaggcccccagcaccagcggccugcagcagguggccuuccagcccggccagaagguguacgugugguacggcggccaggagugcaccggccugguggagcagcacagcuggauggagggccaggugaccguguggcugcuggagcagaagcugcaggugugcugcagaguggaggagguguggcuggccgagcugcagggccccugcccccaggcccccccccuggagcccggcgcccaggcccuggccuacagacccgugagcagaaacaucgacgugcccaagagaaagagcgacgccguggagauggacgagaugauggccgccauggugcugaccagccugagcugcagccccguggugcagagcccccccggcaccgaggccaacuucagcgccagcagagccgccugcgaccccuggaaggagagcggcgacaucagcgacagcggcagcagcaccaccagcggccacuggagcggcagcagcggcgugagcacccccagccccccccacccccaggccagccccaaguaccugggcgacgccuucggcagcccccagaccgaccacggcuucgagaccgaccccgaccccuuccugcuggacgagcccgcccccagaaagagaaagaacagcgugaaggugauguacaagugccuguggcccaacugcggcaaggugcugagaagcaucgugggcaucaagagacacgugaaggcccugcaccugggcgacaccguggacagcgaccaguucaagagagaggaggacuucuacuacaccgaggugcagcugaaggaggagagcgccgccgccgccgccgccgccgccgccggcacccccgugcccggcacccccaccagcgagcccgcccccacccccagcaugaccggccugccccugagcgcccugccccccccccugcacaaggcccagagcagcggccccgagcaccccggccccgagagcagccugcccagcggcgcccugagcaagagcgcccccggcagcuucuggcacauccaggccgaccacgccuaccaggcccugcccagcuuccagauccccgugagcccccacaucuacaccagcgugagcugggccgccgcccccagcgccgccugcagccugagccccgugagaagcagaagccugagcuucagcgagccccagcagcccgcccccgccaugaagagccaccugaucgugaccagcccccccagagcccagagcggcgccagaaaggccagaggcgaggccaagaagugcagaaagguguacggcaucgagcacagagaccaguggugcaccgccugcagauggaagaaggccugccagagauuccuggacuaa

SEQ ID NO: 25989 - RNA, 1416 nt, Artificial Sequence
  ZNF398__Homo_sapiens__NP_065832
augaagggcaacuacgagagccugaucagcauggacuacgccaucaaccagcccgacgugcugagccagauccagcccgagggcgagcacaacaccgaggaccaggccggccccgaggagagcgagauccccaccgaccccagcgaggagcccggcaucagcaccagcgacauccugagcuggaucaagcaggaggaggagccccaggugggcgccccccccgagagcaaggagagcgacguguacaagagcaccuacgccgacgaggagcuggugaucaaggccgagggccuggccagaagcagccugugccccgaggugcccgugcccuucagcagcccccccgccgccgccaaggacgccuucagcgacguggccuucaagagccagcagagcaccagcaugacccccuucggcagacccgccaccgaccugcccgaggccagcgagggccaggugaccuucacccagcugggcagcuacccccugcccccccccgugggcgagcagguguucagcugccaccacugcggcaagaaccugagccaggacaugcugcugacccaccagugcagccacgccaccgagcacccccugcccugcgcccagugccccaagcacuucaccccccaggccgaccugagcagcaccagccaggaccacgccagcgagaccccccccaccugcccccacugcgccagaaccuucacccaccccagcagacugaccuaccaccugagagugcacaacagcaccgagagacccuuccccugccccgacugccccaagagauucgccgaccaggccagacugaccagccacagaagagcccacgccagcgagagacccuucagaugcgcccagugcggcagaagcuucagccugaagaucagccugcugcugcaccagagaggccacgcccaggagagacccuucagcugcccccagugcggcaucgacuucaacggccacagcgcccugaucagacaccagaugauccacaccggcgagagacccuaccccugcaccgacugcagcaagagcuucaugagaaaggagcaccugcugaaccacagaagacugcacaccggcgagagacccuucagcugcccccacugcggcaagagcuucaucagaaagcaccaccugaugaagcaccagagaauccacaccggcgagagacccuaccccugcagcuacugcggcagaagcuucagauacaagcagacccugaaggaccaccugagaagcggccacaacggcggcugcggcggcgacagcgaccccagcggccagccccccaacccccccggcccccugaucaccggccuggagaccagcggccugggcgugaacaccgagggccuggagaccaaccagugguacggcgagggcagcggcggcggcgugcuguaa

SEQ ID NO: 25990 - RNA, 5448 nt, Artificial Sequence
  ZNF407__Homo_sapiens__NP_001139661
augauggacagcgagaacaagcccgagaacgacgaggacgagaagaucaacaaggaggcccaggaccugaccaagcugagcagccacaacgaggacggcggccccgugagcgacgugaucgccagcuuccccgagaacagcaugggcaagagaggcuucagcgagagcagcaacagcgacagcguggugaucggcgaggacagaaacaagcacgccagcaagagaagaaagcuggacgaggccgagccccugaagagcggcaagcagggcaucugcagacuggagaccagcgagagcagcgugaccgagggcggcaucgcccuggacgagaccggcaaggagaccuuccugagcgacugcaccgugggcggcaccugccugcccaacgcccugagccccagcugcaacuucagcaccaucgacguggugagccugaagaccgacaccgagaagaccagcgcccaggagauggugagccuggaccuggagagagagagccccuucccccccaaggagaucagcgugagcugcaccaucggcaacguggacaccgugcugaagugcagcaucugcggccaccuguucagcagcugcagcgaccuggagaagcacgccgagagccacaugcagcagcccaaggagcacaccugcugccacugcagccacaaggccgagagcagcagcgcccugcacaugcacaucaagcaggcccacggcccccagaagguguucagcugcgaccugugcggcuuccagugcagcgaggagaaccugcugaacgcccacuaccugggcaagacccaccugagaagacagaaccuggccgccagaggcggcuucgugcagauccugaccaagcagcccuuccccaagaagagcagaaccauggccaccaagaacgugcacagcaagcccagaaccagcaagagcaucgccaagaacagcgacagcaagggccugagaaacgugggcagcaccuucaaggacuucagaggcagcaucagcaagcagagcggcagcagcagcgagcugcugguggagaugaugcccagcagaaacacccugagccaggagguggagaucguggaggagcacgugaccagccugggccuggcccagaaccccgagaaccagagcagaaagcuggacacccuggugaccagcgagggccugcuggagaagcuggagagcaccaagaacacccugcaggccgcccacggcaacagcgugaccagcagacccagacccgagagaaacauccuggugcugggcaacagcuucagaagaagaagcagcaccuucacccugaagggccaggccaagaagagauucaaccugcugggcaucaagagaggcaccagcgagacccagagaauguacaugaagcaccugagaacccagaugaagacccacgacgccgagagcgugcugaagcaccuggaggccugcagcagcgugcagagagugugcgugaccaccagcgagacccaggaggccgagcagggccagggcagcgccagaccccccgacagcggccugcacagccugaccgugaagcccgccagcggcagccagacccugugcgccugcaccgacugcggccagguggccaccaacagaaccgaccuggagauccacgugaagagaugccacgccagagagaugaaguucuacugcagaaccugcgacuucagcagcaugagcagaagagaccuggacgagcaccugcacagcaaccagcaccagcagaccgccagcgugcugagcugccagugcugcagcuucaucagccuggacgagaucaaccugagagaccacaugaaggagaagcacaacaugcacuuccugugcacccccugcaaccuguucuuccugagcgagaaggacguggaggagcacaaggccaccgagaagcacaucaacagccuggugcagcccaagacccugcagagcagcaacagcgaccuggugcugcagacccugccccugagcacccuggagagcgagaacgccaaggagagcauggacgacagcggcaaggccagccaggaggagccccugaagagcagagugagccacggcaacgaggugagacacagcagcaagccccaguuccagugcaagaagugcuucuacaagaccagaagcagcaccgugcugaccagacacaucaagcugagacacggccaggacuaccacuuccugugcaaggccugcaaccuguacagccugagcaaggagggcauggagaagcacaucaagagaagcaagcaccuggagaacgccaagaagaacaacaucggccugagcuucgaggagugcaucgagagagugugcaucggcgccaacgacaagaaggaggaguucgacgugagcggcaacggcagaaucgagggccacaucggcgugcagcugcaggagcacagcuaccuggagaagggcaugcuggccagcgaggagcugagccagagcggcggcagcaccaaggacgacgagcuggccagcaccaccacccccaagagaggcagacccaagggcaacaucagcagaaccugcagccacugcggccugcuggccagcagcaucaccaaccugaccgugcacaucagaagaaagcacagccaccaguacagcuaccugugcaaggugugcaaguacuacaccgugaccaagggcgacauggagagacacugcgccaccaagaagcacaagggcagaguggagaucgaggccagcggcaagcacagcagcgacaucaucgugggccccgagggcggcagccuggaggccggcaagaagaacgccggcagcgccgugaccaugagcgacgagcacgccaacaagcccgccgagagccccaccagcgugcuggagaagcccgacagaggcaacagcaucgaggccgagguggagaacguguuccacagccuggacggcgaggugaacagccaccugcuggacaagaaggagcagaucagcagcgagcccgaggacuucgcccagcccggcgacguguacagccagagagacgugaccggcaccggcgagaacaagugccugcacugcgaguucagcgcccacagcagcgccagccuggagcugcacgugaagagaaagcacaccaaggaguucgaguucuacugcauggccugcgacuacuacgccgugaccagaagagagaugaccagacacgccgccaccgagaagcacaagaugaagagacagagcuaccugaacagcgccaacguggaggccggcagcgccgacaugagcaagaacaucaucaugcccgaggaggagcaccagcagaacagcgaggaguuccagaucaucagcggccagcccagcgacacccugaagagcagaaacgccgccgacugcagcauccugaacgagaacaccaaccuggacaugagcaaggugcugugcgccgccgacagcguggagguggagaccgaggaggagagcaacuucaacgaggaccacagcuucugcgagaccuuccagcaggcccccgugaaggacaaggugagaaagcccgaggagaugaugagccugaccaugagcagcaacuacggcagccccagcagauuccagaacgagaacagcggcagcagcgcccugaacugcgagaccgccaagaagaaccacgagaucagcaacgacgccggcgagcugagagugcacugcgagggcgagggcggcaacgccggcgacggcggcggcguggugccccacagacaccugugccccgugacccuggacggcgagagaagcgccgagagccccgugcugguggugaccagaaucaccagagagcagggcaaccuggagagcggcggccagaacagaguggccagaggccacggccuggaggaccugaagggcgugcaggaggaccccgugcugggcaacaaggagauccugaugaacagccagcacgagaccgaguucauccuggaggaggacggccccgccagcgacagcaccguggagagcagcgacguguacgagaccaucaucagcaucgacgacaagggccaggccauguacagcuucggcagauucgacagcagcaucaucagaaucaagaaccccgaggacggcgagcugaucgaccagagcgaggagggccugaucgccaccggcgugagaaucagcgagcugccccugaaggacugcgcccagggcgugaagaagaagaagagcgagggcagcagcaucggcgagagcaccagaaucagaugcgacgacugcggcuuccuggccgacggccugagcggccugaacgugcacaucgccaugaagcaccccaccaaggagaagcacuuccacugccugcugugcggcaagagcuucuacaccgagagcaaccugcaccagcaccuggccagcgccggccacaugagaaacgagcaggccagcguggaggagcugcccgagggcggcgccaccuucaagugcgugaagugcaccgagcccuucgacagcgagcagaaccuguuccugcacaucaagggccagcacgaggagcugcugagagaggugaacaaguacaucguggaggacaccgagcagaucaacagagagagagaggagaaccagggcaacgugugcaaguacugcggcaagaugugcagaagcagcaacagcauggccuuccuggcccacaucagaacccacaccggcagcaagcccuucaagugcaagaucugccacuucgccaccgcccagcugggcgacgccagaaaccacgugaagagacaccugggcaugagagaguacaagugccacgugugcggcguggccuucgugaugaagaagcaccugaacacccaccugcugggcaagcacggcgugggcacccccaaggagagaaaguucaccugccaccugugcgacagaagcuucaccgagaagugggcccugaacaaccacaugaagcugcacaccggcgagaagcccuucaagugcaccuggcccaccugccacuacagcuuccugaccgccagcgccaugaaggaccacuacagaacccacaccggcgagaagagcuuccugugcgaccugugcggcuucgccggcggcaccagacacgcccugaccaagcacagaagacagcacaccggcgagaagcccuucaagugcgacgagugcaacuucgccagcaccacccagagccaccugaccagacacaagagagugcacaccggcgagaagcccuacagaugccccuggugcgacuacagaagcaacugcgccgagaacaucagaaagcacauccugcacaccggcaagcacgagggcgugaagauguacaacugccccaagugcgacuacggcaccaacgugcccguggaguucagaaaccaccugaaggagcagcaccccgacaucgagaaccccgaccuggccuaccugcacgccggcaagggccagaagcuguaa

SEQ ID NO: 25991 - RNA, 1551 nt, Artificial Sequence
  ZNF410__Homo_sapiens__NP_001229853
augcugagcgacgagcuggagagcaagcccgagcugcuggugcaguucgugcagaacaccagcaucccccugggccagggccugguggagagcgaggccaaggacaucaccugccugagccugcugcccgugaccgaggccagcgagugcagcagacugaugcugcccgagcccgugcccuggagagaggaggacggcaagagcggcugcagcgaccugaacgacaccaccaaccacagcaacagcagcaaggaggugcccagcagcgccgugcugagaagccugagagugaacgugggccccgacggcgaggagaccagagcccagaccgugcagaagagccccgaguuccugagcaccagcgagagcagcagccugcugcaggaccugcagcccagcgacagcaccagcuucauccugcugaaccugaccagagccggccugggcagcagcgccgagcaccugguguucgugcaggacgaggccgaggacagcggcaacgacuuccugagcagcgagagcaccgacagcagcauccccugguuccugagagugcaggagcuggcccacgacagccugaucgccgccaccagagcccagcuggccaagaacgccaagaccagcagcaacggcgagaacgugcaccugggcagcggcgacggccagagcaaggacagcggcccccugccccagguggagaagaagcugaagugcaccguggagggcugcgacagaaccuucguguggcccgcccacuucaaguaccaccugaagacccacagaaacgacagaagcuucaucugccccgccgagggcugcggcaagagcuucuacgugcugcagagacugaaggugcacaugagaacccacaacggcgagaagcccuucaugugccacgagagcggcugcggcaagcaguucaccaccgccggcaaccugaagaaccacagaagaauccacaccggcgagaagcccuuccugugcgaggcccagggcugcggcagaagcuucgccgaguacagcagccugagaaagcaccugguggugcacagcggcgagaagccccaccagugccaggugugcggcaagaccuucagccagagcggcagcagaaacgugcacaugagaaagcaccaccugcagcugggcgccgccggcagccaggagcaggagcagaccgccgagccccugaugggcagcagccugcuggaggaggccagcgugcccagcaagaaccuggugagcaugaacagccagcccagccugggcggcgagagccugaaccugcccaacaccaacagcauccugggcguggacgacgaggugcuggccgagggcagccccagaagccugagcagcgugcccgacgugacccaccaccuggugaccaugcagagcggcagacagagcuacgaggugagcgugcugaccgccgugaacccccaggagagccuggccccccugcccagacuggagugcagcggcgccuucagcgcccacugcaaccugugccugcccggcagcagcgacagccccgccagcgccagcuaa

SEQ ID NO: 25992 - RNA, 1668 nt, Artificial Sequence
  ZNF415__Homo_sapiens__NP_001129510
auggacggcgacggccugaccuucagagacguggccaucgaguucagccaggacgaguggaagugccugaacagcacccagagaacccuguacagagacgugaugcuggagaacuacagaaaccuggugagccuggaccugagcagaaacugcgugaucaaggagcuggccccccagcaggagggcaaccccggcgagguguuccacaccgugacccuggagcagcacgagaagcacgacaucgaggaguucugcuucagagagaucaagaagaagauccacgacuucgacugccaguggagagacgacgagagaaacugcaacaaggugaccaccgcccccaaggagaaccugaccugcagaagagaccagagagacagaagaggcaucggcaacaagagcaucaagcaccagcugggccugagcuuccugccccacccccacgagcugcagcaguuccaggccgagggcaagaucuacgagugcaaccacguggagaagagcgugaaccacggcagcagcgugagccccccccagaucaucagcagcaccaucaagacccacgugagcaacaaguacggcaccgacuucaucugcagcagccugcugacccaggagcagaagagcugcaucagagagaagcccuacagauacaucgagugcgacaaggcccugaaccacggcagccacaugaccgugagacaggugagccacagcggcgagaagggcuacaagugcgaccugugcggcaagguguucagccagaagagcaaccuggccagacacuggagagugcacaccggcgagaagcccuacaagugcaacgagugcgacagaagcuucagcagaaacagcugccuggcccugcacagaagagugcacaccggcgagaagcccuacaagugcuacgagugcgacaagguguucagcagaaacagcugccuggcccugcaccagaagacccacaucggcgagaagcccuacaccugcaaggagugcggcaaggccuucagcgugagaagcacccugaccaaccaccaggugauccacagcggcaagaagcccuacaagugcaacgagugcggcaagguguucagccagaccagcagccuggccacccaccagagaauccacaccggcgagaagcccuacaagugcaacgagugcggcaagguguucagccagaccagcagccuggccagacacuggagaauccacaccggcgagaagcccuacaagugcaacgagugcggcaagguguucagcuacaacagccaccuggccagccacagaagagugcacaccggcgagaagcccuacaagugcaacgagugcggcaaggccuucagcgugcacagcaaccugaccacccaccaggugauccacaccggcgagaagcccuacaagugcaaccagugcggcaagggcuucagcgugcacagcagccugaccacccaccaggugauccacaccggcgagaagcccuacaagugcaacgagugcggcaagagcuucagcgugagacccaaccugaccagacaccagaucauccacaccggcaagaagcccuacaagugcagcgacugcggcaagagcuucagcgugagacccaaccuguucagacaccagaucauccacaccaaggagaagcccuacaagagaaacuaa

SEQ ID NO: 25993 - RNA, 1536 nt, Artificial Sequence
  ZNF419__Homo_sapiens__NP_001091961
auggccgccgccgcccugagagaccccgcccaggugcccguggccgccgaccugcugaccgaccacgaggagcagggcuacgugaccuucgaggacguggccguguacuucagccaggaggaguggagacugcuggacgacgcccagagacugcuguacagaaacgugaugcuggagaacuucacccugcuggccagccugggccuggccagcagcaagacccacgagaucacccagcuggagagcugggaggagcccuucaugcccgccugggagguggugaccagcgccauccccagaggcugcuggcacggcgccgaggccgaggaggcccccgagcagaucgccagcgugggccugcugagcagcaacauccagcagcaccagaagcagcacugcggcgagaagccccugaagagacaggagggcagagugcccgugcugagaagcugcaaggugcaccugagcgagaagagccugcagagcagagaggugggcaaggcccugcugaucagcagcggcgugcugaagcaccaggugacccacaccggcgagaagagccacagaagcagcaagagcagagaggccuuccacgccggcaagagacacuacaagugcagcgagugcggcaaggccuucggccagaaguaccugcuggugcagcaccagagacugcacgccggcaagaagaccuacgagugcagcgagugcggcaagcuguucagagacaugagcaaccuguucauccaccagaucgugcacaccggcgagagacccuacggcugcagcaacugcggcaagagcuucagcagaaacgcccaccugaucgagcaccagagagugcacaccggcgagaagcccuucaccugcagcgagugcggcaaggccuucagacacaacagcacccuggugcagcaccacaagauccacaccggcgugagacccuacgagugcagcgagugcggcaagcuguucagcuucaacagcagccugaugaagcaccagagaauccacaccggcgagagacccuacaagugcagcgagugcggcaaguucuacagccacaagagcaaccugaucaagcacuggagagugcacaccggcgagagacccuacaagugcagcgacugcggcaaguucuucacccagugcagcagccugaugcagcaccagaaggugcacaccggcgagaagcccuucaagugcaacgagugcggcagauucuucagagagaacagcacccuggugagacaccagagagugcacaccggcgccaagcccuacgagugcagagagugcggcaaguucuucagccagagcagcacccugaugcagcacagaaaggugcacaucggcgagaagcccuucaagugcaacgagugcggcagacuguucagagagaacagcagccuggugaagcaccagagagugcacaccggcgccaagcccuacgagugcagagagugcggcaaguucuucagacacaacagcagccuguucaagcacagaagaauccacaccggcgagaugcaguaa

SEQ ID NO: 25994 - RNA, 2340 nt, Artificial Sequence
  ZNF41__Homo_sapiens__NP_700359
auggccgccaacggcgacagcccccccuggagccccgcccuggccgccgagggcagaggcagcagcugcgaggccagcgugagcuucgaggacgugaccguggacuucagcaaggaggaguggcagcaccuggaccccgcccagagaagacuguacugggacgugacccuggagaacuacagccaccugcugagcgugggcuaccagauccccaagagcgaggccgccuucaagcuggagcagggcgagggccccuggaugcuggagggcgaggccccccaccagagcugcagcggcgaggccaucggcaagaugcagcagcagggcauccccggcggcaucuucuuccacugcgagagauucgaccagcccaucggcgaggacagccugugcagcauccuggaggagcuguggcaggacaacgaccagcuggagcagagacaggagaaccagaacaaccugcugagccacgugaaggugcugaucaaggagagaggcuacgagcacaagaacaucgagaagaucauccacgugaccaccaagcuggugcccagcaucaagagacugcacaacugcgacaccauccugaagcacacccugaacagccacaaccacaacagaaacagcgccaccaagaaccugggcaagaucuucggcaacggcaacaacuucccccacagccccagcagcaccaagaacgagaacgccaagaccggcgccaacagcugcgagcacgaccacuacgagaagcaccugagccacaagcaggcccccacccaccaccagaagauccaccccgaggagaagcuguacgugugcaccgagugcgugaugggcuucacccagaagagccaccuguucgagcaccagagaauccacgccggcgagaagagcagagagugcgacaagagcaacaagguguucccccagaagccccagguggacgugcaccccagcguguacaccggcgagaagcccuaccugugcacccagugcggcaagguguucacccugaagagcaaccugaucacccaccagaagauccacaccggccagaagcccuacaagugcagcgagugcggcaaggccuucuuccagagaagcgaccuguucagacaccugagaauccacaccggcgagaagcccuacgagugcagcgagugcggcaagggcuucagccagaacagcgaccugagcauccaccagaagacccacaccggcgagaagcacuacgagugcaacgagugcggcaaggccuucaccagaaagagcgcccugagaaugcaccagagaauccacaccggcgagaagcccuacgugugcgccgacugcggcaaggccuucauccagaagagccacuucaacacccaccagagaauccacaccggcgagaagcccuacgagugcagcgacugcggcaagagcuucaccaagaagagccagcugcacgugcaccagagaauccacaccggcgagaagcccuacaucugcaccgagugcggcaagguguucacccacagaaccaaccugaccacccaccagaagacccacaccggcgagaagcccuacaugugcgccgagugcggcaaggccuucaccgaccagagcaaccugaucaagcaccagaagacccacaccggcgagaagcccuacaagugcaacggcugcggcaaggccuucaucuggaagagcagacugaagauccaccagaagagccacaucggcgagagacacuacgagugcaaggacugcggcaaggccuucauccagaagagcacccugagcgugcaccagagaauccacaccggcgagaagcccuacgugugccccgagugcggcaaggccuucauccagaagagccacuucaucgcccaccacagaauccacaccggcgagaagcccuacgagugcagcgacugcggcaagugcuucaccaagaagagccagcugagagugcaccagaagauccacaccggcgagaagcccaacaucugcgccgagugcggcaaggccuucaccgacagaagcaaccugaucacccaccagaagauccacaccagagagaagcccuacgagugcggcgacugcggcaagaccuucaccuggaagagcagacugaacauccaccagaagagccacaccggcgagagacacuacgagugcagcaagugcggcaaggccuucauccagaaggccacccugagcaugcaccagaucauccacaccggcaagaagcccuacgccugcaccgagugccagaaggccuucaccgacagaagcaaccugaucaagcaccagaagaugcacagcggcgagaagagauacaaggccagcgacuaa

SEQ ID NO: 25995 - RNA, 3675 nt, Artificial Sequence
  ZNF423__Homo_sapiens__NP_001258549
auggaggacgagagcaucuacaccugcgaccacugccagcaggacuucgagagccuggccgaccugaccgaccacagagcccacagaugccccggcgacggcgacgacgacccccagcugagcuggguggccagcagccccagcagcaaggacguggccagccccacccagaugaucggcgacggcugcgaccugggccugggcgaggaggagggcggcaccggccugcccuaccccugccaguucugcgacaagagcuucaucagacugagcuaccugaagagacacgagcagauccacagcgacaagcugcccuucaagugcaccuacugcagcagacuguucaagcacaagagaagcagagacagacacaucaagcugcacaccggcgacaagaaguaccacugccacgagugcgaggccgccuucagcagaagcgaccaccugaagauccaccugaagacccacagcagcagcaagcccuucaagugcaccgugugcaagagaggcuucagcagcaccagcagccugcagagccacaugcaggcccacaagaagaacaaggagcaccuggccaagagcgagaaggaggccaagaaggacgacuucaugugcgacuacugcgaggacaccuucagccagaccgaggagcuggagaagcacgugcugaccagacacccccagcugagcgagaaggccgaccugcagugcauccacugccccgagguguucguggacgagaacacccugcuggcccacauccaccaggcccacgccaaccagaagcacaagugccccaugugccccgagcaguucagcagcguggagggcguguacugccaccuggacagccacagacagcccgacagcagcaaccacagcgugagccccgaccccgugcugggcagcguggccagcaugagcagcgccacccccgacagcagcgccagcguggagagaggcagcacccccgacagcacccugaagccccugagaggccagaagaagaugagagacgacggccagggcuggaccaaggugguguacagcugccccuacugcagcaagagagacuucaacagccuggccgugcuggagauccaccugaagaccauccacgccgacaagccccagcagagccacaccugccagaucugccuggacagcaugcccacccuguacaaccugaacgagcacgugagaaagcugcacaagaaccacgccuaccccgugaugcaguucggcaacaucagcgccuuccacugcaacuacugccccgagauguucgccgacaucaacagccugcaggagcacaucagagugagccacugcggccccaacgccaaccccagcgacggcaacaacgccuucuucugcaaccagugcagcaugggcuuccugaccgagagcagccugaccgagcacauccagcaggcccacugcagcgugggcagcgccaagcuggagagccccguggugcagcccacccagagcuucauggagguguacagcugccccuacugcaccaacagccccaucuucggcagcauccugaagcugaccaagcacaucaaggagaaccacaagaacaucccccuggcccacagcaagaagagcaaggccgagcagagccccgugagcagcgacguggaggugagcagccccaagagacagagacugagcgccagcgccaacagcaucagcaacggcgaguaccccugcaaccagugcgaccugaaguucagcaacuucgagagcuuccagacccaccugaagcugcaccuggagcugcugcugagaaagcaggccugcccccagugcaaggaggacuucgacagccaggagagccugcugcagcaccugaccgugcacuacaugaccaccagcacccacuacgugugcgagagcugcgacaagcaguucagcagcguggacgaccugcagaagcaccugcuggacaugcacaccuucgugcuguaccacugcacccugugccaggagguguucgacagcaaggugagcauccaggugcaccuggccgugaagcacagcaacgagaagaagauguacagaugcaccgccugcaacugggacuucagaaaggaggccgaccugcaggugcacgugaagcacagccaccugggcaaccccgccaaggcccacaagugcaucuucugcggcgagaccuucagcaccgagguggagcugcagugccacaucaccacccacagcaagaaguacaacugcaaguucugcagcaaggccuuccacgccaucauccugcuggagaagcaccugagagagaagcacugcguguucgacgccgccaccgagaacggcaccgccaacggcgugccccccauggccaccaagaaggccgagcccgccgaccugcagggcaugcugcugaagaaccccgaggcccccaacagccacgaggccagcgaggacgacguggacgccagcgagcccauguacggcugcgacaucugcggcgccgccuacaccauggaggugcugcugcagaaccacagacugagagaccacaacaucagacccggcgaggacgacggcagcagaaagaaggccgaguucaucaagggcagccacaagugcaacgugugcagcagaaccuucuucagcgagaacggccugagagagcaccugcagacccacagaggccccgccaagcacuacaugugccccaucugcggcgagagauuccccagccugcugacccugaccgagcacaaggugacccacagcaagagccuggacaccggcaccugcagaaucugcaagaugccccugcagagcgaggaggaguucaucgagcacugccagaugcaccccgaccugagaaacagccugaccggcuucagaugcguggugugcaugcagaccgugaccagcacccuggagcugaagauccacggcaccuuccacaugcagaagcuggccggcagcagcgccgccagcagccccaacggccagggccugcagaagcuguacaagugcgcccugugccugaaggaguucagaagcaagcaggaccuggugaagcuggacgugaacggccugcccuacggccugugcgccggcugcauggccagaagcgccaacggccaggugggcggccuggccccccccgagcccgccgacagacccugcgccggccugagaugccccgagugcagcgugaaguucgagagcgccgaggaccuggagagccacaugcagguggaccacagagaccugacccccgagaccagcggccccagaaagggcacccagaccagccccgugcccagaaagaagaccuaccagugcaucaagugccagaugaccuucgagaacgagagagagauccagauccacguggccaaccacaugaucgaggagggcaucaaccacgagugcaagcugugcaaccagauguucgacagccccgccaagcugcugugccaccugaucgagcacagcuucgagggcaugggcggcaccuucaagugccccgugugcuucaccguguucgugcaggccaacaagcugcagcagcacaucuucgccgugcacggccaggaggacaagaucuacgacugcagccagugcccccagaaguucuucuuccagaccgagcugcagaaccacaccaugagccagcacgcccaguaa

SEQ ID NO: 25996 - RNA, 1710 nt, Artificial Sequence
  ZNF430__Homo_sapiens__NP_001166142
auggagaaccugaagagcggcguguacccccugaaggaggccagcggcugccccggcgccgacagaaaccugcugguguacagcuucuacgagaagggcccccugaccuucagagacguggccaucgaguucagccuggaggaguggcagugccuggacaccgcccagcaggaccuguacagaaaggugaugcuggagaacuacagaaaccugguguuccugggcaucgccgugagcaagcccgaccugaucaccugccuggagcagggcaaggagcccuggaacaugaagagacacgccaugguggaccagccccccgugaccuacagccacuucgcccaggaccuguggcccgagcagggcaucaaggacagcuuccaggaggugauccugagaagauacggcaagugcggccacgaggaccugcagcugagaaccggcugcaagagcguggacgagugcaaccugcacaaggagugcuacgacgagcugaaccagugccugaccaccacccagagcgagaucuuccaguacgacaaguacgugaacguguucuacaaguucagcaaccccaacauccagaagaucagacacaccggcaagaagcccuucaagugcaagaagugcgacaagagcuucugcaugcugcugcaccugacccagcacaagagaauccacaucagagagaacagcuaccagugcgaggagugcggcaagguguucaacugguucagcacccugaccagacacagaagaauccacaccggcgagaagcccuacaagugcgagcagugcggcaaggccuucaagcagagcagcacccugaccacccacaagaucauccacaccggcgagaagcccuacagaugcgaggagugcggcaagaccuucaacagaagcagccaccugaccacccacaagagaauccacaccggcgagaagcccuacagaugcgaggagugcggcagagccuucaacagaagcagccaccugaccacccacaagaucauccacaccggcgagaagcccuacaagugcgaggagugcggcaaggccuucaaccagagcagcacccugaccacccacaagaucauccacgccggcgagaagcccuacaagugcgaggagugcggcaaggccuucuacagauucagcuaccugaccaagcacaagaucauccacaccggcgagaaguucuacaagugcgaggagugcggcaagggcuucaacuggagcagcacccugaccaagcacaagagaauccacaccggcgagaagcccuacaagugcgagcagugcggcaaggccuucaacgagagcagcaaccugaccgcccacaagaucauccacaccggcgagaagcccuacaagugcgaggagugcggcaaggccuucaacagaagccccaagcugaccgcccacaaggugauccacagcggcgagaagcccuacaagugcgaggagugcggcaaggccuucaaccaguucagcaaccugaccaagcacaagaucacccacaucggcgacaccagcuacaaguaccuggagugcgacaaggccuucagccagagcagcacccugaccaagcacaaggugauccacaccggcgagaagcccuacaacugcgaggaguacggcaaggccuucaaccagagcagcaaccugaucgagcagagcaacagcuacuggagagagacccugcagauguaa

SEQ ID NO: 25997 - RNA, 1959 nt, Artificial Sequence
  ZNF432__Homo_sapiens__XP_011525850
augaucaacgcccaggagcugcugacccuggaggacgugaccguggaguucaccugggaggaguggcagcugcugggccccuuccagaaggaccuguacagagacgugaugcuggagaucuacagcaaccugcugagcaugggcuaccaggugagcaagcccgacgcccugagcaagcuggagagaggcgaggagcccuggaccauggaggacgagagacacagcagaaucugccccgagaacaacgagguggacgaccaccugcaggaccaccuggagaaccagagaaugcugaagagcguggagcaguaccacgagcacaacgccuucggcaacaccgccagccagaccaagagccugugccuguucagagagaaccacgacaccuucgagcuguacaucaagacccugaagagcaaccugagccuggugaaccagaacaagagcugcgagaucaacaacagcaccaaguucagcggcgacggcaagagcuuccugcacggcaacuacgaggagcuguacagcgccgccaaguucagcgugagcaccaaggccaacagcaccaagagccaggugagcaagcaccagagaacccacgagaucgagaagaaccacgugugcagcgagugcggcaaggccuucgugaagaagagccagcugaccgaccacgagagagugcacaccggcgagaagcccuacggcugcacccugugcgccaagguguucagcagaaagagcagacugaacgagcaccagagaauccacaagagagagaagagcuucaucugcagcgagugcggcaagguguucaccaugaagagcagacugaucgagcaccagagaacccacaccggcgagaagcccuacaucugcaacgagugcggcaagggcuuccccggcaagagaaaccugaucgugcaccagagaaaccacaccggcgagaagagcuacaucugcagcgagugcggcaagggcuucaccggcaagagcaugcugaucauccaccagagaacccacaccggcgagaagcccuacaucugcagcgagugcggcaagggcuucaccaccaagcacuacgugaucauccaccagagaaaccacaccggcgagaagcccuacaucugcaacgagugcggcaagggcuucaccaugaagagcagaaugaucgagcaccagagaacccacaccggcgagaagcccuacaucugcagcgagugcggcaagggcuuccccagaaagagcaaccugaucgugcaccagagaaaccacaccguggagaagagcuaccugugcagcgagugcggcaagggcuucaccgugaagagcaugcugaucauccaccagagaacccacaccggcgagaagcccuacaccugcagcgagugcggcaagggcuucccccugaagagcagacugaucgugcaccagagaacccacaccggcgagaagcccuacagaugcagcgagugcggcaagggcuucaucgugaacagcggccugaugcugcaccagagaacccacaccggcgagaagcccuacaucugcaacgagugcggcaagggcuucgccuucaagagcaaccugguggugcaccagagaacccacaccggcgagaagcccuucaugugcagcgagugcggcaagggcuucaccaugaagagauaccugaucgugcaccagcagauccacaccgaggagaagagcugcaucugcagcgagugcggcagaggcuucgccaaggagaccgagcuggcccugcacaagcaggugcacaccggcgagaagcccuacggcugcaacgagugcggcaagggcuucaccaugaagagcagacugaucgugcaccagagaacccacaccggcgagaagcccuucgugugcagcgagugcagaaaggccuucagcagcaagagaaaccugaucgugcaccagagaacccacaacggcaacaagcccuaa

SEQ ID NO: 25998 - RNA, 2022 nt, Artificial Sequence
  ZNF433__Homo_sapiens__NP_001073880
augauguuccaggacagcguggccuucgaggacguggccgugaccuucacccaggaggagugggcccugcuggaccccagccagaagaaccugugcagagacgugaugcaggagaccuucagaaaccuggccagcaucggcaagaaguggaagccccagaacaucuacguggaguacgagaaccugagaagaaaccugagaaucgugggcgagagacuguucgagagcaaggagggccaccagcacggcgagauccugacccaggugcccgacgacaugcugaagaagaccaccaccggcgugaagagcugcgagagcagcguguacggcgaggugggcagcgcccacagcagccugaacagacacaucagagacgacaccggccacaaggccuacgaguaccaggaguacggccagaagcccuacaagugcaaguacugcaagaagcccuucaacugccugagcagcgugcagacccacgagagagcccacagcggcagaaagcuguacgugugcgaggagugcggcaagaccuucaucagccacagcaaccugcagagacacagaaucaugcacagaggcgacggccccuacaagugcaaguucugcggcaaggcccugauguuccugagccuguaccugauccacaagagaacccacaccggcgagaagcccuaccagugcaagcagugcggcaaggccuucagccacagcagcagccugagaauccacgagagaacccacaccggcgagaagcccuacaagugcaacgagugcggcaaggccuuccacagcagcaccugccugcacgcccacaagagaacccacaccggcgagaagcccuacgagugcaagcagugcggcaaggccuucagcagcagccacagcuuccagauccacgagagaacccacaccggcgagaagcccuacgagugcaaggagugcggcaaggccuucaagugccccagcagcgugagaagacacgagagaacccacagcagaaagaagcccuacgagugcaagcacugcggcaaggugcugagcuaccugaccagcuuccagaaccaccugggcaugcacaccggcgagaucagccacaagugcaagaucugcggcaaggccuucuacagccccagcagccugcagacccacgagaagacccacaccggcgagaagcccuacaagugcaaccagugcggcaaggccuucaacagcagcagcagcuucagauaccacgagagaacccacaccggcgagaagcccuacgagugcaagcagugcggcaaggccuucagaagcgccagccugcugcagacccacggcagaacccacaccggcgagaagcccuacgccugcaaggagugcggcaagcccuucagcaacuucagcuucuuccagauccacgagagaaugcacagagaggagaagcccuacgagugcaagggcuacggcaagaccuucagccugcccagccuguuccacagacacgagagaacccacaccggcggcaagaccuacgagugcaagcagugcggcagaagcuucaacugcagcagcagcuucagauaccacggcagaacccacaccggcgagaagcccuacgagugcaagcagugcggcaaggccuucagaagcgccagccagcugcagauccacggcagaacccacaccggcgagaagcccuacgagugcaagcagugcggcaaggccuucggcagcgccagccaccugcagaugcacggcagaacccacaccggcgagaagcccuacgagugcaagcagugcggcaagagcuucggcugcgccagcagacugcagaugcacggcagaacccacaccggcgagaagcccuacaagugcaagcagugcggcaaggccuucggcugccccagcaaccugagaagacacggcagaacccacaccggcgagaagcccuacaagugcaaccagugcggcaagguguucagaugcagcagccagcugcaggugcacggcagagcccacugcaucgacacccccuaa

SEQ ID NO: 25999 - RNA, 2487 nt, Artificial Sequence
  ZNF438__Homo_sapiens__NP_001137240
augcagaacagcgugagcgugccccccaaggacgagggcgagagcaacauccccagcggcaccauccagagcagaaagggccugcagaacaagagccaguucagaaccaucgcccccaagaucgugcccaaggugcugaccagcagaaugcugcccugccacagccccagcagaagcgaccaggugaaccugggccccagcaucaacagcaagcugcugggcaugagcacccagaacuacgcccugaugcagguggccggccaggagggcaccuucagccugguggcccugccccacguggccagcgcccagcccauccagaagcccagaaugagccugcccgagaaccugaagcugcccauccccagauaccagccccccagaaacagcaaggccagcagaaagaagcccauccugaucuuccccaagagcggcugcagcaaggcccccgcccagacccagaugugcccccagaugagccccagccccccccaccaccccgagcugcuguacaagcccagccccuucgaggaggugcccagccuggagcaggcccccgccagcaucagcaccgccgcccugaccaacggcagcgaccacggcgaccugagaccccccgugaccaacacccacggcagccugaacccccccgccacccccgccagcagcacccccgaggagcccgccaagcaggaccugaccgcccugagcggcaaggcccacuucgugagcaagaucaccagcagcaagcccagcgccguggccagcgagaaguucaaggagcagguggaccuggccaagaccaugaccaaccugagccccaccauccugggcaacgccgugcagcugaucagcagcgugcccaagggcaagcugcccaucccccccuacagcagaaugaagaccauggagguguacaagaucaagagcgacgccaacaucgccggcuucagccugcccggccccaaggccgacugcgacaagauccccagcaccaccgagggcuucaacgccgccaccaagguggccagcagacugcccgugccccaggugagccagcagagcgccugcgagagcgccuucugcccccccaccaagcuggaccugaaccacaagaccaagcugaacagcggcgccgccaagagaaagggcagaaagagaaaggugcccgacgagauccuggccuuccagggcaagagaagaaaguacaucaucaacaagugcagagacggcaaggagagagugaagaacgacccccaggaguucagagaccagaagcugggcacccugaagaaguacagaagcaucaugcccaagcccaucauggugauccccacccuggccagccuggccagccccaccacccugcagagccagaugcugggcggccugggccaggacgugcugcugaacaacagccugacccccaaguaccugggcugcaagcaggacaacagcagcagccccaagcccagcagcguguucagaaacggcuucagcggcaucaagaagcccuggcacagaugccacgugugcaaccaccacuuccaguucaagcagcaccugagagaccacaugaacacccacaccaacagaagacccuacagcugcagaaucugcagaaagagcuacgugagacccggcagccugagcacccacaugaagcugcaccacggcgagaacagacugaagaagcugaugugcugcgaguucugcgccaagguguucggccacaucagaguguacuucggccaccugaaggaggugcacagaguggugaucagcaccgagcccgcccccagcgagcugcagcccggcgacauccccaagaacagagacaugagcgugagaggcauggagggcagccuggagagagagaacaagagcaaccuggaggaggacuuccugcugaaccaggccgacgaggugaagcugcagaucaagugcggcagaugccagaucaccgcccagagcuucgccgagaucaaguuccaccugcuggacgugcacggcgaggagaucgagggcagacugcaggagggcaccuuccccggcagcaagggcacccaggaggagcuggugcagcacgccagccccgacuggaagagacaccccgagagaggcaagcccgagaaggugcacagcagcagcgaggagagccacgccugccccagacugaagagacagcugcaccugcaccagaacggcguggagaugcugauggagaacgagggcccccagagcggcaccaacaagcccagagagaccugccagggccccgagugccccggccugcacaccuuccugcuguggagccacagcggcuucaacugccugcugugcgccgagaugcugggcagaaaggaggaccugcugcaccacuggaagcaccagcacaacugcgaggaccccagcaagcugugggccauccugaacaccgugagcaaccagggcgugaucgagcugagcagcgaggccgagaaguaa

SEQ ID NO: 26000 - RNA, 2016 nt, Artificial Sequence
  ZNF443__Homo_sapiens__NP_005806
auggccagcguggcccuggaggacguggccgugaacuucaccagagaggagugggcccugcugggccccugccagaagaaccuguacaaggacgugaugcaggagaccaucagaaaccuggacugcguggugaugaaguggaaggaccagaacaucgaggaccaguacagauaccccagaaagaaccugagaugcagaaugcuggagagauucguggagagcaaggacggcacccagugcggcgagaccagcagccagauccaggacagcaucgugaccaagaacacccugcccggcgugggccccugcgagagcagcaugagaggcgagaaggugaugggccacagcagccugaacugcuacaucagagugggcgccggccacaagccccacgaguaccacgagugcggcgagaagcccgacacccacaagcagagaggcaaggccuucagcuaccacaacagcuuccagacccacgagagacugcacaccggcaagaagcccuacgacugcaaggagugcggcaagagcuucagcagccugggcaaccugcagagacacauggccgugcagagaggcgacggccccuacaagugcaagcugugcggcaaggccuucuucuggcccagccugcugcacaugcacgagagaacccacaccggcgagaagcccuacgagugcaagcagugcagcaaggccuucagcuucuacagcagcuaccugagacacgagagaacccacaccggcgagaagcccuacgagugcaagcagugcagcaaggccuuccccuucuacagcagcuaccugagacacgagagaacccacaccggcgagaagcccuacaagugcaagcagugcagcaaggccuuccccgacagcagcagcugccugauccacgagagaacccacaccggcgagaagcccuacaccugcaagcagugcggcaaggccuucagcgugagcggcagccugcagagacacgagaccacccacagcgccgagaagcccuacgccugccagcagugcggcaaggccuuccaccaccugggcagcuuccagagacacaugaucagacacaccggcaacggcccccacaagugcaagaucugcggcaagggcuucgacugccccagcagccugcagagccacgagagaacccacaccggcgagaagcccuacgagugcaagcagugcggcaaggcccugagccacagaagcagcuucagaagccacaugaucaugcacaccggcgacggcccccacaagugcaaggugugcggcaaggccuucguguaccccagcguguuccagagacacgagagaacccacaccgccgagaagcccuacaagugcaagcagugcggcaaggccuacagaaucagcagcagccugagaagacacgagaccacccacaccggcgagaagcccuacaagugcaagcugggcaaggccuucaucgacuucugcagcuuccagaaccacaagaccacccacaccggcgagaagcccuacgagugcaaggagugcggcaaggccuucagcagauucagauaccugagcagacacaagagaacccacaccggcgagaagcccuacgagugcaagaccugcagaaaggccuucggccacuacgacaaccugaaggugcacgagagaauccacagcggcgagaagcccuacgagugcaaggagugcggcaaggccuucagcuggcugaccugcuuccugagacacgagagaauccacaugagagagaagagcuacgagugcccccagugcggcaaggccuucacccacagcagauuccugcagggccacgagaagacccacaccggcgagaaccccuacgagugcaaggagugcggcaaggccuucgccagccugagcagccugcacagacacaagaagacccacuggaagaagacccacaccggcgagaaccccuacgagugcaaggagugcggcaaggccuucgccagccugagcagccugcacagacacaagaagacccacuaa

SEQ ID NO: 26001 - RNA, 984 nt, Artificial Sequence
  ZNF444__Homo_sapiens__XP_011525370
auggagguggccgugcccgugaagcaggaggccgagggccuggcccuggacagccccuggcacagauucagaagauuccaccugggcgacgcccccggccccagagaggcccugggccugcugagagcccugugcagagacuggcugagacccgaggugcacaccaaggagcagaugcuggagcugcuggugcuggagcaguuccugagcgcccugcccgccgacacccaggccugggugugcagcagacagccccagagcggcgaggaggccguggcccugcuggaggagcuguggggccccgccgccagccccgacggcagcagcgccaccagagugccccaggacgugacccagggccccggcgccaccggcggcaaggaggacagcggcaugaucccccuggccggcaccgcccccggcgccgagggccccgcccccggcgacagccaggccgugagacccuacaagcaggagcccagcagccccccccuggcccccggccugcccgccuuccuggccgcccccggcaccaccagcugccccgagugcggcaagaccagccugaagcccgcccaccugcugagacacagacagagccacagcggcgagaagccccacgccugccccgagugcggcaaggccuucagaagaaaggagcaccugagaagacacagagacacccaccccggcagccccggcagccccggccccgcccugagaccccugcccgccagagagaagccccacgccugcugcgagugcggcaagaccuucuacuggagagagcaccuggugagacacagaaagacccacagcggcgccagacccuucgccugcugggagugcggcaagggcuucggcagaagagagcacgugcugagacaccagagaauccacggcagagccgccgccagcgcccagggcgccguggcccccggccccgacggcggcggccccuucccccccuggccccugggcuaa

SEQ ID NO: 26002 - RNA, 1992 nt, Artificial Sequence
  ZNF44__Homo_sapiens__NP_001157748
auggcccugugcuacggcaccuucuggggcuaccccaagaugcuggaggccgccaaccugauggagggccugguggacaucggccccugggugacccugcccagaggccagcccgaggugcuggaguggggccugcccaaggaccaggacagcguggccuucgaggacguggccgugaacuucacccacgaggagugggcccugcugggccccagccagaagaaccuguacagagacgugaugagagagaccaucagaaaccugaacugcaucggcaugaagugggagaaccagaacaucgacgaccagcaccagaaccugagaagaaaccccagaugcgacgugguggagagauucggcaagagcaaggacggcagccagugcggcgagacccugagccagaucagaaacagcaucgugaacaagaacacccccgccagaguggacgccugcggcagcagcgugaacggcgaggugaucaugggccacagcagccugaacugcuacaucagaguggacaccggccacaagcacagagagugccacgaguacgccgagaagagcuacacccacaagcagugcggcaagggccugagcuacagacacagcuuccagaccugcgagagaccccacaccggcaagaagcccuacgacugcaaggagugcggcaagaccuucagcagccccggcaaccugagaagacacaugguggugaagggcggcgacggccccuacaagugcgagcugugcggcaaggccuucuucuggcccagccugcugagaaugcacgagagaacccacaccggcgagaagcccuacgagugcaagcagugcagcaaggccuuccccguguacagcagcuaccugagacacgagaagauccacaccggcgagaagcccuacgagugcaagcagugcagcaaggccuuccccgacuacagcagcuaccugagacacgagagaacccacaccggcgagaagcccuacaagugcaagcagugcggcaaggccuucagcgugagcggcagccugagagugcacgagagaauccacaccggcgagaagcccuacaccugcaagcagugcggcaaggccuucugccaccugggcagcuuccagagacacaugaucaugcacagcggcgacggcccccacaagugcaagaucugcggcaagggcuucgacuuccccggcagcgccagaauccacgagggcacccacacccuggagaagcccuacgagugcaagcagugcggcaagcugcugagccacagaagcagcuucagaagacacaugauggcccacaccggcgacggcccccacaagugcaccgugugcggcaaggccuucgacagccccagcguguuccagagacacgagagaacccacaccggcgagaagcccuacgagugcaagcagugcggcaaggccuucagaaccagcagcagccugagaaagcacgagaccacccacaccggcgagcagcccuacaagugcaagugcggcaaggccuucagcgaccuguucagcuuccagagccacgagaccacccacagcgaggaggagcccuacgagugcaaggagugcggcaaggccuucagcagcuucaaguacuucugcagacacgagagaacccacagcgaggagaagagcuacgagugccagaucugcggcaaggccuucagcagauucagcuaccugaagacccacgagagaacccacaccgccgagaagcccuacgagugcaagcagugcagaaaggccuucuucuggcccagcuuccugcugagacacgagagaacccacaccggcgagagacccuacgagugcaagcacugcggcaaggccuucagcagaagcagcuucugcagagagcacgagagaacccacaccggcgagaagcccuacgagugcaaggagugcggcaaggccuucagcagccugagcagcuucaacagacacaagagaacccacuggaaggacauccuguaa

SEQ ID NO: 26003 - RNA, 3186 nt, Artificial Sequence
  ZNF451__Homo_sapiens__NP_001026794
augggcgaccccggcagcgagaucaucgagagcgugccccccgccggccccgaggccagcgagagcaccaccgacgagaacgaggacgacauccaguucgugagcgagggcccccugagacccgugcuggaguacaucgaccuggugagcagcgacgacgaggagcccagcaccagcuacaccgacgagaacaucaagagaaaggaccacaucgacuaccagaaggacaagguggcccugacccuggccagacuggccagacacguggagguggagaagcagcagaaggaggagaagaacagagccuucagagagaagaucgacuuccagcacgcccacggccugcaggagcuggaguucaucagaggccacagcgacaccgaggccgccagacugugcguggaccaguggcugaagaugcccggccugaagaccggcaccaucaacugcggcaccaagagcagcuucagaagaggcggccacaccugggugagcggcaagcccauccugugccccaucaugcacugcaacaaggaguucgacaacggccaccugcugcugggccaccugaagagauucgaccacagccccugcgaccccaccaucacccugcacggccccuucuucagcagcuucgccugcguggugugcuacaagaaguucgugacccagcagcaguacagagaccaccuguucgacaaggaggccaccgacgacggccacaacaacaaccugcugccccagaucauccagugcuucgccugccccaacugcuuccugcuguucagcagaaaggaggagugcagcaagcacaugagcggcaagaaccacuuccaccagagcuucaagcugggcgacaacaagggcaucgcccaccccaucagcuuccccagcuucgccaagaagcugcugaucagccugugcaaggacgugcccuuccaggugaagugcguggccugccacaagacccugagaagccacauggagcugaccgcccacuucagagugcacugcagaaacgccggccccguggccguggccgagaagagcaucacccagguggccgagaaguucauccugagaggcuacugccccgacugcaaccagguguucguggacgagaccagcacccagaaccacaagcagaacagcggccacaaggugagagugaucaacagcguggaggagagcgugcugcuguacugccacagcagcgagggcaacaaggaccccagcagcgaccugcaccugcugcuggaccagagcaaguucagcagccugaagagaaccaugagcaucaaggagagcagcagccuggagugcaucgccauccccaagaagaagaugaaccugaaggacaagagccacgagggcguggccugcgugcagaaggagaagagcguggugaagaccugguucugcgagugcaaccagagauuccccagcgaggacgccguggagaagcacguguucagcgccaacaccaugggcuacaagugcguggugugcggcaaggugugcgacgacagcggcgugaucagacugcacaugagcagaauccacggcggcgcccaccugaacaacuuccuguucuggugcagaaccugcaagaaggagcugaccagaaaggacaccaucauggcccacgugaccgaguuccacaacggccacagauacuucuacgagauggacgagguggagggcgagacccugcccagcagcagcaccacccuggacaaccugaccgccaacaagcccagcagcgccaucaccgugaucgaccacagccccgccaacagcagccccagaggcaaguggcagugcagaaucugcgaggacauguucgacagccaggaguacgugaagcagcacugcaugagccuggccagccacaaguuccacagauacagcugcgcccacugcagaaagcccuuccacaagaucgagacccuguacagacacugccaggacgagcacgacaacgagaucaagaucaaguacuucugcggccugugcgaccugaucuucaacguggaggaggccuuccugagccacuacgaggagcaccacagcaucgacuacguguucgugagcgagaagaccgagaccagcaucaagaccgaggacgacuuccccgugaucgagaccagcaaccagcugaccugcggcugcagagagagcuacaucugcaaggugaacagaaaggaggacuacagcagaugccugcagaucaugcuggacaagggcaagcugugguucagaugcagccugugcagcgccaccgcccagaaccugaccgacaugaacacccacauccaccaggugcacaaggagaagagcgacgaggaggagcagcaguacgugaucaagugcggcaccugcaccaaggccuuccacgaccccgagagcgcccagcagcacuuccacagaaagcacugcuuccugcagaagcccagcguggcccacuucggcagcgagaagagcaaccuguacaaguucaccgccagcgccagccacaccgagagaaagcugaagcaggccaucaacuacagcaagagccuggacauggagaagggcguggagaacgaccugagcuaccagaacaucgaggaggagaucguggagcugcccgaccuggacuaccugagaaccaugacccacaucguguucguggacuucgacaacuggagcaacuucuucggccaccugcccggccaccugaaccagggcaccuucaucuggggcuuccagggcggcaacaccaacuggaagcccccccugaacugcaagaucuacaacuaccugaacagaaucggcugcuucuuccugcaccccagaugcagcaagagaaaggacgccgccgacuucgccaucugcaugcacgccggcagacuggacgagcagcugcccaagcagauccccuucaccauccugagcggcgaccagggcuuccuggagcuggagaaccaguucaagaagacccagagacccgcccacauccugaacccccaccaccuggagggcgacaugaugugcgcccugcugaacagcaucagcgacaccaccaaggagugcgacagcgacgacaacaugggcgccaagaacaccagcaucggcgaggaguucaucagcaccgaggacguggagcuggaggaggccaucagaagaagccuggaggagauguaa

SEQ ID NO: 26004 - RNA, 2049 nt, Artificial Sequence
  ZNF45__Homo_sapiens__NP_003416
augaccaagagcaaggaggccgugaccuucaaggacguggccgugguguucagcgaggaggagcugcagcugcuggaccuggcccagagaaagcuguacagagacgugaugcuggagaacuucagaaacguggugagcgugggccaccagagcacccccgacggccugccccagcuggagagagaggagaagcuguggaugaugaagauggccacccagagagacaacagcagcggcgccaagaaccugaaggagauggagacccugcaggaggugggccugagauaccugccccacgaggagcuguucugcagccagaucuggcagcagaucaccagagagcugaucaaguaccaggacagcguggugaacauccagagaaccggcugccagcuggagaagagagacgaccugcacuacaaggacgagggcuucagcaaccagagcagccaccugcaggugcacagagugcacaccggcgagaagcccuacaagggcgagcacugcgugaagagcuucagcuggagcagccaccugcagaucaaccagagagcccacgccggcgagaagcccuacaagugcgagaagugcgacaacgccuucagaagauucagcagccugcaggcccaccagagagugcacagcagagccaagagcuacaccaacgacgccagcuacagaagcuucagccagagaagccaccugccccaccaccagagagugcccaccggcgagaaccccuacaaguacgaggagugcggcagaaacgugggcaagagcagccacugccaggccccccugaucgugcacaccggcgagaagcccuacaagugcgaggagugcggcgugggcuucagccagagaagcuaccugcaggugcaccugaaggugcacaccggcaagaagcccuacaagugcgaggagugcggcaagagcuucagcuggagaagcagacugcaggcccacgagagaauccacaccggcgagaagcccuacaagugcaacgccugcggcaagagcuucagcuacagcagccaccugaacauccacugcagaauccacaccggcgagaagcccuacaagugcgaggagugcggcaagggcuucagcgugggcagccaccugcaggcccaccagaucagccacaccggcgagaagcccuacaagugcgaggagugcggcaagggcuucugcagagccagcaaccugcuggaccaccagagaggccacaccggcgagaagcccuaccagugcgacgccugcggcaagggcuucagcagaagcagcgacuucaacauccacuucagagugcacaccggcgagaagcccuacaagugcgaggagugcggcaagggcuucagccaggccagcaaccugcuggcccaccagagaggccacaccggcgagaagcccuacaagugcggcaccugcggcaagggcuucagcagaagcagcgaccugaacgugcacugcagaauccacaccggcgagaagcccuacaagugcgagagaugcggcaaggccuucagccaguucagcagccugcaggugcaccagagagugcacaccggcgagaagcccuaccagugcgccgagugcggcaagggcuucagcgugggcagccagcugcaggcccaccagagaugccacaccggcgagaagcccuaccagugcgaggagugcggcaagggcuucugcagagccagcaacuuccuggcccacagaggcgugcacaccggcgagaagcccuacagaugcgacgugugcggcaagagauucagacagagaagcuaccugcaggcccaccagagagugcacaccggcgagagacccuacaagugcgaggagugcggcaagguguucagcuggagcagcuaccugcaggcccaccagagagugcacaccggcgagaagcccuacaagugcgaggagugcggcaagggcuucagcuggagcagcagccugaucauccaccagagagugcacgccgacgacgagggcgacaaggacuuccccagcagcgaggacagccacagaaagaccagauaa

SEQ ID NO: 26005 - RNA, 7521 nt, Artificial Sequence
  ZNF462__Homo_sapiens__NP_067047
auggaggugcugcagugcgacggcugcgacuucagagcccccagcuacgaggaccugaaggcccacauccaggacgugcacaccgccuuccugcagcccaccgacguggccgaggacaacgugaacgagcugagaugcggcagcgugaacgccagcaaccagaccgagguggaguucagcagcaucaaggacgaguucgccaucgccgaggaccugagcggccagaacgccaccagccugggcaccggcggcuacuacggccacagccccggcuacuacggccagcacaucgccgccaaccccaagcccaccaacaaguucuuccagugcaaguucugcgugagauacuucagaagcaagaaccugcugaucgagcacaccagaaaggugcacggcgcccaggccgagggcagcagcagcggcccccccgugcccggcagccugaacuacaacaucaugaugcacgagggcuucggcaagguguucagcugccaguucugcaccuacaagagccccagaagagccagaaucaucaagcaccagaagauguaccacaagaacaaccugaaggagaccaccgcccccccccccgcccccgcccccaugcccgaccccguggugccccccgugagccugcaggaccccugcaaggagcugcccgccgaggugguggagagaagcauccuggagagcauggugaagccccugaccaagagcagaggcaacuucugcugcgaguggugcagcuaccagacccccagaagagagagauggugcgaccacaugaugaagaagcacagaagcauggugaagauccugagcagccugagacagcagcaggagggcaccaaccugcccgacgugcccaacaagagcgcccccagccccaccagcaacagcaccuaccugaccaugaacgccgccagcagagagauccccaacaccaccgugagcaacuucagaggcagcaugggcaacagcaucaugagacccaacagcagcgccagcaaguucagccccaugagcuacccccagaugaagcccaagagcccccacaacagcggccuggugaaccugaccgagagaagcagauacggcaugaccgacaugaccaacagcagcgccgaccuggagaccaacagcaugcugaacgacagcagcagcgacgaggagcugaacgagaucgacagcgagaacggccugagcgccauggaccaccagaccagcggccugagcgccgagcagcugaugggcagcgacggcaacaagcugcuggagaccaagggcauccccuucagaagauucaugaacagauuccagugccccuucugccccuuccugaccaugcacagaagaagcaucagcagacacaucgagaacauccaccugagcggcaagaccgccguguacaagugcgacgagugccccuucaccugcaagagcagccugaagcugggcgcccacaagcagugccacaccggcaccaccagcgacugggacgccgugaacagccagagcgagagcaucagcagcagccugaacgagggcguggugagcuacgagagcagcagcaucaacggcagaaagagcggcgugaugcuggacccccugcagcagcagcagcccccccagccccccccccccccccccccccccccccccagccagccccagccccugcagcagccccagcccccccagcugcagcccccccaccaggugcccccccagccccagacccagcccccccccacccagcagccccagccccccacccaggccgccccccugcaccccuacaagugcaccaugugcaacuacagcaccaccacccugaagggccugagagugcaccagcagcacaagcacagcuucugcgacaaccugcccaaguucgagggccagcccagcagccugccccuggagaacgagaccgacagccaccccagcagcagcaacaccgugaagaagagccagaccagcauccugggccugagcagcaagaacaacuucguggccaaggccagcagaaagcuggccaacgacuucccccuggaccugagccccgugaagaagagaaccagaaucgacgagaucgccagcaaccugcagagcaagaucaaccagaccaagcagcaggaggacgccgugaucaacguggaggacgacgaggaggaggaggaggacaacgagguggagaucgagguggagcuggacagagaggaggagcccaccgagcccaucaucgaggugcccaccagcuucagcgcccagcagaucugggugagagacaccagcgagccccagaaggagcccaacuucagaaacaucacccacgacuacaacgccaccaacggcgccgagaucgagcugacccugagcgaggacgaggaggacuacuacggcagcagcaccaaccugaaggaccaccaggugagcaacaccgcccugcugaacacccagacccccaucuacggcaccgagcacaacagcgagaacaccgacuucggcgacagcggcagacuguacuacugcaagcacugcgacuucaacaacaagagcgccagaagcgugagcacccacuaccagagaaugcaccccuacaucaaguucagcuucagauacauccuggaccccaacgaccacagcgccguguacagaugccuggagugcuacaucgacuacaccaacuucgaggaccugcagcagcacuacggcgagcaccaccccgaggccaugaacgugcugaacuucgaccacagcgaccugaucuacagaugcagauucugcagcuacaccagccccaacgugagaagccugaugccccacuaccagagaaugcaccccaccgugaagaucaacaacgccaugaucuucagcagcuacgugguggagcagcaggagggccugaacaccgagagccagacccugagagagauccugaacagcgcccccaagaacauggccaccagcacccccguggccagaggcggcggccugcccgccaccuucaacaagaacacccccaagaccuucacccccgagugcgagaaccagaaggacccccuggugaacaccguggugguguacgacugcgacgugugcagcuucgccagccccaacaugcacagcgugcuggugcacuaccagaagaagcaccccgaggagaaggccagcuacuucagaauccagaagaccaugagaauggugagcguggacagaggcagcgcccugagccagcugagcuucgaggugggcgcccccaugagccccaagaugagcaacaugggcagccccccccccccccagccccccccccccgaccugagcaccgagcuguacuacugcaagcacugcagcuacagcaacagaagcguggugggcgugcuggugcacuaccagaagagacaccccgagaucaaggugaccgccaaguacaucagacaggccccccccaccgccgccaugaugagaggcguggagggcccccagggcagccccagaccccccgcccccauccagcagcugaacagaagcagcagcgagagagacggcccccccguggagaacgagauguucuucugccagcacugcgacuacggcaacagaaccgugaagggcgugcugauccacuaccagaagaagcacagagacuucaaggccaacgccgacgugaucagacagcacaccgccaccaucagaagccugugcgacagaaaccagaagaagcccgccagcugcgugcuggugagccccagcaaccuggagagagacaagaccaagcugagagcccugaagugcagacagugcagcuacaccagccccuacuucuacgcccugagaaagcacaucaagaaggaccaccccgcccugaaggccaccgugaccagcaucaugagaugggccuuccuggacggccugaucgaggccggcuaccacugcgaguggugcaucuacagccacaccgagcccaacggccugcugcugcacuaccagagaagacaccccgagcacuacguggacuacaccuacauggccaccaagcugugggccggccccgaccccagcccccccagccugaccaugcccgccgaggccaagaccuacagaugcagagacugcguguucgaggccgugagcaucugggacaucaccaaccacuaccaggccuuccaccccugggccaugaacggcgacgagagcgugcugcuggacaucaucaaggagaaggacgccguggagaagcccauccugagcagcgaggagcuggccggccccgugaacugcgagaacagcauccccacccccuuccccgagcaggaggccgagugccccgaggacgccagacugagccccgagaagagccugcagcuggccagcgccaaccccgccaucagcagcacccccuaccagugcaccgugugccagagcgaguacaacaaccugcacggccugcugacccacuacggcaagaagcaccccggcaugaaggugaaggccgccgacuucgcccaggacaucgacaucaaccccggcgccguguacaagugcagacacugccccuacaucaacaccagaauccacggcgugcugacccacuaccagaagagacaccccagcaucaaggugaccgccgaggacuucgugcacgacguggagcagagcgccgacaucagccagaacgacguggaggagaccagcagaaucuucaagcagggcuacggcgccuacagaugcaagcugugccccuacacccacggcacccuggagaagcugaagauccacuacgagaaguaccacaaccagcccgaguucgacguguucagccagagcccccccaagcugcccgugccccuggagcccgagaugaccaccgaggugagccccagccaggugagcaucaccgaggaggaggugggcgaggagcccgugagcaccagccacuucagcaccagccaccuggugagccacaccguguucagaugccagcugugcaaguacuucugcagcaccagaaagggcaucgccagacacuacagaaucaagcacaacaacgugagagcccagcccgagggcaagaacaaccuguucaagugcgcccugugcgccuacaccaaccccaucagaaagggccuggccgcccacuaccagaagagacacgacaucgacgccuacuacacccacugccuggccgccagcagaaccaucagcgacaagcccaacaaggugaucauccccagcccccccaaggacgacagcccccagcugagcgaggagcugagaagagccguggagaagaagaagugcagccugugcagcuuccagagcuucagcaagaagggcaucgugagccacuacaugaagagacaccccggcguguuccccaagaagcagcacgccagcaagcugggcggcuacuucaccgccguguacgccgacgagcacgagaagcccacccugauggaggaggaggagagaggcaacuucgagaaggccgagguggagggcgaggcccaggagaucgaguggcugcccuucagaugcaucaagugcuucaagcugagcuucagcaccgccgagcugcugugcaugcacuacaccgaccaccacagcagagaccugaagagagacuucaucauccugggcaacggccccagacugcagaacagcaccuaccagugcaagcacugcgacagcaagcugcagagcaccgccgagcugaccagccaccugaacauccacaacgaggaguuccagaagagagccaagagacaggagagaagaaagcagcugcugagcaagcagaaguacgccgacggcgccuucgccgacuucaagcaggagagacccuucggccaccuggaggaggugcccaagaucaaggagagaaagguggugggcuacaagugcaaguucugcguggaggugcaccccacccugagagccaucugcaaccaccugagaaagcacgugcaguacggcaacgugcccgccgugagcgccgccgugaagggccugagaagccacgagagaagccaccuggcccuggccauguucaccagagaggacaaguacagcugccaguacugcagcuucgugagcgccuucagacacaaccuggacagacacaugcagacccaccacggccaccacaagcccuucagaugcaagcugugcagcuucaagagcagcuacaacagcagacugaagacccacauccugaaggcccacgccggcgagcacgccuacaagugcagcuggugcagcuucagcaccaugaccaucagccagcugaaggagcacagccugaaggugcacggcaaggcccugacccugcccagacccagaaucgugagccugcugagcagccacagccaccacagcagccagaaggccacccccgccgaggagguggaggacagcaacgacagcagcuacagcgagccccccgacgugcagcagcagcugaaccacuaccagagcgccgcccuggccagaaacaacagcagagugagccccgugccccugagcggcgccgccgccggcaccgagcagaagaccgaggccgugcugcacugcgaguucugcgaguucagcagcggcuacauccagagcaucagaagacacuacagagacaagcacggcggcaagaagcuguucaagugcaaggacugcagcuucuacaccggcuucaagagcgccuucaccaugcacguggaggccggccacagcgccgugcccgaggagggccccaaggaccugagaugcccccugugccuguaccacaccaaguacaagagaaacaugaucgaccacaucgugcugcacagagaggagagaguggugcccaucgaggugugcagaagcaagcugagcaaguaccugcagggcgugguguucagaugcgacaagugcaccuucaccugcagcagcgacgagagccugcagcagcacaucgagaagcacaacgagcugaagcccuacaagugccagcugugcuacuacgagaccaagcacaccgaggagcuggacagccaccugagagacgagcacaaggugagcagaaacuucgagcuggugggcagagugaaccuggaccagcuggagcagaugaaggagaagauggagagcagcagcagcgacgacgaggacaaggaggaggagaugaacagcaaggccgaggacagagagcugaugagauucagcgaccacggcgccgcccugaacaccgagaagagauuccccugcgaguucugcggcagagccuucagccagggcagcgagugggagagacacgugcugagacacggcauggcccugaacgacaccaagcaggugagcagagaggagauccaccccaaggagaucauggagaacagcgugaagaugcccagcaucgaggagaaggaggacgacgaggccaucggcaucgacuucagccugaagaacgagaccguggccaucugcguggugaccgccgacaagagccugcuggagaacgccgaggccaagaaggaguaa

SEQ ID NO: 26006 - RNA, 11778 nt, Artificial Sequence
  ZNF469__Homo_sapiens__NP_001120936
augcccggcgagagacccagaggcgcccccccccccaccaugaccggcgaccugcagcccagacagguggccagcagccccggccaccccagccagcccccccuggaggacaacacccccgccaccagaaccaccaagggcgccagagaggccggcggccaggcccaggccauggagcugcccgaggcccagcccagacaggccagagacggcgagcugaagccccccagccugagaggccaggcccccagcagcacccccggcaagagaggcagcccccagaccccccccggcagaagcccccugcaggcccccagcagacuggccggcagagccgagggcagccccccccagagauacauccugggcaucgccagcagcagaaccaagcccacccuggacgagacccccgagaacccccagcuggaggccgcccagcugcccgagguggacaccccccagggccccggcaccggcgccccccugagacccggccugcccagaaccgaggcccagcccgccgccgaggagcugggcuuccacagaugcuuccaggagccccccagcagcuucaccagcaccaacuacaccagccccagcgccacccccagaccccccgcccccggccccccccagagcagaggcaccagcccccugcagcccggcagcuaccccgaguaccaggccagcggcgccgacagcuggccccccgccgccgagaacagcuuccccggcgccaacuucggcgugccccccgccgagcccgagcccauccccaagggcagcagacccggcggcagccccagaggcgugagcuuccaguuccccuuccccgcccugcacggcgccagcaccaagcccuuccccgccgacguggccggccacgccuucaccaacggcccccugguguucgccuuccaccagccccagggcgccuggcccgaggaggccgugggcaccggccccgccuacccccugcccacccagcccgcccccagcccccugcccugcuaccagggccagcccggcggccugaacagacacagcgaccugagcggcgcccugagcagccccggcgccgcccacagcgcccccagacccuucagcgacagccugcacaagagccugaccaagauccugcccgagagaccccccagcgcccaggacggccugggcagcaccagaggcccccccagcagccugccccagagacacuuccccggccaggccuacagagccagcggcguggacaccagccccggcccccccgacaccgagcuggccgcccccggccccccccccgccagacugccccagcugugggaccccaccgccgcccccuaccccaccccccccggcggcccccuggccgccaccagaagcauguucuucaacggccagcccagccccggccagagacugugccugccccagagcgccccccugcccuggccccaggugcugcccaccgccagacccagcccccacggcauggagaugcugagcagacugcccuuccccgccggcggccccgaguggcagggcggcagccagggcgcccugggcaccgccggcaagacccccggccccagagagaagcugcccgccgugagaagcagccagggcggcagccccgcccuguucaccuacaacggcaugaccgaccccggcgcccagccccuguucuucggcguggcccagccccaggugagcccccacggcacccccagccugcccccccccagaguggugggcgccagccccagcgagagcccccugcccagccccgccaccaacaccgccggcagcaccugcagcagccugagccccaugagcagcagccccgccaaccccagcagcgaggagagccagcugcccggcccccugggccccagcgccuucuuccacccccccacccacccccaggagaccggcagccccuuccccagccccgagcccccccacagccugcccacccacuaccagcccgagcccgccaaggccuuccccuuccccgccgacggccugggcgccgagggcgccuuccagugccuggaggagacccccuucccccacgagggccccgaggugggcagaggcggccugcagggcuuccccagagcccccccccccuaccccacccaccacuucagccugagcagcgccagccuggaccagcuggacgugcugcugaccugcagacagugcgacagaaacuacagcagccuggccgccuuccuggcccacagacaguucugcggccugcugcuggccagagccaaggacggccaccagagaagccccggcccccccggccugcccagcccccccgccgcccccagagugcccgccgacgcccacgccggccugcugagccacgccaagaccuuccugcuggccggcgacgcccaggccgagggcaaggacgacccccugagaaccggcuuccugcccagccuggccgccacccccuucccccugcccgccagcgaccuggacauggaggacgacgccaagcuggacagccugaucaccgaggcccugaacggcauggaguaccagagcgacaaccccgagaucgacagcagcuucaucgacguguucgccgacgaggagcccagcggccccagaggccccagcagcggccacccccugaagagcaaggccggcgugacccccgagagcaaggccccccccccccugcccgccgccacccccgacccccagacccccagacccggcgacagaggcugccccgccagaggcagacccaagaccagaagccugggccuggcccccaccgaggccgacgcccccagccagggcagacagcagagaagaggcaagcagcugaagcuguucagaaaggaccuggacagcggcggcgccgccgagggcagcggcagcggcggcggcggcagagccagcggccugagacccagaagaaacgacggccugggcgagagacccccccccagacccagaagacccagaacccaggcccccggcagcagagccgaccccgcccccagagugcccagagccgccgcccugcccgaggagaccagaagcagcagaagaagaagacugccccccagaaaggaccccagaaagagaaaggccagaggcggcgccuggggcaaggagcugauccugaagaucgugcagcagaagaacagacugagagaguacgacuucgccagcgagagcgaggaggacgagcagcccccccccagaggccccggcuucagaggcagaagaggcagaggcgagaagagaaaggagguggagcugacccagggccccagagaggacgagccccagaagcccagaaaggccgccagacaggaggccggcggcgacggcgcccccgccaaccccgaggagcccggcggcagcagacccggccccggcagaagcccccaggccagaggccccagcagaagccuggagaccggcgccgccgccagagagggcggccccaagugcgccgacagacccagcguggcccccaaggacccccugcaggugcccaccaacaccgagaccagcgaggagaccagacccagccuggacuucccccaggaggccaaggagcccgagaccgccgaggagagcgcccccgacagcaccgaguucaccgaggcccugagaagcccccccgccgccugcgccggcgagaugggcgccagccccggccugcugauccccgagcagcccccccccagcagacacgacaccggcacccccaagcccagcggcagccuggccaacaccgccccccacggcagcagccccacccccggcgugggcagccugcugggcggccccggcggcacccaggcccccgugagccacaacagcaaggacccccccgccagacagcccggcgaguuccuggcccccguggccaaccccagcagcaccgccugccccaagcccagcgugcugagcagcaagaucagcagcuucggcugcgaccccgccggcuucaacagagacccccugggcgugcccguggccaagaagggcccccagcccuacagcagcccccacagcgagcuguuccugggccccaaggaccuggccggcugcuuccuggaggagcugcaccccaagcccagcgccagagacgccccccccgccagcagcagcugccugugccaggacggcgaggacgccggcagccuggagccccagcugcccagaagcccccccggcaccgccgagaccgagcccggcagagccgccagcccccccacccuggagagcagcagccuguuccccgaccugcccguggacagauucgaccccccccuguacggcagccugagcgccaacagagacagcggccugcccuucgccugcgccgaccccccccagaagaccgugcccagcgacccccccuaccccagcuuccugcugcuggaggaggugagccccaugcugcccagccacuuccccgaccugagcggcggcaaggugcugagcaagaccugcccccccgagagaaccguggugcccggcgccgcccccagccugcccggcaagggcagcggcugcagcguggcccugaugagccaccugagcgaggacgagcuggagauccagaagcuggugaccgagcuggagagccagcugcagagaagcaaggacaccagaggcgcccccagagagcuggccgaggccgagagcgugggcagaguggagcugggcaccggcaccgagccccccagccagagaagaaccugccaggccaccgugccccacgaggacaccuucagcgccgccgaccugaccagagugggcgagagcaccgcccacagagagggcgccgagagcgccguggccaccguggaggccgugcagggcagacccggcggcaccuggcccugccccgccagcuuccaccccggccacgccgcccugcugcccugcgcccaggaggaccuggugagcggcgcccccuucagccccagaggcgccaacuuccacuuccagcccgugcagaaggccggcgccagcaagaccggccugugccaggccgagggcgacagcagacccccccaggacgugugccugcccgagcccagcaagcagcccggcccccagcuggacgccggcagccuggccaagugcagccccgaccaggagcugagcuuccccaagaacaaggaggccgccagcagccaggagagcgaggacagccugagacugcugcccugcgagcagagaggcggcuuccugcccgagcccggcaccgccgaccagccccacagaggcgcccccgcccccgaggccuucggcagccccgccgugcaccuggcccccgaccuggccuuccagggcgacggcgcccccccccuggacgccaccuggcccuucggcgccagccccagccacgccgcccagggccacagcgccggcagagccggcggccaccugcaccccaccgccggcagacccggcuucgagggcaacgaguucgcccccgccggcgccagcagccugaccgcccccagaggcagagaggccuggcuggugcccgugcccagccccgccugcgugagcaacacccaccccagcagaagaagccaggaccccgcccugagcccccccaucagacagcugcagcugcccggccccggcguggccaagagcaaggacggcauccugggccugcaggagcugacccccgccgcccagagcccccccagagugaaccccagcggccuggagggcggcaccguggagggcggcaagguggccugcggccccgcccagggcagccccggcggcgugcaggugaccacccugcccgccguggccggccaccagcugggccuggaggccgacggccacuggggccugcugggccaggccgagaagacccagggccagggcaccgccaaccagcugcagcccgagaacggcgugagccccggcggcaccgacaaccacgccagcgugaacgccagccccaagaccgcccugaccggccccaccgagggcgccgugcugcuggagaagugcaagggcagcagagccgccaugagccugcaggaggaggccgagcccacccccagcccccccagccccaacagagagagccuggcccuggcccugaccgccgcccacagcagaagcggcagcgagggcagaacccccgagagagccagcagccccggccugaacaagccccugcuggccaccggcgacagccccgcccccagcgugggcgaccuggccgccugcgcccccagccccaccagcgccgcccacaugcccugcagccugggcccccugcccagagaggacccccugaccagccccagcagagcccagggcggccugggcggccagcugcccgccagccccagcugcagagacccccccggcccccagcagcugcuggccugcagccccgccugggccccccuggaggaggccgacggcgugcaggccaccaccgacaccggcgccgaggacagccccguggccccccccagccugaccaccagccccugcgaccccaaggaggcccuggccggcugccugcugcagggcgagggcagcccccuggaggaccccagcagcuggccccccggcagcgugagcgccgugaccugcacccacagcggcgacacccccaaggacagcacccugagaauccccgaggacagcagaaaggagaagcugugggagagccccggcagagccaccagccccccccuggccggcgccgugagccccagcguggccgugagagccaccggccugagcagcacccccaccggcgacgaggcccaggccggcagaggccugcccggccccgacccccagagcagaggcgcccccccccacaccaaccccgacagaaugcccagaggccacagcagcuacagccccagcaacaccgccagacugggccacagagagggccaggccgugaccgccgugcccaccgagccccccacccugcagggcgccggccccgacagccccgccugccuggagggcgagaugggcaccagcagcaaggagcccgaggaccccggcacccccgagaccggcagaagcggcgccaccaagaugcccagagugaccugccccagcaccggccugggccugggcagaaccaccgcccccagcagcaccgccagcgacuuccagagcgacagcccccagagccacagaaacgccagccaccagaccccccagggcgacccccugggcccccaggaccugaagcagagaagcagaggcuacaagaagaagcccgccagcaccgagaacggccaguggaagggccaggccccccacggccccgugaccugcgaggugugcgccgccagcuucagaagcggccccggccugagcagacacaaggccagaaagcacagaccccaccccggcgcccccgccgagcccagccccgccgcccugcccgcccagcagccccuggagccccuggcccagaagugccagccccccagaaagaagagccacagagugagcggcaaggagagacccaaccacagcagaggcgaccccagccacgugacccagcccccccccgcccagggcagcaaggaggugcugagagcccccggcagcccccacagccagcagcugcacccccccagccccaccgagcacgagguggacgugaagacccccgccagcaagcccagacccgaccaggccagagaggacgagcugcaccccaagcaggccgagaagagagagggcagaagauggagaagagagcccaccguggacagccccagccacagcgagggcaagagcaacaagaagagaggcaagcugagaggcagaagacugagagaggagagcauccugcccgugagcgccgacgugaucagcgacggcagaggcagcagacccagccccgccauggccagcuacgccgccagccccagccacugccugagcguggagggcggccccgaggccgacggcgagcagccccccagacuggccacccugggccccggcgugauggagggcgccgccgagaccgaccaggaggcccugugcgccggcgagaccggcgcccagaagccccccggcgacagaaugcugugccccggcagaauggacggcgccgcccugggcgagcagcccaccggccagaagggcgccagcgccagaggcuucuggggccccagagagaccaaggcccugggcgugugcaaggagagcggcagcgagcccgccgaggacagcagcagagcccacagcagaagcgaggagggcgugugggaggagaacacccccccccugggcccccugggcuuccccgagaccagcagcagccccgccgacagcaccaccagcagcugccugcagggccugcccgacaaccccgacacccagggcggcgugcagggccccgagggccccacccccgacgccagcggcagcagcgccaaggacccccccagccuguucgacgacgaggugagcuucagccagcuguucccccccggcggcagacugaccagaaagagaaacccccacguguacggcaagagaugcgagaagcccgugcugccccugcccacccagcccagcuucgaggagggcggcgaccccacccugggccccgccagacugcccaccgaccugagcgacagcagcagccugugccugugccacgaggaccccugggaggacgaggaccccgccggccugcccgagagcuuccugcuggacggcuuccugaacagcagagugcccggcaucgaccccugggcccccggccugagccugugggcccuggagcccagcagagaggccggcgccgagaagcugcccagccacugccccgaggacgacagacccgaggccauccccgagcugcacauggugcccgccgccuggagaggccuggagaugcccgcccccgccgacgacagcagcagcagccugggcgacgugagccccgagccccccagccuggagagagagagaugcgacggcggccugcccggcaacacccaccugcugccccugagagccaccgacuucgaggugcugagcaccaaguucgagaugcaggaccugugcuuccugggccccuucgaggaccccgugggccugcccggccccagcuuccuggacuucgagggcaccgccagcagccagggcccccagagcagaagaaccgaggaggccgccggcgccggcagagcccagggcagaggcagacccgccaagggcagaagagccagcuacaagugcaaggugugcuuccagagauucagaagccugggcgagcuggaccugcacaagcuggcccacacccccgcccccccccccaccugcuacaugugcguggagagaagauucggcagcagagagcugcugagaggccaccugcaggagagacacgcccagagcaaggccggccccugggccugcggcaugugccugaaggagguggccgacguguggauguacaacgagcaccugagagagcacgccgugagauucgccagaagaggccaggccagaagaagccugggcgaccugcccggcggccuggagggcagcagcgccguggcccaccugcugaacagcaucaccgagcccgcccccaagcaccacagaggcaagagaagcgccggcaaggccgccggcagccccggcgaccccuggggccaggagggcgaggccaagaaggacagccccggcgagagagccaagcccagagccagaagcacccccagcaaccccgacggcgccgccacccccgacagcgccagcgccaccgcccuggccgacgccggcagccccggcccccccagaaccacccccagccccagccccgaccccugggccggcggcgagccccugcugcaggccacccccgugcacgaggccugcaaggaccccagcagagacugccaccacugcggcaagagauuccccaagcccuucaagcugcagagacaccuggccgugcacagcccccagagaguguaccugugccccagaugccccagaguguaccccgagcacggcgagcugcuggcccaccugggcggcgcccacggccugcuggagagacccgagcugcagcacaccccccuguacgccugcgagcugugcgccaccgugaugagaaucaucaagaagagcuucgccugcagcagcugcaacuacaccuucgccaagaaggagcaguucgacagacacaugaacaagcaccugagaggcggcagacagcccuucgccuucagaggcgugagaagacccggcgcccccggccagaaggccagagcccuggagggcacccugcccagcaagagaagaagaguggccaugcccggcagcgcccccggccccggcgaggacagacccccccccagaggcagcagccccauccugagcgagggcagccugcccgcccugcugcaccugugcagcgagguggcccccagcaccaccaagggcuggcccgagacccuggagagacccguggaccccgugacccaccccaucagaggcugcgagcugcccagcaaccaccaggagugccccccccccagccugagccccuuccccgccgcccuggccgacggcagaggcgacugcgcccuggacggcgcccuggagagacccgagaacgaggccagccccggcagccccggcccccugcugcagcaggcccugccccugggcgccagccugcccagacccggcgccagaggccaggacgccgagggcaagagagccccccugguguucagcggcaagagaagagcccccggcgccagaggcagaugcgcccccgaccacuuccaggaggaccaccugcugcagaaggagaaggaggugagcagcagccacauggugagcgagggcggccccagaggcgccuuccacaagggcagcgccaccaagcccgccggcugccagagcagcagcaaggacagaagcgccgccagcacccccagcaaggcccugaaguuccccgugcaccccagaaaggccgugggcagccuggcccccggcgagcuggccagaggcaccgagaacggcaugaagcccgccacccccaaggccaagcccggccccagcagccagggcagcggcagccccagacccggcaccaagaccggcggcggcagccagccccagcccgccagcggccagcugcagagcgagaccgccaccacccccgccaagcccagcuuccccagcagaagccccgcccccgagagacugcccgccagagcccaggccaagagcugcaccaagggccccagagaggccggcgagcagggcccccacggcagccugggccccaaggagaagggcgagagcagcaccaagagaaagaagggccaggugcccggccccgccagaagcgagagcgugggcagcuucggcagagcccccagcgcccccgacaagccccccagaacccccagaaagcaggccacccccagcagagugcugcccaccaagcccaagcccaacagccagaacaagcccagacccccccccagcgagcagagaaaggccgagcccggccacacccagagaaaggacagacugggcaaggccuucccccagggcagaccccugcugagaccccccaagagaggcaccgccgugcacggcgccgagcccgccgagccccacacccacagaaccgccgaggcccagagcgaccugcugagccagcuguucggccagagacugaccggcuucaagaucccccugaagaaggacgccagcgaguaa

SEQ ID NO: 26007 - RNA, 771 nt, Artificial Sequence
  ZNF483__Homo_sapiens__NP_001007170
augcaggccguggugccccugaacaagaugaccgccaucagccccgagccccagacccuggccagcaccgagcagaacgaggugcccagaguggugaccagcggcgagcaggaggccauccugagaggcaacgccgccgacgccgagagcuucagacagagauucagaugguucugcuacagcgagguggccggccccagaaaggcccugagccagcugugggagcugugcaaccaguggcugagacccgacauccacaccaaggagcagauccuggagcugcugguguucgagcaguuccugaccauccugcccggcgagaucagaaucugggugaagagccagcaccccgagagcagcgaggagguggugacccugaucgaggaccugacccagaugcuggaggagaaggaccccgugagccaggacagcaccgugagccaggaggagaacagcaaggaggacaagauggugaccgugugccccaacaccgagagcugcgagagcaucacccugaaggacguggccgugaacuucagcagaggcgaguggaagaagcuggagcccuuccagaaggagcuguacaaggaggugcugcuggagaaccugagaaaccuggaguuccuggacuuccccgugagcaagcuggagcugaucagccagcugaaguggguggagcugcccuggcugcuggaggaggugagcaagagcagcagacuggacauccacggcgccgugaagaagaugcagauguucagcgaggccgaguaa

SEQ ID NO: 26008 - RNA, 1590 nt, Artificial Sequence
  ZNF490__Homo_sapiens__NP_065765
augagaagaaacagcagccugagcuuccagauggagagaccccuggaggagcaggugcagagcaaguggagcagcagccagggcagaaccggcaccggcggcagcgacgugcugcagaugcagaacagcgagcaccacggccagagcaucaagacccagaccgacagcaucagccuggaggacguggccgugaacuucacccuggaggagugggcccugcuggaccccggccagagaaacaucuacagagacgugaugagagccaccuucaagaaccuggccugcaucggcgagaaguggaaggaccaggacaucgaggacgagcacaagaaccagggcagaaaccugagaagccccaugguggaggcccugugcgagaacaaggaggacugccccugcggcaagagcaccagccagauccccgaccugaacaccaaccuggagacccccaccggccugaagcccugcgacugcagcgugugcggcgagguguucaugcaccaggugagccugaacagacacaugagaagccacaccgagcagaagcccaacgagugccacgaguacggcgagaagccccacaagugcaaggagugcggcaagaccuucaccagaagcagcagcaucagaacccacgagagaauccacaccggcgagaagcccuacgagugcaaggagugcggcaaggccuucgccuuccuguucagcuucagaaaccacaucagaauccacaccggcgagacccccuacgagugcaaggagugcggcaaggccuucagauaccugaccgcccugagaagacacgagaagaaccacaccggcgagaagcccuacaagugcaagcagugcggcaaggccuucaucuacuaccagcccuuccugacccacgagagaacccacaccggcgagaagcccuacgagugcaagcagugcggcaaggccuucagcugccccaccuaccugagaagccacgagaagacccacaccggcgagaagcccuucgugugcagagagugcggcagagccuucuucagccacagcagccugagaaagcacgugaagacccacaccggcgugcagcccuacaccugcaagaagugcggcgaggccuucaagagcagcagcagcugcgaggugcacgagagaacccacuucggcgagaagcccuacgagugcaagcagugcggcaaggccuucaacagcagcagcuaccugcagcugcacgagagagugcacaccggcgagaagaccuacgagugcaaggagugcggcaaggccuuccuguacagcacccacuucagaauccacgagagaacccacaccagagagaagcccuacgagugcaagcagugcggcagaguguucaucuacuucagccaccugagaagacacgagagaagccacaccggcgugaagcccugcgagugcaagcagugcggcaaggccuucaccugccugaacagccugaaggugcacaagagaauccacaccggcgagagacccuuccagugcagacagugcggcaaggccuucagcuacagcaagagccugcacgugcacgagagaacccacagcagacagaagcccuaa

SEQ ID NO: 26009 - RNA, 1596 nt, Artificial Sequence
  ZNF492__Homo_sapiens__NP_065906
augcuggagaacuacagaaaccugguguucgugggcaucgccgccagcaagcccgaccugaucaccugccuggagcagggcaaggagcccuggaacgugaagagacacgagaugguggccgagccccccguggugugcagcuacuucgccagagaccuguggcccaagcagggcaagaagaacuacuuccagaaggugauccugagaagauacaagaagugcggcugcgagaaccugcagcugagaaaguacugcaagagcauggacgagugcaaggugcacaaggagugcuacaacggccugaaccagugccugaccaccacccagaacaagaucuuccagugcgacaaguacgugaagguguuccacaaguucagcaacagcaacagacacaccaucagacacaccggcaagaagagcuucaagugcaaggagugcgagaagagcuucugcaugcugagccaccuggcccagcacaagagaauccacagcggcgagaagcccuacaagugcaaggagugcggcaaggccuacaacgagaccagcaaccugagcacccacaagagaauccacaccggcaagaagcccuacaagugcgaggagugcggcaaggccuucaacagacugagccaccugaccacccacaagaucauccacaccggcaagaagcccuacaagugcgaggagugcggcaaggccuucaaccagagcgccaaccugaccacccacaagagaauccacaccggcgagaagcccuacaagugcgaggagugcggcagagccuucagccagagcagcacccugaccgcccacaagaucauccacgccggcgagaagcccuacaagugcgaggagugcggcaaggccuucagccagagcagcacccugaccacccacaagaucauccacaccggcgagaaguucuacaagugcgaggagugcggcaaggccuucagccagcugagccaccugaccacccacaagagaauccacagcggcgagaagcccuacaagugcgaggagugcggcaaggccuucaagcagagcagcacccugaccacccacaagagaauccacgccggcgagaaguucuacaagugcgaggugugcagcaaggccuucagcagauucagccaccugaccacccacaagagaauccacaccggcgagaagcccuacaagugcgaggagugcggcaaggccuucaaccugagcagccagcugaccacccacaagaucauccacaccggcgagaagcccuacaagugcgaggagugcggcaaggccuucaaccagagcagcacccugagcaagcacaaggugauccacaccggcgagaagcccuacaaguacgaggagugcggcaaggccuucaaccagagcagccaccugaccacccacaagaugauccacaccggcgagaagcccuacaagugcgaggagugcggcaaggccuucaacaacagcagcauccugaacagacacaagaugauccacaccggcgagaagcuguacaagcccgagagcugcaacaacgccugcgacaacaucgccaagaucagcaaguacaagagaaacugcgccggcgagaaguaa

SEQ ID NO: 26010 - RNA, 1764 nt, Artificial Sequence
  ZNF496__Homo_sapiens__NP_116141
augcccaccgcccugugccccagagugcuggcccccaaggagagcgaggagcccagaaagaugagaagcccccccggcgagaaccccagcccccagggcgagcugcccagccccgagagcagcagaagacuguucagaagauucagauaccaggaggccgccggccccagagaggcccugcagagacugugggaccugugcggcggcuggcugagacccgagagacacaccaaggagcagauccuggagcugcuggugcuggagcaguuccuggccauccugcccagagagauccagagcugggugagagcccaggagcccgagagcggcgagcaggccguggccgccguggaggcccuggagagagagcccggcagacccuggcaguggcugaagcacugcgaggaccccguggugaucgacgacggcgacagcccccuggaccaggagcaggagcagcugcccguggagccccacagcgaccuggccaagaaccaggacgcccagcccaucacccuggcccagugccugggccugcccagcagaccccccagccagcugagcggcgaccccgugcugcaggacgccuuccugcugcaggaggagaacgugagagacacccagcaggugaccacccugcagcugccccccagcagagugagccccuucaaggacaugauccugugcuucagcgaggaggacuggagccugcuggaccccgcccagaccggcuucuacggcgaguucaucaucggcgaggacuacggcgugagcaugccccccaacgaccuggccgcccagcccgaccugagccagggcgaggagaacgagcccagagugcccgagcugcaggaccugcagggcaaggaggugccccaggugagcuaccuggacagccccagccugcagcccuuccagguggaggagagaagaaagagagaggagcugcaggugcccgaguuccaggccugcccccagaccguggugccccagaacaccuaccccgccggcggcaaccccagaagccuggagaacagccuggacgaggaggugaccaucgagaucgugcugagcagcagcggcgacgaggacagccagcacggccccuacugcaccgaggagcugggcagccccaccgagaagcagagaagccugcccgccagccacagaagcagcaccgaggccggcggcgaggugcagaccagcaagaagagcuacgugugccccaacugcggcaagaucuucagauggagagugaacuucaucagacaccugagaagcagaagagagcaggagaagccccacgagugcagcgugugcggcgagcuguucagcgacagcgaggaccuggacggccaccuggagagccacgaggcccagaagcccuacagaugcggcgccugcggcaagagcuucagacugaacagccaccugcugagccacagaagaauccaccugcagcccgacagacugcagcccguggagaagagagagcaggccgccagcgaggacgccgacaagggccccaaggagccccuggagaacggcaaggccaagcugagcuuccagugcugcgagugcggcaaggccuuccagagacacgaccaccuggccagacacagaagccacuuccaccugaaggacaaggccagacccuuccagugcagauacugcgugaagagcuucacccagaacuacgaccugcugagacacgagagacugcacaugaagagaagaagcaagcaggcccugaacagcuacuaa

SEQ ID NO: 26011 - RNA, 816 nt, Artificial Sequence
  ZNF501__Homo_sapiens__NP_659481
augaacagcagccagaucagccugagaaugaagcacggcagagugaacaugcagaagaagcccagcaagugcagcgagugcggcaaguucuucacccagagaagcagccugacccagcaccagagaauccacagaggcgagaagcccuacgugugcagcgagugcggcagcugcuucagaaagcagagcaaccugacccagcaccugagaauccacaccggcgagaagcccuacaagugcaacgagugcgagaaggccuuccagaccaaggccauccuggugcagcaccugagaauccacaccggcgagaagcccuacaagugcaacgagugcggcaaggccuucugccagagccccagccugaucaagcaccagagaauccacaccggcgagaagcccuacaagugcaccgagugcggcaaggccuucagccagagcaucugccugaccagacaccagagaagccacagcggcgacaagcccuucaagugcaacgagugcggcaaggccuucaaccagagcgccugccugaugcagcaccagagaauccacagcggcgagaagcccuacaccugcaccgagugcggcaaggccuucacccagaacagcagccugguggagcacgagagaacccacaccggcgagaagcuguacaagugcagcgagugcgagaagaccuucagaaagcaggcccaccugagcgagcacuacagaauccacaccggcgagaagcccuacgagugcgugggcugcggcaagagcuucagacacagcagcgcccugcugagacaccagagacugcacgccggcgaguaa

SEQ ID NO: 26012 - RNA, 2862 nt, Artificial Sequence
  ZNF507__Homo_sapiens__NP_001129628
auggaggagagcagcagcguggccaugcuggugcccgacaucggcgagcaggaggccauccugaccgccgagagcaucaucagccccagccuggagaucgacgagcagagaaagaccaagcccgacccccugauccacgugauccagaagcugagcaagaucguggagaacgagaagagccagaagugccugcugaucggcaagaagagacccagaagcagcgccgccacccacagccuggagacccaggagcugugcgagauccccgccaaggugauccagagccccgccgccgacaccagaagagccgagaugagccagaccaacuucacccccgacacccuggcccagaacgagggcaaggccaugagcuaccagugcagccugugcaaguuccugagcagcagcuucagcgugcugaaggaccacaucaagcagcacggccagcagaacgaggugauccugaugugcagcgagugccacaucaccagcagaagccaggaggagcuggaggcccacguggugaacgaccacgacaacgacgccaacauccacacccagagcaaggcccagcagugcgugagccccagcagcagccugugcagaaagaccaccgagagaaacgagaccauccccgacauccccgugagcguggacaaccugcagacccacaccgugcagaccgccagcguggccgagaugggcagaagaaagugguacgccuacgagcaguacggcauguacagaugccuguucugcagcuacaccugcggccagcagagaaugcugaagacccacgccuggaagcacgccggcgagguggacugcagcuaccccaucuucgagaacgagaacgagccccugggccugcuggacagcagcgccgccgccgcccccggcggcguggacgccguggugaucgccaucggcgagagcgagcugagcauccacaacggccccagcgugcaggugcagaucugcagcagcgagcagcugagcagcagcagcccccuggagcagagcgccgagagaggcgugcaccugagccagagcgugacccuggaccccaacgaggaggagaugcuggaggugaucagcgacgccgaggagaaccugauccccgacagccugcugaccagcgcccagaagaucaucagcagcagccccaacaagaagggccacgugaacgugaucguggagagacugcccagcgccgaggagacccugagccagaagagauuccugaugaacaccgagauggaggagggcaaggaccugagccugaccgaggcccagaucggcagagagggcauggacgacguguacagagccgacaagugcaccguggacaucggcggccugaucaucggcuggagcagcagcgagaagaaggacgagcugaugaacaagggccuggccaccgacgagaacgccccccccggcagaagaagaaccaacagcgagagccugagacugcacagccuggccgccgaggcccuggugaccaugcccaucagagccgccgagcugaccagagccaaccugggccacuacggcgacaucaaccugcuggaccccgacaccagccagagacagguggacagcacccuggccgccuacagcaagaugaugagcccccugaagaacagcagcgacggccugaccagccugaaccagagcaacagcacccugguggcccugcccgagggcagacaggagcugagcgacggccaggugaagaccggcaucagcaugagccugcugaccgugaucgagaagcugagagagagaaccgaccagaacgccagcgacgacgacauccugaaggagcugcaggacaacgcccagugccagcccaacagcgacaccagccugagcggcaacaacgugguggaguacauccccaacgccgagagacccuacagaugcagacugugccacuacaccagcggcaacaagggcuacaucaagcagcaccugagagugcacagacagagacagcccuaccagugccccaucugcgagcacaucgccgacaacagcaaggaccuggagagccacaugauccaccacugcaagaccagaaucuaccagugcaagcagugcgaggagagcuuccacuacaagagccagcugagaaaccacgagagagagcagcacagccugcccgacacccugagcaucgccaccagcaacgagcccagaaucagcagcgacaccgccgacggcaagugcgugcaggagggcaacaagagcagcgugcagaagcaguacagaugcgacgugugcgacuacaccagcaccaccuacgugggcgugagaaaccacagaagaauccacaacagcgacaagcccuacagaugcagccugugcggcuacgugugcagccacccccccagccugaagagccacauguggaagcacgccagcgaccagaacuacaacuacgagcaggugaacaaggccaucaacgacgccaucagccagagcggcagagugcugggcaagagccccggcaagacccagcugaagagcagcgaggagagcgccgaccccgugaccggcagcagcgagaacgccgugagcagcagcgagcugaugagccagacccccagcgaggugcugggcaccaacgagaacgagaagcugagccccaccagcaacaccagcuacagccuggagaagaucagcagccuggccccccccagcauggaguacugcgugcugcuguucugcugcugcaucugcggcuucgagagcaccagcaaggagaaccugcuggaccacaugaaggagcacgagggcgagaucgugaacaucauccugaacaaggaccacaacaccgcccugaacaccaacuaa

SEQ ID NO: 26013 - RNA, 2679 nt, Artificial Sequence
  ZNF512B__Homo_sapiens__NP_065764
augaccgaccccuucugcgugggcggcagaagacugcccggcagcagcaagagcggccccggcaaggacggcagcagaaaggaggugagacugcccaugcugcacgacccccccaagaugggcaugcccguggugagaggcggccagaccgugcccggccaggccccccugugcuucgaccccggcagccccgccagcgacaagaccgagggcaagaagaagggcagacccaaggccgagaaccaggcccugagagacaucccccugagccugaugaacgacuggaaggacgaguucaaggcccacagcagagugaagugccccaacagcggcugcuggcuggaguuccccagcaucuacggccugaaguaccacuaccagagaugccagggcggcgccaucagcgacagacuggccuuccccugccccuucugcgaggccgccuucaccagcaagacccagcuggagaagcacagaaucuggaaccacauggacagaccccugcccgccagcaagcccggccccaucagcagacccgugaccaucagcagacccgugggcgugagcaagcccaucggcgugagcaagcccgugaccaucggcaagcccgugggcgugagcaagcccaucggcaucagcaagcccgugagcgugggcagacccaugcccgugaccaaggccauccccgugaccagacccgugcccgugaccaagcccgugaccgugagcagacccaugcccgugaccaaggccaugcccgugaccaagcccaucaccgugaccaagagcgugcccgugaccaagcccgugcccgugaccaagcccaucaccgugaccaagcuggugaccgugaccaagcccgugcccgugaccaagcccgugaccgugagcagacccaucguggugagcaagcccgugaccgugagcagacccaucgccaucagcagacacaccccccccugcaagauggugcugcugaccagaagcgagaacaaggcccccagagccaccggcagaaacagcggcaagaagagagccgccgacagccuggacaccugccccaucccccccaagcaggccagacccgagaacggcgaguacggccccagcagcaugggccagagcagcgccuuccagcugagcgccgacaccagcagcggcagccugagccccggcagcagacccagcggcggcauggaggcccugaaggccgccggccccgccagcccccccgaggaggaccccgagagaaccaagcacagaagaaagcagaagacccccaagaaguucaccggcgagcagcccagcaucagcggcaccuucggccugaagggccuggugaaggccgaggacaaggccagagugcacagaagcaagaagcaggagggccccggccccgaggacgccagaaagaaggugcccgccgcccccaucaccgugagcaaggaggcccccgcccccguggcccaccccgcccccggcggccccgaggagcaguggcagagagccauccacgagagaggcgaggccgugugccccaccugcaacguggugaccagaaagacccuggugggccugaagaagcacauggaggugugccagaagcugcaggacgcccugaagugccagcacugcagaaagcaguucaagagcaaggccggccugaacuaccacaccauggccgagcacagcgccaagcccagcgacgccgaggccagcgagggcggcgagcaggaggagagagagagacugagaaaggugcugaagcagaugggcagacugagaugcccccaggagggcugcggcgccgccuucagcagccugaugggcuaccaguaccaccagagaagaugcggcaagccccccugcgagguggacagccccagcuuccccugcacccacugcggcaagaccuacagaagcaaggccggccacgacuaccacgugagaagcgagcacaccgcccccccccccgaggagcccaccgacaagagccccgaggccgaggacccccugggcguggagagaacccccagcggcagagugagaagaaccagcgcccagguggccguguuccaccugcaggagaucgccgaggacgagcuggccagagacuggaccaagagaagaaugaaggacgaccuggugcccgagaccgccagacugaacuacaccagacccggccugcccacccugaacccccagcugcuggaggccuggaagaacgaggugaaggagaagggccacgugaacugccccaacgacugcugcgaggccaucuacagcagcgugagcggccugaaggcccaccuggccagcugcagcaagggcgcccaccuggccggcaaguacagaugccugcugugccccaaggaguucagcagcgagagcggcgugaaguaccacauccugaagacccacgccgagaacugguucagaaccagcgccgaccccccccccaagcacagaagccaggacagccuggugcccaagaaggagaagaagaagaaccuggccggcggcaagaagagaggcagaaagcccaaggagagaacccccgaggagcccguggccaagcugccccccagaagagacgacuggccccccggcugcagagacaagggcgccagaggcagcaccggcagaaaggugggcgugagcaaggcccccgagaaguaa

SEQ ID NO: 26014 - RNA, 1617 nt, Artificial Sequence
  ZNF512__Homo_sapiens__NP_001258215
augagcagcagacugggcgccgugcccgccaccagcggccccaccaccuucaagcagcagagaagcaccagaaucgugggcgccaagaacagaacccagugcagcaucaaggacaacagcuuccaguacaccaucccccacgacgacagccugagcggcagcagcagcgccagcagcugcgagcccgugagcgacuuccccgccagcuucagaaagagcaccuacuggaugaagaugagaagaaucaagcccgccgccaccagccacguggagggcagcggcggcgugagcgccaagggcaagagaaagcccagacaggaggaggacgaggacuacagagaguucccccagaagaagcacaagcuguacggcagccuggaggagcagugguaccuggagaucguggacaagggcagcgugagcugccccaccugccaggccgugggcagaaagaccaucgagggccugaagaagcacauggagaacugcaagcaggagauguucaccugccaccacugcggcaagcagcugagaagccuggccggcaugaaguaccacgugauggccaaccacaacagccugcccauccugaaggccggcgacgagaucgacgagcccagcgagagagagagacugagaaccgugcugaagagacugggcaagcugagaugcaugagagagagcugcagcagcagcuucaccagcaucaugggcuaccuguaccacgugagaaagugcggcaagggcgccgccgagcuggagaagaugacccugaagugccaccacugcggcaagcccuacagaagcaaggccggccuggccuaccaccugagaagcgagcacggccccaucagcuucuuccccgagagcggccagcccgagugccugaaggagaugaaccuggagagcaagagcggcggcagagugcagagaagaagcgccaagaucgccguguaccaccugcaggagcuggccagcgccgagcuggccaaggaguggcccaagagaaaggugcugcaggaccuggugcccgacgacagaaagcugaaguacaccagacccggccugcccaccuucagccaggaggugcugcacaaguggaagaccgacaucaagaaguaccacagaauccagugccccaaccagggcugcgaggccguguacagcagcgugagcggccugaaggcccaccugggcagcugcacccugggcaacuucguggccggcaaguacaagugccugcugugccagaaggaguucgugagcgagagcggcgugaaguaccacaucaacagcgugcacgccgaggacugguucguggugaaccccaccaccaccaagagcuucgagaagcugaugaagaucaagcagagacagcaggaggaggagaagagaagacagcagcacagaagcagaagaagccugagaagaagacagcagcccggcaucgagcugcccgagaccgagcugagccugagagugggcaaggaccagagaagaaacaacgaggagcugguggugagcgccagcugcaaggagcccgagcaggagcccgugcccgcccaguuccagaaggugaagccccccaagaccaaccacaagagaggcagaaaguaa

SEQ ID NO: 26015 - RNA, 1440 nt, Artificial Sequence
  ZNF513__Homo_sapiens__NP_001188388
augggcuucgagagagacagcgagggcgacagccugggcgccagacccggccugcccuacggccugagcgacgacgagagcggcggcggcagagcccugagcgccgagagcgagguggaggagcccgccagaggccccggcgaggccagaggcgagagacccggccccgccugccagcugugcggcggccccaccggcgagggccccugcugcggcgccggcggccccggcggcggcccccugcugccccccagacugcuguacagcugcagacugugcaccuucgugagccacuacagcagccaccugaagagacacaugcagacccacagcggcgagaagcccuucagaugcggcagaugccccuacgccagcgcccagcuggugaaccugaccagacacaccagaacccacaccggcgagaagcccuacagaugcccccacugccccuucgccugcagcagccugggcaaccugagaagacaccagagaacccacgccggcccccccaccccccccugccccaccugcggcuucagaugcugcacccccagacccgccagaccccccagccccaccgagcaggagggcgccgugcccagaagacccgaggacgcccugcugcugcccgaccugagccugcacgugccccccggcggcgccagcuuccugcccgacugcggccagcugagaggcgagggcgagggccugugcggcaccggcagcgagccccugcccgagcugcuguuccccuggaccugcagaggcugcggccaggagcuggaggagggcgagggcagcagacugggcgccgccaugugcggcagaugcaugagaggcgaggccggcggcggcgccagcggcggcccccagggccccagcgacaagggcuucgccugcagccugugccccuucgccacccacuaccccaaccaccuggccagacacaugaagacccacagcggcgagaagcccuucagaugcgccagaugccccuacgccagcgcccaccuggacaaccugaagagacaccagagagugcacaccggcgagaagcccuacaagugcccccugugccccuacgccugcggcaaccuggccaaccugaagagacacggcagaauccacagcggcgacaagcccuucagaugcagccugugcaacuacagcugcaaccagagcaugaaccugaagagacacaugcugagacacaccggcgagaagcccuucagaugcgccaccugcgccuacaccaccggccacugggacaacuacaagagacaccagaaggugcacggccacggcggcgccggcggccccggccugagcgccagcgagggcugggcccccccccacagcccccccagcgugcugagcagcagaggcccccccgcccugggcaccgccggcagcagagccgugcacaccgacagcagcuaa

SEQ ID NO: 26016 - RNA, 3492 nt, Artificial Sequence
  ZNF516__Homo_sapiens__NP_055458
auggacagaaacagagaggccgagauggagcugagaagaggccccagccccaccagagccggcagaggccacgagguggacggcgacaaggccaccugccacaccugcugcaucugcggcaagagcuuccccuuccagagcagccugagccagcacaugagaaagcacaccggcgagaagcccuacaagugccccuacugcgaccacagagccagccagaagggcaaccugaagauccacaucagaagccacagaaccggcacccugauccagggccacgagcccgaggccggcgaggccccccugggcgagaugagagccagcgagggccuggacgccugcgccagccccaccaagagcgccagcgccugcaacagacugcugaacggcgccagccaggccgacggcgccagagugcugaacggcgccagccaggccgacagcggcagagugcugcugagaagcagcaagaagggcgccgagggcagcgccugcgcccccggcgaggccaaggccgccgugcagugcagcuucugcaagagccaguucgagagaaagaaggaccuggagcugcacgugcaccaggcccacaagcccuucaagugcagacugugcagcuacgccacccugagagaggagagccugcugagccacaucgagagagaccacaucaccgcccagggccccggcagcggcgaggccugcguggagaacggcaagcccgagcugagccccggcgaguuccccugcgaggugugcggccaggccuucagccagaccugguuccugaaggcccacaugaagaagcacagaggcagcuucgaccacggcugccacaucugcggcagaagauucaaggagcccugguuccugaagaaccacaugaaggcccacggccccaagaccggcagcaagaacagacccaagagcgagcuggaccccaucgccaccaucaacaacguggugcaggaggaggugaucguggccggccugagccuguacgaggugugcgccaagugcggcaaccuguucaccaaccuggacagccugaacgcccacaacgccauccacagaagaguggaggccagcagaaccagagcccccgccgaggagggcgccgagggccccagcgacaccaagcaguucuuccugcagugccugaaccugagacccagcgccgccggcgacagcugccccggcacccaggccggcagaagaguggccgagcuggaccccgugaacagcuaccaggccuggcagcuggccaccagaggcaagguggccgagcccgccgaguaccugaaguacggcgccugggacgaggcccuggccggcgacguggccuucgacaaggacagaagagaguacgugcuggugagccaggagaagagaaagagagagcaggacgcccccgccgcccagggcccccccagaaagagagccagcggccccggcgaccccgcccccgccggccaccuggaccccagaagcgccgccagacccaacagaagagccgccgccaccaccggccagggcaagagcagcgagugcuucgagugcggcaagaucuucagaaccuaccaccagauggugcugcacagcagagugcacagaagagccagaagagagagagacagcgacggcgacagagccgccagagccagaugcggcagccugagcgagggcgacagcgccagccagcccagcagccccggcagcgccugcgccgccgccgacagccccggcagcggccuggccgacgaggccgccgaggacagcggcgaggagggcgcccccgagcccgcccccggcggccagcccagaagaugcugcuucagcgaggaggugaccagcaccgagcugagcagcggcgaccagagccacaagaugggcgacaacgccagcgagagagacaccggcgagagcaaggccggcaucgccgccagcgugagcauccuggagaacagcagcagagagaccagcagaagacaggagcagcacagauucagcauggaccugaagaugcccgccuuccaccccaagcaggaggugcccgugcccggcgacggcguggaguuccccagcagcaccggcgccgagggccagaccggccaccccgccgagaagcugagcgaccugcacaacaaggagcacagcggcggcggcaagagagcccuggcccccgaccugaugccccuggaccugagcgccagaagcaccagagacgaccccagcaacaaggagaccgccagcagccugcaggccgcccugguggugcaccccugccccuacugcagccacaagaccuacuaccccgaggugcuguggaugcacaagagaaucuggcacagagugagcugcaacagcguggccccccccuggauccagcccaacggcuacaagagcaucagaagcaaccugguguuccugagcagaagcggcagaaccggccccccccccgcccugggcggcaaggagugccagccccugcugcuggccagauucaccagaacccaggugcccggcggcaugcccggcagcaagagcggcagcagcccccugggcguggugaccaaggccgccagcaugcccaagaacaaggagagccacagcggcggccccugcgcccugugggcccccggccccgacggcuacagacagaccaagcccugccacggccaggagccccacggcgccgccacccagggcccccuggccaagcccagacaggaggccagcagcaagcccgugcccgcccccggcggcggcggcuucagcagaagcgccacccccacccccaccgugaucgccagagccggcgcccagcccagcgccaacagcaagcccguggagaaguucggcgugccccccgccggcgccggcuucgcccccaccaacaagcacagcgcccccgacagccugaaggccaaguucagcgcccagccccagggccccccccccgccaagggcgagggcggcgcccccccccugccccccagagagccccccagcaaggccgcccaggagcugagaacccuggccaccugcgccgccggcagcagaggcgacgccgcccugcaggcccagcccggcguggccggcgccccccccgugcugcacagcaucaagcaggagcccguggccgagggccacgagaagagacuggacauccugaacaucuucaagaccuacauccccaaggacuucgccacccuguaccagggcuggggcgugagcggccccggccuggagcacagaggcacccugagaacccaggccagacccggcgaguucgugugcaucgagugcggcaagagcuuccaccagcccggccaccugagagcccacaugagagcccacagcgugguguucgagagcgacggccccagaggcagcgaggugcacaccaccagcgccgacgcccccaagcagggcagagaccacagcaacaccggcaccgugcagaccgugccccugagaaagggcaccuaa

SEQ ID NO: 26017 - RNA, 1623 nt, Artificial Sequence
  ZNF519__Homo_sapiens__XP_011523906
auggagcugcugaccuucagagacguggccaucgaguucagccccgaggaguggaagugccuggaccccgcccagcagaaccuguacagagacgugaugcuggagaacuacagaaaccuggugagccuggccguguacagcuacuacaaccagggcauccugcccgagcagggcauccaggacagcuucaagaaggccacccugggcagauacggcagcugcggccuggagaacaucugccuguggaagaacugggagagcaucggcgagggcgagggccagaaggagugcuacaaccugugcagccaguaccugaccaccagccacaacaagcaccugaccgugaagggcgacaaggaguacagaaucuuccagaagaagccccaguuccugagcgccgcccccaccgagcccugcauccccaugaacaaguaccagcacaaguuccugaagagcguguucugcaacaagaaccagaucaacuucaaccacgacagcaacaucagcaagcaccacagcacccacuuccuggagaacuacuacaacugcaacgagugcgagaagguguucuaccagagcagcaagcugaucuuccccgagaacauccacauccagaagaagcccuacaacagcaacgagugcggcgagaccagcgaccccuucagcaagcugacccagcaccagagaaucuacaucggcgagagcagccagagaugcaacaagaagugcaucaucguguucagccagagccaccugaagggccacaagaucaucaacaccggcgagaagagcgugaaguacaaggagagaggcaaggccuucaccagaggccugcaccugggccaccagaagauccacaccggcgagaagcccuacaagugcaagaagugcgacaaggccuucaacaagagcagccaccuggcccagcaccagagaauccacaccggcgagaagcccuucaagugcaaggagugcggcaaggccuucaacagaggcagcuaccugacccagcaccagagaauccacaccggcgagagagccuucaagugcgaggagugcggcaaggccuucaacagaggcagcuaccugacccagcaccagagaauccacaccggcgagaagcccuucagaugcaaggagugcggcaaggccuucaacagaagcagcuacgugacccagcaccagagaaugcacaccggcgagaagcccuucaagugcaaggagugcggcaaggccuucaacagagccagccaccugacccagcaccagagaauccacaccggcgagaagcacuucaagugcaaggagugcggcaaggccuucaacagaggcagccaccugaccagacaccagagaauccacaccggcgagaagagcuucaagugcgaggagugcggcaaggccuucaucuggggcagccaccugacccagcaccagagagugcacaccggcgagaaguucuucaagugcaaggagugcggcaaggccuucaccagaagcagccaccugacccagcaccagagaauccacaccggcgagaagcccuucaagugcaaggagugcggcaaggccuucaacagaagaagcacccugacccagcaccagaucauccacaccagauaa

SEQ ID NO: 26018 - RNA, 3936 nt, Artificial Sequence
  ZNF521__Homo_sapiens__NP_056276
augagcagaagaaagcaggccaagcccagaagccugaaggaccccaacugcaagcuggaggacaagaccgaggacggcgaggcccuggacugcaagaagagacccgaggacggcgaggagcuggaggacgaggccgugcacagcugcgacagcugccugcagguguucgagagccugagcgacaucaccgagcacaagaucaaccagugccagcugaccgacggcguggacguggaggacgaccccaccugcagcuggcccgccagcagccccagcagcaaggaccagaccagccccagccacggcgagggcugcgacuucggcgaggaggagggcggccccggccugcccuaccccugccaguucugcgacaagagcuucagcagacugagcuaccugaagcaccacgagcagagccacagcgacaagcugcccuucaagugcaccuacugcagcagacuguucaagcacaagagaagcagagacagacacaucaagcugcacaccggcgacaagaaguaccacugcagcgagugcgacgccgccuucagcagaagcgaccaccugaagauccaccugaagacccacaccagcaacaagcccuacaagugcgccaucugcagaagaggcuuccugagcagcagcagccugcacggccacaugcaggugcacgagagaaacaaggacggcagccagagcggcagcagaauggaggacuggaagaugaaggacacccagaagugcagccagugcgaggagggcuucgacuuccccgaggaccugcagaagcacaucgccgagugccaccccgagugcagccccaacgaggacagagccgcccugcagugcguguacugccacgagcuguucguggaggagaccagccugaugaaccacauggagcaggugcacagcggcgagaagaagaacagcugcagcaucugcagcgagagcuuccacaccguggaggagcuguacagccacauggacagccaccagcagcccgagagcugcaaccacagcaacagccccagccuggugaccgugggcuacaccagcgugagcagcaccacccccgacagcaaccugagcguggacagcagcaccaugguggaggccgccccccccauccccaagagcagaggcagaaagagagccgcccagcagacccccgacaugaccggccccagcagcaagcaggccaaggugaccuacagcugcaucuacugcaacaagcagcuguucagcagccuggccgugcugcagauccaccugaagaccaugcaccuggacaagcccgagcaggcccacaucugccaguacugccuggaggugcugcccagccuguacaaccugaacgagcaccugaagcaggugcacgaggcccaggaccccggccugaucgugagcgccaugcccgccaucguguaccagugcaacuucugcagcgagguggugaacgaccugaacacccugcaggagcacaucagaugcagccacggcuucgccaaccccgccgccaaggacagcaacgccuucuucugcccccacugcuacaugggcuuccugaccgacagcagccuggaggagcacaucagacaggugcacugcgaccugagcggcagcagauucggcagccccgugcugggcacccccaaggagcccgugguggagguguacagcugcagcuacugcaccaacagccccaucuucaacagcgugcugaagcugaacaagcacaucaaggagaaccacaagaacaucccccuggcccugaacuacauccacaacggcaagaagagcagagcccugagcccccugagccccguggccaucgagcagaccagccugaagaugaugcaggccgugggcggcgcccccgccagacccaccggcgaguacaucugcaaccagugcggcgccaaguacaccagccuggacagcuuccagacccaccugaagacccaccuggacaccgugcugcccaagcugaccugcccccagugcaacaaggaguuccccaaccaggagagccugcugaagcacgugaccauccacuucaugaucaccagcaccuacuacaucugcgagagcugcgacaagcaguucaccagcguggacgaccugcagaagcaccugcuggacaugcacaccuucguguucuucagaugcacccugugccaggagguguucgacagcaaggugagcauccagcugcaccuggccgugaagcacagcaacgagaagaagguguacagaugcaccagcugcaacugggacuucagaaacgagaccgaccugcagcugcacgugaagcacaaccaccuggagaaccagggcaaggugcacaagugcaucuucugcggcgagagcuucggcaccgagguggagcugcagugccacaucaccacccacagcaagaaguacaacugcaaguucugcagcaaggccuuccacgccaucauccugcuggagaagcaccugagagagaagcacugcguguucgagaccaagacccccaacugcggcaccaacggcgccagcgagcaggugcagaaggaggagguggagcugcagacccugcugaccaacagccaggagagccacaacagccacgacggcagcgaggaggacguggacaccagcgagcccauguacggcugcgacaucugcggcgccgccuacaccauggagacccugcugcagaaccaccagcugagagaccacaacaucagacccggcgagagcgccaucgugaagaagaaggccgagcugaucaagggcaacuacaagugcaacgugugcagcagaaccuucuucagcgagaacggccugagagagcacaugcagacccaccugggccccgugaagcacuacaugugccccaucugcggcgagagauuccccagccugcugacccugaccgagcacaaggugacccacagcaagagccuggacaccggcaacugcagaaucugcaagaugccccugcagagcgaggaggaguuccuggagcacugccagaugcaccccgaccugagaaacagccugaccggcuucagaugcguggugugcaugcagaccgugaccagcacccuggagcugaagauccacggcaccuuccacaugcagaagaccggcaacggcagcgccgugcagaccaccggcagaggccagcacgugcagaagcuguacaagugcgccagcugccugaaggaguucagaagcaagcaggaccuggugaagcuggacaucaacggccugcccuacggccugugcgccggcugcgugaaccugagcaagagcgccagccccggcaucaacgugccccccggcaccaacagacccggccugggccagaacgagaaccugagcgccaucgagggcaagggcaaggugggcggccugaagaccagaugcagcagcugcaacgugaaguucgagagcgagagcgagcugcagaaccacauccagaccauccacagagagcuggugcccgacagcaacagcacccagcugaagaccccccaggugagccccaugcccagaaucagccccagccagagcgacgagaagaagaccuaccagugcaucaagugccagaugguguucuacaacgagugggacauccaggugcacguggccaaccacaugaucgacgagggccugaaccacgagugcaagcugugcagccagaccuucgacagccccgccaagcugcagugccaccugaucgagcacagcuucgagggcaugggcggcaccuucaagugccccgugugcuucaccguguucgugcaggccaacaagcugcagcagcacaucuucagcgcccacggccaggaggacaagaucuacgacugcacccagugcccccagaaguucuucuuccagaccgagcugcagaaccacaccaugacccagcacagcagcuaa

SEQ ID NO: 26019 - RNA, 3903 nt, Artificial Sequence
  ZNF536__Homo_sapiens__NP_055532
auggaggaggccagccugugccugggcgugagcagcgccgagcccgaggccgagccccaccugagcggccccgugcugaacggccaguacgccaugagccagaagcugcaccagaucaccagccagcugagccacgccuuccccgagcugcaccccagacccaaccccgaggagaagccccccgccagccuggaggagaaggcccacgugcccaugagcggccagcccaugggcagccagauggcccugcuggccaaccagcugggcagagagguggacaccagccugaacggcagaguggaccugcagcaguuccugaacggccagaaccugggcaucaugagccagaugagcgacaucgaggacgacgccagaaagaacagaaaguaccccugcccccugugcggcaagagauucagauucaacagcauccugagccugcacaugagaacccacaccggcgagaagcccuucaagugccccuacugcgaccacagagccgcccagaagggcaaccugaagauccaccugagaacccacaagcugggcaaccugggcaagggcagaggcagagugagagaggagaacagacugcugcacgagcuggaggagagagccauccugagagacaagcagcugaagggcagccugcugcagcccagacccgaccugaagccccccccccacgcccagcaggccccccuggccgccugcacccuggcccugcaggccaaccacagcgugcccgacguggcccaccccgugcccagccccaagcccgccagcgugcaggaggacgccguggcccccgccgccggcuucagaugcaccuucugcaagggcaaguucaagaagagagaggagcuggacagacacaucagaauccugcacaagcccuacaagugcacccugugcgacuucgccgccagccaggaggaggagcugaucagccacguggagaaggcccacaucaccgccgagagcgcccagggccagggccccaacggcggcggcgagcagagcgccaacgaguucagaugcgaggugugcggccagguguucagccaggccugguuccugaagggccacaugagaaagcacaaggacagcuucgagcacugcugccagaucugcggcagaagauucaaggagcccugguuccugaagaaccacaugaaggugcaccugaacaagcugagcgugaagaacaagagccccagcgaccccgaggugcccgugcccaugggcggcaugagccaggaggcccacgccaaccuguacagcagauaccugagcugccugcagagcggcuucaugacccccgacaaggccggccugagcgagcccagccagcuguacggcaagggcgagcugcccaugaaggagaaggaggcccugggcaagcugcugagccccaucagcagcauggcccacggcgugcccgagggcgacaagcacagccugcugggcugccugaaccuggugcccccccugaagagcagcugcaucgagagacugcaggccgccgccaaggccgccgagauggaccccgugaacagcuaccaggccuggcagcugauggccagaggcauggccauggagcacggcuuccugagcaaggagcacccccugcagagaaaccacgaggacacccuggccaacgccggcgugcuguucgacaaggagaagagagaguacgugcuggugggcgccgacggcagcaagcagaagaugcccgccgaccuggugcacagcaccaaggugggcagccagagagaccugcccagcaagcuggacccccuggagagcagcagagacuuccugagccacggccugaaccagacccuggaguacaaccugcagggccccggcaacaugaaggagaagcccaccgagugccccgacugcggcagaguguucagaaccuaccaccaggugguggugcacagcagagugcacaagagagacagaaagggcgaggaggacggccugcacgugggccuggacgagagaagaggcagcggcagcgaccaggagagccagagcgugagcagaagcaccacccccggcagcagcaacgugaccgaggagagcggcgugggcggcggccugagccagaccggcagcgcccaggaggacagcccccaccccagcagccccagcagcagcgacaucggcgaggaggccggcagaagcgccggcgugcagcagcccgcccugcugagagacagaagccugggcagcgccaugaaggacugccccuacugcggcaagaccuucagaaccagccaccaccugaaggugcaccugagaauccacaccggcgagaagcccuacaagugcccccacugcgacuacgccggcacccagagcgccagccugaaguaccaccuggagagacaccacagagagagacagaacggcgccggcccccugagcggccagccccccaaccaggaccacaaggacgagaugagcagcaaggccagccuguucaucagacccgacauccugagaggcgccuucaagggccugcccggcaucgacuucagaggcggccccgccagccagcaguggaccagcggcgugcugagcagcggcgaccacagcggccaggccaccggcaugagcagcgaggugcccagcgacgcccugaagggcaccgaccugcccagcaagagcacccacuucagcgagaucggcagagccuaccagagcaucgugagcaacggcgugaacuuccagggcagccugcaggccuucauggacagcuucgugcugagcagccugaagaaggagaaggacaugaaggacaaggcccuggccgacccccccagcaugaaggugcacggcguggacggcggcgaggagaagcccagcggcaagagcagccagagaaagagcgagaagagccaguacgagccccuggaccugagcgugagacccgacgccgccagccugcccggcagcagcgugaccgugcaggacagcaucgccuggcacggcugccuguucugcgccuucaccaccagcagcauggagcugauggcccugcaccugcaggccaaccaccugggcaaggccaagagaaaggacaacaccaucggcgugaccgugaacugcaaggaccaggccagagaggccagcaagauggcccugcugcccagccugcagagcaacaaggaccugggccugagcaacaugaucagcagccuggacagcgccagcgagaagauggcccagggccagcugaaggagacccugggcgagcagaagagcggcgccuggaccggccacguggaccccgccuucugcaacuuccccagcgacuucuacaagcaguucggcguguaccccggcauggugggcagcggcgccagcagcagcugccccaacaaggagcccgacggcaaggcccacagcgaggaggacgugcccauccugauccccgagaccaccagcaagaacaccaccgacgaccugagcgacaucgccagcagcgaggacauggacagcagcaagggcgagaacaacgacgaggaggacguggagaccgagcccgagaugaugaccaagccccugagcgcccugagcaaggacagcagcagcgacggcggcgacagccugcagcccaccggcaccagccagcccgugcagggccuggugagcccccugagccaggcccccgagaagcaguggcacagccagggccugcugcaggcccaggacccccuggccggccugcccaagcccgagagaggcccccagagccuggacaagcccaugaacaugcugagcgugcugagagccuacagcagcgacggccuggccgccuucaacggccuggccagcagcaccgccaacagcggcugcaucaagagacccgaccugugcggcaaguaa

SEQ ID NO: 26020 - RNA, 1884 nt, Artificial Sequence
  ZNF555__Homo_sapiens__NP_001166246
auggacagcgugguguucgaggacguggccguggacuucacccuggaggagugggcccugcuggacagcgcccagagagaccuguacagagacgugaugcuggagaccuuccagaaccuggccagcguggacgacgagacccaguucaaggccagcggcagcgugagccagcaggacaucuacggcgagaagauccccaaggagagcaagaucgccaccuucaccagaaacgugagcugggccagcgugcugggcaagaucugggacagccugagcaucgaggaccagaccaccaaccagggcagaaaccugagaaaccacggccuggagagacugugcgagagcaacgaccagugcggcgaggcccugagccagaucccccaccugaaccuguacaagaagaucccccccggcgugaagcaguacgaguacaacaccuacggcaagguguucaugcacagaagaaccagccugaagagccccaucaccgugcacaccggccacaagcccuaccagugccaggagugcggccaggccuacagcugcagaagccaccugagaaugcacgugagaacccacaacggcgagagacccuacgugugcaagcugugcggcaagaccuuccccagaaccagcagccugaacagacacgugagaauccacaccgccgagaagaccuacgagugcaagcagugcggcaaggccuucaucgacuucagcagccugaccagccaccugagaagccacaccggcgagaagcccuacaagugcaaggagugcggcaaggccuucagcuacagcagcaccuucagaagacacaccaucacccacaccggcgagaagcccuacaagugcaaggagugcgccgaggccuucagcuacagcagcaccuucagaagacacaugaucagccacaccggcgagaagccccacaagugcaaggagugcggcgaggccuucagcuacagcagcgccuucagaagacacaugaucacccacaccggcgagaagcccuacgagugcaagcagugcggcaagaccuucaucuaccugcagagcuucagaagacacgagagaauccacaccggcgagaagcccuacgagugcaagcagugcggcaagaccuucaucuacccccagagcuucagaagacacgagagaacccacggcggcgagaagcccuacgagugcaaccagugcggcaaggccuucagccaccccagcagcuucagaggccacaugagagugcacaccggcgagaagcccuacgagugcaagcagugcggcaagaccuucaacuggcccaucagccugagaaagcacaugagaacccacaccagagagaagcccuacgagugcaagcagugcggcaaggccuucagccugagcgccugcuucagagagcacgugagaaugcaccccgaggacaagagcuacgagugcaagcugugcggcaaggccuucuacugccacaucagccugcagaagcacaugagaagacacaccgccgagaagcuguacaagugcaagcagugcggcaaggccuucagcuggcccgagcugcugcagcagcacgugagaacccacaccguggagaagcccuacgagugcaaggagugcggcaagguguucaaguggcccagcagccugcccauccacaugagacugcacaccggcgagaagcccuaccagugcaagcacugcggcaaggccuucaacugcagcagcagccugagaagacacgugagaauccacaccaccgagaagcaguacaagugcaacgugggccacccccccgccaacgaguucaugugcagcgccagcgagaagagccaccaggagagagaccugaucaagguggugaacauggugcugccccuguaa

SEQ ID NO: 26021 - RNA, 1809 nt, Artificial Sequence
  ZNF559__Homo_sapiens__NP_001189335
augagaaucaccgccgccauccugaccgccagaagcagauggagacugagaaacagcaucagcgccuuccuguucaccgugaccuucgccuggugcccccccggccugagcaaccugaccauccugagcugccccgaccaccugagccaggacguguucugccugcacgagagcaaguucgaggaggagagaaugguggccggcuggcugaccaacuacagccaggacagcgugaccuucgaggacguggccguggacuucacccaggaggaguggacccugcuggaccagacccagagaaaccuguacagagacgugaugcuggagaacuacaagaaccugguggccguggacugggagagccacaucaacaccaaguggagcgccccccagcagaacuuccugcagggcaagaccagcagcgugguggagauggagagaaaccacuucggcgaggagcuguucgacuucaaccagugcgagaaggcccugagcgagcacagcugccugaagacccacagaagaaccuacuucagaaagaagaccugcgagugcaaccagugcgagaaggccuucagaaagcccagcaucuucacccugcacaagaagaccgacaucggcgaggagcugcccaacugcaaccagugcgagaccgccuucagccagcaccugcaccuggugugcaagaagaccagccagaaccugcaccuggugugcaagaagacccacacccaggagaagcccuacaagugcagcgacugcgagaagggccugcccagcagcagccaccugagagagugcgugagaaucuacggcggcgagagacccuacacccacaaggaguacguggagaccuucagccacagcaccgcccuguucgugcacaugcagacccaggacggcgagaaguucuacgagugcaaggccugcggcaagcccuucaccgagagcagcuaccugacccagcaccugagaacccacagcagagugcugcccaucgagcacaagaaguucggcaaggccuucgccuucagccccgaccuggccaagcacaucagacugagaaccagaggcaagcacuacgugugcaacgagugcggcaaggaguucaccugcuucagcaagcugaacauccacaucagagugcacaccggcgagaagcccuacgagugcaacaagugcggcaaggccuucaccgacagcagcggccugaucaagcacagaagaacccacaccggcgagaagcccuacgagugcaaggagugcggcaaggccuucgccaacagcagccaccugaccgugcacaugagaacccacaccggcgagaagcccuaccagugcaaggagugcggcaaggccuucaucaacagcagcagcuucaagagccacaugcagacccaccccggcgugaagcccuacgacugccagcagugcggcaaggccuucaucagaagcagcuuccugaucagacaccugagaagccacagcgccgagagacccuucgagugcgaggagugcggcaaggccuucagauacagcagccaccugagccagcacaagagaauccacaccggcgagagacccuacaagugccagaagugcggccaggccuucagcaucagcagcggccugaccgugcacaugagaacccacaccggcgagagacccuucgagugccaggagugcggcaaggccuucaccagaagcaccuaccugaucagacaccugagaagccacagcguggagaagcccuacaaggagugcggccagaccuucagcaacagcagcugccugaccgagugcguguaa

SEQ ID NO: 26022 - RNA, 1743 nt, Artificial Sequence
  ZNF568__Homo_sapiens__NP_001191766
augaagcccgcccagagaaaccuguacagagacgugaugcuggagaacuacagcaaccuggugaccgugggcugccaggugaccaagcccgacgugaucuucaagcuggagcaggaggaggagcccugggugauggaggaggagauguucggcagacacugccccgaggugugggagguggacgagcagaucaagaagcagcaggagacccuggugagaaaggugaccagcaucagcaagaagauccugaucaaggagaaggugaucgagugcaagaagguggccaagaucuucccccugagcagcgacaucgugaccagcagacagagcuucuacgacugcgacagccuggacaagggccuggagcacaaccuggaccugcugagauacgagaagggcugcgugagagagaagcagagcaacgaguucggcaagcccuucuaccacugcgccagcuacguggugacccccuucaagugcaaccagugcggccaggacuucagccacaaguucgaccugaucagacacgagagaauccacgccggcgagaagcccuacgagugcaaggagugcggcaaggccuucagcagaaaggagaaccugaucacccaccagaagauccacaccggcgagaagcccuacaagugcaacgagugcggcaaggccuucauccagaugagcaaccugaucagacaccacagaauccacaccggcgagaagcccuacgccugcaaggacugcuggaaggccuucagccagaagagcaaccugaucgagcacgagagaauccacaccggcgagaagcccuacgagugcaaggagugcggcaagagcuucagccagaagcagaaccugaucgagcacgagaagauccacaccggcgagaagcccuacgccugcaacgagugcggcagagccuucagcagaaugagcagcgugacccugcacaugagaagccacaccggcgagaagcccuacaagugcaacaagugcggcaaggccuucagccagugcagcguguucaucauccacaugagaagccacaccggcgagaagcccuacgugugcagcgagugcggcaaggccuucagccagagcagcagccugaccgugcacaugagaaaccacaccgccgagaagcccuacgagugcaaggagugcggcaaggccuucagcagaaaggagaaccugaucacccaccagaagauccacaccggcgagaagcccuacgagugcagcgagugcggcaaggccuucauccagaugagcaaccugaucagacaccagagaauccacaccggcgagaagcccuacgccugcaccgugugcggcaaggccuucagccagaagagcaaccugaccgagcacgagaagauccacaccggcgagaagcccuaccacugcaaccagugcggcaaggccuucagccagagacagaaccugcuggagcacgagaagauccacaccggcgagaagcccuucaagugcaacgagugcggcaaggccuucagcagaaucagcagccugacccugcacgugagaagccacaccggcgagaagcccuacgagugcaacaagugcggcaaggccuucagccagugcagccugcugaucauccacaugagaagccacaccggcgagaagcccuucgagugcaacgagugcggcaaggccuucagccagagagccagccugagcauccacaagagaggccacaccggcgagagacaccagguguacuaa

SEQ ID NO: 26023 - RNA, 2061 nt, Artificial Sequence
  ZNF569__Homo_sapiens__NP_689697
augaccgagagccagggcaccgugaccuucaaggacguggccaucgacuucacccaggaggaguggaagagacuggaccccgcccagagaaagcuguacagaaacgugaugcuggagaacuacaacaaccugaucaccgugggcuaccccuucaccaagcccgacgugaucuucaagcuggagcaggaggaggagcccugggugauggaggaggaggugcugagaagacacuggcagggcgagaucuggggcguggacgagcaccagaagaaccaggacagacugcugagacagguggaggugaaguuccagaagacccugaccgaggagaagggcaacgagugccagaagaaguucgccaacguguucccccugaacagcgacuucuuccccagcagacacaaccuguacgaguacgaccuguucggcaagugccuggagcacaacuucgacugccacaacaacgugaagugccugaugagaaaggagcacugcgaguacaacgagcccgugaagagcuacggcaacagcagcagccacuucgugaucacccccuucaagugcaaccacugcggcaagggcuucaaccagacccuggaccugaucagacaccugagaauccacaccggcgagaagcccuacgagugcagcaacugcagaaaggccuucagccacaaggagaagcugaucaagcacuacaagauccacagcagagagcagagcuacaagugcaacgagugcggcaaggccuucaucaagaugagcaaccugaucagacaccagagaauccacaccggcgagaagcccuacgccugcaaggagugcgagaagagcuucagccagaagagcaaccugaucgaccacgagaagauccacaccggcgagaagcccuacgagugcaacgagugcggcaaggccuucagccagaagcagagccugaucgcccaccagaaggugcacaccggcgagaagcccuacgccugcaacgagugcggcaaggccuuccccagaaucgccagccuggcccugcacaugagaagccacaccggcgagaagcccuacaagugcgacaagugcggcaaggccuucagccaguucagcaugcugaucauccacgugagaauccacaccggcgagaagcccuacgagugcaacgagugcggcaaggccuucagccagagcagcgcccugaccgugcacaugagaagccacaccggcgagaagcccuacgagugcaaggagugcagaaaggccuucagccacaagaagaacuucaucacccaccagaagauccacaccagagagaagcccuacgagugcaacgagugcggcaaggccuucauccagaugagcaaccuggugagacaccagagaauccacaccggcgagaagcccuacaucugcaaggagugcggcaaggccuucagccagaagagcaaccugaucgcccacgagaagauccacagcggcgagaagcccuacgagugcaacgagugcggcaaggccuucagccagaagcagaacuucaucacccaccagaaggugcacaccggcgagaagcccuacgacugcaacgagugcggcaaggccuucagccagaucgccagccugacccugcaccugagaagccacaccggcgagaagcccuacgagugcgacaagugcggcaaggccuucagccagugcagccugcugaaccugcacaugagaagccacaccggcgagaagcccuacgugugcaacgagugcggcaaggccuucagccagagaaccagccugaucgugcacaugagaggccacaccggcgagaagcccuacgagugcaacaagugcggcaaggccuucagccagagcagcagccugaccauccacaucagaggccacaccggcgagaagcccuucgacugcagcaagugcggcaaggccuucagccagaucagcagccugacccugcacaugagaaagcacaccggcgagaagcccuaccacugcaucgagugcggcaaggccuucagccagaagagccaccuggugagacaccagagaauccacacccacuaa

SEQ ID NO: 26024 - RNA, 1281 nt, Artificial Sequence
  ZNF577__Homo_sapiens__NP_001129062
augaagaacgccaccaucgugaugagcgugagaagagagcagggcagcagcagcggcgagggcagccugagcuucgaggacguggccgugggcuucaccagagaggaguggcaguuccuggaccagagccagaaggugcuguacaaggaggugaugcuggagaacuacaucaaccuggugagcaucggcuacagaggcaccaagcccgacagccuguucaagcuggagcagggcgagccccccggcaucgccgagggcgccgcccacagccagaucugccccggcggcaagccccacgagugcagcgugugcggcagagccuucagcagaaaggcccagcugauccagcaccagagaaccgagagaggcgagaagccccacggcugcggcgagugcggcaagaccuucaugagaaagauccagcugaccgagcaccagagaacccacaccggcgagaagccccacgagugcagcgagugcggcaaggccuucagcagaaagagccagcugauggugcaccagagaacccacaccggcgagaagcccuacagaugcagcaagugcggcaaggccuucagcagaaagugcagacugaacagacaccagagaagccacaccggcgagaagcuguacggcugcagcgugugcggcaaggccuucagccagaaggccuaccugaccgcccaccagagacugcacaccggcgacaagcccuacaagugcagcgacugcggcagaaccuucuacuucaagagcgaccugaccagacaccagagaauccacaccggcgagaagcccuacgagugcagcgagugcgagaaggccuucagaagcaagagcaagcugauccagcaccagagaacccacaccggcgagagacccuacagcugcagagagugcggcaaggccuucgcccacaugagcgugcugaucaagcacgagaagacccacaucagagagaccgccaucaacagccugaccguggagaagcccagcagcagaagccacaccagccuguacaugagcgagcugauccaggagcagaagaccgugaacaccgugcccaucgagaugcccagcagcggcacccccccccugcugaacaagagcgagagacuggugggcagaaacguggugaucguggagcagcccuuccccagaaaccaggccuucguggugaaccaggaguucgagcagagaaucagccugaccaacgaggugaacguggcccccagcgugaucaacuacauccuguaccugaccgacaucgugagcgaguaa

SEQ ID NO: 26025 - RNA, 519 nt, Artificial Sequence
  ZNF580__Homo_sapiens__NP_057286
augcugcugcugccccccagacccccccaccccagaagcagcagccccgaggccauggacccccccccccccaaggccccccccuuccccaaggccgagggccccagcagcacccccagcagcgccgccggccccagaccccccagacugggcagacaccugcugaucgacgccaacggcgugcccuacaccuacaccgugcagcuggaggaggagcccagaggccccccccagagagaggccccccccggcgagcccggccccagaaagggcuacagcugccccgagugcgccagaguguucgccagcccccugagacugcagagccacagagugagccacagcgaccugaagcccuucaccugcggcgccugcggcaaggccuucaagagaagcagccaccugagcagacacagagccacccacagagccagagccggccccccccacaccugcccccugugccccagaagauuccaggacgccgccgagcuggcccagcacgugagacugcacuaa

SEQ ID NO: 26026 - RNA, 594 nt, Artificial Sequence
  ZNF581__Homo_sapiens__XP_006723303
augcuggugcugcccagccccugcccccagccccuggccuucagcagcguggagaccauggagggcccccccagaagaaccugcagaagccccgagcccggccccagcagcagcaucggcagcccccaggccagcagcccccccagacccaaccacuaccugcugaucgacacccagggcgugcccuacaccgugcugguggacgaggagagccagagagagcccggcgccagcggcgcccccggccagaagaagugcuacagcugccccgugugcagcagaguguucgaguacaugagcuaccugcagagacacagcaucacccacagcgaggugaagcccuucgagugcgacaucugcggcaaggccuucaagagagccagccaccuggccagacaccacagcauccaccuggccggcggcggcagaccccacggcugcccccugugccccagaagauucagagacgccggcgagcuggcccagcacagcagagugcacagcggcgagagacccuuccagugcccccacugccccagaagauucauggagcagaacacccugcagaagcacaccagauggaagcaccccuaa

SEQ ID NO: 26027 - RNA, 1554 nt, Artificial Sequence
  ZNF582__Homo_sapiens__NP_653291
augagccugggcagcgagcuguucagagacguggccaucguguucagccaggaggaguggcaguggcuggcccccgcccagagagaccuguacagagacgugaugcuggagaccuacagcaaccuggugagccugggccuggccgugagcaagcccgacgugaucagcuuccuggagcagggcaaggagcccuggaugguggagagaguggugagcggcggccugugccccgugcuggagagcagauacgacaccaaggagcuguuccccaagcagcacguguacgagguggagagcccccagugggagaucauggagagccugaccagcuacggccuggagugcagcagcuuccaggacgacugggagugcagaaaccaguucgacagacagcagggcaaccccgacagacacuuccaccagaugaucaucagacacgaggagaugcccaccuucgaccagcacgccagccugaccuucuaccagaagauccacaccagagagaagcccuucggcuacaacaagugcagaaaggacuucuggcagaaggagcugcugaucaaccaccagggcaucuacaccaacgagaagcccuacaagugcaaggagugcggcaaggccuucaaguacggcagcagacugauccagcacgagaacauccacagcggcaagaagcccuacgagugcaaggagugcggcaaggccuucaacagcggcagcaacuucauccagcaccagagagugcacaccggcgagaagcccuacgagugcaaggacugcgagaaggccuucagcagaagcagccagcugaucgagcaccagagaacccacaccggcgagaagcccuaccagugcaaggagugcggcaaggccuucaacagaaucagccaccugaaggugcacuacagaauccacaccggcgagaagcccuacgccugcaaggagugcggcaagaccuucagccacagaagccagcugauccagcaccagaccgugcacaccggcagaaagcuguacgagugcaaggagugcggcaaggccuucaaccagggcagcacccugaucagacaccagagaauccacaccggcgagaagcccuacgagugcaaggugugcggcaaggccuucagagugagcagccagcugaagcagcaccagagaauccacaccggcgagaagcccuaccagugcaaggugugcggcagagccuucaagagagugagccaccugaccgugcacuacagaauccacaccggcgagaagcccuacgagugcaaggagugcggcaaggccuucagccacugcagccagcugauccaccaccaggugauccacaccgagaagaagcccuacgaguacaaggagugcgagaagacccugagccacgacagcaccaccgugcagccccagagaaugcacaacagagagacccacgugaacaucaucaacguggagaagcccagcaucagcagcuacccccugcugaucaucagagaguucaugcuggccagcaaccacaugaacggcagcaacggcgagagcccccuggccuaa

SEQ ID NO: 26028 - RNA, 1710 nt, Artificial Sequence
  ZNF583__Homo_sapiens__XP_011524819
augagcaaggaccuggugaccuucggcgacguggccgugaacuucagccaggaggagugggaguggcugaaccccgcccagagaaaccuguacagaaaggugaugcuggagaacuacagaagccuggugagccugggcgugagcgugagcaagcccgacgugaucagccugcuggagcagggcaaggagcccuggauggugaagaaggagggcaccagaggccccugccccgacugggaguacguguucaagaacagcgaguucagcagcaagcaggagaccuacgaggagagcagcaagguggugaccgugggcgccagacaccugagcuacagccuggacuaccccagccugagagaggacugccagagcgaggacugguacaagaaccagcugggcagccaggaggugcaccugagccagcugaucaucacccacaaggagauccugcccgaggugcagaacaaggaguacaacaagagcuggcagaccuuccaccaggacaccaucuucgacauccagcagagcuuccccaccaaggagaaggcccacaagcacgagccccagaagaagagcuacagaaagaagagcguggagaugaagcacagaaagguguacguggagaagaagcugcugaagugcaacgacugcgagaagguguucaaccagagcagcagccugacccugcaccagagaauccacaccggcgagaagcccuacgccugcguggagugcggcaagaccuucagccagagcgccaaccuggcccagcacaagagaauccacaccggcgagaagcccuacgagugcaaggagugcagaaaggccuucagccagaacgcccaccuggcccagcaccagagagugcacaccggcgagaagcccuaccagugcaaggagugcaagaaggccuucagccagaucgcccaccugacccagcaccagagagugcacaccggcgagagacccuucgagugcaucgagugcggcaaggccuucagcaacggcagcuuccuggcccagcaccagagaauccacaccggcgagaagcccuacgugugcaacgugugcggcaaggccuucagccacagaggcuaccugaucgugcaccagagaauccacaccggcgagagacccuacgagugcaaggagugcagaaaggccuucagccaguacgcccaccuggcccagcaccagagagugcacaccggcgagaagcccuacgagugcaaggugugcagaaaggccuucagccagaucgccuaccuggaccagcaccagagagugcacaccggcgagaagcccuacgagugcaucgagugcggcaaggccuucagcaacagcagcagccuggcccagcaccagagaagccacaccggcgagaagcccuacaugugcaaggagugcagaaagaccuucagccagaacgccggccuggcccagcaccagagaauccacaccggcgagaagcccuacgagugcaacgugugcggcaaggccuucagcuacagcggcagccugacccugcaccagagaauccacaccggcgagagacccuacgagugcaaggacugcagaaagagcuucagacagagagcccaccuggcccaccacgagagaauccacaccauggagagcuuccugacccugagcagccccagccccagcaccagcaaccagcugcccagacccgugggcuucaucagcuaa

SEQ ID NO: 26029 - RNA, 2310 nt, Artificial Sequence
  ZNF585B__Homo_sapiens__NP_689492
augcccgccagcuggaccagcccccagaagagcagcgcccuggcccccgaggaccacggcagcagcuacgagggcagcgugagcuucagagacguggccaucgacuucagcagagaggaguggagacaccuggaccugagccagagaaaccuguacagagacgugaugcuggagaccuacagccaccugcugagcgugggcuaccaggugcccaagcccgagguggugaugcuggagcagggcaaggagcccugggcccugcagggcgagagacccagacacagcugccccggcgagaagcugugggaccacaaccagcacagaaagaucaucggcuacaagcccgccagcagccaggaccagaagaucuacagcggcgagaagagcuacgagugcgccgaguucggcaagagcuucaccuggaagagccaguucaaggugcaccugaaggugcccaccggcgagaagcuguacgugugcaucgagugcggcagagccuucgugcagaagcccgaguucaucacccaccagaagacccacaugagagagaagcccuacaagugcaacgagugcggcaagagcuucuuccaggugagcagccuguucagacaccacagaauccacaccggcgagaagcuguacgagugcagcgagugcggcaagggcuuccccuacaacagcgaccugagcauccacgagaagauccacaccggcgagagacaccacgagugcaccgacugcggcaaggccuucacccagaagagcacccugaagauccaccagaagauccacaccggcgagagaagcuacaucugcaucgagugcggccaggccuucauccagaagacccagcugaucgcccacagaagaauccacagcggcgagaagcccuacgagugcaacaacugcggcaagagcuucaucagcaagagccagcugcaggugcaccagagagugcacaccagagugaagcccuacaucugcaccgaguacggcaagguguucagcaacaacagcaaccugaucacccacgagaagauccagagcagagagaagagcagcaucugcaccgagugcggcaaggccuucaccuacagaagcgagcugaucauccaccagagaauccacaccggcgagaagcccuacgagugcagcgacugcggcagagccuucacccagaagagcgcccugaccgugcaccagagaauccacaccggcgagaagagcuacaucugcaugaagugcggccuggccuucaucagaaaggcccaccugaucacccaccagaucauccacaccggcgagaagcccuacaagugcggccacugcggcaagcuguucaccagcaagagccagcugcacgugcacaagagaauccacaccggcgagaagcccuacgugugcaacaagugcggcaaggccuucaccaacagaagcaaccugaucacccaccagaagacccacaccggcgagaagagcuacaucugcagcaagugcggcaaggccuucacccagagaagcgaccugaucacccaccagagaauccacaccggcgagaagcccuacgagugcaacaccugcggcaaggccuucacccagaagagcaaccugaacauccaccagaagauccacaccggcgagagacaguacgagugccacgagugcggcaaggccuucaaccagaagagcauccugaucgugcaccagaagauccacaccggcgagaagcccuacgugugcaccgagugcggcagagccuucaucagaaagagcaacuucaucacccaccagagaauccacaccggcgagaagcccuacgagugcagcgacugcggcaagagcuucaccagcaagagccagcugcuggugcaccagcccgugcacaccggcgagaagcccuacgugugcgccgagugcggcaaggccuucagcggcagaagcaaccugagcaagcaccagaagacccacaccggcgagaagcccuacaucugcagcgagugcggcaagaccuucagacagaagagcgagcugaucacccaccacagaauccacaccggcgagaagcccuacgagugcagcgacugcggcaagagcuucaccaagaagagccagcugcaggugcaccagagaauccacaccggcgagaagcccuacgugugcgccgagugcggcaaggccuucagcaacagaagcaaccugaacaagcaccagaccacccacaccggcgacaagcccuacaagugcggcaucugcggcaagggcuucgugcagaagagcguguucagcgugcaccagagcagccacgccuaa

SEQ ID NO: 26030 - RNA, 3804 nt, Artificial Sequence
  ZNF592__Homo_sapiens__NP_055445
augggcgacaugaagacccccgacuucgacgaccugcuggccgccuucgacauccccgaccccaccagccuggacgccaaggaggccauccagacccccagcgaggagaacgagagcccccugaagccccccggcaucugcauggacgagagcgugagccugagccacagcggcagcgcccccgacgugcccgccgugagcgugaucgugaagaacaccagcagacaggagagcuucgaggccgagaaggaccacaucacccccagccugcugcacaacggcuucagaggcagcgaccugccccccgacccccacaacugcggcaaguucgacagcaccuucaugaacggcgacagcgccagaagcuuccccggcaagcuggagccccccaagagcgagccccugcccaccuucaaccaguucagccccaucagcagccccgagcccgaggaccccaucaaggacaacggcuucggcaucaagcccaagcacagcgacagcuacuucccccccccccugggcugcggcgccgugggcggccccgugcuggaggcccuggccaaguuccccgugcccgagcugcacauguucgaccacuucugcaagaaggagcccaagcccgagccccugccccugggcagccagcaggagcacgagcagagcggccagaacaccguggagccccacaaggaccccgacgccaccagauucuucggcgaggcccuggaguucaacagccaccccagcaacagcaucggcgagagcaagggccuggccagagagcugggcaccugcagcagcgugccccccagacagagacugaagcccgcccacagcaagcugagcagcugcguggccgcccugguggcccugcaggccaagagaguggccagcgugaccaaggaggaccagcccggccacaccaaggaccugagcggccccaccaaggagagcagcaagggcagccccaagaugcccaagagccccaagagccccagaagcccccuggaggccaccagaaagagcaucaagcccagcgacagccccagaagcaucugcagcgacagcagcagcaagggcagccccagcguggccgccagcagcccccccgccauccccaaggugagaaucaagaccaucaagaccagcagcggcgagaucaagagaaccgugaccagaauccugcccgaccccgacgaccccagcaagagccccgugggcagcccccugggcagcgccaucgccgaggcccccagcgagaugcccggcgacgaggugcccguggaggagcacuuccccgaggccggcaccaacagcggcagcccccagggcgccagaaagggcgacgagagcaugaccaaggccagcgacagcagcagccccagcugcagcagcggccccagagugcccaagggcgccgcccccggcagccagaccggcaagaagcagcagagcaccgcccugcaggccagcacccuggcccccgccaaccugcugcccaaggccgugcaccuggccaaccugaaccuggugccccacagcguggccgccagcgugaccgccaagagcagcgugcagagaagaagccagccccagcugacccagaugagcgugccccuggugcaccaggugaagaaggccgccccccugaucguggagguguucaacaaggugcugcacagcagcaaccccgugccccuguacgcccccaaccugagcccccccgccgacagcagaauccacgugcccgccagcggcuacugcugccuggagugcggcgacgccuucgcccuggagaagagccugagccagcacuacggcagaagaagcgugcacaucgaggugcugugcacccugugcagcaagacccugcuguucuucaacaagugcagccugcugagacacgccagagaccacaagagcaagggccuggugaugcagugcagccagcugcuggugaagcccaucagcgccgaccagauguucgugagcgcccccgugaacagcaccgcccccgccgcccccgcccccagcagcagccccaagcacggccugaccagcggcagcgccagcccccccccccccgcccugccccuguaccccgaccccgugagacugaucagauacagcaucaagugccuggagugccacaagcagaugagagacuacauggugcuggccgcccacuuccagagaaccaccgaggagaccgagggccugaccugccaggugugccagaugcugcugcccaaccagugcagcuucugcgcccaccagagaauccacgcccacaagagccccuacugcugccccgagugcggcgugcugugcagaagcgccuacuuccagacccacgugaaggagaacugccugcacuacgccagaaaggugggcuacagaugcauccacugcggcguggugcaccugacccuggcccugcugaagagccacauccaggagagacacugccagguguuccacaagugcgccuucugccccauggccuucaagaccgccagcagcaccgccgaccacagcgccacccagcaccccacccagccccacagacccagccagcugaucuacaagugcagcugcgagaugguguucaacaagaagagacacauccagcagcacuucuaccagaacgugagcaagacccaggugggcguguucaagugccccgagugcccccugcuguucgugcagaagcccgagcugaugcagcacgugaagagcacccacggcgugcccagaaacguggacgagcugagcagccugcagagcagcgccgacaccagcagcagcagacccggcagcagagugcccaccgagccccccgccaccagcguggccgccagaagcagcagccugcccagcggcagauggggcagacccgaggcccacagaagaguggaggccagacccagacugagaaacaccggcuggaccugccaggagugccaggagugggugcccgacagagagagcuacgugagccacaugaagaagagccacggcagaacccugaagagauaccccugcagacagugcgagcagagcuuccacacccccaacagccugagaaagcacaucagaaacaaccacgacaccgugaagaaguucuacaccugcggcuacugcaccgaggacagccccagcuuccccagacccagccugcuggagagccacaucagccugaugcacggcaucagaaaccccgaccugagccagaccagcaaggugaagccccccggcggccacagcccccaggugaaccaccugaagagacccgugagcggcgugggcgacgcccccggcaccagcaacggcgccaccgugagcagcaccaagagacacaagagccuguuccagugcgccaagugcagcuucgccaccgacagcggccuggaguuccagagccacaucccccagcaccagguggacagcagcaccgcccagugccugcugugcggccugugcuacaccagcgccagcagccugagcagacaccuguucaucgugcacaaggugagagaccaggaggaggaggaggaggaggaggccgccgccgccgagauggccguggagguggccgagcccgaggagggcagcggcgaggaggugcccauggagaccagagagaacggccuggaggagugcgccggcgagccccugagcgccgaccccgaggccagaagacugcugggccccgcccccgaggacgacggcggccacaacgaccacagccagccccaggccagccaggaccaggacagccacacccugagcccccagguguaa

SEQ ID NO: 26031 - RNA, 1515 nt, Artificial Sequence
  ZNF596__Homo_sapiens__XP_011533044
augcccagccccgacagcaugaccuucgaggacaucaucguggacuucacccaggaggagugggcccugcuggacaccagccagagaaagcuguuccaggacgugaugcuggagaacaucagccaccuggugagcaucggcaagcagcugugcaagagcguggugcugagccagcuggagcagguggagaagcugagcacccagagaaucagccugcugcagggcagagaggugggcaucaagcaccaggagauccccuucauccagcacaucuaccagaagggcaccagcaccaucagcaccaugagaagccacacccaggaggaccccuuccugugcaacgaccugggcgaggacuucacccagcacaucgcccugacccagaacgugaucaccuacaugagaaccaagcacuucgugagcaagaaguucggcaagaucuucagcgacuggcugagcuucaaccagcacaaggagauccacaccaagugcaagagcuacggcagccaccuguucgacuacgccuucauccagaacagcgcccugagaccccacagcgugacccacaccagagagaucacccuggagugcagagugugcggcaagaccuucagcaagaacagcaaccugagaagacacgagaugauccacaccggcgagaagccccacggcugccaccugugcggcaaggccuucacccacugcagcgaccugagaaagcacgagagaacccacaccggcgagaagcccuacggcugccaccugugcggcaaggccuucagcaagagcagcaaccugagaagacacgagaugauccacaccagagagaaggcccagaucugccaccugugcggcaaggccuucacccacugcagcgaccugagaaagcacgagagaacccaccugggcgacaagcccuacggcugccugcugugcggcaaggccuucagcaagugcagcuaccugagacagcacgagagaacccacaacggcgagaagcccuacgagugccaccugugcggcaaggccuucagccacugcagccaccugagacagcacgagagaagccacaacggcgagaagccccacggcugccaccugugcggcaaggccuucaccgagagcagcgugcugaagagacacgagagaauccacaccggcgagaagcccuacgagugccacgugugcggcaaggccuucaccgagagcagcgaccugagaagacacgagagaacccacaccggcgagaagcccuacgagugccaccugugcggcaaggccuucaaccacagcagcgugcugagaagacacgagagaacccacaccggcgagaagcccuacgagugcaacaucugcggcaaggccuucaacagaagcuacaacuucagacugcacagaagagugcacaccggcgagaagcccuacgugugcccccugugcggcaaggccuucagcaaguucuucaaccugagacagcacgagagaacccacaccaagaaggccaugaacauguaa

SEQ ID NO: 26032 - RNA, 2379 nt, Artificial Sequence
  ZNF606__Homo_sapiens__NP_079303
auggccgccaucaaccccugggccagcuggggcgcccugaccgaccagagcuggggcaugaccgccguggaccccugggccagcugggcccugugcccccaguaccccgccuggcacguggagggcagccuggaggagggcagaagagccaccggccugcccgccgcccaggugcaggagcccgugaccuucaaggacguggccguggacuucacccaggaggaguggggccagcuggaccuggugcagagaacccuguacagagacgugaugcuggagaccuacggccaccugcugagcgugggcaaccagaucgccaagcccgaggugaucagccugcuggagcagggcgaggagcccuggagcguggagcaggccugcccccagagaaccugccccgagugggugagaaaccuggagagcaaggcccugauccccgcccagagcaucuucgaggaggagcagagccacggcaugaagcuggagagauacaucugggacgaccccugguucagcagacuggaggugcugggcugcaaggaccagcuggagauguaccacaugaaccagagcaccgccaugagacagaugguguucaugcagaagcaggugcugagccagagaagcagcgaguucugcggccugggcgccgaguucagccagaaccugaacuucgugcccagccagagagugagccagaucgagcacuucuacaagcccgacacccacgcccagagcuggagaugcgacagcgccaucauguacgccgacaaggugaccugcgagaacaacgacuacgacaagaccguguaccagagcauccagcccaucuaccccgccagaauccagaccggcgacaaccuguucaagugcaccgacgccgugaagagcuucaaccacaucauccacuucggcgaccacaagggcauccacaccggcgagaagcuguacgaguacaaggagugccaccagaucuucaaccagagccccagcuucaacgagcaccccagacugcacgugggcgagaaccaguacaacuacaaggaguacgagaacaucuucuacuucagcagcuucauggagcaccagaagaucggcaccguggagaaggccuacaaguacaacgagugggagaagguguucggcuacgacagcuuccugacccagcacaccagcaccuacaccgccgagaagcccuacgacuacaacgagugcggcaccagcuucaucuggagcagcuaccugauccagcacaagaagacccacaccggcgagaagcccuacgagugcgacaagugcggcaagguguucagaaacagaagcgcccugaccaagcacgagagaacccacaccggcaucaagcccuacgagugcaacaagugcggcaaggccuucagcuggaacagccaccugaucgugcacaagagaauccacaccggcgagaagcccuacgugugcaacgagugcggcaagagcuucaacuggaacagccaccugaucggccaccagagaacccacaccggcgagaagcccuucgagugcaccgagugcggcaagagcuucagcuggagcagccaccugaucgcccacaugagaaugcacaccggcgagaagcccuucaagugcgacgagugcgagaaggccuucagagacuacagcgcccugagcaagcacgagagaacccacagcggcgccaagcccuacaagugcaccgagugcggcaagagcuucagcuggagcagccaccugaucgcccaccagagaacccacaccggcgagaagcccuacaacugccaggagugcggcaaggccuucagagagagaagcgcccugaccaagcacgagaucauccacagcggcaucaagcccuacgagugcaacaagugcggcaagagcugcagccagauggcccaccuggugagacaccagagaacccacaccggcgagaagcccuacgagugcaacaagugcggcaagagcuucagccagagcugccaccugguggcccacagaagaauccacaccggcgagaagcccuacaagugcaaccagugcgagagaagcuucaacugcagcagccaccugaucgcccacagaagaacccacaccggcgagaagcccuacagaugcaacgagugcggcaaggccuucaacgagagcagcagccugaucgugcaccugagaaaccacaccggcgagaagcccuacaagugcaaccacugcgagaaggccuucugcaagaacagcagccugaucauccaccagagaaugcacagcggcgagaagagauucaucugcagcgagugcggcaaggccuucagcggccacagcgcccugcugcagcaccagagaaaccacagcgaggagaagcugaacuaa

SEQ ID NO: 26033 - RNA, 2088 nt, Artificial Sequence
  ZNF607__Homo_sapiens__NP_001166148
augagcuacggcagcaucaccuucggcgacguggccaucgacuucagccaccaggagugggaguaccugagccuggugcagaagacccuguaccaggaggugaugauggagaacuacgacaaccuggugagccugggccacagcgugagcaagcccgaccugaucacccugcuggagcagggcaaggagcccuggaugaucgugagagaggagaccagaggcgagugcaccgaccuggacagcagaugcgagaucaucagcgacggcaagaugcagcuguacagaaagcacagcugcgugacccugcaccagagaauccacaacggccagaagcccuacgagugcaagcagugccagaagagcuucagccaccugaccgagcugauggugcaccagaccauccacaccagcgaggagcccgaccagugcgagaaguucagaaaggccuucagccaccugaccgaccugagaaagcaccagaagaucaacgccagagagaagcccuacgagugcgaggagugcggcaagguguucagcuaccccgccaaccuggcccagcacggcaaggugcacguggagaagcccuacgagugcaaggagugcggcgaggccuucagaaccagcagacagcugaccgugcaccacagauuccacuacggcgagaagcccuacgagugcaaggagugcggcaaggccuucagcguguacggcagacugagcagacaccagagcauccacaccggcgagaagcccuucgagugcaacaagugcggcaagagcuucagacugaaggccggccugaaggugcaccagagcauccacaccggcgagaagccccacgagugcaaggagugcggcaaggccuucagacaguucagccaccuggugggccacaagagaauccacaccggcgagaagcccuacgagugcaaggagugcggcaagggcuucaccugcagauaccagcugaccaugcaccagagaaucuacagcggcgagaagcacuacgagugcaaggagaacggcgaggccuucagcagcggccaccagcugaccgccccccacaccuucgagagcguggagaagcccuacaagugcgaggagugcggcaaggccuucagcgugcacggcagacugaccagacaccagggcauccacagcggcaagaagcccuacgagugcaacaagugcggcaagagcuucagacugaacagcagccugaagauccaccagaacauccacaccggcgagaagcccuacaagugcaaggagugcggcaaggccuucagccagagagcccaccuggcccaccacaacagaauccacaccggcuacaagcccuucgagugcaaggagugcggcaagagcuucagaugcgccagcuaccuggugauccacgagagaauccacaccggcgagaagcccuacgugugccaggagugcggcaagggcuucagcuacagccacaagcugaccauccacagaagagugcacaccggcgagaagcccuacgagugcaaggagugcggcaaggccuucagcgugagcggccagcugacccagcaccugagcauccacagcggcaagaagcccuucgagugcaacaagugcggcaagagcuucagauucaucagcgugcugaaggcccaccagaacauccacagcgccgagaagcccuacgagugcaaggagugcggcaaggccuucagacacgccaccagccugaucuaccacgacagaacccacgccggcgagaagagcuacgagugcaaggagugcggcgagaccuucagccacgccagccaccugaucauccacgagagaauccacaccagcgacaagcccuacgagugcaagagaugcggcaaggccuuccacugcgccagcuaccuggugagacacgagagcgugcacgccgacggcaaccccuacaugugcgaggagugcggcaaggccuucaacagcagccacgagcugagcauccaccacagagugcacaccggcgagaagcccuucaagugcaacaagugcagaagaagcuucagacugagaagcauccuggaggugcaccagagaauccacaucuaa

SEQ ID NO: 26034 - RNA, 4539 nt, Artificial Sequence
  ZNF608__Homo_sapiens__NP_065798
augagcgugaacaucagcaccgccggcaagggcguggaccccaacaccguggacaccuacgacagcggcgacgacugggagaucggcgugggcaaccugaucaucgaccuggacgccgaccuggagaaggacagacagaaguucgagaugaacaacagcaccaccaccaccagcagcagcaacagcaaggacugcggcggccccgccagcagcggcgccggcgccaccgccgcccuggccgacggccugaaguucgccagcgugcaggccagcgccccccagggcaacagccacaaggagaccagcaagagcaaggugaagagaagcaagaccagcaaggacgccaacaagagccugcccagcgccgcccuguacggcauccccgagaucagcagcaccggcaagagacaggaggugcagggcagacccggcgaggccaccggcaugaacagcgcccugggccagagcgugagcagcggcggcagcggcaaccccaacagcaacagcaccagcaccagcaccagcgccgccaccgccggcgccggcagcugcggcaagagcaaggaggagaagcccggcaagagccagagcagcagaggcgccaagagagacaaggacgccggcaagagcagaaaggacaagcacgaccugcugcagggccaccagaacggcagcggcagccaggcccccagcggcggccaccuguacggcuucggcgccaagagcaacggcggcggcgccagccccuuccacugcggcggcaccggcagcggcagcguggccgccgccggcgaggugagcaagagcgcccccgacagcggccugaugggcaacagcaugcuggugaagaaggaggaggaggaggaggagagccacagaagaaucaagaagcugaagaccgagaagguggacccccuguucaccgugcccgccccccccccccccaucagcagcagccugaccccccagauccugcccagcuacuucagccccagcagcagcaacaucgccgcccccguggagcagcugcuggugagaaccagaagcgugggcgugaacaccugcgaggugggcguggugaccgagcccgagugccugggccccugcgagcccggcaccagcgugaaccuggagggcaucguguggcacgagaccgaggagggcgugcugguggugaacgugaccuggagaaacaagaccuacgugggcacccugcuggacugcaccaagcacgacugggccccccccagauucugcgagagccccaccagcgaccuggagaugagaggcggcagaggcagaggcaagagagccagaagcgccgccgccgcccccggcagcgaggccagcuucaccgagagcagaggccugcagaacaagaacagaggcggcgccaacggcaagggcagaagaggcagccugaacgccagcggcagaagaaccccccccaacugcgccgccgaggacaucaaggccagccccagcagcaccaacaagagaaagaacaagccccccauggagcuggaccugaacagcagcagcgaggacaacaagcccggcaagagagugagaaccaacagcagaagcacccccaccaccccccagggcaagcccgagaccaccuuccuggaccagggcugcagcagccccgugcugaucgacugcccccaccccaacugcaacaagaaguacaagcacaucaacggccugagauaccaccaggcccacgcccaccuggaccccgagaacaagcuggaguucgagcccgacagcgaggacaagaucagcgacugcgaggagggccugagcaacguggcccuggagugcagcgagcccagcaccagcgugagcgccuacgaccagcugaaggcccccgccagccccggcgccggcaacccccccggcacccccaagggcaagagagagcugaugagcaacggccccggcagcaucaucggcgccaaggccggcaagaacagcggcaagaagaagggccugaacaacgagcugaacaaccugcccgugaucagcaacaugaccgccgcccuggacagcugcagcgccgccgacggcagccuggccgccgagaugcccaagcuggaggccgagggccugaucgacaagaagaaccugggcgacaaggagaagggcaagaaggccaccaacugcaagaccgacaagaaccugagcaagcugaagagcgccagacccaucgcccccgcccccgcccccacccccccccagcugaucgccauccccaccgccaccuucaccaccaccaccaccggcaccauccccggccugcccagccugaccaccaccguggugcaggccacccccaagagccccccccugaagcccauccagcccaagcccaccaucaugggcgagcccaucaccgugaaccccgcccuggugagccugaaggacaagaagaagaaggagaagagaaagcugaaggacaaggagggcaaggagaccggcagccccaagauggacgccaagcugggcaagcuggaggacagcaagggcgccagcaaggaccugcccggccacuuccugaaggaccaccugaacaagaacgagggccuggccaacggccugagcgagagccaggagagcagaauggccagcaucaaggccgaggccgacaagguguacaccuucaccgacaacgcccccagccccagcaucggcagcgccagcagacuggagugcagcacccuggugaacggccaggcccccauggccccccugcacgugcugacccagaacggcgccgagagcagcgccgccaagaccagcagccccgccuacagcgacaucagcgacgccgccgacgacggcggcagcgacagcagaagcgagggcaugagaagcaaggccagcagccccagcgacaucaucagcagcaaggacagcguggugaagggccacagcagcaccaccgcccagagcagccagcugaaggagagccacagccccuacuaccacagcuacgaccccuacuacagccccagcuacaugcaccccggccaggugggcgcccccgccgccggcaacagcggcagcacccagggcaugaagaucaagaaggagagcgaggaggacgccgagaagaaggacaaggccgagcagcuggacagcaagaagguggaccacaacagcgccagccugcagccccagcaccagagcgugaucacccagagacaccccgcccuggcccagagccuguacuacggccaguacgccuacggccuguacauggaccagaagagccugauggccaccagccccgccuacagacagcaguacgagaaguacuacgaggaccagagacuggccgagcagaagauggcccagaccggcagaggcgacugcgagagaaagagcgagcugccccugaaggagcugggcaaggaggagaccaagcagaagaacaugcccagcgccaccaucagcaaggcccccagcacccccgagcccaacaagaaccacagcaagcugggccccagcgugcccaacaagaccgaggagaccggcaagagccagcugcugagcaaccaccagcagcagcugcaggccgacagcuucaaggccaagcagauggagaaccaccagcugaucaaggaggccguggagaugaagagcgugauggacagcaugaagcagaccggcguggaccccaccagcagauucaagcaggaccccgacagcagaaccuggcaccacuacguguaccagcccaaguaccuggaccagcagaagagcgaggagcuggacagagagaagaagcugaaggaggacagccccagaaagacccccaacaaggagagcggcgugcccagccugcccgugagccugaccagcaucaaggaggagcccaaggaggccaagcaccccgacagccagagcauggaggagagcaagcugaagaacgacgacagaaagacccccgugaacuggaaggacagcagaggcaccagaguggccgugagcagccccaugagccagcaccagagcuacauccaguaccugcacgccuaccccuacccccagauguacgaccccagccaccccgccuacagagccgugagccccgugcugaugcacagcuaccccggcgccuaccugagccccggcuuccacuaccccguguacggcaagaugagcggcagagaggagaccgagaaggugaacaccagccccagcgugaacaccaagaccaccaccgagagcaaggcccuggaccugcugcagcagcacgccaaccaguacagaagcaagagccccgcccccguggagaaggccaccgccgagagagagagagaggccgagagagagagagacagacacagccccuucggccagagacaccugcacacccaccaccacacccacgugggcaugggcuacccccugauccccggccaguacgaccccuuccagggccugaccagcgccgcccugguggccagccagcagguggccgcccaggccagcgccagcggcauguuccccggccagagaagagaguaa

SEQ ID NO: 26035 - RNA, 2229 nt, Artificial Sequence
  ZNF615__Homo_sapiens__XP_011525128
augaugcaggcccaggagagccugacccuggaggacguggccguggacuucaccugggaggaguggcaguuccugagccccgcccagaaggaccuguacagagacgugaugcuggagaacuacagcaaccugguggccgugggcuaccaggccagcaagcccgacgcccugagcaagcuggagagaggcgaggagaccugcaccaccgaggacgagaucuacagcagaaucugcagcgacagcggcggcgccagcggcggcgccuacgccgagaucagaaagaucgacgacccccugcagcaccaccugcagaaccagagcauccagaagagcgugaagcagugccacgagcagaacauguucggcaacaucgugaaccagaacaagggccacuuccugcugaagcaggacugcgacaccuucgaccugcacgagaagccccugaagagcaaccugagcuucgagaaccagaagagaagcagcggccugaagaacagcgccgaguucaacagagacggcaagagccuguuccacgccaaccacaagcaguucuacaccgagaugaaguuccccgccaucgccaagcccaucaacaagagccaguucaucaagcagcagagaacccacaacaucgagaacgcccacgugugcagcgagugcggcaaggccuuccugaagcugagccaguucaucgaccaccagagagugcacaccggcgagaagccccacgugugcagcaugugcggcaaggccuucagcagaaagagcagacugauggaccaccagagaacccacaccgagcugaagcacuacgagugcaccgagugcgacaagaccuuccugaagaagagccagcugaacauccaccagaagacccacaugggcggcaagcccuacaccugcagccagugcggcaaggccuucaucaagaagugcagacugaucuaccaccagagaacccacaccggcgagaagccccacggcugcagcgugugcggcaaggccuucagcaccaaguucagccugaccacccaccagaagacccacaccggcgagaagcccuacaucugcagcgagugcggcaagggcuucaucgagaagagaagacugaccgcccaccacagaacccacaccggcgagaagcccuucaucugcaacaagugcggcaagggcuucacccugaagaacagccugaucacccaccagcagacccacaccggcgagaagcuguacaccugcagcgagugcggcaagggcuucagcaugaagcacugccugauggugcaccagagaacccacaccggcgagaagcccuacaagugcaacgagugcggcaagggcuucgcccugaagagcccccugaucagacaccagagaacccacaccggcgagaagcccuacgugugcaccgagugcagaaagggcuucaccaugaagagcgaccugaucgugcaccagagaacccacaccgccgagaagcccuacaucugcaacgacugcggcaagggcuucaccgugaagagcagacugaucgugcaccagagaacccacaccggcgagaagcccuacgugugcggcgagugcggcaagggcuuccccgccaagaucagacugaugggccaccagagaacccacaccggcgagaagcccuacaucugcaacgagugcggcaagggcuucaccgagaagagccaccugaacgugcacagaagaacccacaccggcgagaagcccuacgugugcagcgagugcggcaagggccugaccggcaagagcaugcugaucgcccaccagagaacccacaccggcgagaagcccuacaucugcaacgagugcggcaagggcuucaccaugaagagcacccugagcauccaccagcagacccacaccggcgagaagcccuacaagugcaacgagugcgacaagaccuucagaaagaagaccugccugauccagcaccagagauuccacaccggcaagaccagcuucgccugcaccgagugcggcaaguucagccugagaaagaacgaccugaucacccaccagagaauccacaccggcgagaagcccuacaagugcagcgacugcggcaaggccuucaccaccaagagcggccugaacgugcaccagagaaagcacaccggcgagagacccuacggcugcagcgacugcggcaaggccuucgcccaccugagcauccuggugaagcacagaagaauccacagauaa

SEQ ID NO: 26036 - RNA, 2586 nt, Artificial Sequence
  ZNF618__Homo_sapiens__NP_588615
augaaccagcccggcggcgccgccgccccccaggccgacggcgccagcgccgccggcagaaagagcaccgccagcagagagagacugaagagaagccagaagagcaccaagguggagggccccgagcccgugcccgccgaggccagccugagcgccgagcagggcaccaugaccgaggugaaggugaagaccgagcugcccgacgacuacauccaggaggugaucuggcagggcgaggccaaggaggagaagaaggccgugagcaaggacggcaccagcgacgugcccgccgagaucugcguggugaucggcggcgugagaaaccagcagacccugggcagcuacgagugcggcaucugcggcaagaaguacaaguacuacaacugcuuccagacccacgugagagcccacagagacaccgaggccaccagcggcgagggcgccagccagagcaacaacuucagauacaccugcgacaucugcggcaagaaguacaaguacuacagcugcuuccaggagcacagagaccugcacgccguggacguguucagcguggagggcgcccccgagaacagagccgaccccuucgaccagggcgugguggccaccgacgaggugaaggaggagccccccgagcccuuccagaagaucggccccaugaacaacaucaccagcgacaucuucaagaagaaggaggugagacagugccagaagagagagaccggcaacuacaccugcgaguucugcggcaagcaguacaaguacuacacccccuaccaggagcacguggcccugcacgcccccaucaagagcgccuucagcagaagaguggagggcaaggcccagaaccacuucgaggagaccaacagcagcagccagaacagcagcgagcccuacaccugcggcgccugcggcauccaguuccaguucuacaacaaccugcuggagcacaugcagagccacgccgccgacaacgagaacaacaucgccagcaaccagagcagaagcccccccgccgugguggaggagaaguggaagccccaggcccagagaaacagcgccaacaacaccaccaccagcggccugacccccaacagcaugauccccgagaaggagagacagaacaucgccgagagacugcugagagugaugugcgccgaccugggcgcccugagcguggugagcggcaaggaguuccugaagcuggcccagacccugguggacagcggcgccagauacggcgccuucagcgugaccgagauccugggcaacuucaacacccuggcccugaagcaccugcccagaauguacaaccaggugaaggugaaggugaccugcgcccugggcagcaacgccugccugggcaucggcgugaccugccacagccagagcgugggccccgacagcugcuacauccugaccgccuaccaggccgagggcaaccacaucaagagcuacgugcugggcgugaagggcgccgacaucagagacagcggcgaccuggugcaccacugggugcagaacgugcugagcgaguucgugaugagcgagaucagaaccguguacgugaccgacugcagagugagcaccagcgccuucagcaaggccggcaugugccugagaugcagcgccugcgcccugaacagcguggugcagagcgugcugagcaagagaacccugcaggccagaagcaugcacgaggugaucgagcugcugaacgugugcgaggaccuggccggcagcaccggccuggccaaggagaccuucggcagccuggaggagaccagccccccccccugcuggaacagcgugaccgacagccugcugcuggugcacgagagauacgagcagaucugcgaguucuacagcagagccaagaagaugaaccugauccagagccugaacaagcaccugcugagcaaccuggccgccauccugacccccgugaagcaggccgugaucgagcugagcaacgagagccagcccacccugcagcuggugcugcccaccuacgugagacuggagaagcuguucaccgccaaggccaacgacgccggcaccgugagcaagcugugccaccuguuccuggaggcccugaaggagaacuucaaggugcaccccgcccacaagguggccaugauccuggacccccagcagaagcugagacccgugccccccuaccagcacgaggagaucaucggcaaggugugcgagcugaucaacgaggugaaggagagcugggccgaggaggccgacuucgagcccgccgccaagaagcccagaagcgccgccguggagaaccccgccgcccaggaggacgacagacugggcaagaacgagguguacgacuaccugcaggagccccuguuccaggccacccccgaccuguuccaguacuggagcugcgugacccagaagcacaccaagcuggccaagcuggccuucuggcugcuggccgugcccgccgugggcgccagaagcggcugcgugaacaugugcgagcaggcccugcugaucaagagaagaagacugcugagccccgaggacaugaacaagcugauguuccugaagagcaacaugcuguaa

SEQ ID NO: 26037 - RNA, 1386 nt, Artificial Sequence
  ZNF627__Homo_sapiens__NP_660338
auggacagcguggccuucgaggacguggccgugaacuucacccuggaggagugggcccugcuggaccccagccagaagaaccuguacagagacgugaugagagagaccuucagaaaccuggccagcgugggcaagcagugggaggaccagaacaucgaggaccccuucaagauccccagaagaaacaucagccacauccccgagagacugugcgagagcaaggagggcggccagggcgaggagaccuucagccagauccccgacggcauccugaacaagaagacccccggcgugaagcccugcgagagcagcgugugcggcgaggugggcaugggccccagcagccugaacagacacaucagagaccacaccggcagagagcccaacgaguaccaggaguacggcaagaagagcuacaccagaaaccagugcggcagagcccugagcuaccacagaagcuuccccgugagagagagaacccaccccggcggcaagcccuacgacugcaaggagugcggcgagaccuucaucagccuggugagcaucagaagacacaugcugacccacagaggcggcgugcccuacaagugcaaggugugcggcaaggccuucgacuaccccagccuguucagaauccacgagagaagccacaccggcgagaagcccuacgagugcaagcagugcggcaaggccuucagcugcagcagcuacaucagaauccacgagagaacccacaccggcgacaagcccuacgagugcaagcagugcggcaaggccuucagcugcagcaaguacaucagaauccacgagagaacccacaccggcgagaagcccuacgagugcaagcagugcggcaaggccuucagaugcgccagcagcgugagaagccacgagagaacccacaccggcgagaagcuguucgagugcaaggagugcggcaaggcccugaccugccuggccagcgugagaagacacaugaucaagcacaccggcaacggccccuacaagugcaaggugugcggcaaggccuucgacuuccccagcagcuucagaauccacgagagaacccacaccggcgagaagcccuacgacugcaagcagugcggcaaggccuucagcugcagcagcagcuucagaaagcacgagagaauccacaccggcgagaagcccuacaagugcaccaagugcggcaaggccuucagcagaagcagcuacuucagaauccacgagagaacccacaccggcgagaagcccuacgagugcaagcagugcggcaaggccuucagcagaagcaccuacuucagagugcacgagaagauccacaccggcgagaagcccuacgagaaccccaaccccaacgccagcguggugcccgugcugagcuaa

SEQ ID NO: 26038 - RNA, 2610 nt, Artificial Sequence
  ZNF629__Homo_sapiens__NP_001073886
auggagcccgagaccgcccuguggggccccgaccugcagggccccgagcagagccccaacgacgcccacagaggcgccgagagcgagaacgaggaggagagccccagacaggagagcagcggcgaggagaucaucaugggcgaccccgcccagagccccgagagcaaggacagcaccgagaugagccuggagagaagcagccaggaccccagcgugccccagaacccccccaccccccugggccacagcaacccccuggaccaccagaucccccuggacccccccgcccccgagguggugcccacccccagcgacuggaccaaggccugcgaggccagcuggcaguggggcgcccugaccaccuggaacagcccccccguggugcccgccaacgagcccagccugagagagcuggugcagggcagacccgccggcgccgagaagcccuacaucugcaacgagugcggcaagagcuucagccaguggagcaagcugcugagacaccagagaauccacaccggcgagagacccaacaccugcagcgagugcggcaagagcuucacccagagcagccaccuggugcagcaccagagaacccacaccggcgagaagcccuacaagugccccgacugcggcaagugcuucagcuggagcagcaaccuggugcagcaccagagaacccacaccggcgagaagcccuacaagugcaccgagugcgagaaggccuucacccagagcaccaaccugaucaagcaccagagaagccacaccggcgagaagcccuacaagugcggcgagugcagaagagccuucuacagaagcagcgaccugauccagcaccaggccacccacaccggcgagaagcccuacaagugccccgagugcggcaagagauucggccagaaccacaaccugcugaagcaccagaagauccacgccggcgagaagcccuacagaugcaccgagugcggcaagagcuucauccagagcagcgagcugacccagcaccagagaacccacaccggcgagaagcccuacgagugccuggagugcggcaagagcuucggccacagcagcacccugaucaagcaccagagaacccaccugagagaggaccccuucaagugccccgugugcggcaagaccuucacccugagcgccacccugcugagacaccagagaacccacaccggcgagagacccuacaagugccccgagugcggcaagagcuucagcgugagcagcaaccugaucaaccaccagagaauccacagaggcgagagacccuacaucugcgccgacugcggcaagagcuucaucaugagcagcacccugaucagacaccagagaauccacaccggcgagaagcccuacaagugcagcgacugcggcaagagcuucaucagaagcagccaccugauccagcacagaagaacccacaccggcgagaagcccuacaagugccccgagugcggcaagagcuucagccagagcagcaaccugaucacccacgugagaacccacauggacgagaaccuguucgugugcagcgacugcggcaaggccuuccuggaggcccacgagcuggagcagcacagagugauccacgagagaggcaagacccccgccagaagagcccagggcgacagccugcugggccugggcgaccccagccugcugacccccccccccggcgccaagccccacaagugccuggugugcggcaagggcuucaacgacgagggcaucuucaugcagcaccagagaauccacaucggcgagaaccccuacaagaacgccgacggccugaucgcccacgccgcccccaagcccccccagcugagaagccccagacugcccuucagaggcaacagcuaccccggcgccgccgagggcagagccgaggcccccggccagccccugaagccccccgagggccaggagggcuucagccagagaagaggccugcugagcagcaagaccuacaucugcagccacugcggcgagagcuuccuggacagaagcgugcugcugcagcaccagcugacccacggcaacgagaagcccuuccuguuccccgacuacagaaucggccugggcgagggcgccggccccagccccuuccugagcggcaagcccuucaagugccccgagugcaagcagagcuucggccugagcagcgagcugcugcugcaccagaaggugcacgccggcggcaagagcagccagaagagccccgagcugggcaagagcagcagcgugcugcuggagcaccugagaagcccccugggcgccagacccuacagaugcagcgacugcagagccagcuuccuggacagaguggcccugaccagacaccaggagacccacacccaggagaagccccccaaccccgaggaccccccccccgaggccgugacccugagcaccgaccaggagggcgagggcgagacccccacccccaccgagagcagcagccacggcgagggccagaaccccaagacccugguggaggagaagcccuaccugugccccgagugcggcgccggcuucaccgagguggccgcccugcugcugcacagaagcugccaccccggcgugagccuguaa

SEQ ID NO: 26039 - RNA, 1458 nt, Artificial Sequence
  ZNF639__Homo_sapiens__NP_001290355
augaacgaguaccccaagaagagaaagagaaagacccugcaccccagcagauacagcgacagcagcggcaucagcagaaucgccgacggcuucaacggcaucuucagcgaccacugcuacagcgugugcagcaugagacagcccgaccugaaguacuucgacaacaaggacgacgacagcgacaccgagaccagcaacgaccugcccaaguucgccgacggcaucaaggccagaaacagaaaccagaacuaccuggugcccagccccgugcugagaauccuggaccacaccgccuucagcaccgagaagagcgccgacaucgugaucugcgacgaggagugcgacagccccgagagcgugaaccagcagacccaggaggagagccccaucgaggugcacaccgccgaggacgugcccaucgccguggaggugcacgccaucagcgaggacuacgacaucgagaccgagaacaacagcagcgagagccugcaggaccagaccgacgaggagccccccgccaagcugugcaagauccuggacaagagccaggcccugaacgugaccgcccagcagaaguggccccugcugagagccaacagcagcggccuguacaagugcgagcugugcgaguucaacagcaaguacuucagcgaccugaagcagcacaugauccugaagcacaagagaaccgacagcaacgugugcagagugugcaaggagagcuucagcaccaacaugcugcugaucgagcacgccaagcugcacgaggaggaccccuacaucugcaaguacugcgacuacaagaccgugaucuucgagaaccugagccagcacaucgccgacacccacuucagcgaccaccuguacuggugcgagcagugcgacgugcaguucagcagcagcagcgagcuguaccugcacuuccaggagcacagcugcgacgagcaguaccugugccaguucugcgagcacgagaccaacgaccccgaggaccugcacagccacguggugaacgagcacgccugcaagcugaucgagcugagcgacaaguacaacaacggcgagcacggccaguacagccugcugagcaagaucaccuucgacaagugcaagaacuucuucgugugccaggugugcggcuucagaagcagacugcacaccaacgugaacagacacguggccaucgagcacaccaagaucuucccccacgugugcgacgacugcggcaagggcuucagcagcaugcuggaguacugcaagcaccugaacagccaccugagcgagggcaucuaccugugccaguacugcgaguacagcaccggccagaucgaggaccugaagauccaccuggacuucaagcacagcgccgaccugccccacaagugcagcgacugccugaugagauucggcaacgagagagagcugaucagccaccugcccgugcacgagaccaccuaa

SEQ ID NO: 26040 - RNA, 4107 nt, Artificial Sequence
  ZNF644__Homo_sapiens__XP_011540563
augagaagcuuccugcagcaggacgugaacaagaccaagagcagacugaacgugcugaacggccuggccaacaacauggacgaccugaagaucaacaccgacaucaccggcgccaaggaggagcugcuggacgacaacaacuucaucagcgacaaggagagcggcgugcacaagcccaaggacugccagaccagcuuccagaagaacaacacccugacccugcccgaggagcugagcaaggacaagagcgagaacgcccugagcggcggccagagcagccuguucauccacgccggcgcccccaccgugagcagcgagaacuucauccugcccaagggcgccgccgugaacggccccgugagccacagcagccugaccaagaccagcaacaugaacaagggcagcgugagccugaccaccggccagcccguggaccagcccaccaccgagagcugcagcacccugaagguggccgccgaccugcagcugagcaccccccagaaggccagccagcaccaggugcuguuccugcugagcgacguggcccacgccaagaaccccacccacagcaacaagaagcugcccaccagcgccagcgugggcugcgacauccagaacagcgugggcagcaacaucaagagcgacggcacccugaucaaccagguggaggugggcgaggacggcgaggaccugcuggugaaggacgacugcgugaacaccgugaccggcaucagcagcggcaccgacggcuucagaagcgagaacgacaccaacugggacccccagaaggaguucauccaguuccugaugaccaacgaggagaccguggacaaggcccccccccacagcaagaucggccuggagaagaagagaaagagaaagauggacgugagcaagaucaccagauacaccgaggacugcuucagcgacagcaacugcgugcccaacaagagcaagaugcaggagguggacuuccuggagcagaacgaggagcugcaggccguggacagccagaaguacgcccugagcaaggugaagcccgagagcaccgacgaggaccuggagagcguggacgccuuccagcaccugaucuacaaccccgacaagugcggcgaggagagcagccccgugcacaccagcaccuuccugagcaacacccugaagaagaagugcgaggagagcgacagcgagagccccgccaccuucagcaccgaggagcccagcuucuaccccugcaccaagugcaacgugaacuucagagagaagaagcaccugcacagacacaugauguaccaccuggacggcaacagccacuucagacaccugaacgugcccagacccuacgccugcagagagugcggcagaaccuucagagacagaaacagccugcugaagcacaugaucauccaccaggagagaagacagaagcugauggaggagaucagagagcugaaggagcugcaggacgagggcagaagcgccagacugcagugcccccagugcguguucggcaccaacugccccaagaccuucgugcagcacgccaagacccacgagaaggacaagagauacuacugcugcgaggagugcaacuucauggccgugaccgagaacgagcuggagugccacagaggcaucgcccacggcgccguggugaagugccccauggugaccagcgacaucgcccagagaaagacccagaagaagaccuucaugaaggacagcguggugggcagcagcaagaagagcgccaccuacaucugcaagaugugccccuucaccaccagcgccaagagcgugcugaagaagcacaccgaguaccugcacagcagcagcugcguggacagcuucggcagcccccugggccuggacaagagaaagaacgacauccuggaggagcccguggacagcgacagcaccaagacccugaccaagcagcagagcaccaccuuccccaagaacagcgcccugaagcaggacgugaagagaaccuucggcagcaccagccagagcagcagcuucagcaagauccacaagagaccccacagaauccagaaggccagaaagagcaucgcccagagcggcgugaacaugugcaaccagaacagcagcccccacaagaacgugaccaucaagagcagcguggaccagaagcccaaguacuuccaccaggccgccaaggagaagagcaacgccaaggccaacagccacuaccuguacagacacaaguacgagaacuacagaaugaucaagaagagcggcgagagcuaccccgugcacuucaagaaggaggaggccagcagccugaacagccugcaccuguucagcagcagcagcaacagccacaacaacuucaucagcgacccccacaagcccgacgccaagagacccgagagcuucaaggaccacagaagaguggccgugaagagagugaucaaggagagcaagaaggagagcagcgugggcggcgaggaccuggacagcuaccccgacuuccugcacaagaugaccgugguggugcugcagaagcugaacagcgccgagaagaaggacagcuacgagaccgaggacgagagcagcugggacaacguggagcugggcgacuacaccacccaggccaucgaggacgagaccuacagcgacaucaaccaggagcacgugaaccuguucccccuguucaagagcaagguggagggccaggagcccggcgagaacgccacccugagcuacgaccagaacgacggcuucuacuucgaguacuacgaggacaccggcagcaacaacuuccugcacgagauccacgacccccagcaccuggagaccgccgacgccagccugagcaagcacagcagcguguuccacuggaccgaccugagccuggagaagaagagcugccccuacugccccgccaccuucgagaccggcgugggccugagcaaccacgugagaggccaccugcacagagccggccugagcuacgaggccagacacguggugagccccgagcagaucgccaccagcgacaagaugcagcacuucaagagaaccggcaccggcacccccgugaagagagugagaaaggccaucgagaagagcgagaccaccagcgagcacaccugccagcugugcggcggcugguucgacaccaagaucggccugagcaaccacgugagaggccaccugaagagacugggcaagaccaagugggacgcccacaagagccccaucugcgugcugaacgagaugaugcagaacgaggagaaguacgagaagauccugaaggcccugaacagcagaagaaucauccccagacccuucguggcccagaagcuggccagcagcgacgacuucaucagccagaacgugaucccccuggaggccuacagaaacggccugaagaccgaggcccugagcgugagcgccagcgaggaggagggccugaacuuccugaacgaguacgacgagaccaagcccgagcugcccagcggcaagaagaaccagagccugacccugaucgagcugcugaagaacaagagaaugggcgaggagagaaacagcgccaucagcccccagaagauccacaaccagaccgccagaaagagauucgugcagaagugcgugcugccccugaacgaggacagcccccugauguaccagccccagaagauggaccugaccaugcacagcggcaugcccgugaagcugagaaccugcgugcacugcaacaccaccuucaccagcgccgugagccugagcaaccaccugagagccuacgccagaaagaagagcgccggccugcugaccggcaccgcccuggacugcaagcagaagaagagcagaagcagaagcggcagcaagaagaagaugcugacccugccccacggcgccgacgagguguacauccugagaugcagauucugcggccugguguucagaggcccccugagcgugcaggaggacuggaucaagcaccugcagagacacaucgugaacgccaaccugcccagaaccggcgccggcaugguggaggugaccagccugcugaagaagcccgccagcaucaccgagaccagcuucagccugcugauggccgaggccgccagcuaa

SEQ ID NO: 26041 - RNA, 1278 nt, Artificial Sequence
  ZNF645__Homo_sapiens__NP_689790
augaacaagaugcccgccggcgagcaggagugcgaguacaacaaggagggcaaguacuacagcaagggcgugaagcuggugagaaagaagaagaagauccccggcuacagauggggcgacaucaagaucaacaucaucggcgagaaggacgaccugcccauccacuucugcgacaagugcgaccugcccaucaagaucuacggcagaaucauccccugcaagcacgccuucugcuaccacugcgccaaccuguacgacaaggugggcuacaaggugugccccagaugcagauaccccgugcugagaaucgaggcccacaagagaggcagcguguucaugugcagcaucgugcagcagugcaagagaaccuaccugagccagaagagccugcaggcccacaucaagagaagacacaagagagccagaaagcaggugaccagcgccagccuggagaaggugagaccccacaucgcccccccccagaccgagaucagcgacauccccaagagacugcaggacagagaccaccugagcuacaucccccccgagcagcacaccauggugagccugcccagcgugcagcacaugcugcaggagcagcacaaccagccccacaaggacauccaggcccccccccccgagcugagccugagccugcccuuccccauccagugggagaccgugagcaucuucaccagaaagcacggcaaccugaccguggaccacauccagaacaacagcgacagcggcgccaagaagcccaccccccccgacuacuaccccgagugccagagccagcccgccgugagcagcccccaccacaucaucccccagaagcagcacuacgcccccccccccagccccagcagccccgugaaccaccagaugcccuaccccccccaggacguggugacccccaacagcgugagaagccaggugcccgcccugaccaccaccuacgaccccagcagcggcuacaucaucgugaaggugccccccgacaugaacagccccccccugagagccccccagagccagaacggcaaccccagcgccagcgaguucgccagccaccacuacaaccugaacauccugccccaguucaccgagaaccaggagacccugagcccccaguucacccagaccgacgccauggaccacagaagauggcccgccuggaagagacugagccccugcccccccaccagaagccccccccccagcacccugcacggcagaagccaccacagccaccagagaagacacagaagauacuaa

SEQ ID NO: 26042 - RNA, 5499 nt, Artificial Sequence
  ZNF646__Homo_sapiens__NP_055514
auggaggacaccccccccagccugagcugcagcgacugccagagacacuuccccagccugcccgagcugagcagacacagagagcugcugcaccccagccccaaccaggacagcgaggaggccgacagcauccccagacccuacagaugccagcagugcggcagaggcuacagacaccccggcagccuggugaaccacagaagaacccacgagaccggccuguuccccugcaccaccugcggcaaggacuucagcaaccccauggcccugaagagccacaugagaacccacgcccccgagggcagaagaagacacagaccccccagacccaaggaggccaccccccaccugcagggcgagaccgugagcaccgacagcuggggccagagacugggcagcagcgagggcugggagaaccagaccaagcacaccgaggagacccccgacugcgagagcgugcccgaccccagagccgccagcggcaccugggaggaccugcccaccagacagagagagggccuggccagccaccccggccccgaggacggcgccgacggcuggggccccagcaccaacagcgccagagcccccccccugcccauccccgccagcagccugcugagcaaccuggagcaguaccuggccgagagcguggugaacuucaccggcggccaggagcccacccagagcccccccgccgaggaggagagaagauacaagugcagccagugcggcaagaccuacaagcacgccggcagccugaccaaccacagacagagccacacccugggcaucuaccccugcgccaucugcuucaaggaguucagcaaccugauggcccugaagaaccacagcagacugcacgcccaguacagacccuaccacugcccccacugccccagaguguucagacugcccagagagcugcuggagcaccagcagagccacgagggcgagagacaggagcccagaugggaggagaagggcaugcccaccaccaacggccacaccgacgagagcagccaggaccagcugcccagcgcccagaugcugaacggcagcgccgagcugagcaccagcggcgagcuggaggacagcggccuggaggaguacagacccuucagaugcggcgacugcggcagaaccuacagacacgccggcagccugaucaaccacagaaagagccaccagaccggcguguaccccugcagccugugcagcaagcagcuguucaacgccgccgcccugaagaaccacgugagagcccaccacagacccagacagggcgugggcgagaacggccagcccagcgugccccccgccccccugcugcuggccgagaccacccacaaggaggaggaggaccccaccaccacccuggaccacagacccuacaagugcagcgagugcggcagagccuacagacacagaggcagccuggugaaccacagacacagccacagaaccggcgaguaccagugcagccugugccccagaaaguaccccaaccugauggcccugagaaaccacgugagagugcacugcaaggccgccagaagaagcgccgacaucggcgccgagggcgcccccagccaccugaagguggagcugccccccgaccccguggaggccgaggccgccccccacaccgaccaggaccacgugugcaagcacgaggaggaggccaccgacaucacccccgccgccgacaagaccgccgcccacaucugcagcaucugcggccugcuguucgaggacgccgagagccuggagagacacggccugacccacggcgccggcgagaaggagaacagcagaaccgagaccaccaugagcccccccagagccuucgccugcagagacugcggcaagagcuacagacacagcggcagccugaucaaccacagacagacccaccagaccggcgacuucagcugcggcgccugcgccaagcacuuccacaccauggccgccaugaagaaccaccugagaagacacagcagaagaagaagcagaagacacagaaagagagccggcggcgccagcggcggcagagaggccaagcugcuggccgccgagagcuggaccagagagcuggaggacaacgagggccuggagagcccccaggaccccagcggcgagagcccccacggcgccgagggcaaccuggagagcgacggcgacugccugcaggccgagagcgagggcgacaagugcggccuggagagagacgagacccacuuccagggcgacaaggagagcggcggcaccggcgagggccuggagagaaaggacgccagccugcuggacaaccuggacauccccggcgaggagggcggcggcacccacuucugcgacagccugaccggcguggacgaggaccagaagcccgccaccggccagcccaacagcagcagccacagcgccaacgccgugaccggcuggcaggccggcgccgcccacaccugcagcgacugcggccacagcuucccccacgccaccggccugcugagccacagacccugccacccccccggcaucuaccagugcagccugugccccaaggaguucgacagccugcccgcccugagaagccacuuccagaaccacagacccggcgaggccaccagcgcccagcccuuccugugcugccugugcggcaugaucuuccccggcagagccggcuacagacugcacagaagacaggcccacagcagcagcggcaugaccgagggcagcgaggaggagggcgaggaggagggcguggccgaggccgcccccgccagaagccccccccugcagcugagcgaggccgagcugcugaaccagcugcagagagagguggaggcccuggacagcgccggcuacggccacaucugcggcugcugcggccagaccuacgacgaccugggcagccuggagagacaccaccagagccagagcagcggcaccaccgccgacaaggcccccagcccccugggcguggccggcgacgccauggagauggugguggacagcgugcuggaggacaucgugaacagcgugagcggcgagggcggcgacgccaagagccaggagggcgccggcaccccccugggcgacagccugugcauccagggcggcgagagccugcuggaggcccagcccagacccuucagaugcaaccagugcggcaagaccuacagacacggcggcagccuggugaaccacagaaagauccaccagaccggcgacuuccugugccccgugugcagcagaugcuaccccaaccuggccgccuacagaaaccaccugagaaaccaccccagaugcaagggcagcgagccccaggugggccccauccccgaggccgccggcagcagcgagcugcaggugggccccauccccgagggcggcagcaacaagccccagcacauggccgaggagggccccggccaggccgagguggagaagcugcaggaggagcugaagguggagccccuggaggagguggccagagugaaggaggaggugugggaggagaccaccgugaagggcgaggagaucgagcccagacuggagaccgccgagaagggcugccagaccgaggccagcagcgagagacccuucagcugcgaggugugcggcagaagcuacaagcacgccggcagccugaucaaccacagacagagccaccagaccggccacuucggcugccaggccugcagcaagggcuucagcaaccugaugagccugaagaaccacagaagaauccacgccgaccccagaagauucagaugcagcgagugcggcaaggccuucagacugagaaagcagcuggccagccaccagagagugcacauggagagaagaggcggcggcggcaccagaaaggccaccagagaggacagacccuucagaugcggccagugcggcagaaccuacagacacgccggcagccugcugaaccacagaagaagccacgagaccggccaguacagcugccccaccugccccaagaccuacagcaacagaauggcccugaaggaccaccagagacugcacagcgagaacagaagaagaagagccggcagaagcagaagaaccgccgugagaugcgcccugugcggcagaagcuuccccggcagaggcagccuggagagacaccugagagagcacgaggagaccgagagagagcccgccaacggccagggcggccuggacggcaccgccgccagcgaggccaaccugaccggcagccagggccuggagacccagcugggcggcgccgagcccgugccccaccuggaggacggcgugcccagacccggcgagagaagccagagccccaucagagccgccagcagcgaggcccccgagccccugagcuggggcgccggcaaggccggcggcuggcccgugggcggcggccugggcaaccacagcggcggcugggugccccaguuccugaccagaagcgaggagcccgaggacagcgugcacagaagccccugccacgccggcgacugccagcugaacggccccacccugagccacauggacagcugggacaacagagacaacagcagccagcugcagcccggcagccacagcagcugcagccagugcggcaagaccuacugccagagcggcagccugcugaaccacaacaccaacaagaccgacagacacuacugccugcugugcagcaaggaguuccugaaccccguggccaccaagagccacagccacaaccacaucgacgcccagaccuucgccugccccgacugcggcaaggccuucgagagccaccaggagcuggccagccaccugcaggcccacgccagaggccacagccaggugcccgcccagauggaggaggccagagaccccaaggccggcaccggcgaggaccagguggugcugcccggccagggcaaggcccaggaggcccccagcgagacccccagaggccccggcgagagcguggagagagccagaggcggccaggccgugaccagcauggccgccgaggacaaggagagacccuucagaugcacccagugcggcagaagcuacagacacgccggcagccugcugaaccaccagaaggcccacaccaccggccuguaccccugcagccugugccccaagcugcugcccaaccugcugagccugaagaaccacagcagaacccacaccgaccccaagagacacugcugcagcaucugcggcaaggccuucagaaccgccgccagacuggagggccacggcagagugcacgcccccagagagggccccuucaccugcccccacugccccagacacuucagaagaagaaucagcuucgugcagcaccagcagcagcaccaggaggaguggaccguggccggcagcggcgcccccguggcccccgugaccggcagaggcgaccugccccugccccccccccccacccccaccaccccccugcuggaccccagcccccaguggcccgccgaccugagcuucagccuguaa

SEQ ID NO: 26043 - RNA, 1821 nt, Artificial Sequence
  ZNF652__Homo_sapiens__NP_001138837
augagccacaccgccagcagcugccaggagcugguggagaacugcgccgugcacguggccggcauggcccaggaggacagcagaagaggccaggugcccagcagcuucuaccacggcgccaaccaggagcuggaccugagcaccaagguguacaagagagagagcggcagccccuacagcgugcugguggacaccaagaugagcaagccccaccugcacgagaccgaggagcagcccuacuucagagagaccagagccgugagcgacgugcacgccgugaaggaggacagagagaacagcgacgacaccgaggaggaggaggaggaggugagcuacaagagagagcagaucaucguggaggugaaccugaacaaccagacccugaacgugagcaagggcgagaagggcgugagcagccagagcaaggagacccccgugcugaagaccagcagcgaggaggaggaggaggagagcgaggaggaggccaccgacgacagcaacgacuacggcgagaacgagaagcagaagaagaaggagaagaucguggagaaggugagcgugacccagagaagaaccagaagagccgccagcguggccgccgccaccaccagccccacccccagaaccaccagaggcagaagaaagagcguggagccccccaagagaaagaagagagccaccaaggagcccaaggcccccgugcagaaggccaagugcgaggagaaggagacccugaccugcgagaagugccccagaguguucaacaccagaugguaccuggagaagcacaugaacgugacccacagaagaaugcagaucugcgacaagugcggcaagaaguucgugcuggagagcgagcugagccugcaccagcagaccgacugcgagaagaacauccagugcgugagcugcaacaagagcuucaagaagcuguggagccugcacgagcacaucaagaucgugcacggcuacgccgagaagaaguucagcugcgagaucugcgagaagaaguucuacaccauggcccacgugagaaagcacaugguggcccacaccaaggacaugcccuucaccugcgagaccugcggcaagagcuucaagagaagcaugagccugaaggugcacagccugcagcacagcggcgagaagcccuucagaugcgagaacugcgacgagagauuccaguacaaguaccagcugagaagccacaugagcauccacaucggccacaagcaguucaugugccaguggugcggcaaggacuucaacaugaagcaguacuucgacgagcacaugaagacccacaccggcgagaagcccuucaucugcgagaucugcggcaagagcuucaccagcagacccaacaugaagagacacagaagaacccacaccggcgagaagcccuaccccugcgacgugugcggccagagauucagauucagcaacaugcugaaggcccacaaggagaagugcuucagagugaccagccccgugaacgugccccccgccgugcagaucccccugaccaccagccccgccacccccgugcccagcguggugaacaccgccaccacccccaccccccccaucaacaugaaccccgugagcacccugccccccagacccaucccccaccccuucagccaccugcacauccacccccacccccaccacccccaccaccugcccaucccccccgugccccaccugccccccccccccgcccuguucaagagcgagccccugaaccacagaggccagagcgaggacaacuuccugagacaccuggccgagaagaacagcagcgcccagcaccacuaa

SEQ ID NO: 26044 - RNA, 1746 nt, Artificial Sequence
  ZNF654__Homo_sapiens__NP_060763
augcugugcaacaaggaguuccugggcggccacaucgugagacacgcccaggcccaccagaagaagggcagcuucgccugcgugaucugcggcagaaaguucagaaacagaggccugaugcagaagcaccugaagaaccacgugaagaagauccagagacagcagaucgccgccgcccagcaggacgaccaggaggugaccgcccuggaggagaucaacugcagcagcagcagcaucagcuucgagaacggcaacagcgacagcaaggaccuggagguggagacccugaccgccagcagcgagggcaacaaggaggugauccccgagcacguggccgaguucaucgagauccccaucagcgugcccgaggacgugaucgagaacgugaucgagaacggcagccccaacaacagccugaacaacguguucaagccccugaccgagugcggcgacgacuacgaggaggaggaggacgaggagggcgacuacgaggaggacgacuacgaccugaaccaggagaccagcgugauccacaagaucaacggcaccgugugccaccccaaggacaucuacgccaccgaccaggagggcaacuucaagugccccgcccugggcugcgugagaaucuucaagagaaucggcuuccugaacaagcacgccaugaccgugcaccccaccgaccugaacgugagacagaccgugaugaaguggagcaagggcaagugcaaguucugccagagacaguucgaggacagccagcacuucaucgaccaccugaacagacacagcuaccccaacguguacuucugccugcacuucaacugcaacgagagcuucaagcugcccuuccagcuggcccagcacaccaagagccacagaaucuuccaggcccagugcagcuuccccgagugccacgagcuguucgaggaccugccccugcuguacgagcacgaggcccagcacuaccugagcaagacccccgagagcagcgcccagcccagcgagaccauccugugggacgugcagaccgacagcaaccccaaccaggagaaggacagcagcagcaacgagaagcagaccaucagccugcccgugagcaccagcaagagcagaaaggagagcaccgagcccaagaccugcaucgagagcauggagaagaagaccgacagccuggugcagaacggcaacgagagaagcgacgacaccgugagcaacaucagccugaucgaccagaagaugcccgacaucgagcccaacagcgagaacaacugcagcagcagcgacaucgugaacggccacagcgagaucgagcagaccccccuggugagcagcgaccccgcccugaagaucgacaccaacagaaucagaaccgagaacggcagcauccugcccagcguggugccccaggagcacaacacccugcccgugagccaggcccccagcaagcccaaccugaccagcgagcacaccagcuacggccugauccugaccaagcccuacgugagaccccugccccccagcuaccuggacgagagauaccugagcaugcccaagagaagaaaguuccugaccgacagaguggacgccugcagcgaccaggacaacguguacaagaagagcgugaagagacugagaugcggcaagugccugaccaccuacugcaacgccgaggcccuggaggcccaccuggcccagaagaagugccagacccuguucggcuucgacagcgacgacgagagcgccuaa

SEQ ID NO: 26045 - RNA, 786 nt, Artificial Sequence
  ZNF664__Homo_sapiens__NP_689650
augaucuacaagugccccaugugcagagaguucuucagcgagagagccgaccuguucaugcaccagaagauccacaccgccgagaagccccacaagugcgacaagugcgacaagggcuucuuccacaucagcgagcugcacauccacuggagagaccacaccggcgagaagguguacaagugcgacgacugcggcaaggacuucagcaccaccaccaagcugaacagacacaagaagauccacaccguggagaagcccuacaagugcuacgagugcggcaaggccuucaacuggagcagccaccugcagauccacaugagagugcacaccggcgagaagcccuacgugugcagcgagugcggcagaggcuucagcaacagcagcaaccugugcaugcaccagagagugcacaccggcgagaagcccuucaagugcgaggagugcggcaaggccuucagacacaccagcagccugugcaugcaccagagagugcacaccggcgagaagcccuacaagugcuacgagugcggcaaggccuucagccagagcagcagccugugcauccaccagagagugcacaccggcgagaagcccuacagaugcugcggcugcggcaaggccuucagccagagcagcagccugugcauccaccagagagugcacaccggcgagaagcccuucaagugcgacgagugcggcaaggccuucagccagagcaccagccugugcauccaccagagagugcacaccaaggagagaaaccaccugaagaucagcgugaucuaa

SEQ ID NO: 26046 - RNA, 1833 nt, Artificial Sequence
  ZNF667__Homo_sapiens__NP_071386
augcccagcgccagaggcaagagcaagagcaaggcccccaucaccuucggcgaccuggccaucuacuucagccaggaggagugggaguggcugagccccauccagaaggaccuguacgaggacgugaugcuggagaacuacagaaaccuggugagccugggccugagcuucagaagacccaacgugaucacccugcuggagaagggcaaggcccccuggaugguggagcccgugagaagaagaagagcccccgacagcggcagcaagugcgagaccaagaagcugccccccaaccagugcaacaagagcggccagagcaucugccagaagcuggugagcgcccagcagaaggcccccaccagaaagagcggcugcaacaagaacagcgugcuggugaagcccaagaagggccacagcggcaagaagccccugaagugcaacgacugcggcaagaccuucagcagaagcuucagccugaagcugcaccagaacauccacaccggcgagaagcccuucgagugcagcaacugcagaaaggccuucagacagaucagcagcauccugcugcaccagagaauccacagcggcaagaagagccacgagugcaacaagugcggcgagagcuucaaccagagaaccacccugauccugcacaugagaauccacgacggcaaggagauccuggacugcggcaaggcccugagccagugccagagcuucaacauccaccagaagauccacguggugggcaacgugugccagugcagaaagugcggcaaggccuucaaccagaugagcagccugcugcugcacaagaagauccacaacggcaagaagacccacaaguacaacaagugcggcagaggcuucaagaagaagagcguguucguggugcacaagagaauccacgccggcgagaagauccccgagaacgccaaggcccugagccagagccugcagcagagaagccaccaccuggagaaccccuucaagugcagaaagugcggcaagcuguucaacagaaucagcccccugaugcugcaccagagaauccacaccagcgagaagcccuacaagugcgacaagugcgacaaguucuucagaagacugagcacccugauccugcaccugagaauccacaacggcgagaagcuguacagaugcaacaagugcgagaaggugugcaacagacacagcagccugauccagcaccagaaggugcacaccaagaagaagaagcuguucgagugcaaggagugcggcaagauguucagcggcaccgccaaccugaagauccaccagaacauccacagcgaggagaagcccuucaagugcaacaagugcagcaagguguucggcagacagagcuuccugaucgagcaccagagaauccacaccggcgagaagcccuaccagugcgaggagugcggcaaggccuucagccacagaaucagccugaccagacacaagagaauccacaccgaggacagacccuacgagugcgaccagugcggcaaggccuucagccagagcgcccaccuggcccagcacgagagaauccacaccggcgagaagcccuacaccugcaagaccugcggcaaggccuucagccagagaaccagccugauccugcacgagagaagccacaccggcgagaagcccuacgagugcaacgagugcggcaaggccuucagcagcggcagcgaccugaucagacaccagagaagccacagcagcgagaagcccuacgagugcagcaagugcggcaaggccuacagcagaagcagcagccugaucagacaccagaacacccacagcgaggagaaggccuaa

SEQ ID NO: 26047 - RNA, 1860 nt, Artificial Sequence
  ZNF668__Homo_sapiens__NP_078982
auggagguggaggccgccgaggccagaagccccgcccccggcuacaagagaagcggcagaagauacaagugccugagcugcaccaagaccuuccccaacgcccccagagccgccagacacgccgccacccacggccccgccgacugcagcgaggagguggccgaggugaagcccaagcccgagaccgaggccaaggccgaggaggccagcggcgagaaggugagcggcagcgccgccaagcccagacccuacgccugcccccugugccccaaggccuacaagaccgcccccgagcugagaagccacggcagaagccacaccggcgagaagcccuuccccugccccgagugcggcagaagauucaugcagcccgugugccugagagugcaccuggccagccacgccggcgagcugcccuucagaugcgcccacugccccaaggccuacggcgcccugagcaagcugaagauccaccagagaggccacaccggcgagagacccuacgccugcgccgacugcggcaagagcuucgccgaccccagcguguucagaaagcacagaagaacccacgccggccugagacccuacagcugcgagagaugcggcaaggccuacgccgagcugaaggaccugagaaaccacgagagaagccacaccggcgagagacccuuccugugcagcgagugcggcaagagcuucagcagaagcagcagccugaccugccaccagagaauccacgccgcccagaagcccuacagaugccccgccugcggcaagggcuucacccagcugagcagcuaccagagccacgagagaacccacagcggcgagaagcccuuccugugccccagaugcggcagaauguucagcgaccccagcagcuucagaagacaccagagagcccacgagggcgugaagcccuaccacugcgagaagugcggcaaggacuucagacagcccgccgaccuggccaugcacagaagagugcacaccggcgacagacccuucaagugccugcagugcgacaagaccuucguggccagcugggaccugaagagacacgcccuggugcacagcggccagagacccuucagaugcgaggagugcggcagagccuucgccgagagagccagccugaccaagcacagcagagugcacagcggcgagagacccuuccacugcaacgccugcggcaagagcuucguggugagcagcagccugagaaagcacgagagaacccacagaagcagcgaggccgccggcgugccccccgcccaggagcugguggugggccuggcccugcccgugggcguggccggcgagagcagcgccgcccccgccgccggcgccggccugggcgacccccccgccggccugcugggccugccccccgagagcggcggcgugauggccacccaguggcagguggugggcaugaccguggagcacguggagugccaggacgccggcgugagagaggcccccggcccccuggagggcgccggcgaggccggcggcgaggaggccgacgagaagcccccccaguucgugugcagagagugcaaggagaccuucagcaccaugacccugcugagaagacacgagagaagccaccccgagcugagacccuuccccugcacccagugcggcaagagcuucagcgacagagccggccugagaaagcacagcagaacccacagcagcgugagacccuacaccugcccccacugccccaaggccuuccugagcgccagcgaccugagaaagcacgagagaacccaccccgugcccaugggcacccccaccccccuggagccccugguggcccugcugggcaugcccgaggagggccccgccuaa

SEQ ID NO: 26048 - RNA, 1728 nt, Artificial Sequence
  ZNF674__Homo_sapiens__NP_001139763
auggccaugagccaggagagccugaccuucaaggacguguucguggacuucacccuggaggaguggcagcagcuggacagcgcccagaagaaccuguacagagacgugaugcuggagaacuacagccaccuggugagcgugggccaccuggugggcaagcccgacgugaucuucagacugggccccggcgacgagagcuggauggccgacggcggcacccccgugagaaccugcgccgugugggagguggacgagcagaucgaccacuacaaggagagccaggacaaguuccuguggcaggccgccuucaucggcaaggagacccugaaggacgagagcggccaggagugcaagaucugcagaaagaucaucuaccugaacaccgacuucgugagcgugaagcagagacugcccaaguacuacagcugggagagaugcagcaagcaccaccugaacuuccugggccagaacagaagcuacgugagaaagaaggacgacggcugcaaggccuacuggaaggugugccugcacuacaaccugcacaaggcccagcccgccgagagauucuucgaccccaaccagagaggcaaggcccugcaccagaagcaggcccugagaaagagccagagaagccagaccggcgagaagcuguacaagugcaccgagugcggcaagguguucauccagaaggccaaccugguggugcaccagagaacccacaccggcgagaagcccuacgagugcugcgagugcgccaaggccuucagccagaagagcacccugaucgcccaccagagaacccacaccggcgagaagcccuacgagugcagcgagugcggcaagaccuucauccagaagagcacccugaucaagcaccagagaacccacaccggcgagaagcccuucgugugcgacaagugccccaaggccuucaagagcagcuaccaccugaucagacacgagaagacccacaucagacaggccuucuacaagggcaucaagugcaccaccagcagccugaucuaccagagaauccacaccagcgagaagccccagugcagcgagcacggcaaggccagcgacgagaagcccagccccaccaagcacuggagaacccacaccaaggagaacaucuacgagugcagcaagugcggcaagagcuucagaggcaagagccaccugagcgugcaccagagaauccacaccggcgagaagcccuacgagugcagcaucugcggcaagaccuucagcggcaagagccaccugagcgugcaccacagaacccacaccggcgagaagcccuacgagugcagaagaugcggcaaggccuucggcgagaagagcacccugaucgugcaccagagaaugcacaccggcgagaagcccuacaagugcaacgagugcggcaaggccuucagcgagaagagcccccugaucaagcaccagagaauccacaccggcgagagacccuacgagugcaccgacugcaagaaggccuucagcagaaagagcacccugaucaagcaccagagaauccacaccggcgagaagcccuacaagugcagcgagugcggcaaggccuucagcgugaagagcacccugaucgugcaccacagaacccacaccggcgagaagcccuacgagugcagagacugcggcaaggccuucagcggcaagagcacccugaucaagcaccagagaagccacaccggcgacaagaaccuguaa

SEQ ID NO: 26049 - RNA, 1896 nt, Artificial Sequence
  ZNF676__Homo_sapiens__XP_011526034
auguggagcgugcugugccugagccugcagcccgagggcgcccugaccuucagagacguggccaucgaguucagccuggaggaguggcagugccuggacagcacccagcagaaccuguacagaaacgugaugcuggagaacuacagaaaccugguguuccugggcaucgccgccuucaagcccgaccugaucaucuuccuggagcagggcaaggagcccuggaacaugaagagacacgagaugguggaggagccccccgugaucugcagccacuucagccaggaguucuggcccgagcagggcaucgaggacagcuuccagaagaugauccugagaagauacgacaagugcggccacgagaaccugcaccugaagaucagcugcaccaacguggacgagugcaacgugcacaaggagggcuacaacaagcugaaccagagccugaccaccacccagagcaagguguuccagugcggcaaguacgccaacguguuccacaagugcagcaacagcaacagacacaagaucagacacaccggcgagaagggccugaagugcaaggaguacgugagaagcuucugcaugcugagccaccugagccagcacgagagaaucuacaccagagagaacagcuacaagugcgaggagaacggcaaggccuucaacuggagcagcacccugaccuacuacaagagcauccacaccggcgagaagcccuacaagugcgaggagugcggcaaggccuucagcaaguucagcauccugaccaagcacaaggugauccacaccggcgagaagcccuacaagugcgaggagugcggcaaggccuucaacagaagcagcauccugaccaagcacaagaucauccacaccggcgagaagcccuacaagugcgaggagugcggcaagggcuucagcagcgugagcacccugaacacccacaaggccauccacgccgaggagaagcccuacaagugcgaggagugcggcaaggccagcaacagcagcagcaagcugauggagcacaagagaauccacaccggcgagaagcccuacaagugcgaggagugcggcaaggccuucagcuggagcagcagccugaccgagcacaagagaauccacgccggcgagaagcccuacaagugcgaggagugcggcaaggccuucaacagaagcagcauccugaccaagcacaagaucauccacaccggcgagaagcccuacaagugcgagggcugcggcaaggccuucagcaaggugagcacccugaacacccacaaggccauccacgccgaggagaagcccuacaagugcgaggagugcggcaaggccagcaacagcagcagcaagcugauggagcacaagagaauccacaccggcgagaagcccuacaagugcgaggagugcggcaaggccuucagcuggagcagcagccugaccgagcacaagagaauccacgccggcgagaagcccuacaagugcgaggagugcggcaaggccuucaccuggagcagcagcuucaccaagcacaagagaauccacgccgccgagaagcccuacaagugcgaggagugcggcaagggcuucagcaccuucagcauccugaccaagcacaagaucauccacaccggcgagaagagauacaagugcgaggagugcggcaaggccuucagcuggagcagcauccugaccgagcacaagaucauccacaccggcgagaagcccuacaagugcgaggagugcggcaaggccuucagcagaagcagcagccugaccagacacaagagaauccacaccggcgagaagcccuacaagugcgaggagugcggcaaggccuucaagagcagcagcaccgugagcuaccacaagaagauccacaccggcgagaaccccuaa

SEQ ID NO: 26050 - RNA, 1743 nt, Artificial Sequence
  ZNF678__Homo_sapiens__NP_848644
augcccggccaccccgagagcagaaagaccagaagaauccugaccaugcugcccagacuggugcugaacagcuucccccaggugauccugcugcccaacccccccaaggugcugagacugcagggccugcuggccuucagcgacguggugaucgaguucagccccgaggagugggccugccuggaccccgcccagagaaaccuguacagagacgugauguucgagaacuacagaaaccuggugagccuggccauccugagcuacagcauccaggaccugcugcccgagcaggacaugaaggaccugugccagaaggugacccugaccagacacagaagcuggggccuggacaaccugcaccuggugaaggacuggagaaccgugaacgagggcaagggccagaaggaguacugcaacagacugacccagugcagcagcaccaagagcaagaucuuccagugcaucgagugcggcagaaacuucagcuggagaagcauccugaccgagcacaagagaauccacaccggcgagaagcccuacaagugcgaggagugcggcaagguguucaacagaugcagcaaccugaccaagcacaagagaauccacaccggcgagaagcccuacaagugcgacgagugcggcaagguguucaacugguggagccagcugaccaaccacaagaagauccacaccggcgagaagcccuacaagugcgacgagugcgacaagguguucaacugguggagccagcugaccagccacaagaagauccacagcggcgagaagcccuaccccugcgaggagugcggcaaggccuucacccaguucagcaaccugacccagcacaagagaauccacaccggcgagaagcccuacaagugcaaggagugcugcaaggccuucaacaaguucagcaaccugacccagcacaagagaauccacaccggcgagaagcccuacaagugcgaggagugcggcaacguguucaacgagugcagccaccugaccagacacagaagaauccacaccggcgagaagcccuacaagugcgaggagugcggcaaggccuucacccaguucgccagccugaccagacacaagagaauccacaccggcgagaagcccuaccagugcgaggagugcggcaagaccuucaacagaugcagccaccugagcagccacaagagaauccacaccggcgagaagcccuacaagugcgaggagugcggcagaaccuucacccaguucagcaaccugacccagcacaagagaauccacaccggcgagaagcccuacaagugcaaggagugcggcaaggccuucaacaaguucagcagccugacccagcacagaagaauccacaccggcgugaagcccuacaagugcgaggagugcggcaagguguucaagcagugcagccaccugaccagccacaagagaauccacaccggcgagaagcccuacaagugcaaggagugcggcaaggccuucuaccagagcagcauccugagcaagcacaagagaauccacaccgaggagaagcccuacaagugcgaggagugcggcaaggccuucaaccaguucagcagccugaccagacacaagagaauccacaccggcgagaagagauacaagugcaaggagugcggcaagggcuucuaccagagcagcauccacagcaaguacaagagaaucuacaccggcgaggagcccgacaagugcaagaagugcggcagccuguaa

SEQ ID NO: 26051 - RNA, 1623 nt, Artificial Sequence
  ZNF683__Homo_sapiens__XP_011539498
augaucaccagagugggcugggaggugagaaucgagggcaacggcgacaugaaggaggagagcgccgcccagcugggcugcugccacagacccauggcccugggcggcaccggcggcagccugagccccagccuggacuuccagcuguucagaggcgaccagguguucagcgccugcagaccccugcccgacaugguggacgcccacggccccagcugcgccagcuggcugugcccccugccccuggcccccggcagaagcgcccugcuggccugccugcaggaccuggaccugaaccugugcaccccccagcccgccccccugggcaccgaccugcagggccugcaggaggacgcccugagcaugaagcacgagccccccggccugcaggccagcagcaccgacgacaagaaguucaccgugaaguacccccagaacaaggacaagcugggcaagcagcccgagagagccggcgagggcgcccccugccccgccuucagcagccacaacagcagcagcccccccccccugcagaacagaaagagccccagcccccuggccuucugccccugcccccccgugaacagcaucagcaaggagcugcccuuccugcugcacgccuucuaccccggcuacccccugcugcugccccccccccaccuguucaccuacggcgcccugcccagcgaccagugcccccaccugcugaugcugccccaggaccccagcuaccccaccauggccaugcccagccugcugaugauggugaacgagcugggccaccccagcgccagaugggagacccugcugcccuaccccggcgccuuccaggccagcggccaggcccugcccagccaggccagaaaccccggcgccggcgccgcccccaccgacagccccggccuggagagaggcggcauggccagccccgccaagagagugccccugagcagccagaccggcaccgccgcccugcccuacccccugaagaagaagaacggcaagauccuguacgagugcaacaucugcggcaagagcuucggccagcugagcaaccugaaggugcaccugagagugcacagcggcgagagacccuuccagugcgcccugugccagaagagcuucacccagcuggcccaccugcagaagcaccaccuggugcacaccggcgagagaccccacaagugcagcauccccugggugcccggcagaaaccacuggaagagcuuccaggccuggagagagagagaggugugccacaagagauucagcagcagcagcaaccugaagacccaccugagacugcacagcggcgccagacccuuccagugcagcgugugcagaagcagauucacccagcacauccaccugaagcugcaccacagacugcacgccccccagcccugcggccuggugcacacccagcugccccuggccagccuggccugccuggcccaguggcaccagggcgcccuggaccugauggccguggccagcgagaagcacaugggcuacgacaucgacgaggugaaggugagcagcaccagccagggcaaggccagagccgugagccugagcagcgccggcaccccccuggugaugggccaggaccagaacaacuaa

SEQ ID NO: 26052 - RNA, 3714 nt, Artificial Sequence
  ZNF687__Homo_sapiens__NP_001291693
augggcgacaugaagacccccgacuucgacgaccugcuggccgccuucgacauccccgacaucgacgccaacgaggccauccacagcggccccgaggagaacgagggccccggcggccccggcaagcccgagcccggcgugggcagcgagagcgaggacaccgccgccgccagcgccggcgacggccccggcgugcccgcccaggccagcgaccacggccugcccccccccgacaucagcguggugagcgugaucgugaagaacaccgugugccccgagcagagcgaggcccuggccggcggcagcgccggcgacggcgcccaggccgccggcgugaccaaggagggccccgugggcccccacagaaugcagaacggcuucggcagccccgagcccagccugcccggcaccccccacagccccgccccccccagcggcggcaccuggaaggagaagggcauggagggcaagaccccccuggaccuguucgcccacuucggccccgagcccggcgaccacagcgacccccugccccccagcgcccccagccccaccagagagggcgcccugacccccccccccuuccccagcagcuucgagcuggcccaggagaacggccccggcaugcagccccccgugagcagccccccccugggcgcccugaagcaggagagcugcagcccccaccacccccaggugcuggcccagcagggcagcggcagcagccccaaggccaccgacauccccgccagcgccagccccccccccguggccggcgugcccuucuucaagcagagccccggccaccagagcccccuggccagccccaaggugcccgugugccagccccugaaggaggaggacgacgacgagggccccguggacaagagcagccccggcagcccccagagccccagcagcggcgccgaggccgccgacgaggacagcaacgacagccccgccagcagcagcagcagaccccugaaggugagaaucaagaccaucaagaccagcugcggcaacaucaccagaaccgugacccaggugcccagcgaccccgacccccccgccccccuggccgagggcgccuuccuggccgaggccagccugcugaagcugagccccgccacccccaccagcgagggccccaagguggugagcgugcagcugggcgacggcaccagacugaagggcaccgugcugcccguggccaccauccagaacgccagcaccgccaugcugauggccgccagcguggccagaaaggccguggugcugcccggcggcaccgccaccagccccaagaugaucgccaagaacgugcugggccuggugccccaggcccugcccaaggccgacggcagagccggccugggcaccggcggccagaaggugaacggcgccagcguggugauggugcagcccagcaagaccgccaccggccccagcaccggcggcggcaccgugaucagcagaacccagagcagccugguggaggccuucaacaagauccugaacagcaagaaccugcugcccgccuacagacccaaccugagcccccccgccgaggccggccuggcccugccccccaccggcuacagaugccuggagugcggcgacgccuucagccuggagaagagccuggccagacacuacgacagaagaagcaugagaaucgaggugaccugcaaccacugcgccagaagacugguguucuucaacaagugcagccugcugcugcacgccagagagcacaaggacaagggccuggugaugcagugcagccaccuggugaugagacccguggcccuggaccagauggugggccagcccgacaucaccccccugcugcccguggccgugccccccgugagcggcccccuggcccugcccgcccugggcaagggcgagggcgccaucaccagcagcgccaucaccaccguggccgccgaggcccccgugcugccccugagcaccgagccccccgccgcccccgccaccagcgccuacaccugcuucagaugccuggagugcaaggagcagugcagagacaaggccggcauggccgcccacuuccagcagcugggcccccccgcccccggcgccaccagcaacgugugccccaccugccccaugaugcugcccaacagaugcagcuucagcgcccaccagagaaugcacaagaacagacccccccacgugugccccgagugcggcggcaacuuccugcaggccaacuuccagacccaccugagagaggccugccugcacgugagcagaagagugggcuacagaugccccagcugcagcgugguguucggcggcgugaacagcaucaagagccacauccagaccagccacugcgagguguuccacaagugccccaucugccccauggccuucaagagcggccccagcgcccacgcccaccuguacagccagcaccccagcuuccagacccagcaggccaagcugaucuacaagugcgccaugugcgacaccguguucacccacaagccccugcugagcagccacuucgaccagcaccugcugccccagagagugagcguguucaagugccccagcugcccccugcuguucgcccagaagagaaccaugcuggagcaccugaagaacacccaccagagcggcagacuggaggagaccgccggcaagggcgccggcggcgcccugcugacccccaagaccgagcccgaggagcuggccgugagccagggcggcgccgcccccgccaccgaggagagcagcagcagcagcgaggaggaggaggugcccagcagccccgagccccccagacccgccaagagacccagaagagagcugggcagcaagggccugaagggcggcggcggcggccccggcggcuggaccugcggccugugccacagcugguuccccgagagagacgaguacguggcccacaugaagaaggagcacggcaagagcgugaagaaguuccccugcagacugugcgagagaagcuucugcagcgcccccagccugagaagacacgugagagugaaccacgagggcaucaagagaguguaccccugcagauacugcaccgagggcaagagaaccuucagcagcagacugauccuggagaagcacgugcaggugagacacggccugcagcugggcgcccagagccccggcagaggcaccacccuggccagaggcagcagcgccagagcccagggccccggcagaaagagaagacagagcagcgacagcugcagcgaggagcccgacagcaccaccccccccgccaagagccccagaggcggccccggcagcggcggccacggcccccugagauacagaagcagcagcagcaccgagcagagccugaugaugggccugagaguggaggacggcgcccagcagugccuggacugcggccugugcuucgccagccccggcagccugagcagacacagauucaucagccacaagaagagaagaggcgugggcaaggccagcgcccugggccugggcgacggcgaggaggaggccccccccagcagaagcgaccccgacggcggcgacagcccccugcccgccagcggcggcccccugaccugcaaggugugcggcaagagcugcgacagcccccugaaccugaagacccacuucagaacccacggcauggccuucaucagagccagacagggcgccgugggcgacaacuaa

SEQ ID NO: 26053 - RNA, 1503 nt, Artificial Sequence
  ZNF689__Homo_sapiens__NP_612456
auggccccccccagcgccccccugcccgcccagggccccggcaaggccagacccagcagaaagagaggcagaagacccagagcccugaaguucguggacguggccguguacuucagccccgaggaguggggcugccugagacccgcccagagagcccuguacagagacgugaugagagagaccuacggccaccugggcgcccugggcugcgccggccccaagcccgcccugaucagcuggcuggagagaaacaccgacgacugggagcccgccgcccuggacccccaggaguaccccagaggccugaccgugcagagaaagagcagaaccagaaagaagaacggcgagaaggagguguucccccccaaggaggcccccagaaagggcaagagaggcagaagacccagcaagcccagacugauccccagacagaccagcggcggccccaucugccccgacugcggcugcaccuuccccgaccaccaggcccuggagagccacaagugcgcccagaaccugaagaagcccuaccccugccccgacugcggcagaagauucagcuaccccagccugcuggugagccacagaagagcccacagcggcgagugccccuacgugugcgaccagugcggcaagagauucagccagagaaagaaccugagccagcaccaggugauccacaccggcgagaagcccuaccacugccccgacugcggcagaugcuucagaagaagcagaagccuggccaaccacagaaccacccacaccggcgagaagccccaccagugccccagcugcggcagaagauucgccuaccccagccugcuggccauccaccagagaacccacaccggcgagaagcccuacaccugccuggagugcaacagaagauucagacagagaaccgcccuggugauccaccagagaauccacaccggcgagaagcccuaccccugccccgacugcgagagaagauucagcagcagcagcagacuggugagccacagaagagugcacagcggcgagagacccuacgccugcgagcacugcgaggccagauucagccagagaagcacccugcugcagcaccagcugcugcacaccggcgagaagcccuaccccugccccgacugcggcagagccuucagaagaagcggcagccuggccauccacagaagcacccacaccgaggagaagcugcacgccugcgacgacugcggcagaagauucgccuaccccagccugcuggccagccacagaagagugcacagcggcgagagacccuacgccugcgaccugugcagcaagagauucgcccaguggagccaccuggcccagcaccagcugcugcacaccggcgagaagcccuuccccugccuggagugcggcagaugcuucagacagagauggagccuggccgugcacaagugcagccccaaggcccccaacugcagccccagaagcgccaucggcggcagcagccagagaggcaacgcccacuaa

SEQ ID NO: 26054 - RNA, 1773 nt, Artificial Sequence
  ZNF703__Homo_sapiens__NP_079345
augagcgacagccccgccggcagcaaccccagaacccccgagagcagcggcagcggcagcggcggcggcggcaagagacccgccgugcccgccgccgugagccugcugccccccgccgacccccugagacaggccaacagacugcccaucagagugcugaagaugcugagcgcccacaccggccaccugcugcaccccgaguaccugcagccccugagcagcacccccgugagccccaucgagcuggacgccaagaagagcccccuggcccugcuggcccagaccugcagccagaucggcaagcccgaccccccccccagcagcaagcugaacagcguggccgccgccgccaacggccugggcgccgagaaggaccccggcagaagcgcccccggcgccgccagcgccgccgccgcccugaagcagcugggcgacagccccgccgaggacaagagcagcuucaagcccuacagcaagggcagcggcggcggcgacagcagaaaggacagcggcagcagcagcgugagcagcaccagcagcagcagcagcagcagccccggcgacaaggccggcuucagagugcccagcgccgccugcccccccuuccccccccacggcgcccccgugagcgccagcagcagcagcagcagccccggcggcagcagaggcggcagcccccaccacagcgacugcaagaacggcggcggcgugggcggcggcgagcuggacaagaaggaccaggagcccaagcccagccccgagcccgccgccgugagcagaggcggcggcggcgagcccggcgcccacggcggcgccgagagcggcgccagcggcagaaagagcgagccccccagcgcccuggugggcgccggccacguggcccccgugagccccuacaagcccggccacagcguguucccccugccccccagcagcaucggcuaccacggcagcaucgugggcgccuacgccggcuaccccagccaguucgugcccggccuggaccccagcaagagcggccuggugggcggccagcugagcggcggccugggccugccccccggcaagccccccagcagcagcccccugaccggcgccagcccccccagcuuccugcagggccugugcagagaccccuacugccugggcggcuaccacggcgccagccaccugggcggcagcagcugcagcaccugcagcgcccacgaccccgccggccccagccugaaggccggcggcuacccccugguguaccccggccacccccugcagcccgccgcccugagcagcagcgccgcccaggccgcccugcccggccacccccuguacaccuacggcuucaugcugcagaacgagccccugccccacagcugcaacuggguggccgccagcggccccugcgacaagagauucgccaccagcgaggagcugcugagccaccugagaacccacaccgcccugcccggcgccgagaagcugcuggccgccuaccccggcgccagcggccugggcagcgccgccgccgccgccgccgccgccgccagcugccaccugcaccugcccccccccgccgcccccggcagccccggcagccugagccugagaaacccccacacccugggccugagcagauaccaccccuacggcaagagccaccugagcaccgccggcggccuggccgugcccagccugcccaccgccggccccuacuacagccccuacgcccuguacggccagagacuggccagcgccagcgcccugggcuaccaguaa

SEQ ID NO: 26055 - RNA, 1239 nt, Artificial Sequence
  ZNF704__Homo_sapiens__NP_001028895
augaccuucaccuuccagagcgaggaccugaagagagacugcggcaagaagaugagccaccagcacguguucagccuggccauggaggaggacgugaagaccgccgacaccaagaaggccagcagaauccuggaccacgagaaggagaacaccagaagcaucugccugcuggagcagaagagaaagguggugagcagcaacaucgacgugccccccgccagaaagagcagcgaggagcuggacauggacaaggugaccgccgccauggugcugaccagccugagcaccagcccccuggugagaagcccccccgugagacccaacgagagccugagcggcagcuggaaggagggcggcugcgugcccagcagcaccagcagcagcggcuacuggagcuggagcgcccccagcgaccagagcaaccccagcacccccagccccccccugagcgccgacagcuucaagcccuucagaagccccgcccagcccgacgacggcaucgacgaggccgaggccagcaaccugcuguucgacgagcccauccccagaaagagaaagaacagcaugaaggugauguucaagugccuguggaagaacugcggcaaggugcugagcaccgccgccggcauccagaagcacaucagaaccauccaccugggcagagugggcgacagcgacuacagcgacggcgaggaggacuucuacuacaccgagaucaagcugaacaccgacagcguggccgacggccugagcagccuggcccccgugagccccagccagagccuggccagcccccccaccuuccccauccccgacagcagcagaaccgagacccccugcgccaagaccgagaccaagcugaugaccccccugagcagaagcgcccccaccacccuguaccuggugcacaccgaccacgccuaccaggccaccccccccgugaccauccccggcagcgccaaguucacccccaacggcagcagcuucagcaucagcuggcagagcccccccgugaccuucaccggcauccccgugagccccacccaccaccccgugggcaccggcgagcagagacagcacgcccacaccgugcugagcagcccccccagaggcaccgugagccugagaaagcccagaggcgagggcaagaagugcagaaagguguacggcauggagaacagagacauguggugcaccgccugcagauggaagaaggccugccagagauuccuggacuaa

SEQ ID NO: 26056 - RNA, 231 nt, Artificial Sequence
  ZNF706__Homo_sapiens__NP_001254638
auggccagaggccagcagaagauccagagccagcagaagaacgccaagaagcaggccggccagaagaagaagcagggccacgaccagaaggccgccgccaaggccgcccugaucuacaccugcaccgugugcagaacccagaugcccgaccccaagaccuucaagcagcacuucgagagcaagcaccccaagaccccccugccccccgagcuggccgacgugcaggccuaa

SEQ ID NO: 26057 - RNA, 2286 nt, Artificial Sequence
  ZNF711__Homo_sapiens__NP_068838
auggacagcggcggcggcagccugggccugcacacccccgacagcagaauggcccacaccaugaucaugcaggacuucguggccggcauggccggcaccgcccacaucgacggcgaccacaucguggugagcgugcccgaggccgugcuggugagcgacguggugaccgacgacggcaucacccuggaccacggccuggccgccgagguggugcacggccccgacaucaucaccgagaccgacguggugaccgagggcgugaucgugcccgaggccgugcuggaggccgacguggccaucgaggaggaccuggaggaggacgacggcgaccacauccugaccagcgagcugaucaccgagaccgugagagugcccgagcagguguucguggccgaccuggugaccggccccaacggccaccuggagcacguggugcaggacugcgugagcggcguggacagccccaccauggugagcgaggaggugcuggugaccaacagcgacaccgagaccgugauccaggccgccggcggcgugcccggcagcaccgugaccaucaagaccgaggacgacgacgacgacgacgugaagagcaccagcgaggacuaccugaugaucagccuggacgacgugggcgagaagcuggagcacaugggcaacaccccccugaagaucggcagcgacggcagccaggaggacgccaaggaggacggcuucggcagcgaggugaucaagguguacaucuucaaggccgaggccgaggacgacguggagaucggcggcaccgagaucgugaccgagagcgaguacaccagcggccacagcguggccggcgugcuggaccagagcagaaugcagagagagaagaugguguacauggccgugaaggacagcagccaggaggaggacgacaucagagacgagagaagagugagcagaagauacgaggacugccaggccagcggcaacacccuggacagcgcccuggagagcagaagcagcaccgccgcccaguaccugcagaucugcgacggcaucaacaccaacaaggugcugaagcagaaggccaagaagagaagaagaggcgagaccagacaguggcagaccgccgugaucaucggccccgacggccagccccugaccguguaccccugccacaucugcaccaagaaguucaagagcagaggcuuccugaagagacacaugaagaaccaccccgaccaccugaugagaaagaaguaccagugcaccgacugcgacuucaccaccaacaagaaggugagcuuccacaaccaccuggagagccacaagcugaucaacaagguggacaagacccacgaguucaccgaguacaccagaagauacagagaggccagcccccugagcagcaacaagcugauccugagagacaaggagcccaagaugcacaagugcaaguacugcgacuacgagaccgccgagcagggccugcugaacagacaccugcuggccgugcacagcaagaacuucccccacgugugcguggagugcggcaagggcuucagacaccccagcgagcugaagaagcacaugagaacccacaccggcgagaagcccuaccagugccaguacugcaucuucagaugcgccgaccagagcaaccugaagacccacaucaagagcaagcacggcaacaaccugcccuacaagugcgagcacugcccccaggccuucggcgacgagagagagcugcagagacaccuggaccuguuccagggccacaagacccaccagugcccccacugcgaccacaagagcaccaacagcagcgaccugaagagacacaucaucagcgugcacaccaaggacuucccccacaagugcgaggugugcgacaagggcuuccacagacccagcgagcugaagaagcacagcgacauccacaagggcagaaagauccaccagugcagacacugcgacuucaagaccagcgaccccuucauccugagcggccacauccugagcgugcacaccaaggaccagccccugaagugcaagagaugcaagagaggcuucagacagcagaacgagcugaagaagcacaugaagacccacaccggcagaaagaucuaccagugcgaguacugcgaguacagcaccaccgacgccagcggcuucaagagacacgugaucagcauccacaccaaggacuacccccacagaugcgaguucugcaagaagggcuucagaagacccagcgagaagaaccagcacaucaugagacaccacaaggaggcccugauguaa

SEQ ID NO: 26058 - RNA, 1488 nt, Artificial Sequence
  ZNF716__Homo_sapiens__NP_001152751
auggccaagagacccggcccccccggcagcagagagaugggccugcugaccuucagagacaucgccaucgaguucagccuggccgaguggcagugccuggaccacgcccagcagaaccuguacagagacgugaugcuggagaacuacagaaaccuggugagccugggcaucgccgugagcaagcccgaccugaucaccugccuggagcagaacaaggagccccagaacaucaagagaaacgagaugguggccaagcaccccgugaccugcagccacuucacccaggaccugcagagcgagcagggcaucaaggacagccugcagaaggugauccugagaagauacggcaagugcggccaggaggaccugcaggugaagaagugcugcaagagcgugggcgagugcgaggugcacaagggcggcuacaacuacgugaaccagugccugagcgccacccagaacaagaccuuccagacccacaagugcgugaagguguucggcaaguucagcaacagcaacagacacaagaccagacacaccggcaagaagcacuucaagugcaagaacgacggcaagagcuucugcaugcugagcagacugaaccagcaccagaucauccacaccagagagaagagcuacaagugcgaggagugcggcaagagcuucaacugcagcagcacccugaccagacacaagagaauccacaccggcgagaagcccuacagaugcgaggagugcggcaaggccuucagcuggagcgccagccugaccaagcacaagagaauccacaccggcgagaagcccuacaccugcgaggagagaggcaagguguucagcagaagcacccugaccaacuacaagagaauccacaccggcgagaagcccuacaccugcgaggagugcggcaaggccuucagcagaagcagcacccugaccaaccacaagagaauccacaccggcgagagacccuacaagugcgaggagugcggcaaggccuucagccugagcagcacccugaagaagcacaagaucgugcacaccggcgagaagcuguacaccugcgaggagugcggcaaggccuucaccuucagcagcacccugaacacccacaagagaauccacaccggcgagaagcccuacaccugcgaggagugcggcaaggccuucagccugcccagcaccuucaccuaccacaagagaacccacaccggcgagaagcccuacaagugcgaggagugcggcaaggccuucaacugcagcagcacccugaagaagcacaagaucauccacaccggcgagaagcuguacaagugcaaggagugcggcaaggccuucaccuucagcagcacccugaacacccacaagagaauccacaccggcgagaagcccuacaagugcgaggagugcgaccagaccuucaaguggcacagcagccuggccaaccacaagaacaugcacaccggcgagaagcccuacaaguacgaguaa

SEQ ID NO: 26059 - RNA, 2745 nt, Artificial Sequence
  ZNF717__Homo_sapiens__NP_001277137
auguuccccguguucagcggcugcuuccaggagcugcaggagaagaacaagagccuggagcuggugagcuucgaggagguggccgugcacuucaccugggaggaguggcaggaccuggacgacgcccagagaacccuguacagagacgugaugcuggagaccuacagcagccuggugagccugggccacuacaucaccaagcccgagaugaucuucaagcuggagcagggcgccgagcccuggaucguggaggagacccccaaccugagacugagcgccgugcagaucaucgacgaccugaucgagagaagccacgagagccacgacagauucuucuggcagaucgugaucaccaacagcaacaccagcacccaggagagaguggagcugggcaagaccuucaaccugaacagcaaccacgugcugaaccugaucaucaacaacggcaacagcagcggcaugaagcccggccaguucaacgacugccagaacaugcuguuccccaucaagcccggcgagacccagagcggcgagaagccccacgugugcgacaucaccagaagaagccacagacaccacgagcaccugacccagcaccacaagauccagacccugcugcagaccuuccagugcaacgagcagggcaagaccuucaacaccgaggccauguucuucauccacaagagagugcacaucgugcagaccuucggcaaguacaacgaguacgagaaggccugcaacaacagcgccgugaucgugcaggugaucacccaggugggccagcccaccugcugcagaaagagcgacuucaccaagcaccagcagacccacaccggcgagaagcccuacgagugcguggagugcgagaagcccagcaucagcaagagcgaccugaugcugcagugcaagaugcccaccgaggagaagcccuacgccugcaacuggugcgagaagcuguucagcuacaagagcagccugaucauccaccagagaauccacaccggcgagaagcccuacggcugcaacgagugcggcaagaccuucagaagaaagagcuuccugacccugcacgagagaacccacaccggcgacaagcccuacaagugcaucgagugcggcaagaccuuccacugcaagagccugcugacccugcaccacagaacccacagcggcgagaagcccuaccagugcagcgagugcggcaagaccuucagccagaagagcuaccugaccauccaccacagaacccacaccggcgagaagcccuacgccugcgaccacugcgaggaggccuucagccacaagagcagacugaccgugcaccagagaacccacaccggcgagaagcccuacgagugcaacgagugcggcaagcccuucaucaacaagagcaaccugagacugcaccagagaacccacaccggcgagaagcccuacgagugcaacgagugcggcaagaccuuccacagaaagagcuuccugaccauccaccaguggacccacaccggcgagaagcccuacgagugcaacgagugcggcaagaccuucagaugcaagagcuuccugaccgugcaccagagaacccacgccggcgagaagcccuacgccugcaacgagugcggcaagaccuacagccacaagagcuaccugaccgugcaccacagaacccacaccggcgagaagcccuacgagugcaacgagugcggcaagagcuuccacugcaagagcuuccugaccauccaccagagaacccacgccggcaagaagcccuacgagugcaacgagugcgagaagaccuucaucaacaagcugaaccugggcauccacaagagaacccacaccggcgagagacccuacgagugcaacgagugcggcaagaccuucagacagaagagcaaccugagcacccaccagggcacccacaccggcgagaagcccuacgugugcaacgagugcggcaagaccuuccacagaaagagcuuccugaccauccaccagagaacccacaccggcaagaacagaauggacgugaugaacguggagaagcuguucgugagaaaccacacccugcuguacaucagagagcugacccccggcaagagccccaugaacgugaugaacguggagaaccccuucaucagaagacagaucuucagaagcaucaagguguucaccagaggcagaaaccccaugaacguggccaacguggagaagcccugccagaagagcgugcugaccgugcaccacagaacccacaccggcgagaagcccuacgagugcaacgagugcggcaagaccuucugccacaagagcaaccugagcacccaccagggcacccacagcggcgagaagcccuacgagugcgacgagugcagaaagaccuucuacgacaagaccgugcugaccauccaccagagaacccacaccggcgagaagcccuucgagugcaaggagugcagaaagaccuucagccagaagagcaagcuguucgugcaccacagaacccacaccggcgagaagcccuucagaugcaacgagugcagaaagaccuucagccagaagagcggccugagcauccaccagagaacccacaccggcgagaagcccuacgagugcaaggagugcggcaagaccuucugccagaagagccaccugagcagacaccagcagacccacaucggcgagaagagcgacguggccgaggccggcuacguguucccccagaaccacagcuucuuccccuaa

SEQ ID NO: 26060 - RNA, 1938 nt, Artificial Sequence
  ZNF746__Homo_sapiens__NP_001156946
auggccgaggccguggccgcccccaucagccccuggaccauggccgccaccauccaggccauggagagaaagaucgagagccaggccgccagacugcugagccuggagggcagaaccggcauggccgagaagaagcuggccgacugcgagaagaccgccguggaguucggcaaccagcuggagggcaagugggccgugcugggcacccugcugcaggaguacggccugcugcagagaagacuggagaacguggagaaccugcugagaaacagaaacuucuggauccugagacugccccccggcagcaagggcgagagccccaaggaguggggcaagcuggaggacuggcagaaggagcuguacaagcacgugaugagaggcaacuacgagacccuggugagccuggacuacgccaucagcaagcccgaggugcugagccagaucgagcagggcaaggagcccugcaacuggagaagacccggccccaagauccccgacgugcccguggaccccagccccggcagcggcccccccgugcccgcccccgaccugcugaugcagaucaagcaggagggcgagcugcagcugcaggagcagcaggcccugggcguggaggccugggccgccggccagcccgacaucggcgaggagcccuggggccugagccagcuggacagcggcgccggcgacaucagcaccgacgccaccagcggcgugcacagcaacuucagcaccaccaucccccccaccagcuggcagaccgaccugcccccccaccaccccagcagcgccugcagcgacggcacccugaagcugaacaccgccgccagcaccgaggccgacgugaagaucgugaucaagaccgaggugcaggaggaggaggugguggccacccccgugcaccccaccgaccuggaggcccacggcacccuguucggccccggccaggccaccagauucuuccccagccccgcccaggagggcgccugggagagccagggcagcagcuuccccagccaggaccccgugcugggccugagagagcccgccagacccgagagagacaugggcgagcugagccccgccguggcccaggaggagaccccccccggcgacuggcuguucggcggcgugagauggggcuggaacuucagaugcaagccccccgugggccugaaccccagaaccggccccgagggccugcccuacagcagccccgacaacggcgaggccauccuggaccccagccaggcccccagacccuucaacgagcccugcaaguaccccggcagaaccaagggcuucggccacaagcccggccugaagaagcaccccgccgccccccccggcggcagacccuucaccugcgccaccugcggcaagagcuuccagcugcaggugagccugagcgcccaccagagaagcugcggcgcccccgacggcagcggccccggcaccggcggcggcggcagcggcagcggcggcggcggcggcggcagcggcggcggcagcgccagagacggcagcgcccugagaugcggcgagugcggcagaugcuucaccagacccgcccaccugaucagacacagaaugcugcacaccggcgagagacccuuccccugcaccgagugcgagaagagauucaccgagagaagcaagcugaucgaccacuacagaacccacaccggcgugagacccuucaccugcaccgugugcggcaagagcuucaucagaaaggaccaccugagaaagcaccagagaaaccacgccgccggcgccaagacccccgccagaggccagccccugcccaccccccccgccccccccgaccccuucaagagccccgccagcaagggcccccuggccagcaccgaccuggugaccgacuggaccugcggccugagcgugcugggccccaccgacggcggcgacauguaa

SEQ ID NO: 26061 - RNA, 1935 nt, Artificial Sequence
  ZNF74__Homo_sapiens__NP_001243453
auggagauccccgcccccgagcccgagaagaccgcccugagcagccaggaccccgcccugagccugaaggagaaccuggaggacaucagcggcuggggccugcccgaggccagaagcaaggagagcgugagcuucaaggacguggccguggacuucacccaggaggaguggggccagcuggacagcccccagagagcccuguacagagacgugaugcuggagaacuaccagaaccugcuggcccugggccccccccugcacaagcccgacgugaucagccaccuggagagaggcgaggagcccuggagcaugcagagagaggugcccagaggccccugccccgagugggagcugaaggccgugcccagccagcagcagggcaucugcaaggaggagcccgcccaggagcccaucauggagagaccccugggcggcgcccaggccuggggcagacaggccggcgcccugcagagaagccaggccgcccccugggcccccgcccccgccauggugugggacgugcccguggaggaguucccccugagaugcccccuguucgcccagcagagagugcccgagggcggcccccugcuggacaccagaaagaacgugcaggccaccgagggcagaaccaaggcccccgccagacugugcgccggcgagaacgccagcacccccagcgagcccgagaaguucccccaggugagaagacagagaggcgccggcgccggcgagggcgaguucgugugcggcgagugcggcaaggccuucagacagagcagcagccugacccugcacagaagauggcacagcagagagaaggccuacaagugcgacgagugcggcaaggccuucaccuggagcaccaaccugcuggagcacagaagaauccacaccggcgagaagcccuucuucugcggcgagugcggcaaggccuucagcugccacagcagccugaacgugcaccagagaauccacaccggcgagagacccuacaagugcagcgccugcgagaaggccuucagcugcagcagccugcugagcaugcaccugagagugcacaccggcgagaagcccuacagaugcggcgagugcggcaaggccuucaaccagagaacccaccugaccagacaccacagaauccacaccggcgagaagcccuaccagugcggcagcugcggcaaggccuucaccugccacagcagccugaccgugcacgagaagauccacagcggcgacaagcccuucaagugcagcgacugcgagaaggccuucaacagcagaagcagacugacccugcaccagagaacccacaccggcgagaagcccuucaagugcgccgacugcggcaagggcuucagcugccacgccuaccugcuggugcacagaagaauccacagcggcgagaagcccuucaagugcaacgagugcggcaaggccuucagcagccacgccuaccugaucgugcacagaagaauccacaccggcgagaagcccuucgacugcagccagugcuggaaggccuucagcugccacagcagccugaucgugcaccagagaauccacaccggcgagaagcccuacaagugcagcgagugcggcagagccuucagccagaaccacugccugaucaagcaccagaagauccacagcggcgagaagagcuucaagugcgagaagugcggcgagauguucaacuggagcagccaccugaccgagcaccagagacugcacagcgagggcaagccccuggccauccaguucaacaagcaccugcugagcaccuacuacgugcccggcagccugcugggcgccggcgacgccggccugagagacguggaccccaucgacgcccuggacguggccaagcugcugugcguggugccccccagagccggcagaaacuucagccugggcagcaagcccagaaacuaa

SEQ ID NO: 26062 - RNA, 2172 nt, Artificial Sequence
  ZNF750__Homo_sapiens__NP_078978
augagccugcugaaggagagaaagcccaagaagccccacuacauccccagaccccccggcaagcccuucaaguacaagugcuuccagugccccuucaccugcaacgagaagagccaccuguucaaccacaugaaguacggccugugcaagaacagcaucacccuggugagcgagcaggacagagugcccaagugccccaagagcaacagccuggaccccaagcagaccaaccagcccgacgccaccgccaagcccgccagcagcaagagcguggccaacggccugagcgccuucgacagcaagcugcagcacagcagcgccagagaggacaucaaggagaaccuggagcugcaggccagaggcacccacagaugccugggccagaagcccgcccugcacagagccagccccugcaagagccccgcccccgaggccgcccugggcgcccagcccgcccuggagggcgccgccagacccagcgccuucgugcccgugggcgagcacagacugaagggccccgacaacgccgaggcccccgagacccuggcccugcacaaccccaccgccaaggccgugagcuuccacaccaagagcgccuuccacacccccggcuaccccuggaaggccggcagccccuuccugccccccgaguucccccacaagaucagcagcaccaagggccugggcgccaucagccccuacaugcaccccaccauccccgaguaccccccccacuucuacaccgagcacggccuggccaccaucuacagccccuaccugcuggccggcagcagccccgagugcgacgccccccugcugagcguguacggcacccaggaccccagacacuuccugccccaccccggccccauccccaagcaccuggcccccagccccgccaccuacgaccacuacagauucuuccagcaguaccccagcaaccugcccauccccuacggcuucuacagacccgagagcgccuucagcagcuacggccugagacugccccccgugaccggccugaccagagaccagagcagccaccugcuggaggaggccacccugguguaccccgccagcagccccagcagacugaaccccagcgaccccaacagaaagcacguggaguucgagagccccauccccgaggccaaggacagcagcaaggccggccagagagacaccgagggcagcaagaugagccccagagccggcagcgccgccaccggcagccccggcagacccagccccaccgacuucaugcagaccagccagaccugcgagggccuguacgaccugagcaacaaggccgccagcagcgcccugggcagacuguacccccccgagcagagccugaccgccuucagacccgugaagaagagcaccgagugccugcccgcccaggccgccgagaccaccgccgagagccccgugagccugaacguggugaacggcgacccccccgcccccaccggcagcgccagccuggugagcgaggccgcccccagcagccccgacgacagcagcggcaugggcccccugaaccugagcaagaagagcgagaucaaccuggccgccacccacgagcccaccuaccagggcagcccccaggccgagaccgccagcuucagcgagcugcaggaccugccccugaaccugagcgugaaggaccccugcaacacccaggcccccagacccgccuuccccggcagacccagagccgccgagcccgccgccgccgugccccagaagaccggcaccgagggcagcgaggacggccccagccaccccgagaccaagcccggcagccuggacggcgacggcgccccccccaccggccccggcgaggaggcccccgacgccugcgccguggacagcagcgaggagcagaagcagaccgccgccguggcccugugccagcuggccgccuacagccccagaaacaucagagugggcgacggcgacgccgccgcccccgagcccgccugcagacaggacacccccacccugagcagcauggagagccaggaggcccagugcgaccugagacccaagggccagaagagaaccagccugagagacgccggcaagagccagcagggcgccaagaaggccaagcugcaggacaccgccagaguguucacccugagaagaagagccagagugagcuaa

SEQ ID NO: 26063 - RNA, 1194 nt, Artificial Sequence
  ZNF763__Homo_sapiens__NP_001012771
augauguuccaggaccccguggccugcgaggacguggccgugaacuucacccaggaggagugggcccugcuggacaucagccagagaaagcuguacagagaggugaugcuggagaccuucagaaaccugaccagcaucggcaagaaguggaaggaccagaacaucgaguacgaguaccagaaccccagaagaaacuucagaagccugaucgagggcaacgugaacgagaucaaggaggacagccacugcggcgagaccuucacccaggugcccgacgacagacugaacuuccaggagaagaaggccagccccgaggccaagagcugcgacaacuucgugugcggcgaggugggcaucggcaacagcagcuucaacaugaacaucagaggcgacaucggccacaaggccuacgaguaccaggacuacgcccccaagcccuacaagugccagcagcccaagaaggccuucagauaccaccccagcuucagaacccaggagagaaaccacaccggcgagaagcccuacgccugcaaggagugcggcaagaccuucaucagccacagcggcaucagaagaagaauggugaugcacagcggcgacggccccuacaagugcaaguucugcggcaaggccgugcacugccugagacuguaccugauccacgagagaacccacaccggcgagaagcccuacgagugcaagcagugcgugaagagcuucagcuacagcgccacccacagaauccacgagagaacccacaccggcgagaagcccuacgagugccagcagugcggcaaggccuuccacagcagcagcagcuuccaggcccacaagagaacccacaccggcggcaagcccuacgagugcaagcagugcggcaagagcuucagcuggugccacagcuuccagauccacgagagaacccacaccggcgagaagcccugcgagugcagcaagugcaacaaggccuucagaagcuacagaagcuaccugagacacaagagaagccacaccggcgagaagcccuaccagugcaaggagugcagaaaggccuucaccuaccccagcagccugagaagacacgagagaacccacagcgccaagaagcccuacgagugcaagcagugcggcaaggcccugagcuacaaguucagcaacacccccaagaacgcccuguggagaaagacccuguaa

SEQ ID NO: 26064 - RNA, 1224 nt, Artificial Sequence
  ZNF764__Homo_sapiens__NP_001166150
auggcccccccccuggccccccugccccccagagaccccaacggcgccggccccgaguggagagagcccggcgccgugagcuucgccgacguggccguguacuucugcagagaggaguggggcugccugagacccgcccagagagcccuguacagagacgugaugagagagaccuacggccaccugagcgcccugggcaucggcggcaacaagcccgcccugaucagcuggguggaggaggaggccgagcuguggggccccgccgcccaggaccccgagguggccaagugccagacccagaccgaccccgacagcagaaacaagaagaaggagagacagagagagggcaccggcgcccuggagaagcccgaccccguggccgccggcagccccggccugaagagcccccaggcccccagcgccggcccccccuacggcugggagcagcugagcaaggccccccacagaggcagacccagccugugcgcccacccccccgugcccagagccgaccagagacacggcugcuacgugugcggcaagagcuucgccuggagaagcacccugguggagcacguguacagccacaccggcgagaagcccuuccacugcaccgacugcggcaagggcuucggccacgccagcagccugagcaagcacagagccauccacagaggcgagagaccccacagaugccuggagugcggcagagccuucacccagagaagcgcccugaccagccaccugagagugcacaccggcgagaagcccuacggcugcgccgacugcggcagaagauucagccagagcagcgcccuguaccagcacagaagagugcacagcggcgagacccccuuccccugccccgacugcggcagagccuucgccuaccccagcgaccugagaagacacgugagaacccacaccggcgagaagcccuaccccugccccgacugcggcagaugcuucagacagagcagcgagauggccgcccacagaagaacccacagcggcgagaagcccuaccccugcccccagugcggcagaagauucggccagaagagcgccguggccaagcaccagugggugcacagacccggcgccggcggccacagaggcagaguggccggcagacugagcgugacccugacccccggccacggcgaccuggacccccccgugggcuuccagcuguaccccgagaucuuccaggagugcggcuaa

SEQ ID NO: 26065 - RNA, 1572 nt, Artificial Sequence
  ZNF765__Homo_sapiens__XP_006723529
auggcccugccccagggccugcugaccuucagagacguggccaucgaguucagccaggaggaguggaagugccuggaccccgcccagagaacccuguacagagacgugaugcuggagaacuacagaaaccuggugagccuggacaucagcagcaagugcaugaugaaggaguucagcagcaccgcccagggcaacagagagguguuccacgccggcaccagccagagacacgagagccaccacaacggcgacuucugcuuccaggacaucgacaaggacauccacgacaucgaguuccaguggcaggaggacgagagaaacggccacgaggcccugaugaccaagaucaagaagcugaccggcagcaccgagagauacgaccagaacuacgccggcaacaagcccgugaaguaccagcugggcuucagcuuccacagccaccugcccgagcugcacaucuuccacaccgaggagaagaucgacaaccagguggugaagagcauccacgacgccagccuggugagcaccgcccagagaaucagcugcagacccgagacccacaucagcaacgacuacggcaacaacuuccugaacagcagccuguucacccagaagcaggaggugcacaugagagagaagagcuuccagugcaacgacagcggcaaggccuacaacugcagcagccugcugagaaagcaccagcugauccaccugggcgagaagcaguacaagugcgacaucugcggcaagguguucaacagcaagagauacguggccagacacagaagaugccacaccggcgagaagcccuacaagugcaacgagugcggcaagaccuucagccagaccuacuaccugaccugccacagaagacugcacaccggcgagaagcccuacaagugcgaggagugcgacaaggccuuccacuucaagagcaagcugcagauccacagaagaauccacaccggcgagaagcccuacaagugcaacgagugcggcaagaccuucagccagaagagcuaccugaccugccacagaagacugcacaccggcgagaagcccuacaagugcaacgagugcggcaagaccuucagcagaaagagccacuucaccugccaccacagagugcacaccggcgagaagcccuacaagugcaacgagugcagcaagaccuucagccacaagagcagccugaccuaccacagaagacugcacaccgaggagaagcccuacaagugcaacgagugcggcaagaccuucaaccagcagcugacccugaacaucugcagacugcacagcggcgagaagcccuacaagugcgaggagugcgacaaggccuacagcuucaagagcaaccuggagauccaccagaagauccacaccgaggagaaccccuacaagugcaacgagugcggcaagaccuucagcagaaccagcagccugaccuaccaccacagacugcacaccggccagaagcccuacaagugcgaggacugcgacgaggccuucagcuucaagagcaaccuggagagacacagaagaaucuacaccggcgagaagcugcacguguaa

SEQ ID NO: 26066 - RNA, 1548 nt, Artificial Sequence
  ZNF76__Homo_sapiens__NP_001278961
auggagagccugggccugcacaccgugacccugagcgacggcaccaccgccuacgugcagcaggccgugaagggcgagaagcugcuggagggccaggugauccagcuggaggacggcaccaccgccuacauccaccaggugaccgugcagaaggaggcccugagcuucgaggacggccagcccgugcagcuggaggacggcagcauggccuacauccacagaacccccagagagggcuacgaccccagcacccuggaggccgugcagcuggaggacggcagcaccgccuacauccaccaccccguggccgugcccagcgagagcaccauccuggccgugcagaccgaggugggccuggaggaccuggccgccgaggacgacgagggcuucagcgccgacgccgugguggcccuggagcaguacgccagcaaggugcugcacgacagccagauccccagaaacggcaagggccagcaggugggcgacagagccuucagaugcggcuacaagggcugcggcagacuguacaccaccgcccaccaccugaaggugcacgagagagcccacaccggcgacagacccuacagaugcgacuuccccagcugcggcaaggccuucgccaccggcuacggccugaagagccacgugagaacccacaccggcgagaagcccuacaagugccccgaggagcugugcagcaaggccuucaagaccagcggcgaccugcagaagcacgugagaacccacaccggcgagagacccuuccagugccccuucgagggcugcggcagaagcuucaccaccagcaacaucagaaaggugcacgugagaacccacaccggcgagagacccuacaccugccccgagccccacugcggcagaggcuucaccagcgccaccaacuacaagaaccacgugagaauccacaccggcgagaagcccuacgugugcaccgugcccggcugcggcaagagauucaccgaguacagcagccuguacaagcaccacguggugcacacccacugcaagcccuacaccugcagcaccugcggcaagaccuacagacagaccagcacccuggccaugcacaagagaagcgcccacggcgagcuggaggccaccgaggagagcgagcaggcccuguacgagcagcagcagcuggaggccgccagcgccgccgaggagagccccccccccaagagacccagaaucgccuaccugagcgaggugaaggaggagagagacgacauccccgcccagguggccauggugaccgaggaggacggcgccccccagguggcccugaucacccaggacggcgcccagcaggugaccaucaucaccagcggcgccgugguggccgaggacagcagcguggccagccugagacaccagcagguggcccugcuggccaccgccaacggcacccacaucgccgugcagcuggaggagcagcagacccuggaggaggccaucaacguggccaccgccgccaugcagcagggcgccgugacccuggagaccaccgugagcgagagcggcugcuaa

SEQ ID NO: 26067 - RNA, 1452 nt, Artificial Sequence
  ZNF774__Homo_sapiens__NP_001004309
auguggcugggcaccagcggcaagagcggccugcccggccacugccuggagaacccccugcaggagugccaccccgcccagcuggaggagugggcccugaagggcaucagcagacccagcgugaucagccagcccgagcagaaggaggagcccugggugcugccccugcagaacuucgaggccagaaagauccccagagagagccacaccgacugcgagcaccagguggccaagcugaaccaggacaacagcgagaccgccgagcagugcggcaccagcagcgagagaaccaacaaggaccugagccacacccugagcuggggcggcaacugggagcagggccuggagcuggagggccagcacggcacccugcccggcgagggccagcuggagagcuucagccaggagagagaccugaacaagcugcuggacggcuacgugggcgagaagcccaugugcgccgagugcggcaagagcuucaaccagagcagcuaccugaucagacaccugagaacccacaccggcgagagacccuacaccugcaucgagugcggcaagggcuucaagcagagcagcgaccuggugacccacagaagaacccacaccggcgagaagcccuaccagugcaagggcugcgagaagaaguucagcgacagcagcacccugaucaagcaccagagaacccacaccggcgagagacccuacgagugccccgagugcggcaagaccuucggcagaaagccccaccugaucaugcaccagagaacccacaccggcgagaagcccuacgccugccuggagugccacaagagcuucagcagaagcagcaacuucaucacccaccagagaacccacaccggcgugaagcccuacagaugcaacgacugcggcgagagcuucagccagagcagcgaccugaucaagcaccagagaacccacaccggcgagagacccuucaagugccccgagugcggcaagggcuucagagacagcagccacuucguggcccacaugagcacccacagcggcgagagacccuucagcugccccgacugccacaagagcuucagccagagcagccaccuggugacccaccagagaacccacaccggcgagagacccuucaagugcgagaacugcggcaagggcuucgccgacagcagcgcccugaucaagcaccagagaauccacaccggcgagagacccuacaagugcggcgagugcggcaagagcuucaaccagagcagccacuucaucacccaccagagaauccaccugggcgacagacccuacagaugccccgagugcggcaagaccuucaaccagagaagccacuuccugacccaccagagaacccacaccggcgagaagcccuuccacugcagcaagugcaacaagagcuucagacagaaggcccaccugcugugccaccagaacacccaccugaucuaa

SEQ ID NO: 26068 - RNA, 1557 nt, Artificial Sequence
  ZNF776__Homo_sapiens__NP_775903
auggccgccgccgcccugagaccccccgcccagggcaccgugaccuucgaggacguggccgugaacuucagccaggaggaguggagccugcugagcgaggcccagagaugccuguaccacgacgugaugcuggagaaccugacccugaucagcagccugggcugcugguacggcgccaaggacgagacccccagcaagcagacccugagcauccagcaggagagcccccugagaacccacuggaccggcgugugcaccaagaaggugcaccuguggggcaugugcggcccccugcugggcgacauccugcaccagggcacccagcacaaccagaagcugaacggcuucggcgccuacgagaagaagcuggacgacgacgccaaccaccaccaggaccagaagcagcacaucggcgagaagagcuacagaagcaacgccaagggcaccagcuucgugaagaacugcaaguuccacaugagccacgagcccuucaucuuccacgaggugggcaaggacuuccugagcagccugagacugcugcagcaggaggacauccacaccagcggcaagagcaacuucgagaccaagcacggcaucccccugcagggcggcaagacccacuacaucugcggcgagagcaccauccccuucagcaacaagcacagccuggugcugcaccagagacugcugcccagagagggccccuacgugugcagcgacagcggcaaguucaccagcaagagcaacagcuucaacaaccaccagggcgugagaaccggcaagagacccuaccagugcggccagugcgacgagagcuucugguacaaggcccaccugaccgagcaccagagagugcacaccggcgagagacccuacgagugcggcgagugcgacaagagcuucagccacaagcacagccugguggaccaccagagagugcacaccggcgagagacccuacgagugcgacgagugcggcaagagcuucagccacaagagaagccuggugcaccaccagagagugcacaccggcgagagacccuaccagugcggcgagugcggcaagagcuucaaccacaagugcaaccugauccagcaccagagagugcacaccggcgagagacccuucgagugcaccgccugcggcaagcuguucagaagcaacagccaccugaaggagcaccagagagugcacaccggcgagagacccuacgagugcaaggagugcagaaagagcuucagauacaagagccaccugaccgagcaccagagagugcacaccggcgagagacccuacgagugcagagagugcggcaagugcuuccaccagaagggcagccugauccagcaccagcagauccacagcggcgagagaccccacgagugcggcgagugcggcaagugcuuccaccagaagggcagccugaucagacaccagcagauccacagcggcgagagaccccacgagugcggcgagugcggcaagugcuucagacagaagggcaaccugaucaagcaccagagagugcacaccggcgagagacaccacgagugcuaa

SEQ ID NO: 26069 - RNA, 2274 nt, Artificial Sequence
  ZNF778__Homo_sapiens__NP_001188336
auggccgcccccgaccuggcccacggcggccacgugagcagagacagcgugugccugcacgaggagcagacccaggccgccggcaugguggccggcuggcugaucaacugcuaccaggacgccgugaccuucgacgacguggccguggacuucacccaggaggaguggacccugcuggaccccagccagagagaccuguacagagacgugaugcuggagaacuacgagaaccuggccagcgugggccaccaccuguuccagcccagcgugaucuacuggcuggagcaggaggaggagcugagagccggcagaagagccgugcugcaggaguggagacugaagaccaagggccccgcccugagacaggacagaagcugguucagagccagcaacgagacccagaccgccagaagccacaacggcggccagcugugcgacagaacccagugcggcgaggccuucagcgagcacagcggccugagcacccacgugagaacccagaacaccggcgacagcugcgugagcaaccacuacgagagagacuucuucauccccugccagaagacccuguucaagaucggcgagcaguucagcgugcugggccagugcggcaaggccuucagcagcacccccaacguggugagccagcaggccugcaccagagacagaagccuggacuacagcagcugcggcgagguguuccugaaccagagcuaccugcaggccagagccggcagccacaacggcgaggagaccuggaaguggaagcccugcggcaaggcccugacccacagcaugggcugcgccacccccguggagaugcacgccgugagaaacccccacgugugcagagagugcggcaaggccuucagauacaccgccuaccugaccggcagagugcaggugcaccccggcgagaagcccugcgagcuggaggagugcggcaaggccagccccgugagcagcagccugacccagcacgugagaauccacgccgccgagaagcccugcgagugcaaggagugcggcaaggccuucaccggccugagcggccugagcaagcacgugcagaccgaccccggccagaagcccuacgagugcaaggacugcggcaaggccugcggcggcuucuaccugcugaacgagcacggcaagacccacaccagagagaagcccuucgccugcguggugugcggcaaguacuucagaaacagcagcugccugaacaaccacgugagaauccacaccggcaucaagcccuacaccugcagcuacugcggcaaggccuucaccgugagaugcggccugaccagacacgugagaacccacaccggcgagaagcccuacaccugcaaggacugcggcaaggccuucugcaccagcagcggccugaccgagcacgugagaacccacaccggcgagaagcccuacgagugcaaggacugcggcaagagcuucaccgugagcagcagccugaccgagcacgccagaauccacaccggcgagaagcccuacgagugcaagcagugcggcaaggccuucaccggcagaagcggccugaccaagcacaugagaacccacaccggcgagaagcccuacgagugcaaggacugcggcaaggccuacaacagaguguaccugcugaacgagcacgugaagacccacaccgaggagaagcccuucaucugcaccgugugcagaaagagcuucagaaacagcagcugccugaacaagcacauccagauccacaccggcaucaagcccuacgagugcaaggacugcggcaagaccuucaccgugagcagcagccugaccgagcacaucagaacccacaccggcgagaagcccuacgagugcaaggugugcggcaaggccuucaccaccagcagccaccugaucgugcacaucagaacccacaccggcgagaagcccuacaucugcaaggagugcggcaaggccuucgccagcagcagccaccugaucgagcacagaagaacccacaccggcgagaagcccuacaucugcaacgagugcggcaaggccuucagagccagcagccaccugcacaagcacggcagaauccacaccggccagaagcccuacaagugcaaggagugcggcaaggccuacaacagauucuaccugcugaaggagcaccugaagaccuacaccgaggagcagguguucgugugcaaggacugcggcaagagcuucaagaacagcagcugccugaaccaccacacccagauccacaccgacgagaagcccuucuaa

SEQ ID NO: 26070 - RNA, 972 nt, Artificial Sequence
  ZNF784__Homo_sapiens__NP_976308
auggccgccgccagacccgaggcccagagcagaagcagccccacccccgagagcagaagccaggagccccuggaccuggugcuggugcccgacgacugcagacccggcaccccccccagcgaccugaucgagauccagguggugaaggugaccgacaccacccuggugcccgagccccccgagcccggcagcuuccacugcgcccugugccccgccgccuucagacuggugagcgagcugcuguuccacgagcacggccaccuggccggcgccgagggcggcggccagggcggcgaccccagcagaugccacgugugcggccacagcugccccggccccgccagccugagagcccacuacagccugcacaccggcgagagacccuacagaugcgcccugugccccagagccuucaaggcccuggccccccugcugagacaccagcacagacacggcguggagcccggcaccagcagaagaccccccgacaccgccgccguggccgagcagagacccggcguggcccccgagagagccgagguggugauggccgccgccgccgccggcgccgccgugggcaagcccuucgccugcagauucugcgccaagcccuucagaagaagcagcgacaugagagaccacgagagagugcacaccggcgagagacccuaccacugcggcaucugcggcaagggcuucacccagagcagcgugcugagcggccacgccagaauccacaccggcgagagacccuucagaugcacccugugcgacagaaccuucaacaacagcagcaacuucagaaagcaccagagaacccacuuccacggccccggccccggccugggcgacagcggcggccagcugggcagcagcgccgccgagggcagcggcagcggcugcggcgugggcgaccccgccgaggagggcagaggcgagaccgccaaggugaagguggaggccgaccaguaa

SEQ ID NO: 26071 - RNA, 1425 nt, Artificial Sequence
  ZNF79__Homo_sapiens__NP_001273625
auggccgccggccugcugaccgccggccccagaggcagcaccuucuucagcagcgugaccguggccuucgcccaggagagauggagaugccuggugagcacccccagagacagauucaaggagggcauccccggcaagagcagaagccuggugcugcugggccugcccgugagccagcccggcaugaacagccagcuggagcagagagagggcgccuggaugcuggagggcgaggaccugagaagccccagccccggcuggaagaucaucagcggcagcccccccgagcaggcccugagcgaggccagcuuccaggaccccugcguggagaugccccccggcgacagcgaccacggcaccagcgaccuggagaagagcuucaaccugagacccgugcugagcccccagcagagagugcccguggaggccagacccagaaagugcgagacccacaccgagagcuucaagaacagcgagauccugaagccccacagagccaagcccuacgccugcaacgagugcggcaaggccuucagcuacugcagcagccugagccagcaccagaagagccacaccggcgagaagcccuacgagugcagcgagugcggcaaggccuucagccagagcagcagccugauccagcaccagagaauccacaccggcgagaagcccuacaagugcagcgagugcggcagagccuucagccagaacgccaaccugaccaagcaccagagaacccacaccggcgagaagcccuacagaugcagcgagugcgagaaggccuucagcgacugcagcgcccuggugcagcaccagagaauccacaccggcgagaagcccuacgagugcagcgacugcggcaaggccuucagacacagcgccaaccugaccaaccaccagagaacccacaccggcgagaagcccuacaagugcagcgagugcggcaaggccuucagcuacugcgccgccuucauccagcaccagagaauccacaccggcgagaagcccuacagaugcgccgccugcggcaaggccuucagccagagcgccaaccugaccaaccaccagagaacccacaccggcgagaagcccuacaagugcagcgagugcggcaaggccuucagccagagcaccaaccugaucauccaccagaagacccacaccggcgagaagcccuacaagugcaacgagugcggcaaguucuucagcgagagcagcgcccugaucagacaccacaucauccacaccggcgagaagcccuacgagugcaacgagugcggcaaggccuucaaccagagcagcagccugagccagcaccagagaauccacaccggcgugaagcccuacgagugcagcgagugcggcaaggccuucagaugcagcagcgccuucgugagacaccagagacugcacgccggcgaguaa

SEQ ID NO: 26072 - RNA, 447 nt, Artificial Sequence
  ZNF7__Homo_sapiens__NP_001269725
auggagguggugaccuucggcgacguggccgugcacuucagcagagaggaguggcagugccuggaccccggccagagagcccuguacagagaggugaugcuggagaaccacagcagcguggccggccuggccggcuuccugguguucaagcccgagcugaucagcagacuggagcagggcgaggagcccugggugcuggaccugcagggcgccgagggcaccgaggcccccagaaccagcaagaccggcuuccugggcagacccaccaugggccaggagcccagacacccccacgccccccccgccacccccgugcccggccugcccaagcacugcagccagagacugacccugcccccccccggccugagcagcagcccccugggccacuuccuggugcacgaccaggacagaagaagaggcaccagcgccaucuggaugguguaa

SEQ ID NO: 26073 - RNA, 1995 nt, Artificial Sequence
  ZNF800__Homo_sapiens__XP_005250238
augccccugagagacaaguacugccagaccgaccaccaccaccacggcugcugcgagcccguguacauccuggagcccggcgaccccccccugcugcagcagccccugcagaccagcaagagcggcauccagcagaucaucgagugcuucagaagcggcaccaagcagcugaagcacauccugcugaaggacguggacaccaucuucgagugcaagcugugcagaagccuguucagaggccugcccaaccugaucacccacaagaaguucuacugcccccccagccugcagauggacgacaaccugcccgacgugaacgacaagcagagccaggccaucaacgaccugcuggaggccaucuaccccagcguggacaagagagaguacaucaucaagcuggagcccaucgagaccaaccagaacgccguguuccaguacaucagcagaaccgacaaccccaucgaggugaccgagagcagcagcacccccgagcagaccgaggugcagauccaggagaccagcaccgagcagagcaagaccgugcccgugaccgacaccgagguggagaccguggagcccccccccguggagaucgugaccgacgagguggcccccaccagcgacgagcagccccaggagagccaggccgaccuggagaccagcgacaacagcgacuucggccaccagcugaucugcugccugugcagaaaggaguucaacagcagaagaggcgugagaagacacaucagaaaggugcacaagaagaagauggaggagcugaagaaguacaucgagaccagaaagaaccccaaccagagcagcaagggcagaagcaagaacgugcuggugccccugagcagaagcugccccgugugcugcaagagcuucgccaccaaggccaacgugagaagacacuucgacgaggugcacagaggccugagaagagacagcaucacccccgacaucgccaccaagcccggccagccccuguuccuggacagcaucagccccaagaagagcuucaagaccagaaagcagaagagcagcagcaaggccgaguacaaccugaccgccugcaagugccugcugugcaagagaaaguacagcagccagaucaugcugaagagacacaugcagaucgugcacaagaucacccugagcggcaccaacagcaagagagagaagggccccaacaacaccgccaacagcagcgagaucaaggugaagguggagcccgccgacagcguggagagcagcccccccagcaucacccacagcccccagaacgagcugaagggcaccaaccacagcaacgagaagaagaacacccccgccgcccagaagaacaaggugaagcaggacagcgagagccccaagagcaccagccccagcgccgccggcggccagcagaagaccagaaagcccaagcugagcgccggcuucgacuucaagcagcuguacugcaagcugugcaagagacaguucaccagcaagcagaaccugaccaagcacaucgagcugcacaccgacggcaacaacaucuacgugaaguucuacaagugcccccugugcaccuacgagaccagaagaaagagagacgugaucagacacaucaccguggugcacaagaagagcagcagauaccugggcaagaucaccgccagccuggagaucagagccaucaagaagcccaucgacuucgugcugaacaagguggccaagagaggccccagcagagacgaggccaagcacagcgacagcaagcacgacggcaccagcaacagccccagcaagaaguacgagguggccgacgugggcaucgaggugaaggugaccaagaacuucagccugcacagaugcaacaagugcggcaaggccuucgccaagaagaccuaccuggagcaccacaagaagacccacaaggccaacgccagcaacagccccgagggcaacaagaccaagggcagaagcaccagaagcaaggcccugguguaa

SEQ ID NO: 26074 - RNA, 3630 nt, Artificial Sequence
  ZNF804A__Homo_sapiens__NP_919226
auggagugcuacuacaucgugaucagcagcacccaccugagcaacggccacuucagaaacaucaagggcguguucagaggcccccugagcaagaacggcaacaagacccuggacuacgccgagaaggagaacaccaucgccaaggcccuggaggaccugaaggccaacuucuacugcgagcugugcgacaagcaguacuacaagcaccaggaguucgacaaccacaucaacagcuacgaccacgcccacaagcagagacugaaggagcugaagcagagagaguucgccagaaacguggccagcaagagcagaaaggacgagagaaagcaggagaaggcccugcagagacugcacaagcuggccgagcugagaaaggagaccgugugcgcccccggcagcggccccauguucaagagcaccaccgugaccgugagagagaacugcaacgagaucagccagagaguggugguggacagcgugaacaaccagcaggacuucaaguacacccugauccacagcgaggagaacaccaaggacgccaccaccguggccgaggaccccgagagcgccaacaacuacaccgccaagaacaaccaggugggcgaccaggcccagggcauccacagacacaagaucggcuucagcuucgccuuccccaagaaggccagcgugaagcuggagagcagcgccgccgccuucagcgaguacagcgacgacgccagcgugggcaagggcuucagcagaaagagcagauucgugcccagcgccugccaccugcagcagagcagccccaccgacgugcugcugagcagcgaggagaagaccaacagcuuccacccccccgaggccaugugcagagacaaggagaccgugcagacccaggagaucaaggaggugagcagcgagaaggacgcccugcugcugcccagcuucugcaaguuccagcugcagcugagcagcgacgccgacaacugccagaacagcgugccccuggccgaccagaucccccuggagagcguggugaucaacgaggacauccccgugagcggcaacagcuucgagcugcugggcaacaagagcaccgugcuggacaugagcaacgacugcaucagcgugcaggccaccaccgaggagaacgugaagcacaacgaggccagcaccaccgagguggagaacaagaacggccccgagacccuggcccccagcaacaccgaggaggugaacaucaccauccacaagaagaccaacuucugcaagagacagugcgagcccuucgugcccgugcugaacaagcacagaagcaccgugcugcaguggcccagcgagaugcugguguacaccaccaccaagcccagcaucagcuacagcugcaacccccugugcuucgacuucaagagcaccaaggugaacaacaaccuggacaagaacaagcccgaccugaaggaccugugcagccagcagaagcaggaggacaucugcaugggcccccugagcgacuacaaggacgugagcaccgagggccugaccgacuacgagaucggcagcagcaagaacaagugcagccaggugaccccccugcuggccgacgacauccugagcagcagcugcgacagcggcaagaacgagaacaccggccagagauacaagaacaucagcugcaagaucagagagaccgagaaguacaacuucaccaagagccagaucaagcaggacacccuggacgagaaguacaacaagaucagacugaaggagacccacgaguacugguuccacaagagcagaagaaagaagaagagaaagaagcugugccagcaccaccacauggagaagaccaaggagagcgagaccagaugcaagauggaggccgagaacagcuacaccgagaacgccggcaaguaccugcuggagcccaucagcgagaagcaguaccuggccgccgagcagcugcuggacagccaccagcugcuggacaagagacccaagagcgagagcaucagccugagcgacaacgaggagaugugcaagaccuggaacaccgaguacaacaccuacgacaccaucagcagcaagaaccacugcaagaagaacaccauccugcugaacggccagagcaacgccaccaugauccacagcggcaagcacaaccugaccuacagcagaaccuacugcugcuggaagaccaagaugagcagcugcagccaggaccacagaagccuggugcugcagaacgacaugaagcacaugagccagaaccaggccgugaagagaggcuacaacagcgugaugaacgagagcgagagauucuacagaaagagaagacagcacagccacagcuacagcagcgacgagagccugaacagacagaaccaccugcccgaggaguuccugagaccccccagcaccagcguggcccccugcaagcccaagaagaagagaagaagaaagagaggcagauuccaccccggcuucgagacccuggagcugaaggagaacaccgacuaccccgugaaggacaacagcagccugaacccccuggacagacugaucagcgaggacaagaaggagaagaugaagccccaggagguggccaagaucgagagaaacagcgagcagaccaaccagcugagaaacaagcugagcuuccaccccaacaaccugcugcccagcgagaccaacggcgagaccgagcaccuggagauggagaccaccagcggcgagcugagcgacgugagcaacgaccccaccaccagcgugugcguggccagcgcccccaccaaggaggccaucgacaacacccugcuggagcacaaggagagaagcgagaacaucaaccugaacgagaagcagauccccuuccaggugcccaacaucgagagaaacuucagacagagccagcccaagagcuaccugugccacuacgagcuggccgaggcccugccccagggcaagaugaacgagacccccaccgaguggcugagauacaacagcggcauccugaacacccagcccccccugcccuucaaggaggcccacgugagcggccacaccuucgugaccgccgagcagauccuggccccccuggcccugcccgagcaggcccugcugaucccccuggagaaccacgacaaguucaagaacgugcccugcgagguguaccagcacauccugcagcccaacaugcuggccaacaaggugaaguucaccuucccccccgccgcccugcccccccccagcaccccccugcagccccugccccugcagcagagccugugcagcaccagcgugaccaccauccaccacaccgugcugcagcagcacgccgccgccgccgccgccgccgccgccgccgccgccgccggcaccuucaaggugcugcagccccaccagcaguuccugagccagauccccgcccugaccagaaccagccugccccagcugagcgugggccccgugggccccagacugugccccggcaaccagcccaccuucguggcccccccccagaugcccaucauccccgccagcgugcugcaccccagccaccuggccuuccccagccugccccacgcccuguuccccagccugcugagcccccaccccaccgugaucccccugcagccccuguucuaa

SEQ ID NO: 26075 - RNA, 4050 nt, Artificial Sequence
  ZNF804B__Homo_sapiens__NP_857597
auggccugcuaccuggugaucagcagcagacaccugagcaacggccacuacagaggcaucaagggcguguucagaggcccccugugcaagaacggcagccccagccccgacuucgccgagaagaagagcaccgccaaggcccuggaggacgugaaggccaacuucuacugcgagcugugcgacaagcaguaccacaagcaccaggaguucgacaaccacaucaacagcuacgaccacgcccacaagcagagacugaaggagcugaagcagagagaguucgccagaaacguggccagcaagagcuggaaggacgagaagaagcaggagaaggcccugaagagacugcaccagcuggccgagcugagacagcagagcgagugcgugagcggcaacggccccgccuacaaggcccccagaguggccaucgagaagcagcugcagcagggcaucuuccccaucaagaacggcagaaaggugagcugcaugaagagcgcccugcugcugaagggcaagaaccugcccagaaucaucagcgacaagcagagaagcaccaugcccaacagacaccagcugcagagcgacagaagaugccuguucggcaaccaggugcugcagaccagcagcgaccugagcaacgccaaccacagaaccggcgugagcuucaccuucagcaagaaggugcaccugaagcuggagagcagcgccagcguguucagcgagaacaccgaggagacccacgacugcaacaagagccccaucuacaagaccaagcagaccgccgacaagugcaagugcugcagauucgccaacaaggacacccaccugaccaaggagaaggaggugaacaucagccccagccaccuggagagcgugcugcacaacaccaucagcaucaacagcaagauccugcaggacaagcacgacagcaucgacgagacccuggaggacagcaucggcauccacgccagcuucagcaagagcaacauccaccugagcgacguggacuucacccccaccagcagagagaaggagaccagaaacacccugaagaacacccuggagaacugcgugaaccaccccugccaggccaacgccagcuucagcccccccaacaucuacaaccacagcgacgccagaaucagcgagugccuggacgaguucagcagccuggagcccagcgagcagaagagcaccgugcaccugaaccccaacagcagaaucgagaacagagagaagagccuggacaagaccgagagagugagcaagaacgugcagagacuggugaaggaggccugcacccacaacguggccagcaagccccugcccuuccugcacgugcagagcaaggacggccacaccacccugcaguggcccaccgagcugcugcuguucaccaagaccgagcccugcaucagcuacggcugcaacccccuguacuucgacuucaagcugagcagaaacaccaaggaggaccacaaccuggaggaccugaagaccgagcugggcaagaagccccuggagcugaagaccaagagagagagccaggugagcggccugaccgaggaccagcagaagcugauccaggaggacuaccaguaccccaagcccaagaccaugaucgccaaccccgacugggagaaguuccagagaaaguacaaccuggacuacagcgacagcgagcccaacaagagcgaguacaccuucagcgccaacgaccuggagaugaagaaccccaaggugccccuguaccugaacaccagccugaaggacugcgccggcaagaacaacagcagcgagaacaagcugaaggaggccagcagagcccacuggcagggcugcagaaaggccgugcugaacgacaucgacgaggaccugagcuuccccagcuacaucagcagauucaagaagcacaagcugauccccugcagcccccaccuggaguucgaggacgagagacaguucaacugcaagagcagccccugcaccgugggcggccacagcgaccacggcaaggacuucagcgugauccugaagagcaaccacaucagcaugaccagcaaggugagcggcugcggcaaccagagauacaagagauacagcccccagagcugccugagcagauacagcagcagccuggacaccagccccagcagcaugagcagccugagaagcaccugcagcagccacagauucaacggcaacagcagaggcaaccugcugugcuuccacaagagagagcaccacagcguggagagacacaagagaaagugccugaagcacaacugcuucuaccugagcgacgacaucaccaagagcagccagaugcagagcgagccccagaaggagagaaacugcaagcugugggagagcuucaagaacgagaaguacagcaagagaagauacugccacugcagagagagacagaagcugggcaagaaccagcagcaguucagcggccugaagagcaccagaaucaucuacugcgacagcaacagccagaucagcugcaccggcagcagcaagaagccccccaacugccagggcacccagcacgacagacuggacagcuacagcaucgagaagauguacuaccugaacaagagcaagagaaaccaggagagccugggcagcccccacaucugcgaccugggcaaggugagacccaugaagugcaacagcggcaacaucagcugccugcugaagaacugcagcagcggccccagcgagaccaccgagagcaacaccgccgagggcgagagaaccccccugaccgccaagauccugcuggagagagugcaggccaagaagugccaggagcagagcagcaacguggagaucagcagcaacagcugcaagagcgagcuggaggcccccagccaggugcccugcaccauccagcuggcccccagcggcugcaacagacaggcccugccccugagcgagaagauccaguacgccagcgagagcagaaacgaccaggacagcgccauccccagaaccaccgagaaggacaagagcaagagcagccacaccaacaacuucaccauccuggccgacaccgacugcgacaaccaccugagcaagggcaucauccaccuggugaccgagagccagagccugaacaucaagagagacgccaccaccaaggagcagagcaagccccugaucagcgagauccagcccuucauccagagcugcgaccccgugcccaacgaguuccccggcgccuuccccagcaacaaguacaccggcgugaccgacagcaccgagacccaggaggaccagaucaaccuggaccugcaggacgugagcaugcacaucaaccacguggagggcaacaucaacagcuacuacgacagaaccaugcagaagcccgacaagguggaggacggccuggagaugugccacaagagcaucagccccccccugauccagcagcccaucaccuucagccccgacgagaucgacaaguacaagauccugcagcugcaggcccagcagcacaugcagaagcagcugcugagcaagcaccugagagugcugcccgccgccggccccaccgccuucagccccgccagcaccgugcagaccgugcccgugcaccagcacaccagcaucaccaccauccaccacaccuuccugcagcacuucgccgugagcgccagccugagcagccacagcagccaccugcccaucgcccaccugcacccccugagccaggcccacuucagccccaucagcuucagcacccugacccccaccaucauccccgcccaccccaccuuccuggccggccacccccugcaccugguggccgccacccccuuccaccccagccacaucacccugcagccccugccccccaccgccuucauccccacccuguucggcccccaccugaaccccgccaccaccagcaucauccaccugaacccccugauccagcccguguuccagggccaggacuucugccaccacagcugcagcagccagaugcagcagcugaacgaggugaaggaggcccugaacgugagcacccaccugaacuaa

SEQ ID NO: 26076 - RNA, 822 nt, Artificial Sequence
  ZNF80__Homo_sapiens__NP_009067
augagccccaagagagacggccugggcaccggcgacggccugcacagccaggugcugcaggagcaggugagcaccggcgacaaccugcacgagugcgacagccagggccccagcaaggacacccuggugagagagggcaagaccuacaagugcaaggagugcggcagcguguucaacaagaacagccugcuggugagacaccagcagauccacaccggcgugaagcccuacgagugccaggagugcggcaaggccuuccccgagaagguggacuucgugagacccaugagaauccacaccggcgagaagcccugcaagugcguggagugcggcaagguguucaacagaagaagccaccugcugugcuacagacagauccacaccggcgagaagcccuacgagugcagcgagugcggcaagaccuucagcuaccacagcguguucauccagcacagagugacccacaccggcgagaagcuguucggcugcaaggagugcggcaagaccuucuacuacaacagcagccugaccagacacaugaagauccacaccggcgagaagcccugcaagugcagcgagugcggcaagaccuucaccuacagaagcguguucuucagacacagcaugacccacaccgccggcaagcccuacgagugcaaggagugcggcaagggcuucuacuacagcuacagccugaccagacacaccagaagccacaccggcgagaagcccuacgagugccuggagcacagaaaggacuucggcuaccacagcgccuucgcccagcagagcaagauccacagcggcggcaagaaccuguaa

SEQ ID NO: 26077 - RNA, 1185 nt, Artificial Sequence
  ZNF812__Homo_sapiens__XP_011526544
augccccugcagagaugcgacgugggcgagcugugcgagcccggccugugcggcagacaggaggccaccguggacggcaacagcgagaacugcggcgagguguucagcgagugguucugccugaagacccacaugagagcccagaacggcggcaacaucuucgagggcaacugcuacggcaaggacauccugagcgugcacaaggaggccagcaucggccaggagcugagcaaguucaaccccugcggcaagguguucacccugacccccgaccuggccgcccaccugggcauccugaacgccagacagcccuacaagugcaaggagugcagaaagggcuucaaguacuucgccagccuggacaaccacaugggcauccacaucggcgagaaguucugcgaguuccaggagugcagaagagccaucacccacagcagccaccugaagcagugcgugaccgugcacaccggcaagaagagcaagaagaccaagaagcacggcaagagcuucaccaacuucagccagcugagcgcccacgugaagauccacaagggcgagaagagcuucgagugcaaggagugcggcagaagcuucagaaacagcagcagcuucaacgugcacauccagauccacaccggcaucaagccccacaaguacaccgagugcggcaaggccuucaccagaagcacccaccugacccagcacgugagaacccacaccggcaucaagcccuacgagugcaaggagugcggccaggccuucacccaguacaccggccuggccauccacaucagaaaccacaccggcgagaagcacuaccagugcaaggagugcggcaaggccuucaacggcagcagcacccugacccagcacaagaucauccacaccggcgagaagcccuacggcugcguggagugcggcaagaccuucaucaccagcagcuacagaagcaagcaccugaagacccaccacgaggagagacccuucgugugcaagaucugcggcaaggccuuccuguacagcagcccccugaacgugcaccugcagacccacaccagagagaaggcccugaucugcaaggagugcggcaaggccuucgccgugagcagccaccugagcagacacgagagaauccacaccggcgaggagcccuacgaguacaagggcaugaacgugaccaucuaa

SEQ ID NO: 26078 - RNA, 1854 nt, Artificial Sequence
  ZNF813__Homo_sapiens__NP_001004301
auggcccugccccagggccugcugaccuucagagacguggccaucgaguucagccaggaggaguggaagugccuggaccccgcccagagaacccuguacagagacgugaugcuggagaacuacagaaaccuggugagccuggacaucagcagcaagugcaugaugaaggaguucagcagcaccgcccagggcaacagagaggugauccacaccggcacccugcagagacacgagagccaccacaccggcgacuucagauuccaggagaucgacaaggacauccacaaccuggaguuccaguggcaggaggacgagagaaacagccacgaggcccccaugaccgagaucaagaagcugaccggcagcgccgacagauacgaccagagacacgccggcaacaagcccaucaaggaccagcugggcagcagcuuccacagccaccugcccgagcugcacauguuccagacccagggcaagaucggcaaccagguggagaagagcaucaacgacgccagcagcaucagcaccagccagagaaucagcugcagacccaagacccacaucagcaacaacuacggcaacaacuucagaaacagcagccugcugacccagaagcaggaggugcacaugagagagaagagcuuccagugcaacgagagcggcaaggccuucaacuacagcagccugcugagaaagcaccagaucauccaccugggcgagaagcaguacaagugcgacgugugcggcaagguguucaacagaaagagaaaccuggugugccacagaagaugccacaccggcgagaagcccuacagaugcaacgagugcggcaagaccuucagccagaccuacagccugaccugccacagaagacugcacaccggcgagaagcccuacaagugcgaggagugcgacaaggccuucagcuucaagagcaaccugaagagacacagaagaauccacgccggcgagaagcccuacaagugcaacgagugcggcaagaccuucagccagaccagcagccugaccugccacagaagacugcacaccggcgagaagcccuucaagugcaacgagugcggcaagaccuucagcagaaagagcagccugaccugccaccacagacugcacaccggcgagaagcccuacaagugcaacgagugcggcaagaccuucagccaggagcugacccugaagugccacagaagacugcacaccggcgagaagcccuacaagugcaacgagugcggcaagguguucaacaagaaggccaaccuggccagacaccacagacugcacagcggcgagaagcccuacaagugcaccgagugcgugaagaccuucagcagaaacagcgcccuggugauccacaaggccauccacaucggcgagaagagauacaagugcaacgagugcggcaagaccuucagcagaaucagcgcccuggugauccacaccgccauccacaccggcgagaagcccuacaagugcaacgagugcggcaagggcuucaacagaaagacccaccuggccugccaccacagacugcacaccggcgagaagcccuacaagugcaacgagugcggcaagguguucaacagaaagacccaccuggcccaccaccacagacugcacaccggcgacaagcccuacaagugcaacgagugcggcaagguguucaaccagaaggcccaccuggccagacaccacagacugcacaccggcgagaagcccuacaagugcaacgagugcggcaagguguucaaccagaaggccaaccuggccagacaccacagacugcacaccggcgagaagcccuacaaguucaacgagugcggcaaggccuucaacuaa

SEQ ID NO: 26079 - RNA, 1956 nt, Artificial Sequence
  ZNF816__Homo_sapiens__NP_001189386
augcugagagaggaggccaccaagaagagcaaggagaaggagcccggcauggcccugccccagggcagacugaccuucagagacguggccaucgaguucagccuggaggaguggaagugccugaaccccgcccagagagcccuguacagagccgugaugcuggagaacuacagaaaccuggaguucguggacagcagccugaagagcaugauggaguucagcagcaccagacacagcaucaccggcgaggugauccacaccggcacccugcagagacacaagagccaccacaucggcgacuucugcuuccccgagaugaagaaggacauccaccacuucgaguuccaguggcaggagguggagagaaacggccacgaggcccccaugaccaagaucaagaagcugaccggcagcaccgacagaagcgaccacagacacgccggcaacaagcccaucaaggaccagcugggccugagcuuccacagccaccugcccgagcugcacauguuccagaccaagggcaagaucagcaaccagcuggacaagagcaucggcgccagcagcgccagcgagagccagagaaucagcugcagacugaagacccacaucagcaacaaguacggcaagaacuuccugcacagcagcuucacccagauccaggagaucugcaugagagagaagcccugccagagcaacgagugcggcaaggccuucaacuacagcagccugcugagaagacaccacaucacccacagcagagagagagaguacaagugcgacgugugcggcaagaucuucaaccagaagcaguacaucguguaccaccacagaugccacaccggcgagaagaccuacaagugcaacgagugcggcaagaccuucacccagaugagcagccuggugugccacagaagacugcacaccggcgagaagcccuacaagugcaacgagugcggcaagaccuucagcgagaagagcagccugagaugccacagaagacugcacaccggcgagaagcccuacaagugcaacgagugcggcaagaccuucggcagaaacagcgcccuggugauccacaaggccauccacaccggcgagaagcccuacaagugcaacgagugcggcaagaccuucagccagaagagcagccugcagugccaccacauccugcacaccggcgagaagcccuacaagugcgaggagugcgacaacguguacaucagaagaagccaccuggagagacacagaaagauccacaccggcgagggcagcuacaagugcaaggugugcgacaagguguucagaagcgacagcuaccuggccgagcaccagagagugcacaccggcgagaagcccuacaagugcaacaagugcggcagaagcuucagcagaaagagcagccugcaguaccaccacacccugcacaccggcgagaagcccuacaccugcaacgagugcggcaagguguucagcagaagagagaaccuggccagacaccacagacugcacgccggcgagaagcccuacaagugcgaggagugcgacaagguguucagcagaagaagccaccuggagagacacagaagaauccacaccggcgagaagcccuacaagugcaaggugugcgacaaggccuucagaagcgacagcugccuggccaaccacaccagagugcacaccggcgagaagcccuacaagugcaacaagugcgccaagguguucaaccagaagggcauccuggcccagcaccagagagugcacaccggcgagaagcccuacaagugcaacgagugcggcaagguguucaaccagaaggccagccuggccaagcaccagagagugcacaccgccgagaagcccuacaagugcaacgagugcggcaaggccuucaccggccagagcacccugauccaccaccaggccauccacggcugcagagagacccugcagauguaa

SEQ ID NO: 26080 - RNA, 1986 nt, Artificial Sequence
  ZNF81__Homo_sapiens__XP_011542204
augcccgccaacgaggacgccccccagcccggcgagcacggcagcgccugcgaggugagcgugagcuucgaggacgugaccguggacuucagcagagaggaguggcagcagcuggacagcacccagagaagacuguaccaggacgugaugcuggagaacuacagccaccugcugagcgugggcuucgaggugcccaagcccgaggugaucuucaagcuggagcagggcgagggccccuggacccuggagggcgaggccccccaccagagcugcagcgacggcaaguucggcaucaagcccagccagagaagaaucagcggcaagagcaccuuccacagcgagauggagggcgaggacaccagagacgacagccuguacagcauccuggaggagcuguggcaggacgccgagcagaucaagagaugccaggagaagcacaacaagcugcugagcagaaccaccuuccugaacaagaagauccugaacaccgagugggacuacgaguacaaggacuucggcaaguucgugcaccccagccccaaccugauccugagccagaagagaccccacaagagagacagcuucggcaagagcuucaagcacaaccuggaccugcacauccacaacaagagcaacgccgccaagaaccuggacaagaccaucggccacggccagguguucacccagaacagcagcuacagccaccacgagaacacccacaccggcgugaaguucugcgagagaaaccagugcggcaaggugcugagccugaagcacagccugagccagaacgugaaguuccccaucggcgagaaggccaacaccugcaccgaguucggcaagaucuucacccagagaagccacuucuucgccccccagaagauccacaccguggagaagccccacgagcugagcaagugcgugaacguguucacccagaagccccugcugagcaucuaccugagagugcacagagacgagaagcuguacaucugcaccaagugcggcaaggccuucauccagaacagcgagcugaucaugcacgagaagacccacaccagagagaagcccuacaagugcaacgagugcggcaagagcuucuuccaggugagcagccugcugagacaccagaccacccacaccggcgagaagcuguucgagugcagcgagugcggcaagggcuucagccugaacagcgcccugaacauccaccagaagauccacaccggcgagagacaccacaagugcagcgagugcggcaaggccuucacccagaagagcacccugagaaugcaccagagaauccacaccggcgagagaagcuacaucugcacccagugcggccaggccuucauccagaaggcccaccugaucgcccaccagagaauccacaccggcgagaagcccuacgagugcagcgacugcggcaagagcuuccccagcaagagccagcugcagaugcacaagagaauccacaccggcgagaagcccuacaucugcaccgagugcggcaaggccuucaccaacagaagcaaccugaacacccaccagaagagccacaccggcgagaagagcuacaucugcgccgagugcggcaaggccuucaccgacagaagcaacuucaacaagcaccagaccauccacaccggcgagaagcccuacgugugcgccgacugcggcagagccuucauccagaagagcgagcugaucacccaccagagaauccacaccaccgagaagcccuacaagugccccgacugcgagaagagcuucagcaagaagccccaccugaaggugcaccagagaauccacaccggcgagaagcccuacaucugcgccgagugcggcaaggccuucaccgacagaagcaacuucaacaagcaccagaccauccacaccggcgacaagcccuacaagugcagcgacugcggcaagggcuucacccagaagagcgugcugagcaugcacagaaacauccacaccuaa

SEQ ID NO: 26081 - RNA, 1833 nt, Artificial Sequence
  ZNF823__Homo_sapiens__NP_001073962
auggacagcguggccuucgaggacguggccgugaacuucacccaggaggagugggcccugcugggccccagccagaagagccuguacagaaacgugaugcaggagaccaucagaaaccuggacugcaucgagaugaagugggaggaccagaacaucggcgaccagugccagaacgccaagagaaaccugagaagccacaccugcgagaucaaggacgacagccagugcggcgagaccuucggccagauccccgacagcaucgugaacaagaacacccccagagugaaccccugcgacagcggcgagugcggcgagguggugcugggccacagcagccugaacugcaacaucagaguggacaccggccacaagagcugcgagcaccaggaguacggcgagaagcccuacacccacaagcagagaggcaaggccaucagccaccagcacagcuuccagacccacgagagaccccccaccggcaagaagcccuucgacugcaaggagugcgccaagaccuucagcagccugggcaaccugagaagacacauggccgcccaccacggcgacggccccuacaagugcaagcugugcggcaaggccuucguguggcccagccuguuccaccugcacgagagaacccacaccggcgagaagcccuacgagugcaagcagugcagcaaggccuuccccuucuacagcagcuaccugagacacgagagaauccacaccggcgagaaggccuacgagugcaagcagugcagcaaggccuuccccgacuacagcaccuaccugagacacgagagaacccacaccggcgagaagcccuacaagugcacccagugcggcaaggccuucagcugcuacuacuacaccagacugcacgagagaacccacaccggcgagcagcccuacgccugcaagcagugcggcaagaccuucuaccaccacaccagcuucagaagacacaugaucagacacaccggcgacggcccccacaagugcaagaucugcggcaagggcuucgacugccccagcagcgugagaaaccacgagaccacccacaccggcgagaagcccuacgagugcaagcagugcggcaaggugcugagccacagcagcagcuucagaagccacaugaucacccacaccggcgacggcccccagaagugcaagaucugcggcaaggccuucggcugccccagccuguuccagagacacgagagaacccacaccggcgagaagcccuaccagugcaagcagugcggcaaggccuucagccuggccggcagccugagaagacacgaggccacccacaccggcgugaagcccuacaagugccagugcggcaaggccuucagcgaccugagcagcuuccagaaccacgagaccacccacaccggcgagaagcccuacgagugcaaggagugcggcaaggccuucagcugcuucaaguaccugagccagcacaagagaacccacaccguggagaagcccuacgagugcaagaccugcagaaaggccuucagccacuucagcaaccugaaggugcacgagagaauccacagcggcgagaagcccuacgagugcaaggagugcggcaaggccuucagcuggcugaccugccugcugagacacgagagaauccacaccggcgagaagcccuacgagugccugcagugcggcaaggccuucaccagaagcagauuccugagaggccacgagaagacccacaccggcgagaagcuguacgagugcaaggagugcggcaaggcccugagcagccugagaagccugcacagacacaagagaacccacuggaaggacacccuguaa

SEQ ID NO: 26082 - RNA, 3234 nt, Artificial Sequence
  ZNF827__Homo_sapiens__NP_849157
augcccagaagaaagcaggagcagcccaagagacugcccagccacgugagcagacaggaggaggccgagggcgagcugagcgagggcgagcacugguacggcaacagcagcgagacccccagcgaggccagcuacggcgaggugcaggagaacuacaagcugagccuggaggacagaauccaggagcagagcaccagccccgacaccagccugggcagcaccacccccagcagccacacccuggagcugguggcccuggacagcgaggugcugagagacagccugcagugccaggaccaccugagccccggcgugagcagccugugcgacgacgaccccggcagcaacaagccccugagcagcaaccugagaagacugcuggaggccggcagccugaagcuggacgccgccgccaccgccaacggcagaguggagagccccgugaacgugggcagcaaccugagcuucagcccccccagccaccacgcccagcagcugagcgugcuggccagaaagcuggccgagaagcaggagcagaacgaccaguacacccccagcaacagauucaucuggaaccagggcaaguggcugcccaacagcaccaccaccugcagccugagccccgacagcgccauccugaagcugaaggccgccgccaacgccgugcugcaggacaagagccugaccagaaccgaggagaccaugagauucgagagcuucagcagccccuucagcagccagagcgccagcagcacccuggccgcccugagcaagaaggugagcgagagaagccugacccccggccaggagcaccccccccccgccagcagcuuccugagccuggccagcaugaccagcagcgccgcccugcugaaggagguggccgccagagccgccggcagccugcuggccgagaagagcagccugcugcccgaggacccccugccccccccccccagcgagaagaagcccgagaaggugaccccccccccccccccccccccccccccccccccccccccccccccccagagccuggagcugcugcugcugcccgugcccaagggcagagugagcaagcccagcaacagcgccagcgaggaggagagcggcaagcccuuccagugccccaucugcggccuggugaucaagagaaagagcuacuggaagagacacauggugauccacaccggccugaagagccaccagugcccccugugccccuucagaugcgccagaaaggacaaccugaagagccacaugaaggugcaccagcaccaggacagaggcgagaccuuccagugccagcugugccccuucaccagcagcagacacuucagccugaagcugcacaugagaugccaccagcacuuccugagaaccgaggccaaggugaaggaggagauccccgaccccgacgugaagggcagcccccaccugagcgacagcgccugccugggccagcagagagagggcggcggcaccgagcuggugggcaccaugaugaccagcaacacccccgagagaaccagccagggcggcgccggcgugagcccccugcuggugaaggaggagcccaaggaggacaacggccugcccaccagcuucacccugaacgccgccgacagacccgccaaccacaccaagcugaaggaccccagcgaguacguggccaacagcgccagcgcccuguucagccaggacaucagcgugaagauggccagcgacuuccugaugaagcugagcgccgccaaccagaaggagcccaugaaccugaacuucaaggugaaggaggagcccaaggagggcgagagccugagcaccacccugcccagaagcagcuacguguucagccccgagagcgaggugagcgcccccggcgugagcgaggacgcccugaagccccaggagggcaagggcagcgugcugagaagagacgugagcgugaaggccgccagcgagcugcugaugaagcugagcgccgagagcuacaaggagacccagauggugaagaucaaggaggagcccauggagguggacauccaggacagccacgugagcaucagccccagcagaaacgugggcuacagcacccugaucggcagagagaagaccgagccccugcagaagaugcccgagggcagagugccccccgagagaaaccuguucagccaggacaucagcgugaagauggccagcgagcugcuguuccagcugagcgagaaggugagcaaggagcacaaccacaccaaggagaacaccaucagaaccaccaccagccccuucuucagcgaggacaccuucagacagagccccuucaccagcaacagcaaggagcugcugcccagcgacagcgugcugcacggcagaaucagcgcccccgagaccgagaagaucgugcuggaggccggcaacggccugcccagcuggaaguucaacgaccagcuguuccccugcgacgugugcggcaagguguucggcagacagcagacccugagcagacaccugagccugcacaccgaggagagaaaguacaagugccaccugugccccuacgccgccaagugcagagccaaccugaaccagcaccugaccgugcacagcgugaagcuggugagcaccgacaccgaggacaucgugagcgccgugaccagcgagggcagcgacggcaagaagcaccccuacuacuacagcugccacgugugcggcuucgagaccgagcugaacgugcaguucgugagccacaugagccugcacguggacaaggagcaguggauguucagcaucugcugcaccgccugcgacuucgugaccauggaggaggccgagaucaagacccacaucggcaccaagcacaccggcgaggacagaaagacccccagcgagagcaacagccccagcagcagcagccugagcgcccugagcgacagcgccaacagcaaggacgacagcgacggcagccagaagaacaagggcggcaacaaccugcuggugaucagcgugaugcccggcagccagcccagccugaacagcgaggagaagcccgagaagggcuucgagugcguguucugcaacuucgugugcaagaccaagaacauguucgagagacaccugcagauccaccugaucaccagaauguucgagugcgacgugugccacaaguucaugaagacccccgagcagcugcuggagcacaagaagugccacaccgugcccaccggcggccugaaguaa

SEQ ID NO: 26083 - RNA, 1542 nt, Artificial Sequence
  ZNF829__Homo_sapiens__NP_001165450
augaccggcaagggccugggcgaggacaccgaggacagauggggcgccggcgcccugggccccugcggcagaagcggccugaagggcggcggcugcgugugggaggccgaggccggcggcagcagaggccaggagaucgagaccauccuggccaacauggagaccagccugagaagcggccagauccccacccuggacagcagcgagcacaaccugagccccgagccccuggagcuggacagaaugccccacagcccccugaucagcaucccccacguguggugccaccccgaggaggaggagagaaugcacgacgagcugcugcaggccgugagcaagggccccgugauguucagagacgugagcaucgacuucagccaggaggagugggagugccuggacgccgaccagaugaaccuguacaaggaggugaugcuggagaacuucagcaaccuggugagcgugggccugagcaacagcaagcccgccgugaucagccugcuggagcagggcaaggagcccuggaugguggacagagagcugaccagaggccugugcagcgaccuggagagcaugugcgagaccaagauccugagccugaagaagagacacuucagccaggugaucaucaccagagaggacaugagcaccuucauccagcccaccuuccugauccccccccagaagaccaugagcgaggagaagcccugggagugcaagaucugcggcaagaccuucaaccagaacagccaguucauccagcaccagagaauccacuucggcgagaagcacuacgagagcaaggaguacggcaagagcuucagcagaggcagccuggugaccagacaccagagaauccacaccggcaagaagcccuacgagugcaaggagugcggcaaggccuucagcugcagcagcuacuucagccagcaccagagaauccacaccggcgagaagcccuacgagugcaaggagugcggcaaggccuucaaguacugcagcaaccugaacgaccaccagagaauccacaccggcgagaagcccuacgagugcaaggugugcggcaaggccuucaccaagagcagccagcuguuccugcaccugagaauccacaccggcgagaagcccuacgagugcaaggagugcggcaaggccuucacccagcacagcagacugauccagcaccagagaaugcacaccggcgagaagcccuacgagugcaagcagugcggcaaggccuucaacagcgccagcacccugaccaaccaccacagaauccacgccggcgagaagcuguacgagugcgaggagugcagaaaggccuucauccagagcagcgagcugauccagcaccagagaauccacaccgacgagaagcccuacgagugcaacgagugcggcaaggccuucaacaagggcagcaaccugaccagacaccagagaauccacaccggcgagaagcccuacgacugcaaggagugcggcaaggccuucggcagcagaagcgaccugaucagacacgagggcauccacaccggcuaa

SEQ ID NO: 26084 - RNA, 5034 nt, Artificial Sequence
  ZNF831__Homo_sapiens__NP_848552
auggaggugcccgagcccaccugccccgccccccccgccagagaccagcccgcccccacccccggcccccccggcgcccccggcggccaggccagcccccaccugacccugggccccgugcugcugccccccgagcagggccuggccccccccaccguguuccugaaggcccugcccaucccccuguaccacaccgugccccccggcggccugcagcccagagccccccuggugaccggcagccuggacggcggcaacgugcccuucauccugagccccgugcugcagcccgagggccccggccccacccaggugggcaagcccgccgcccccacccugaccgugaacaucgugggcacccugcccgugcugagccccggccugggccccacccugggcagccccggcaaggugagaaacgccggcaaguaccugugcccccacugcggcagagacugccugaagcccagcgugcuggagaagcacaucagaagccacaccggcgagagacccuuccccugcgccaccugcggcaucgccuucaagacccagagcaaccuguacaagcacagaagaacccagacccaccugaacaacagcagacugagcagcgagagcgagggcgccggcggcggccugcuggaggagggcgacaaggccggcgagccccccagacccgagggcagaggcgagagcagaugccagggcaugcacgagggcgccagcgagagaccccugagccccggcgcccacgugccccugcuggccaagaaccuggacgugagaaccgaggccgcccccugccccggcagcgccuucgccgacagagaggcccccugggacagcgcccccauggccagccccggccugcccgccgccagcacccagcccuggagaaagcugcccgagcagaagagccccaccgccggcaagcccugcgcccugcagagacagcaggccaccgccgccgagaagcccugggacgccaaggcccccgagggcagacugagaaagugcgagagcaccgacagcggcuaccugagcagaagcgacagcgccgagcagccccacgcccccugcagcccccugcacagccugagcgagcacagcgccgagagcgagggcgagggcggccccggccccggccccggcguggccggcgccgagcccggcgccagagaggccggccuggagcuggagaagaagagacuggaggagagaaucgcccagcugaucagccacaaccaggccgugguggacgacgcccagcuggacaacgugagacccagaaagaccggccugagcaagcagggcagcaucgaccugcccacccccuacaccuacaaggacagcuuccacuucgacaucagagcccuggagcccggcagaagaagagcccccggccccgugagaagcaccuggaccccccccgacaagagcagaccccuguucuuccacagcgugcccacccagcugagcaccaccguggagugcgugcccgugaccagaagcaacagccugcccuucguggagggcagcagaaccuggcuggagcccagagagcccagagaccccuggagcagaacccagaagccccugagccccagacccggccccgccagacugggcugcagaagcggccugagcagcaccgacgugcccagcggccaccccagagcccuggugagacaggccgccguggaggaccugcccggcacccccaucggcgacgcccuggugcccgccgaggacaccgacgccaagagaaccgccgccagagaggccauggccggcaagggcagagccggcggcagaaagugcggccagagaagacugaagauguucagccaggagaaguggcagguguacggcgacgagaccuucaagagaaucuaccagaagaugaaggccagcccccacggcggcaagaaggccagagaggugggcaugggcagcggcgccgagcugggcuucccccugcagaaggaggccgccggcagcagcggcaccgugcccacccaggacagaagaacccccgugcacgaggacaucagcgccggcgccacccccgagcccuggggcaacccccccgcccuggaggccagccuggugaccgagcccaccaagcacggcgagaccguggccagaagaggcgacagcgacagacccagaguggaggaggccgugagcagccccgcccugggcggcagagacagccccugcagcggcagcagaagcccccuggugagccccaacggcagacuggagcugggcuggcagaugccccccgcccccggcccccugaagggcggcgacguggaggcccccagacccguguggcccgaccccaagcuggagggcggcgccagaggcgugggcgacgugcaggagaccugccugugggcccagaccgugcugagauggcccagcagaggcagcggcgaggacaagcugcccagcgagagaaagaagcugaagguggaggaccugcacagcuggaagcagcccgagcccgugagcgccgagacccccggcggccccacccagcccgccagccugagcagccagaagcaggacgccgaccccggcgaggugcccggcggcagcaaggagagcgccagacaggugggcgagccccuggagagcagcggcgccagccuggccgccgccagcguggcccugaagagagugggccccagagacaaggccaccccccugcaccccgccgcccccgcccccgccgagcaccccagccuggccacccccccccaggcccccagagugcugagcgcccuggccgacaacgccuucagccccaaguaccugcugagacugccccaggccgagaccccccugccccugcccauccccuggggccccagacacagccaggacagccugugcagcagcggcuggcccgaggagagagccagcuucgugggcagcggccugggcaccccccugagccccagccccgccagcggccccagccccggcgaggccgacagcauccuggaggaccccagcugcagcagaccccaggacggcagaaagggcgcccagcugggcggcgacaagggcgacagaauggccaccagcagacccgccgccagagagcugcccaucagcgcccccggcgcccccagagaggccaccagcagcccccccacccccaccugcgaggcccaccuggugcaggacauggagggcgacagccacagaauccacagacugugcaugggcagcacccuggccagagccagacugagcggcgacgugcugaaccccugggugcccaacugggagcugggcgagccccccggcaacgcccccgaggaccccagcagcggcccccuggugggccccgaccccugcagcccccugcagcccggcagcuuccugaccgcccugaccagaccccagggcgugccccccggcuggcccgagcuggcccugagcagccacagcggcaccagcagaagccacagcaccagaagcccccacagcacccagaaccccuuccccagccugaaggccgagcccagacugaccuggugcugccugagcagaagcgugccccugcccgccgagcagaaggccaaggccgccagcguguaccuggccgugcacuuccccggcagcagccugagagacgagggccccaacggcccccccggcagcaacggcggcuggaccuggaccagccccggcgagggcggccccgcccagaugagcaaguucagcuaccccaccgugcccggcgugaugccccagcaccaggugagcgagcccgaguggaagaagggccugcccuggagagccaagaugagcagaggcaacagcaagcagagaaagcugaagaucaaccccaagagauacaagggcaacuuccugcagagcugcgugcagcugagagccagcagacugagaacccccaccugggugagaagaagaagcagacacccccccgcccuggagggccugaagcccugcagaacccccggccagaccagcagcgagaucgccggccugaaccugcaggaggagcccagcugcgccaccagcgagagcccccccugcugcggcaaggaggagaagaaggagggcgacugcagacagacccugggcacccugagccugggcaccagcagcagaaucgugagagagauggacaagagaaccgugaaggacaucagccccagcgccggcgagcacggcgacugcaccacccacagcaccgccgccaccagcggccugagccugcagagcgacaccugccuggccguggugaacgacgugccccugccccccggcaagggccuggaccugggccugcuggagacccagcugcuggccagccaggacagcgugagcaccgaccccaagcccuacaucuucagcgacgcccagagacccagcagcuucggcagcaagggcaccuucccccaccacgacaucgccaccagcguggccgccgugugcaucagccugcccgugagaaccgaccacaucgcccaggagauccacagcgccgagagcagagaccacagccagaccgccggcagaacccugaccagcagcagccccgacagcaaggugaccgaggagggcagagcccagacccugcugcccggcagacccagcagcggccagagaaucagcgacagcgugccccuggagagcaccgagaagacccaccuggagauccccgccagcggccccagcagcgccagcagccaccacaaggagggcagacacaagaccuucuuccccagcagaggccaguacggcugcggcgagaugaccgugcccugccccagccugggcagcgacggcagaaagagacaggugagcggccugaucaccagaaaggacagcguggugcccagcaagcccgagcagcccaucgagauccccgaggcccccagcaagagccugaagaagagaagccuggagggcaugagaaagcagaccagaguggaguucagcgacaccagcagcgacgacgaggacagacuggugaucgagaucuaa

SEQ ID NO: 26085 - RNA, 3480 nt, Artificial Sequence
  ZNF91__Homo_sapiens__NP_001287880
augcccggcacccccggcagccuggagaugggccugcugaccuucagagacguggccaucgaguucagccccgaggaguggcagugccuggacaccgcccagcagaaccuguacagaaacgugaugcuggagaacuacagaaaccuggccuuccugggcaucugcccccacuucccccaggacuucuggcccgagcagagcauggaggacagcuuccagaaggugcugcugagaaaguacgagaagugcggccacgagaaccugcagcugagaaagggcugcaagagcguggacgagugcaaggugcacaaggagggcuacaacaagcugaaccagugccugaccaccgcccagagcaagguguuccagugcggcaaguaccugaagguguucuacaaguuccugaacagcaacagacacaccaucagacacaccggcaagaagugcuucaagugcaagaagugcgugaagagcuucugcaucagacugcacaagacccagcacaagugcguguacaucaccgagaagagcugcaagugcaaggagugcgagaagaccuuccacuggagcagcacccugaccaaccacaaggagauccacaccgaggacaagcccuacaagugcgaggagugcggcaaggccuucaagcagcugagcacccugaccacccacaagaucaucugcgccaaggagaagaucuacaagugcgaggagugcggcaaggccuuccuguggagcagcacccugaccagacacaagagaauccacaccggcgagaagcccuacaagugcgaggagugcggcaaggccuucagccacagcagcacccuggccaagcacaagagaauccacaccggcgagaagcccuacaagugcgaggagugcggcaaggccuucagcagaagcagcacccuggccaagcacaagagaauccacaccggcgagaagcccuacaagugcaaggagugcggcaaggccuucagcaacagcagcacccuggccaaccacaagaucacccacaccgaggagaagcccuacaagugcaaggagugcgacaaggccuucaagagacugagcacccugaccaagcacaagaucauccacgccggcgagaagcuguacaagugcgaggagugcggcaaggccuucaacagaagcagcaaccugaccauccacaaguucauccacaccggcgagaagcccuacaagugcgaggagugcggcaaggccuucaacuggagcagcagccugaccaagcacaagagauuccacaccagagagaagcccuucaagugcaaggagugcggcaaggccuucaucuggagcagcacccugaccagacacaagagaauccacaccggcgagaagcccuacaagugcgaggagugcggcaaggccuucagacagagcagcacccugaccaagcacaagaucauccacaccggcgagaagcccuacaaguucgaggagugcggcaaggccuucagacagagccugacccugaacaagcacaagaucauccacagcagagagaagcccuacaagugcaaggagugcggcaaggccuucaagcaguucagcacccugaccacccacaagaucauccacgccggcaagaagcuguacaagugcgaggagugcggcaaggccuucaaccacagcagcagccugagcacccacaagaucauccacaccggcgagaagagcuacaagugcgaggagugcggcaaggccuuccuguggagcagcacccugagaagacacaagagaauccacaccggcgagaagcccuacaagugcgaggagugcggcaaggccuucagccacagcagcgcccuggccaagcacaagagaauccacaccggcgagaagcccuacaagugcaaggagugcggcaaggccuucagcaacagcagcacccuggccaaccacaagaucacccacaccgaggagaagcccuacaagugcaaggagugcgacaagaccuucaagagacugagcacccugaccaagcacaagaucauccacgccggcgagaagcuguacaagugcgaggagugcggcaaggccuucaacagaagcagcaaccugaccauccacaaguucauccacaccggcgagaagcccuacaagugcgaggagugcggcaaggccuucaacuggagcagcagccugaccaagcacaagagaauccacaccagagagaagcccuucaagugcaaggagugcggcaaggccuucaucuggagcagcacccugaccagacacaagagaauccacaccggcgagaagcccuacaagugcgaggagugcggcaaggccuucagcagaagcagcacccugaccaagcacaagaccauccacaccggcgagaagcccuacaagugcaaggagugcggcaaggccuucaagcacagcagcgcccuggccaagcacaagaucauccacgccggcgagaagcuguacaagugcgaggagugcggcaaggccuucaaccagagcagcaaccugaccacccacaagaucauccacaccaaggagaagcccagcaagagcgaggagugcgacaaggccuucaucuggagcagcacccugaccgagcacaagagaauccacaccagagagaagaccuacaagugcgaggagugcggcaaggccuucagccagcccagccaccugaccacccacaagagaaugcacaccggcgagaagcccuacaagugcgaggagugcggcaaggccuucagccagagcagcacccugaccacccacaagaucauccacaccggcgagaagcccuacaagugcgaggagugcggcaaggccuucagaaagagcagcacccugaccgagcacaagaucauccacaccggcgagaagcccuacaagugcgaggagugcggcaaggccuucagccagagcagcacccugaccagacacaccagaaugcacaccggcgagaagcccuacaagugcgaggagugcggcaaggccuucaacagaagcagcaagcugaccacccacaagaucauccacaccggcgagaagcccuacaagugcgaggagugcggcaaggccuucaucagcagcagcacccugaacggccacaagagaauccacaccagagagaagcccuacaagugcgaggagugcggcaaggccuucagccagagcagcacccugaccagacacaagagacugcacaccggcgagaagcccuacaagugcggcgagugcggcaaggccuucaaggagagcagcgcccugaccaagcacaagaucauccacaccggcgagaagcccuacaagugcgagaagugcggcaaggccuucaaccagagcagcauccugaccaaccacaagaagauccacaccaucacccccgugaucccccugcugugggaggccgaggccggcggcagcagaggccaggagauggagaccauccuggccaacaccgugaagccccugcuguacuaa

SEQ ID NO: 26086 - RNA, 1665 nt, Artificial Sequence
  ZNF92__Homo_sapiens__NP_001274461
augggcccccugaccuucagagacgugaagaucgaguucagccuggaggaguggcagugccuggacaccgcccagagaaaccuguacagagacgugaugcuggagaacuacagaaaccugguguuccuggugaugugcagccacuucgcccaggacguguggcccgagcacagcaucaaggacagcuuccagaaggugauccugagaaccuacggcaaguacggccacgagaaccugcagcugagaaaggaccacaagagcguggacgccugcaagguguacaagggcggcuacaacggccugaaccagugccugaccaccaccgacagcaagaucuuccagugcgacaaguacgugaagguguuccacaaguuccccaacgugaacagaaacaagaucagacacaccggcaagaagcccuucaagugcaagaacagaggcaagagcuucugcaugcugagccagcugacccagcacaagaagauccacaccagagaguacagcuacaagugcgaggagugcggcaaggccuucaacuggagcagcacccugaccaagcacaagaucauccacaccggcgagaagcccuacaagugcgaggagugcggcaaggccuucaacagaagcagcaaccugaccaagcacaagaucauccacaccggcgagaagcccuacaagugcgaggagugcggcaaggccuucaacagaagcagcacccugaccaagcacaagagaauccacaccgaggagaagcccuacaagugcgaggagugcggcaaggccuucaaccaguucagcauccugaacaagcacaagagaauccacauggaggacaagcccuacaagugcgaggagugcggcaaggccuucagaguguucagcauccugaagaagcacaagaucauccacaccggcgagaagcccuacaagugcgaggagugcggcaaggccuucaaccaguucagcaaccugaccaagcacaagaucauccacaccggcgagaagcccuacaagugcgacgagugcggcaaggccuucaaccagagcagcacccugaccaagcacaagagaauccacaccggcgagaagcccuacaagugcgaggagugcggcaaggccuucaagcagagcagcacccugaccgagcacaagaucauccacaccggcgagaagcccuacaagugcgagaagugcggcaaggccuucagcuggagcagcgccuucaccaagcacaagagaaaccacauggaggacaagcccuacaagugcgaggagugcggcaaggccuucagcguguucagcacccugaccaagcacaagaucauccacaccagagagaagcccuacaagugcgaggagugcggcaaggccuucaaccagagcagcaucuucaccaagcacaagaucauccacaccgagggcaagagcuacaagugcgagaagugcggcaacgccuucaaccagagcagcaaccugaccgccagaaagaucaucuacaccggcgagaagcccuacaaguacgaggagugcgacaaggccuucaacaaguucagcacccugaucacccaccagaucaucuacaccggcgagaagcccugcaagcacgagugcggcagagccuucaacaagagcagcaacuacaccaaggagaagcugcagaccuaa

SEQ ID NO: 26087 - RNA, 1863 nt, Artificial Sequence
  ZNF93__Homo_sapiens__NP_112495
augggcccccugcaguucagagacguggccaucgaguucagccuggaggaguggcacugccuggacaccgcccagagaaaccuguacagaaacgugaugcuggagaacuacagcaaccugguguuccugggcaucguggugagcaagcccgaccugaucgcccaccuggagcagggcaagaagccccugaccaugaagagacacgagaugguggccaaccccagcgugaucugcagccacuucgcccaggaccuguggcccgagcagaacaucaaggacagcuuccagaaggugauccugagaagauacgagaagagaggccacggcaaccugcagcugaucaagagaugcgagagcguggacgagugcaaggugcacaccggcggcuacaacggccugaaccagugcagcaccaccacccagagcaagguguuccagugcgacaaguacggcaagguguuccacaaguucagcaacagcaacagacacaacaucagacacaccgagaagaagcccuucaagugcaucgagugcggcaaggccuucaaccaguucagcacccugaucacccacaagaagauccacaccggcgagaagcccuacaucugcgaggagugcggcaaggccuucaaguacagcagcgcccugaacacccacaagagaauccacaccggcgagaagcccuacaagugcgacaagugcgacaaggccuucaucgccagcagcacccugagcaagcacgagaucauccacaccggcaagaagcccuacaagugcgaggagugcggcaaggccuucaaccagagcagcacccugaccaagcacaagaagauccacaccggcgagaagcccuacaagugcgaggagugcggcaaggccuucaaccagagcagcacccugaccaagcacaagaagauccacaccggcgagaagcccuacgugugcgaggagugcggcaaggccuucaaguacagcagaauccugaccacccacaagagaauccacaccggcgagaagcccuacaagugcaacaagugcggcaaggccuucaucgccagcagcacccugagcagacacgaguucauccacaugggcaagaagcacuacaagugcgaggagugcggcaaggccuucaucuggagcagcgugcugaccagacacaagagagugcacaccggcgagaagcccuacaagugcgaggagugcggcaaggccuucaaguacagcagcacccugagcagccacaagagaagccacaccggcgagaagcccuacaagugcgaggagugcggcaaggccuucguggccagcagcacccugagcaagcacgagaucauccacaccggcaagaagcccuacaagugcgaggagugcggcaaggccuucaaccagagcagcagccugaccaagcacaagaagauccacaccggcgagaagcccuacaagugcgaggagugcggcaaggccuucaaccagagcagcagccugaccaagcacaagaagauccacaccggcgagaagcccuacaagugcgaggagugcggcaaggccuucaaccagagcagcacccugaucaagcacaagaagauccacaccagagagaagcccuacaagugcgaggagugcggcaaggccuuccaccugagcacccaccugaccacccacaagauccugcacaccggcgagaagcccuacagaugcagagagugcggcaaggccuucaaccacagcgccacccugagcagccacaagaagauccacagcggcgagaagcccuacgagugcgacaagugcggcaaggccuucaucagccccagcagccugagcagacacgagaucauccacaccggcgagaagcccuaa

SEQ ID NO: 26088 - RNA, 1719 nt, Artificial Sequence
  ZNF98__Homo_sapiens__NP_001092096
augcccggcccccugggcagccuggagaugggcgugcugaccuucagagacguggcccuggaguucagccuggaggaguggcagugccuggacaccgcccagcagaaccuguacagaaacgugaugcuggagaacuacagaaaccugguguucgugggcaucgccgccagcaagcccgaccugaucaccugccuggagcagggcaaggagcccuggaacgugaagagacacgagauggugaccgagccccccgugguguacagcuacuucgcccaggaccuguggcccaagcagggcaagaagaacuacuuccagaaggugauccugagaaccuacaagaagugcggcagagagaaccugcagcugagaaaguacugcaagagcauggacgagugcaaggugcacaaggagugcuacaacggccugaaccagugccugaccaccacccagaacaagaucuuccaguacgacaaguacgugaagguguuccacaaguucagcaacagcaacagacacaagaucggccacaccggcaagaagagcuucaagugcaaggagugcgagaagagcuucugcaugcugagccaccuggcccagcacaagagaauccacagcggcgagaagcccuacaagugcaaggagugcggcaaggccuacaacgaggccagcaaccugagcacccacaagagaauccacaccggcaagaagcccuacaagugcgaggagugcggcaaggccuucaacagacugagccaccugaccacccacaagaucauccacaccggcaagaagcccuacaagugcgaggagugcggcaaggccuucaaccagagcgccaaccugaccacccacaagagaauccacaccggcgagaagcccuacaagugcgaggagugcggcagagccuucagccagagcagcacccugaccgcccacaagaucauccacgccggcgagaagcccuacaagugcgaggagugcggcaaggccuucagccagagcagcacccugaccacccacaagaucauccacaccggcgagaaguucuacaagugcgaggagugcggcaaggccuucagcagacugagccaccugaccacccacaagagaauccacagcggcgagaagcccuacaagugcgaggagugcggcaaggccuucaagcagagcagcacccugaccacccacaagagaauccacgccggcgagaaguucuacaagugcgaggugugcagcaaggccuucagcagauucagccaccugaccacccacaagagaauccacaccggcgagaagcccuacaagugcgaggagugcggcaaggccuucaaccugagcagccagcugaccacccacaagaucauccacaccggcgagaagcccuacaagugcgaggagugcggcaaggccuucaaccagagcagcacccugagcaagcacaaggugauccacaccggcgagaagcccuacaagugcgaggagugcggcaaggccuucaaccagagcagccaccugaccacccacaagaugauccacaccggcgagaagcccuacaagugcgaggagugcggcaaggccuucaacaacagcagcauccugaacagacacaagaugauccacaccggcgagaagcuguacaagcccgagagcugcaacaacgccugcgacaacaucgccaagaucagcaaguacaagagaaacugcgccggcgagaaguaa

SEQ ID NO: 26089 - RNA, 5757 nt, Artificial Sequence
  ZNFX1__Homo_sapiens__NP_066363
auggaggagagaagaccccaccuggacgccagacccagaaacagccacaccaaccacagaggccccguggacggcgagcugccccccagagccagaaaccaggccaacaacccccccgccaacgcccugagaggcggcgccagccaccccggcagacaccccagagccaacaaccaccccgccgccuacuggcagagagaggagagauucagagccaugggcagaaacccccaccagggcagaagaaaccaggagggccacgccagcgacgaggccagagaccagagacacgaccaggagaacgacaccagauggagaaacggcaaccaggacugcagaaacagaagaccccccuggagcaacgacaacuuccagcaguggagaaccccccaccagaagcccaccgagcagccccagcaggccaagaagcugggcuacaaguuccuggagagccugcugcagaaggaccccagcgagguggugaucacccuggccaccagccugggccugaaggagcugcugagccacagcagcaugaagagcaacuuccuggagcugaucugccaggugcugagaaaggccugcagcagcaagauggacagacagagcgugcugcacgugcugggcauccugaagaacagcaaguuccugaaggugugccugcccgccuacguggugggcaugaucaccgagcccauccccgacaucagaaaccaguaccccgagcacaucagcaacaucaucagccugcugcaggaccuggugagcguguuccccgccagcagcgugcaggagaccagcaugcuggugagccugcugcccaccagccugaacgcccugagagccagcggcguggacaucgaggaggagaccgagaagaaccuggagaaggugcagaccaucaucgagcaccugcaggagaagagaagagagggcacccugagaguggacaccuacacccuggugcagcccgaggccgaggaccacguggagagcuacagaaccaugcccaucuaccccaccuacaacgaggugcaccuggacgagagacccuuccugagacccaacaucaucagcggcaaguacgacagcaccgccaucuaccuggacacccacuucagacugcugagagaggacuucgugagaccccugagagagggcauccuggagcugcugcagagcuucgaggaccagggccugagaaagagaaaguucgacgacaucagaaucuacuucgacaccagaaucaucacccccaugugcagcagcagcggcaucguguacaaggugcaguucgacaccaagccccugaaguucgugagauggcagaacagcaagagacugcuguacggcagccuggugugcaugagcaaggacaacuucgagaccuuccuguucgccaccgugagcaacagagagcaggaggaccugugcagaggcaucgugcagcugugcuucaacgagcagagccagcagcugcuggccgaggugcagcccagcgacagcuuccugaugguggagaccaccgccuacuucgaggccuacagacacgugcuggagggccugcaggaggugcaggaggaggacgugcccuuccagagaaacaucguggagugcaacagccacgugaaggagcccagauaccugcugaugggcggcagauacgacuucaccccccugaucgagaaccccagcgccaccggcgaguuccugagaaacguggagggccugagacaccccagaaucaacgugcuggaccccggccaguggcccagcaaggaggcccugaagcuggacgacagccagauggaggcccugcaguucgcccugaccagagagcuggccaucauccagggcccccccggcaccggcaagaccuacgugggccugaagaucgugcaggcccugcugaccaacgagagcguguggcagaucagccugcagaaguuccccauccugguggugugcuacaccaaccacgcccuggaccaguuccuggagggcaucuacaacugccagaagaccagcaucgugagagugggcggcagaagcaacagcgagauccugaagcaguucacccugagagagcugagaaacaagagagaguucagaagaaaccugcccaugcaccugagaagagccuacaugagcaucaugacccagaugaaggagagcgagcaggagcugcacgagggcgccaagacccuggagugcaccaugagaggcgugcugagagagcaguaccugcagaaguacaucagcccccagcacugggagagccugaugaacggccccgugcaggacagcgaguggaucugcuuccagcacuggaagcacagcaugaugcuggaguggcugggccugggcgugggcagcuucacccagagcgugagccccgccggccccgagaacaccgcccaggccgagggcgacgaggaggaggagggcgaggaggagagcagccugaucgagaucgccgaggaggccgaccugauccaggccgacagagugaucgaggaggaggagguggugagaccccagagaagaaagaaggaggagagcggcgccgaccaggagcuggccaagaugcugcuggccaugagacuggaccacugcggcaccggcaccgccgccggccaggagcaggccaccggcgaguggcagacccagagaaaccagaagaagaagaugaagaagagagugaaggacgagcugagaaagcugaacaccaugaccgccgccgaggccaacgagaucgaggacguguggcagcuggaccugagcagcagauggcagcuguacagacuguggcugcagcuguaccaggccgacaccagaagaaagauccugagcuacgagagacaguacagaaccagcgccgagagaauggccgagcugagacugcaggaggaccugcacauccugaaggacgcccagguggugggcaugaccaccaccggcgccgccaaguacagacagauccugcagaagguggagcccagaaucgugaucguggaggaggccgccgaggugcuggaggcccacaccaucgccacccugagcaaggccugccagcaccugauccugaucggcgaccaccagcagcugagacccagcgccaacguguacgaccuggccaagaacuucaaccuggaggugagccuguucgagagacuggugaaggugaacauccccuucgugagacugaacuaccagcacagaaugugccccgagaucgccagacugcugaccccccacaucuaccaggaccuggagaaccaccccagcgugcugaaguacgagaagaucaagggcgugagcagcaaccuguucuucguggagcacaacuuccccgagcaggagauccaggagggcaagagccaccagaaccagcacgaggcccacuucgugguggagcugugcaaguacuuccugugccaggaguaccugcccagccagaucaccauccugaccaccuacaccggccagcuguucugccugagaaagcugaugcccgccaagaccuucgccggcgugagagugcacgugguggacaaguaccagggcgaggagaacgacaucauccugcugagccuggugagaagcaaccaggagggcaaggugggcuuccugcagaucagcaacagaaucugcguggcccugagcagagccaagaagggcauguacugcaucggcaacaugcagaugcuggccaaggugccccuguggagcaagaucauccacacccugagagagaacaaccagaucggccccaugcugagacugugcugccagaaccaccccgagacccacacccuggugagcaaggccagcgacuuccagaaggugcccgagggcggcugcagccugcccugcgaguucagacugggcugcggccacgugugcaccagagccugccaccccuacgacagcagccacaaggaguuccagugcaugaagcccugccagaaggugaucugccaggagggccacagaugcccccuggugugcuuccaggagugccagcccugccaggugaaggugcccaagaccauccccagaugcggccacgagcagauggugcccugcagcgugcccgagagcgacuucugcugccaggagcccugcagcaagagccugagaugcggccacagaugcagccaccccugcggcgaggacugcgugcagcugugcagcgagauggugaccaucaagcugaagugcggccacagccagcccgugaagugcggccacguggagggccugcuguacggcggccugcuggugaagugcaccaccaagugcggcaccauccuggacugcggccaccccugccccggcagcugccacagcugcuucgagggcagauuccacgagagaugccagcagcccugcaagagacugcugaucugcagccacaagugccaggagcccugcaucggcgagugcccccccugccagagaaccugccagaacagaugcgugcacagccagugcaagaagaagugcggcgagcugugcagccccugcguggagcccugcguguggagaugccagcacuaccagugcaccaagcugugcagcgagcccugcaacagaccccccugcuacgugcccugcaccaagcugcuggugugcggccaccccugcaucggccugugcggcgagcccugccccaagaagugcagaaucugccacauggacgaggugacccagaucuucuucggcuucgaggacgagcccgacgccagauucgugcagcuggaggacugcagccacaucuucgaggugcaggcccuggacagauacaugaacgagcagaaggacgacgagguggccaucagacugaaggugugccccaucugccaggugcccaucagaaagaaccugagauacggcaccagcaucaagcagagacuggaggagaucgagaucaucaaggagaagauccagggcagcgccggcgagaucgccaccagccaggagagacugaaggcccugcuggagagaaagagccugcugcaccagcugcugcccgaggacuuccugaugcugaaggagaagcuggcccagaagaaccugagcgugaaggaccugggccugguggagaacuacaucagcuucuacgaccaccuggccagccugugggacagccugaagaagaugcacgugcuggaggagaagagagugagaaccagacuggagcaggugcacgaguggcuggccaagaagagacugagcuucaccagccaggagcugagcgaccugagaagcgagauccagagacugaccuaccuggugaaccugcugaccagauacaagaucgccgagaagaaggugaaggacagcaucgccguggagguguacagcgugcagaacauccuggagaagaccugcaaguucacccaggaggacgagcagcuggugcaggagaagauggaggcccugaaggccacccugcccugcagcggccugggcaucagcgaggaggagagagugcagaucgugagcgccaucggcuaccccagaggccacugguucaagugcagaaacggccacaucuacgugaucggcgacugcggcggcgccauggagagaggcaccugccccgacugcaaggaggugaucggcggcaccaaccacacccuggagagaagcaaccagcuggccagcgagauggacggcgcccagcacgccgccuggagcgacaccgccaacaaccugaugaacuucgaggagauccagggcaugauguaa

SEQ ID NO: 26090 - RNA, 1212 nt, Artificial Sequence
  ZNHIT2__Homo_sapiens__NP_055020
auggagcccgccggccccugcggcuucugccccgccggcgaggugcagcccgccagauacaccugccccagaugcaacgcccccuacugcagccugagaugcuacagaacccacggcaccugcgccgagaacuucuacagagaccaggugcugggcgagcugagaggcugcagcgccccccccagcagacuggccagcgcccugagaagacugagacagcagagagagaccgaggacgagcccggcgaggccggccugagcagcggccccgcccccggcggccugagcggccugugggagagacuggcccccggcgagaaggccgccuucgagagacugcugagcagaggcgaggccggcagacugcugccccccuggagacccuggugguggaacagaggcgccggcccccagcugcuggaggagcuggacaacgcccccggcagcgacgccgccgagcuggagcuggcccccgccagaaccccccccgacagcgugaaggacgccagcgccgccgagcccgccgccgccgagagagugcugggcgacgugcccggcgccugcacccccguggugcccaccagaauccccgccaucgugagccugagcagaggccccgugagcccccuggugagauuccagcugcccaacgugcuguucgccuacgcccacacccuggcccuguaccacggcggcgacgacgcccugcugagcgacuucugcgccacccugcugggcgugagcggcgcccugggcgcccagcagguguucgccagcgccgaggaggcccugcaggccgccgcccacgugcuggaggccggcgagcacccccccggcccccugggcaccagaggcgccaugcacgagguggccagaauccugcugggcgagggccccaccaaccagaagggcuacacccuggccgcccugggcgaccuggcccagacccugggcagagccagaaagcaggccguggccagagaggagagagaccaccuguacagagccagaaagaagugccaguuccugcuggccuggaccaacgagaacgaggccgcccugaccccccuggcccuggacugcgccagagcccaccaggcccacgccgugguggccgaggagguggccgcccugaccggcgagcuggagagacuguggggcggccccgugccccccgcccccagaacccugaucgaggagcugcccagcuaa

SEQ ID NO: 26091 - RNA, 468 nt, Artificial Sequence
  ZNHIT3__Homo_sapiens__NP_004764
auggccagccugaagugcagcaccguggugugcgugaucugccuggagaagcccaaguacagaugccccgccugcagagugcccuacugcagcguggugugcuucagaaagcacaaggagcagugcaaccccgagaccagacccguggagaagaagaucagaagcgcccugcccaccaagaccgugaagcccguggagaacaaggacgacgacgacagcaucgccgacuuccugaacagcgacgaggaggaggacagagugagccugcagaaccugaagaaccugggcgagagcgccacccugagaagccugcugcugaacccccaccugagacagcugauggugaaccuggaccagggcgaggacaaggccaagcugaugagagccuacaugcaggagccccuguucguggaguucgccgacugcugccugggcaucguggagcccagccagaacgaggagagcuaa

SEQ ID NO: 26092 - RNA, 381 nt, Artificial Sequence
  ZNRD1__Homo_sapiens__NP_001265715
augagcgugauggaccuggccaacaccugcagcagcuuccagagcgaccuggacuucugcagcgacugcggcagcgugcugccccugcccggcgcccaggacaccgugaccugcaucagaugcggcuucaacaucaacgugagagacuucgagggcaagguggugaagaccagcgugguguuccaccagcugggcaccgccaugcccaugagcguggaggagggccccgagugccagggccccgugguggacagaagaugccccagaugcggccacgagggcauggccuaccacaccagacagaugagaagcgccgacgagggccagaccguguucuacaccugcaccaacugcaaguuccaggagaaggaggacagcuaa

SEQ ID NO: 26093 - RNA, 2811 nt, Artificial Sequence
  ZNRF3__Homo_sapiens__NP_001193927
augagacccagaagcggcggcagacccggcgccaccggcagaagaagaagaagacugagaagaagacccagaggccugagaugcagcagacugccccccccccccccccugccccugcugcugggccugcugcuggccgccgccggccccggcgccgccagagccaaggagaccgccuucguggagguggugcuguucgagagcagccccagcggcgacuacaccaccuacaccaccggccugaccggcagauucagcagagccggcgccacccugagcgccgagggcgagaucgugcagaugcacccccugggccugugcaacaacaacgacgaggaggaccuguacgaguacggcugggugggcguggugaagcuggagcagcccgagcuggaccccaagcccugccugaccgugcugggcaaggccaagagagccgugcagagaggcgccaccgccgugaucuucgacgugagcgagaaccccgaggccaucgaccagcugaaccagggcagcgaggacccccugaagagacccgugguguacgugaagggcgccgacgccaucaagcugaugaacaucgugaacaagcagaagguggccagagccagaauccagcacagaccccccagacagcccaccgaguacuucgacaugggcaucuuccuggccuucuucgugguggugagccuggugugccugauccugcuggugaagaucaagcugaagcagagaagaagccagaacagcaugaacagacuggccgugcaggcccuggagaagauggagaccagaaaguucaacagcaagagcaagggcagaagagagggcagcugcggcgcccuggacacccugagcagcagcagcaccagcgacugcgccaucugccuggagaaguacaucgacggcgaggagcugagagugauccccugcacccacagauuccacagaaagugcguggaccccuggcugcugcagcaccacaccugcccccacugcagacacaacaucaucgagcagaagggcaaccccagcgccgugugcguggagaccagcaaccugagcagaggcagacagcagagagugacccugcccgugcacuaccccggcagagugcacagaaccaacgccauccccgccuaccccaccagaaccagcauggacagccacggcaaccccgugacccugcugaccauggacagacacggcgagcagagccuguacagcccccagacccccgccuacaucagaagcuaccccccccugcaccuggaccacagccuggccgcccacagaugcggccuggagcacagagccuacagccccgcccaccccuucagaagacccaagcugagcggcagaagcuucagcaaggccgccugcuucagccaguacgagaccauguaccagcacuacuacuuccagggccugagcuaccccgagcaggagggccagagcccccccagccuggcccccagaggccccgccagagccuucccccccagcggcagcggcagccugcuguuccccaccguggugcacguggccccccccagccaccuggagagcggcagcaccagcagcuucagcugcuaccacggccacagaagcgugugcagcggcuaccuggccgacugccccggcagcgacagcagcagcagcagcagcagcggccagugccacugcagcagcagcgacagcgugguggacugcaccgaggugagcaaccagggcguguacggcagcugcagcaccuucagaagcagccugagcagcgacuacgaccccuucaucuacagaagcagaagccccugcagagccagcgaggccggcggcagcggcagcagcggcagaggccccgcccugugcuucgagggcagccccccccccgaggagcugcccgccgugcacagccacggcgccggcagaggcgagcccuggcccggccccgccagccccagcggcgaccaggugagcaccugcagccuggagaugaacuacagcagcaacagcagccuggagcacagaggccccaacagcagcaccagcgaggugggccuggaggccagccccggcgccgcccccgaccugagaagaaccuggaagggcggccacgagcugcccagcugcgccugcugcugcgagccccagcccagccccgccggccccagcgccggcgccgccggcagcagcacccuguuccugggcccccaccuguacgagggcagcggccccgccggcggcgagccccagagcggcagcagccagggccuguacggccugcaccccgaccaccugcccagaaccgacggcgugaaguacgagggccugcccugcugcuucuacgaggagaagcagguggccagaggcggcggcggcggcagcggcugcuacaccgaggacuacagcgugagcgugcaguacacccugaccgaggagcccccccccggcugcuaccccggcgccagagaccugagccagagaauccccaucauccccgaggacguggacugcgaccugggccugcccagcgacugccagggcacccacagccugggcagcuggggcggcaccagaggccccgacacccccagaccccacagaggccugggcgccaccagagaggaggagagagcccugugcugccaggccagagcccugcugagacccggcugcccccccgaggaggccggcgccgugagagccaacuuccccagcgcccugcaggacacccaggagagcagcaccaccgccaccgaggccgccggccccagaagccacagcgccgacagcagcagccccggcgccuaa

SEQ ID NO: 26094 - RNA, 1917 nt, Artificial Sequence
  ZP1__Homo_sapiens__NP_997224
auggccggcggcagcgccaccaccuggggcuaccccguggcccugcugcugcugguggccacccugggccugggcagauggcugcagcccgaccccggccugcccggccugagacacagcuacgacugcggcaucaagggcaugcagcugcugguguuccccagacccggccagacccugagauucaaggugguggacgaguucggcaacagauucgacgugaacaacugcagcaucugcuaccacugggugaccagcagaccccaggagcccgccguguucagcgccgacuacagaggcugccacgugcuggagaaggacggcagauuccaccugagaguguucauggaggccgugcugcccaacggcagaguggacguggcccaggacgccacccugaucugccccaagcccgaccccagcagaacccuggacagccagcuggccccccccgccauguucagcgugagcaccccccagacccugagcuuccugcccaccagcggccacaccagccagggcagcggccacgccuuccccagcccccuggaccccggccacagcagcgugcaccccacccccgcccugcccagccccggccccggccccacccuggccacccuggcccagccccacuggggcacccuggagcacugggacgugaacaagagagacuacaucggcacccaccugagccaggagcagugccagguggccagcggccaccugcccugcaucgugagaagaaccagcaaggaggccugccagcaggccggcugcugcuacgacaacaccagagaggugcccugcuacuacggcaacaccgccaccgugcagugcuucagagacggcuacuucgugcugguggugagccaggagauggcccugacccacagaaucacccuggccaacauccaccuggccuacgcccccaccagcugcagccccacccagcacaccgaggccuucgugguguucuacuucccccugacccacugcggcaccaccaugcagguggccggcgaccagcugaucuacgagaacuggcuggugagcggcauccacauccagaagggcccccagggcagcaucaccagagacagcaccuuccagcugcacgugagaugcguguucaacgccagcgacuuccugcccauccaggccagcaucuuccccccccccagccccgcccccaugacccagcccggcccccugagacuggagcugagaaucgccaaggacgagaccuucagcagcuacuacggcgaggacgacuaccccaucgugagacugcugagagagcccgugcacguggaggugagacugcugcagagaaccgaccccaaccuggugcugcugcugcaccagugcuggggcgcccccagcgccaaccccuuccagcagccccaguggcccauccugagcgacggcugccccuucaagggcgacagcuacagaacccagaugguggcccuggacggcgccacccccuuccagagccacuaccagagauucaccguggccaccuucgcccugcuggacagcggcagccagagagcccugagaggccugguguaccuguucugcagcaccagcgccugccacaccagcggccuggagaccugcagcaccgccugcagcaccggcaccaccagacagagaagaagcagcggccacagaaacgacaccgccagaccccaggacaucgugagcagccccggccccgugggcuucgaggacagcuacggccaggagcccacccugggccccaccgacagcaacggcaacagcagccugagaccccugcugugggccgugcugcugcugcccgccguggcccuggugcugggcuucggcguguucgugggccugagccagaccugggcccagaagcugugggagagcaacagacaguaa

SEQ ID NO: 26095 - RNA, 1623 nt, Artificial Sequence
  ZP4__Homo_sapiens__NP_067009
auguggcugcugagaugcgugcugcugugcgugagccugagccuggccgugagcggccagcacaagcccgaggcccccgacuacagcagcgugcugcacugcggccccuggagcuuccaguucgccgugaaccugaaccaggaggccaccagcccccccgugcugaucgccugggacaaccagggccugcugcacgagcugcagaacgacagcgacugcggcaccuggaucagaaagggccccggcagcagcguggugcuggaggccaccuacagcagcugcuacgugaccgagugggacagccacuacaucaugcccgugggcguggagggcgccggcgccgccgagcacaagguggugaccgagagaaagcugcugaagugccccauggaccugcuggccagagacgcccccgacaccgacuggugcgacagcauccccgccagagacagacugcccugcgcccccagccccaucagcagaggcgacugcgagggccugggcugcugcuacagcagcgaggaggugaacagcugcuacuacggcaacaccgugacccugcacugcaccagagagggccacuucagcaucgccgugagcagaaacgugaccagccccccccugcugcuggacagcgugagacuggcccugagaaacgacagcgccugcaaccccgugauggccacccaggccuucgugcuguuccaguuccccuucaccagcugcggcaccaccagacagaucaccggcgacagagccguguacgagaacgagcugguggccaccagagacgugaagaacggcagcagaggcagcgugaccagagacagcaucuucagacugcacgugagcugcagcuacagcgugagcagcaacagccugcccaucaacgugcagguguucacccugcccccccccuuccccgagacccagcccggcccccugacccuggagcugcagaucgccaaggacaagaacuacggcagcuacuacggcgugggcgacuaccccguggugaagcugcugagagaccccaucuacguggaggugagcauccugcacagaaccgaccccuaccugggccugcugcugcagcagugcugggccacccccagcaccgacccccugagccagccccaguggcccauccuggugaagggcugccccuacaucggcgacaacuaccagacccagcugauccccgugcagaaggcccuggaccugcccuuccccagccaccaccagagauucagcaucuucaccuucagcuucgugaaccccaccguggagaagcaggcccugagaggccccgugcaccugcacugcagcgugagcgugugccagcccgccgagacccccagcugcguggugaccugccccgaccugagcagaagaagaaacuucgacaacagcagccagaacaccaccgccagcgugagcagcaagggccccaugauccugcugcaggccaccaaggacccccccgagaagcugagagugcccguggacagcaaggugcuguggguggccggccugagcggcacccugauccugggcgcccugcuggugagcuaccuggccgugaagaagcagaagagcugccccgaccagaugugccaguaa

SEQ ID NO: 26096 - RNA, 951 nt, Artificial Sequence
  ZPBP2__Homo_sapiens__NP_942141
augaugagaaccugcgugcugcugagcgccgugcuguggugccugaccggcgacaagaucuacguggagcugcaccagaacagccccgugcugaucugcauggacuucaagcugagcaagaaggagaucguggaccccaccuaccuguggaucggccccaacgagaagacccugaccggcaacaacagaaucaacaucaccgagaccggccagcugauggugaaggacuuccuggagccccugagcggccuguacaccugcacccugagcuacaagaccgugaaggccgagacccaggaggagaagaccgugaagaagagauacgacuucaugguguucgccuacagagagcccgacuacagcuaccagauggccgugagauucaccaccagaagcugcaucggcagauacaacgacguguucuucagagugcugaagaagauccuggacagccugaucagcgaccugagcugccacgugaucgagcccagcuacaagugccacagcguggagauccccgagcacggccugauccacgagcuguucaucgccuuccaggugaaccccuucgcccccggcuggaagggcgccugcaacggcagcguggacugcgaggacaccaccaaccacaacauccugcaggccagagacagaaucgaggacuucuucagaagccaggccuacaucuucuaccacaacuucaacaagacccugcccgccaugcacuucguggaccacagccugcagguggugagacuggacagcugcagacccggcuucggcaagaacgagagacugcacagcaacugcgccagcugcugcguggugugcagccccgccaccuucagccccgacgugaacgugaccugccagaccugcgugagcgugcugaccuacggcgccaagagcugcccccagaccagcaacaagaaccagcaguacgaggacuaa

SEQ ID NO: 26097 - RNA, 1296 nt, Artificial Sequence
  ZPLD1__Homo_sapiens__NP_778226
augaugcugagauucagcaugugcagaggcaacgacgagggcuucgccauggagcagaucuggcugcugcugcugcugaccaucagagugcugcccggcagcgcccaguucaacggcuacaacugcgacgccaaccugcacagcagauuccccgccgagagagacaucagcguguacugcggcgugcaggccaucaccaugaagaucaacuucugcaccgugcuguucagcggcuacagcgagaccgaccuggcccugaacggcagacacggcgacagccacugcagaggcuucaucaacaacaacaccuuccccgccguggugaucuucaucaucaaccugagcacccuggagggcugcggcaacaaccugguggugagcaccauccccggcgugagcgccuacggcaacgccaccagcgugcaggugggcaacaucagcggcuacaucgacacccccgacccccccaccaucaucagcuaccugcccggccugcuguacaaguucagcugcagcuacccccuggaguaccuggugaacaacacccagcuggccagcagcagcgccgccaucagcgugagagagaacaacggcaccuucgugagcacccugaaccugcugcuguacaacgacagcaccuacaaccagcagcugaucauccccagcaucggccugccccugaagaccaagguguucgccgccgugcaggccaccaaccuggacggcagauggaacgugcugauggacuacugcuacaccacccccagcggcaaccccaacgacgacaucagauacgaccuguuccugagcugcgacaaggacccccagaccaccgugaucgagaacggcagaagccagagaggcagauucagcuucgagguguucagauucgugaagcacaagaaccagaagaugagcaccguguuccugcacugcgugaccaagcugugcagagccgacgacugccccuuccugaugcccaucugcagccacagagagagaagagacgccggcagaagaaccaccuggagcccccagagcagcagcggcagcgccgugcugagcgccggccccaucaucaccagaagcgacgagacccccaccaacaacagccagcugggcagccccagcaugccccccuuccagcugaacgccaucaccagcgcccugaucagcggcauggugauccugggcgugaccagcuucagccugcugcugugcagccuggcccugcugcacagaaagggccccaccagccuggugcugaacggcaucagaaaccccguguucgacuaa

SEQ ID NO: 26098 - RNA, 1380 nt, Artificial Sequence
  ZPR1__Homo_sapiens__NP_003895
auggccgccagcggcgccguggagcccggcccccccggcgccgccguggcccccagccccgcccccgcccccccccccgcccccgaccaccuguucagacccaucagcgccgaggacgaggagcagcagcccaccgagaucgagagccugugcaugaacugcuacugcaacggcaugaccagacugcugcugaccaagauccccuucuucagagagaucaucgugagcagcuucagcugcgagcacugcggcuggaacaacaccgagauccagagcgccggcagaauccaggaccagggcgugagauacacccugagcgugagagcccuggaggacaugaacagagagguggugaagaccgacagcgccgccaccagaauccccgagcuggacuucgagauccccgccuucagccagaagggcgcccugaccaccguggagggccugaucaccagagccaucagcggccuggagcaggaccagcccgccagaagagccaacaaggacgccaccgccgagagaaucgacgaguucaucgugaagcugaaggagcugaagcagguggccagccccuucacccugaucaucgacgaccccagcggcaacagcuucguggagaacccccacgccccccagaaggacgacgcccuggugaucacccacuacaacagaaccagacagcaggaggagaugcugggccugcaggaggaggcccccgccgagaagcccgaggaggaggaccugagaaacgaggugcugcaguucagcaccaacugccccgagugcaacgcccccgcccagaccaacaugaagcuggugcagaucccccacuucaaggaggugaucaucauggccaccaacugcgagaacugcggccacagaaccaacgaggugaagagcggcggcgccguggagccccugggcaccagaaucacccugcacaucaccgacgccagcgacaugaccagagaccugcugaagagcgagaccugcagcguggagauccccgagcuggaguucgagcugggcauggccgugcugggcggcaaguucaccacccuggagggccugcugaaggacaucagagagcuggugaccaagaaccccuucacccugggcgacagcagcaaccccggccagaccgagagacugcaggaguucagccagaagauggaccagaucaucgagggcaacaugaaggcccacuucaucauggacgaccccgccggcaacagcuaccugcagaacguguacgcccccgaggacgaccccgagaugaagguggagagauacaagagaaccuucgaccagaacgaggagcugggccugaacgacaugaagaccgagggcuacgaggccggccuggccccccagagauaa

SEQ ID NO: 26099 - RNA, 3234 nt, Artificial Sequence
  ZRANB3__Homo_sapiens__NP_001273497
augcccagagugcacaacaucaagaagagccugaccccccacaucagcugcgugaccaacgagagcgacaaccugcuggacuuccugcccgacagacugagagccaagcugcugcccuuccagaaggacggcaucaucuucgcccugaagagaaacggcagaugcaugguggccgacgagaugggccugggcaagaccauccaggccaucggcaucaccuacuucuacaaggaggaguggccccugcugaucguggugcccagcagccugagauaccccuggaccgaggagaucgagaaguggauccccgagcugagccccgaggagaucaacgugauccagaacaagaccgacgugagaagaaugagcaccagcaaggugaccgugcugggcuacggccugcugaccgccgacgccaagacccugaucgacgcccugaacaaccagaacuucaagguggugaucguggacgagagccacuacaugaagagcagaaacgccaccagaagcagaauccugcugcccaucgugcagaaggccagaagagccauccugcugaccggcacccccgcccugggcagacccgaggagcuguucaugcagaucgaggcccuguucccccagaaguucggcagauggaccgacuacgccaagagauacugcaacgcccacaucagauacuucggcaagagaccccagugggacugcagaggcgccagcaaccugaacgagcugcaccagcugcugagcgacaucaugaucagaagacugaagaccgaggugcugacccagcugccccccaaggugagacagagaauccccuucgaccugcccagcgccgccgccaaggagcugaacaccagcuucgaggagugggagaagaucaugagaacccccaacagcggcgccauggagaccgugaugggccugaucaccagaauguucaagcagaccgccaucgccaaggccggcgccgugaaggacuacaucaagaugaugcugcagaacgacagccugaaguuccugguguucgcccaccaccugagcaugcugcaggccugcaccgaggccgugaucgagaacaagaccagauacaucagaaucgacggcagcgugagcagcagcgagagaauccaccuggugaaccaguuccagaaggaccccgacaccagaguggccauccugagcauccaggccgccggccagggccugaccuucaccgccgccagccacgugguguucgccgagcuguacugggaccccggccacaucaagcaggccgaggacagagcccacagaaucggccagugcagcagcgugaacauccacuaccugaucgccaacggcacccuggacacccugauguggggcaugcugaacagaaaggcccaggugaccggcagcacccugaacggcagaaaggagaagauccaggccgaggagggcgacaaggagaagugggacuuccugcaguucgccgaggccuggacccccaacgacagcagcgaggagcugagaaaggaggcccuguucacccacuucgagaaggagaagcagcacgacaucagaagcuucuucgugccccagcccaagaagagacagcugaugaccagcugcgacgagagcaagagauucagagaggagaacaccguggugagcagcgaccccaccaagaccgccgccagagacaucaucgacuacgagagcgacguggagcccgagaccaagagacugaagcuggccgccagcgaggaccacugcagccccagcgaggagacccccagccagagcaagcagaucagaaccccccugguggagagcgugcaggaggccaaggcccagcugaccacccccgccuuccccguggagggcuggcagugcagccugugcaccuacaucaacaacagcgagcugcccuacugcgagaugugcgagaccccccagggcagcgccgugaugcagaucgacagccugaaccacauccaggacaagaacgagaaggacgacagccagaaggacaccagcaagaaggugcagaccaucagcgacugcgagaagcaggcccuggcccagagcgagcccggccagcuggccgacagcaaggaggagacccccaagaucgagaaggaggacggccugaccagccagcccgagcaguggaagagcagcgacacccugcccguguacgacacccugauguucugcgccagcagaaacaccgacagaauccacaucuacaccaaggacggcaagcagaugagcugcaacuucaucccccuggacaucaagcuggaccugugggaggaccugcccgccagcuuccagcugaagcaguacagaagccugauccugagauucgugagagaguggagcagccugaccgccaugaagcagagaaucaucagaaagagcggccagcuguucugcagccccauccuggcccuggaggagaucaccaagcagcagaccaagcagaacugcaccaagagauacaucaccaaggaggacguggccguggccagcauggacaaggugaagaacgugggcggccacgugagacugaucaccaaggagagcagacccagagaccccuucaccaagaagcugcuggaggacggcgccugcgugcccuuccugaaccccuacaccgugcaggccgaccugaccgugaagcccagcaccagcaagggcuaccugcaggccguggacaacgagggcaacccccugugccugagaugccagcagcccaccugccagaccaagcaggccugcaaggccaacagcugggacagcagauucugcagccugaagugccaggaggaguucuggaucagaagcaacaacagcuaccugagagccaagguguucgagaccgagcacggcgugugccagcugugcaacgugaacgcccaggagcuguuccugagacugagagacgcccccaagagccagagaaagaaccugcuguacgccaccuggaccagcaagcugccccuggagcagcugaacgagaugaucagaaaccccggcgagggccacuucuggcagguggaccacaucaagcccguguacggcggcggcggccagugcagccuggacaaccugcagacccugugcaccgugugccacaaggagagaaccgccagacaggccaaggagagaagccaggugagaagacagagccuggccagcaagcacggcagcgacaucaccagauuccuggugaagaaguaa

SEQ ID NO: 26100 - RNA, 1449 nt, Artificial Sequence
  ZRSR2__Homo_sapiens__NP_005080
auggccgcccccgagaagaugaccuuccccgagaagcccagccacaagaaguacagagccgcccugaagaaggagaagagaaagaagagaagacaggagcuggccagacugagagacagcggccugagccagaaggaggaggaggaggacaccuucaucgaggagcagcagcuggaggaggagaagcugcuggagagagagagacagagacugcacgaggaguggcugcugagagagcagaaggcccaggaggaguucagaaucaagaaggagaaggaggaggccgccaagaagagacaggaggagcaggagagaaagcugaaggagcagugggaggagcagcagagaaaggagagagaggaggaggagcagaagagacaggagaagaaggagaaggaggaggcccugcagaagaugcuggaccaggccgagaacgagcuggagaacggcaccaccuggcagaaccccgagccccccguggacuucagagugauggagaaggacagagccaacugccccuucuacagcaagaccggcgccugcagauucggcgacagaugcagcagaaagcacaacuuccccaccagcagccccacccugcugaucaagagcauguucaccaccuucggcauggagcagugcagaagagacgacuacgaccccgacgccagccuggaguacagcgaggaggagaccuaccagcaguuccuggacuucuacgaggacgugcugcccgaguucaagaacgugggcaaggugauccaguucaaggugagcugcaaccuggagccccaccugagaggcaacguguacgugcaguaccagagcgaggaggagugccaggccgcccugagccuguucaacggcagaugguacgccggcagacagcugcagugcgaguucugccccgugaccagauggaagauggccaucugcggccuguucgagauccagcagugccccagaggcaagcacugcaacuuccugcacguguucagaaaccccaacaacgaguucugggaggccaacagagacaucuaccugagccccgacagaaccggcagcagcuucggcaagaacagcgagagaagagagagaaugggccaccacgacgacuacuacagcagacugagaggcagaagaaaccccagccccgaccacagcuacaagagaaacggcgagagcgagagaaagagcagcagacacagaggcaagaagagccacaagagaaccagcaagagcagagagagacacaacagcagaagcagaggcagaaacagagacagaagcagagacagaagcagaggcagaggcagcagaagcagaagcagaagcagaagcagaagaagcagaagaagcagaagccagagcagcagcagaagcagaagcagaggcagaagaagaagcggcaacagagacagaaccgugcagagccccaagagcaaguaa

SEQ ID NO: 26101 - RNA, 1701 nt, Artificial Sequence
  ZSCAN18__Homo_sapiens__NP_001139014
augagaagagugggcggcagagccgacgaggacgccaccgccgccggcagccugugggugcuggccccccccgagcccaccggccaccuggugauccccggcaccagcccccuggagccccccugccccuggcuggacagccacaucuuccagugcagauucggcaagaugcugccccuggagaaggccuucgccagccccagaagcagccccgccccccccgaccugcccacccccggcagcgccgccggcgugcagcaggaggagcccgagaccauccccgagagaacccccgccgaccuggaguucagcagacugagauucagagaguucguguaccaggaggccgccggcccccaccagacccuggccagacugcacgagcugugcagacaguggcugaugcccgaggccagaagcaaggagcagaugcuggagcugcuggugcuggagcaguuccugggcauccugcccgacaaggugagacccugggugguggcccaguaccccgagagcugcaagaaggccgccagccugguggagggccuggccgacgugcuggaggagcccggcaugcugcugggcagccccgccggcagcagcagcauccugagcgacggcguguacgagagacacauggacccccugcugcugcccggcgagcuggccagccccagccaggcccugggcgccggcgagauccccgcccccagcgagacccccuggcugagccccgacccccuguuccuggagcagagaagagugagagaggccaagaccgaggaggacggccccgccaacaccgagcagaagcugaagagcuuccccgaggacccccagcaccugggcgaguggggccaccuggaccccgccgaggagaaccugaagagcuacagaaagcugcugcuguggggcuaccagcugagccagcccgacgccgccagcagacuggacaccgaggagcugagacugguggagagagacccccagggcagcagccugcccgagggcggcagaagacaggagagcgccggcugcgccugcgaggaggccgcccccgccggcgugcugcccgagcugcccaccgaggccccccccggcgacgcccuggccgacccccccagcggcaccaccgaggaggaggaggagcagcccggcaaggcccccgacccccaggacccccaggacgccgagagcgacagcgccaccggcagccagagacagagcgugauccagcagcccgcccccgacagaggcaccgccaagcugggcaccaagagaccccaccccgaggacggcgacggccagagccuggagggcgugagcagcagcggcgacagcgccggccuggaggccggccagggccccggcgccgacgagcccggccugagcagaggcaagcccuacgccugcggcgagugcggcgaggccuucgccuggcugagccaccugauggagcaccacagcagccacggcggcagaaagagauacgccugccagggcugcuggaagaccuuccacuucagccuggcccuggccgagcaccagaagacccacgagaaggagaagagcuacgcccugggcggcgccagaggcccccagcccagcaccagagaggcccaggccggcgccagagccggcggcccccccgagagcguggagggcgaggccccccccgccccccccgaggcccagagauaa

SEQ ID NO: 26102 - RNA, 1476 nt, Artificial Sequence
  ZSCAN22__Homo_sapiens__NP_862829
auggccauccccaagcacagccugagccccgugcccugggaggaggacagcuuccugcaggugaagguggaggaggaggaggaggccagccugagccagggcggcgagagcagccacgaccacaucgcccacagcgaggccgccagacugagauucagacacuucagauacgaggaggccagcggcccccacgaggcccuggcccaccugagagcccugugcugccaguggcugcagcccgaggcccacagcaaggagcagauccuggagcugcuggugcuggagcaguuccugggcgcccugccccccgagauccaggccugggugggcgcccagagccccaagagcggcgaggaggccgccgugcugguggaggaccugacccaggugcuggacaagagaggcugggaccccggcgccgagcccaccgaggccagcugcaagcagagcgaccugggcgagagcgagcccagcaacgugaccgagacccugaugggcggcgugagccugggccccgccuucgugaaggccugcgagcccgagggcagcagcgagagaagcggccugagcggcgagaucuggaccaagagcgugacccagcagauccacuucaagaagaccagcggccccuacaaggacgugcccaccgaccagagaggcagagagagcggcgccagcagaaacagcagcagcgccuggcccaaccugaccagccaggagaagccccccagcgaggacaaguucgaccugguggacgccuacggcaccgagccccccuacaccuacagcggcaagagaagcagcaagugcagagagugcagaaagauguuccagagcgccagcgcccuggaggcccaccagaagacccacagcagaaagacccccuacgccugcagcgagugcggcaaggccuucagcagaagcacccaccuggcccagcaccagguggugcacaccggcgccaagccccacgagugcaaggagugcggcaaggccuucagcagagugacccaccugacccagcaccagagaauccacaccggcgagaagcccuacaagugcggcgagugcggcaagaccuucagcagaagcacccaccugacccagcaccagagagugcacaccggcgagagacccuacgagugcgacgccugcggcaaggccuucagccagagcacccaccugacccagcaccagagaauccacaccggcgagaagcccuacaagugcgacgccugcggcagagccuucagcgacugcagcgcccugaucagacaccugagaauccacagcggcgagaagcccuaccagugcaaggugugccccaaggccuucgcccagagcagcagccugaucgagcaccagagaauccacaccggcgagaagcccuacaagugcagcgacugcggcaaggccuucagcagaagcagcgcccugauggugcaccugagaauccacaucaccgugcugcaguaa

SEQ ID NO: 26103 - RNA, 1437 nt, Artificial Sequence
  ZSCAN26__Homo_sapiens__NP_001104509
auggccaccgcccuggugagcgcccacagccuggccccccugaaccugaagaaggagggccugagaguggugagagaggaccacuacagcaccugggagcagggcuucaagcugcagggcaacagcaagggccugggccaggagccccugugcaagcaguucagacagcugagauacgaggagaccaccggccccagagaggcccugagcagacugagagagcugugccagcaguggcugcagcccgagacccacaccaaggagcagauccuggagcugcuggugcuggagcaguuccugaucauccugcccaaggagcugcaggccagagugcaggagcaccaccccgagagcagagaggacguggugguggugcuggaggaccugcagcuggaccugggcgagaccggccagcaggaccccgaccagcccaagaagcagaagauccugguggaggagauggccccccugaagggcgugcaggagcagcaggugagacacgagugcgaggugaccaagcccgagaaggagaagggcgaggagaccagaaucgagaacggcaagcugaucguggugaccgacagcugcggcagaguggagagcagcggcaagaucagcgagcccauggaggcccacaacgagggcagcaaccuggagagacaccaggccaagcccaaggagaagaucgaguacaagugcagcgagagagagcagagauucauccagcaccuggaccugaucgagcacgccagcacccacaccggcaagaagcugugcgagagcgacgugugccagagcagcagccugaccggccacaagaaggugcugagcagagagaagggccaccagugccacgagugcggcaaggccuuccagagaagcagccaccuggugagacaccagaagauccaccugggcgagaagcccuaccagugcaacgagugcggcaagguguucagccagaacgccggccugcuggagcaccugagaauccacaccggcgagaagcccuaccugugcauccacugcggcaagaacuucagaagaagcagccaccugaacagacaccagagaauccacagccaggaggagcccugcgagugcaaggagugcggcaagaccuucagccaggcccugcugcugacccaccaccagagaauccacagccacagcaagagccaccagugcaacgagugcggcaaggccuucagccugaccagcgaccugaucagacaccacagaauccacaccggcgagaagcccuucaagugcaacaucugccagaaggccuucagacugaacagccaccuggcccagcacgugagaauccacaacgaggagaagcccuaccagugcagcgagugcggcgaggccuucagacagagaagcggccuguuccagcaccagagauaccaccacaaggacaagcuggccuaa

SEQ ID NO: 26104 - RNA, 744 nt, Artificial Sequence
  ZSCAN31__Homo_sapiens__NP_001230173
auggugacccagcugagauacgagagcuucugccugcaccaguuccaggagcaggacggcgagagcauccccgagaaccaggagcuggccagcaagcaggagauccugaaggagauggagcaccugggcgacagcaagcugcagagagacgugagccuggacagcaaguacagagagaccugcaagagagacagcaaggccgagaagcagcaggcccacagcaccggcgagagaagacacagaugcaacgagugcggcaagagcuucaccaagagcagcgugcugaucgagcaccagagaauccacaccggcgagaagcccuacgagugcgaggagugcggcaaggccuucagcagaagaagcagccugaacgagcacagaagaagccacaccggcgagaagcccuaccagugcaaggagugcggcaaggccuucagcgccagcaacggccugaccagacacagaagaauccacaccggcgagaagcccuacgagugcaaggugugcggcaaggccuuccugcugagcagcugccuggugcagcaccagagaauccacaccggcgagaagagauaccagugcagagagugcggcaaggccuucauccagaacgccggccuguuccagcaccugagagugcacaccggcgagaagcccuaccagugcagccagugcagcaagcuguucagcaagagaacccugcugaagaagcaccagaagauccacaccggcgagagacccuaa

SEQ ID NO: 26105 - RNA, 1227 nt, Artificial Sequence
  ZSCAN32__Homo_sapiens__NP_001271458
auggccgagggccugugggagcagggcuuccugagaacccccgagcagugcagaaccaaguucaagagccugcagcugagcuacagaaaggugagaagaggcagagugcccgagcccugcaucuucuacgaggagaugaacgcccugagcggcagcugggccagcgccccccccauggccagcgacgccgugcccggccaggagggcagcgacaucgaggccggcgagcugaaccaccagaacggcgagcccaccgagguggaggacggcaccguggacggcgccgacagagacgagaaggacuucagaaaccccggccaggaggugagaaagcuggaccugcccgugcuguuccccaacagacugggcuucgaguucaagaacgagaucaagaaggagaaccugaagugggacgacagcgaggagguggagaucaacaaggcccugcagagaaagagcagaggcguguacuggcacagcgagcugcagaagggccuggagagcgagcccaccagcagaagacagugcagaaacagccccggcgagagcgaggagaagacccccagccaggagaagaugagccaccagagcuucugcgccagagacaaggccugcacccacauccugugcggcaagaacugcagccagagcgugcacagcccccacaagcccgcccugaagcuggagaaggugagccagugccccgagugcggcaagaccuucagcagaagcagcuaccuggugagacaccagagaauccacaccggcgagaagccccacaagugcagcgagugcggcaagggcuucagcgagagaagcaaccugaccgcccaccugagaacccacaccggcgagagacccuaccagugcggccagugcggcaagagcuucaaccagagcagcagccugaucgugcaccagagaacccacaccggcgagaagcccuaccagugcaucgugugcggcaagagauucaacaacagcagccaguucagcgcccacagaagaauccacaccggcgagagccccuacaagugcgccgugugcggcaagaucuucaacaacagcagccacuucagcgcccacagaaagacccacaccggcgagaagcccuacagaugcagccacugcgagagaggcuucaccaagaacagcgcccugaccagacaccagaccgugcacaugaaggccgugcugagcagccaggagggcagagacgcccuguaa

SEQ ID NO: 26106 - RNA, 1338 nt, Artificial Sequence
  ZSCAN9__Homo_sapiens__NP_001186408
augaacaccaacagcaaggaggugcugagccugggcgugcaggugcccgaggccugggaggagcugcugaccaugaagguggaggccaagagccaccugcaguggcaggagagcagacugaagagaagcaacccccuggccagagagaucuucagaagacacuucagacagcugugcuaccaggagacccccggccccagagaggcccugaccagacugcaggagcugugcuaccaguggcugagaccccacgugagcaccaaggagcagauccuggaccugcuggugcuggagcaguuccugagcauccugcccaaggagcugcagggcugggugagagagcacugccccgagagcggcgaggaggccgugauccugcuggaggaccuggagagagagcuggacgagccccagcacgagaugguggcccacagacacagacaggaggugcugugcaaggagauggugccccuggccgagcagaccccccugacccugcagagccagcccaaggagccccagcugaccugcgacagcgcccagaagugccacagcaucggcgagaccgaccugaucagaagccugagaagaagagccgugcugaucccccugggcgcccaccuguucagcaccgacaccuuccuguucagcaagcccguggugaucccccagcugaagggcggcggcgagaccuggcccaacaacagaggcgugcugagagacgaggugaccaagaccgaggacagagagcuggugcugagaaaggacugccccaagaucguggagccccacggcaagauguucaacgagcagaccugggaggugagccagcaggaccccagccacggcgaggugggcgagcacaaggacagaaucgagagacaguggggcaaccugcugggcgagggccagcacaagugcgacgagugcggcaagagcuucacccagagcagcggccugaucagacaccagagaauccacaccggcgagagacccuacgagugcaacgagugcggcaaggccuucagcagaagcagcggccuguucaaccacagaggcauccacaacauccagaagagauaccacugcaaggagugcggcaagguguucagccagagcgccggccugauccagcaccagagaauccacaagggcgagaagcccuaccagugcagccagugcagcaagagcuacagcagaagaagcuuccugaucgagcaccagagaagccacaccggcgagagaccccaccagugcaucgagugcggcaagagcuucaacagacacugcaaccugaucagacaccagaagauccacaccguggccgagcugguguaa

SEQ ID NO: 26107 - RNA, 1902 nt, Artificial Sequence
  ZSWIM2__Homo_sapiens__NP_872327
augcugagaagaggcuacaaggccagcgagagaagaagacaccugagcgagagacugagcuggcaccaggaccaggcccugagcagcagcaucuaccugcugagagagaugggccccaccggcuuccugcugagagaggaggagcccgaguacauggacuucagaguguuccugggcaacccccacgugugcaacugcagcaccuuccccaagggcggcgagcugugcaagcacaucugcugggugcugcugaagaaguucaagcugcccagaaaccacgagagcgcccugcagcugggccugggcgagagagagaucagcgaccugcugagaggcauccacagagugcagaccccccagcccggcaccaacgacgagaacgagcacguggaggaggacggcuacaucaagcagaaggagaucgacagcgaggacaucugcagcaucugccaggagcugcugcuggagaagaagcugcccgugaccuucugcagauucggcugcggcaacagcauccacaucaagugcaugaagauccuggccaacuaccagagcaccagcaacaccagcaugcugaagugcccccugugcagaaaggaguucgccccccugaagcugauccuggaggaguucaagaacagcagcaagcugguggccgccgccgagaaggagagacuggacaagcaccugggcauccccugcaacaacugcaagcaguuccccaucgagggcaagugcuacaagugcaccgagugcaucgaguaccaccugugccaggagugcuucgacagcugcugccaccugagccacaccuucaccuucagagagaagagaaaccagaaguggagaagccuggagaagagagccgacgagguggugaaguacaucgacaccaagaacgagaucgaggagaagaugagccacuuccaggagaagcagggccagguguacacccccaagcacaucgugagaagccugccccugcagcugaucaccaagaacagcaagcugcuggcccccggcuaccagugccugcugugccugaaggccuuccaccugggccagcacaccagacugcugcccugcacccacaaguuccacagaaagugcaucgacaacuggcuguuccacaagugcaacagcugccccaucgacggccaggugaucuacaacccccugaccuggaagaacagcgccgugaacggccaggcccaccagagcgugagcaacagagacaucauccaccugagcaagcagaaggagcccgaccuguucauccccggcaccggccuggugcugaagcagaacagacugggcauccugcccagcaucccccagugcaacuucgacgagcugaacaccccccagagccccaaggacgccuacgagaacaccaccaucgacaaccugugcagcaucaagcuggacaacagcaacagcaagaagcugaccuacgacuacaagaucagccagcacuuccccagauaccugcaggaccugcccaccgugagcuucggcaagauccccagccagacccugcugccccccaucgugcacaagaacaucgugugccccaccgccauggagagccccugcaucagcggcaaguuccacaccagccugagcagaaugaccaagggcugcaagugcaacaaccacaaccugaagaagacccccgccaccaagaucagagaggacaacaagagaagcacccugcugcccgaggacuucaaccugaucgugaacuggagcaccgccaagcugagccugagcaagagauacagcaacugcaugggcgagaucaccagaaagugcagccaccugagcagacagcccgugagccacagcgugaacaccaagagcaccgagcugagccugaucaucgagggcgugcagcuguaa

SEQ ID NO: 26108 - RNA, 3648 nt, Artificial Sequence
  ZSWIM6__Homo_sapiens__NP_065979
auggccgagagaggccagcagcccccccccgccaagagacugugcugcagacccggcggcggcggcggcggcggcggcagcagcggcggcggcggcggcgccggcggcggcuacagcagcgccugcagacccggccccagagccggcggcgccgccgccgccgccgccugcggcggcggcgccgcccugggccugcugccccccggcaagacccagagccccgagagccugcuggacaucgccgccagaagaguggccgagaaguggcccuuccagagaguggaggagagauucgagagaauccccgagcccgugcagagaagaaucguguacuggagcuuccccagaagcgagagagagaucugcauguacagcagcuucaacaccggcggcggcgccgccggcggccccggcgacgacagcggcggcggcggcggcgccggcggcggcggcggcggcggcagcagcagcagccccgccgccaccagcgccgccgccaccagcgccgccgccgccgccgccgccgccgccgccgccgccgccgccgccgccggcgccggcgcccccagcgugggcgccgccggcgccgccgacggcggcgacgagaccagacugcccuucagaagaggcaucgcccugcuggagagcggcugcguggacaacgugcugcaggugggcuuccaccugagcggcaccgugaccgagcccgccauccagagcgagcccgagaccgugugcaacguggccaucagcuucgacagaugcaagaucaccagcgugaccugcagcugcggcaacaaggacaucuucuacugcgcccacgugguggcccugagccuguacagaaucagaaagcccgaccaggugaagcugcaccugcccaucagcgagacccuguuccagaugaacagagaccagcugcagaaguucgugcaguaccugaucaccgugcaccacaccgaggugcugcccaccgcccagaagcuggccgacgagauccugagccagaacagcgagaucaaccaggugcacggcgcccccgaccccaccgccggcgccagcaucgacgacgagaacugcuggcaccuggacgaggagcaggugcaggagcaggugaagcuguuccugagccagggcggcuaccacggcagcggcaagcagcugaaccugcuguucgccaaggugagagagaugcugaagaugagagacagcaacggcgccagaaugcugacccugaucaccgagcaguucauggccgaccccagacugagccuguggagacagcagggcaccgccaugaccgacaaguacagacagcugugggacgagcugggcgcccuguggaugugcaucgugcugaacccccacugcaagcuggagcagaaggccagcuggcugaagcagcugaagaaguggaacagcguggacgugugccccugggaggacggcaaccacggcagcgagcugcccaaccugaccaacgcccugccccagggcgccaacgccaaccaggacagcagcaacagaccccacagaaccguguucaccagagccaucgaggccugcgaccugcacuggcaggacagccaccugcagcacaucaucagcagcgaccuguacaccaacuacugcuaccacgacgacaccgagaacagccuguucgacagcagaggcuggccccuguggcacgagcacgugcccaccgccugcgccagaguggacgcccugagaagccacggcuaccccagagaggcccugagacuggccaucgccaucgugaacacccugagaagacagcagcagaagcagcuggagauguucagaacccagaagaaggagcugccccacaagaacaucaccagcaucaccaaccuggagggcugggugggccacccccuggaccccgugggcacccuguucagcagccugauggaggccugcagaaucgacgacgagaaccugagcggcuucagcgacuucaccgagaacaugggccagugcaagagccuggaguaccagcaccugcccgcccacaaguuccuggaggagggcgagagcuaccugacccuggccguggagguggcccugaucggccugggccagcagagaaucaugcccgacggccuguacacccaggagaaggugugcagaaacgaggagcagcugaucagcaagcugcaggagaucgagcuggacgacacccuggugaagaucuucagaaagcaggccguguuccugcuggaggccggccccuacagcggccugggcgagaucauccacagagagagcgugcccaugcacaccuucgccaaguaccuguucaccagccugcugccccacgacgccgagcuggccuacaagaucgcccugagagccaugagacugcuggugcuggagagcaccgcccccagcggcgaccugaccagaccccaccacaucgccagcguggugcccaacagauaccccagaugguucacccugagccacaucgagagccagcagugcgagcuggccagcaccaugcugaccgccgccaagggcgacgugagaagacuggagaccgugcuggagagcauccagaagaacauccacagcagcagccacaucuucaagcuggcccaggacgccuucaagaucgccacccugauggacagccugcccgacaucacccugcugaaggugagccuggagcugggccugcaggugaugagaaugacccugagcacccugaacuggagaagaagagagauggugagauggcuggugaccugcgccaccgaggugggcguguacgcccuggacagcaucaugcagaccugguucacccuguucacccccaccgaggccaccagcaucguggccaccaccgugaugagcaacagcaccaucgugagacugcaccuggacugccaccagcaggagaagcuggccagcagcgccagaacccuggcccugcagugcgccaugaaggacccccagaacugcgcccugagcgcccugacccugugcgagaaggaccacaucgccuucgagaccgccuaccagaucgugcuggacgccgccaccaccggcaugagcuacacccagcuguucaccaucgccagauacauggagcacagaggcuaccccaugagagccuacaagcuggccacccuggccaugacccaccugaaccugagcuacaaccaggacacccaccccgccaucaacgacgugcugugggccugcgcccugagccacagccugggcaagaacgagcuggccgccaucaucccccugguggugaagagcgugaagugcgccaccgugcugagcgacauccugagaagaugcacccugaccacccccggcauggugggccugcacggcagaagaaacagcggcaagcugaugagccuggacaaggccccccugagacagcugcuggacgccaccaucggcgccuacaucaacaccacccacagcagacugacccacaucagccccagacacuacagcgaguucaucgaguuccugagcaaggccagagagaccuuccugauggcccacgacggccacauccaguucacccaguucaucgacaaccugaagcagaucuacaagggcaagaagaagcugaugaugcuggugagagagagauucggcuaa

SEQ ID NO: 26109 - RNA, 2340 nt, Artificial Sequence
  ZW10__Homo_sapiens__NP_004715
auggccagcuucgugaccgaggugcuggcccacagcggcagacuggagaaggaggaccugggcaccagaaucagcagacugaccagaagaguggaggagaucaagggcgaggugugcaacaugaucagcaagaaguacagcgaguuccugcccagcaugcagagcgcccagggccugaucacccagguggacaagcugagcgaggacaucgaccugcugaagagcagaaucgagagcgaggugagaagagaccugcacgugagcaccggcgaguucaccgaccugaagcagcagcuggagagagacagcguggugcugagccugcugaagcagcugcaggaguucagcaccgccaucgaggaguacaacugcgcccugaccgagaagaaguacgugaccggcgcccagagacuggaggaggcccagaagugccugaagcugcugaagagcagaaagugcuucgaccugaagauccugaagagccugagcauggagcugaccauccagaagcagaacauccuguaccaccugggcgaggaguggcagaagcugaucguguggaaguucccccccagcaaggacaccagcagccuggagagcuaccugcagaccgagcugcaccuguacaccgagcagagccacaaggaggagaagacccccaugccccccaucagcagcgugcugcuggccuucagcgugcugggcgagcugcacagcaagcugaagagcuucggccagaugcugcugaaguacauccugagaccccuggccagcugccccagccugcacgccgugaucgagagccagcccaacaucgugaucaucagauucgagagcaucaugaccaaccuggaguaccccagccccagcgagguguucaccaagaucagacuggugcuggaggugcugcagaagcagcugcuggaccugccccuggacaccgaccuggagaacgagaagaccagcaccgugccccuggccgagaugcugggcgacaugaucugggaggaccugagcgagugccugaucaagaacugccugguguacagcauccccaccaacagcagcaagcugcagcaguacgaggagaucauccagagcaccgaggaguucgagaacgcccugaaggagaugagauuccugaagggcgacaccaccgaccugcugaaguacgccagaaacaucaacagccacuucgccaacaagaagugccaggacgugaucguggccgccagaaaccugaugaccagcgagauccacaacaccgugaagaucauccccgacagcaagaucaacgugcccgagcugcccacccccgacgaggacaacaagcuggaggugcagaaggugagcaacacccaguaccacgaggugaugaaccuggagcccgagaacacccuggaccagcacagcuucagccugcccaccugcagaaucagcgagagcgugaagaagcugauggagcuggccuaccagacccugcuggaggccaccaccagcagcgaccagugcgccgugcagcuguucuacagcgugagaaacaucuuccaccuguuccacgacguggugcccaccuaccacaaggagaaccugcagaagcugccccagcuggccgccauccaccacaacaacugcauguacaucgcccaccaccugcugacccugggccaccaguucagacugagacuggcccccauccugugcgacggcaccgccaccuucguggaccuggugcccggcuucagaagacugggcaccgagugcuuccuggcccagaugagagcccagaagggcgagcugcuggagagacugagcagcgccagaaacuucagcaacauggacgacgaggagaacuacagcgccgccagcaaggccgugagacaggugcugcaccagcugaagagacugggcaucguguggcaggacgugcugcccgugaacaucuacugcaaggccaugggcacccugcugaacaccgccaucagcgaggugaucggcaagaucaccgcccuggaggacaucagcaccgaggacggcgacagacuguacagccugugcaagaccgugauggacgagggcccccagguguucgccccccugagcgaggagagcaagaacaagaaguaccaggaggaggugcccguguacgugcccaaguggaugcccuucaaggagcugaugaugaugcugcaggccagccugcaggagaucggcgacagaugggccgacggcaagggcccccuggccgccgccuucagcagcagcgaggugaaggcccugaucagagcccuguuccagaacaccgagagaagagccgccgcccuggccaagaucaaguaa

SEQ ID NO: 26110 - RNA, 1434 nt, Artificial Sequence
  ZWILCH__Homo_sapiens__NP_001274752
auggcccacaaccccaacaugacccaccugaagaucaaccugcccgugaccgcccugcccccccugugggugagaugcgacagcagcgaccccgagggcaccugcuggcugggcgccgagcugaucaccaccaacaacagcaucaccggcaucgugcuguacguggugagcugcaaggccgacaagaacuacagcgugaaccuggagaaccugaagaaccugcacaagaagagacaccaccugagcaccgugaccagcaagggcuucgcccaguacgagcuguucaagagcagcgcccuggacgacaccaucaccgccagccagaccgccaucgcccuggacaucagcuggagccccguggacgagauccugcagauccccccccugagcagcaccgccacccugaacaucaagguggagagcggcgagcccagaggcccccugaaccaccuguacagagagcugaaguuccugcuggugcuggccgacggccugagaaccggcgugaccgaguggcuggagccccuggaggccaagagcgccguggagcuggugcaggaguuccugaacgaccugaacaagcuggacggcuucggcgacagcaccaagaaggacaccgagguggagacccugaagcacgacaccgccgccguggacagaagcgugaagagacuguucaaggugagaagcgaccuggacuucgccgagcagcuguggugcaagaugagcagcagcgugaucagcuaccaggaccuggugaagugcuucacccugaucauccagagccugcagagaggcgacauccagcccuggcugcacagcggcagcaacagccugcugagcaagcugauccaccagagcuaccacggcaccauggacaccgugagccugagcggcaccauccccgugcagaugcugcuggagaucggccuggacaagcugaagaaggacuacaucagcuucuucaucggccaggagcuggccagccugaaccaccuggaguacuucaucgcccccagcguggacauccaggagcagguguacagagugcagaagcugcaccacauccuggagauccuggugagcugcaugcccuucaucaagagccagcacgagcugcuguucagccugacccagaucugcaucaaguacuacaagcagaacccccuggacgagcagcacaucuuccagcugcccgugagacccaccgccgugaagaaccuguaccagagcgagaagccccagaaguggagaguggagaucuacagcggccagaagaagaucaagaccguguggcagcugagcgacagcagccccaucgaccaccugaacuuccacaagcccgacuucagcgagcugacccugaacggcagccuggaggagagaaucuucuucaccaacauggugaccugcagccaggugcacuucaaguaa

SEQ ID NO: 26111 - RNA, 693 nt, Artificial Sequence
  ZWINT__Homo_sapiens__NP_001005413
auggaggccgccgagaccgaggccgaggccgccgcccuggaggugcuggccgagguggccggcauccuggagcccgugggccugcaggaggaggccgagcugcccgccaagauccugguggaguucgugguggacagccagaagaaggacaagcugcugugcagccagcugcagguggccgacuuccugcagaacauccuggcccaggaggacaccgccaagggccuggacccccuggccagcgaggacaccagcagacagaaggccaucgccgccaaggagcaguggaaggagcugaaggccaccuacagagagcacguggaggccaucaagaucggccugaccaaggcccugacccagauggaggaggcccagagaaagagaacccagcugagagaggccuucgagcagcugcaggccaagaagcagauggccauggagaagagaagagccgugcagaaccaguggcagcugcagcaggagaagcaccugcagcaccuggccgaggugagcgccgagggcaagcugcuguuccccgaggccgaggccgaggccgagaaccugcccgacgacaagccccagcagcccaccagaccccaggagcagagcaccggcgacaccaugggcagagaccccggcgugagcuucaaggccgugggccugcagcccgccggcgacgugaaccugcccuaa

SEQ ID NO: 26112 - RNA, 1719 nt, Artificial Sequence
  ZYX__Homo_sapiens__NP_001010972
auggccgcccccagacccagccccgccaucagcgugagcgugagcgcccccgccuucuacgccccccagaagaaguucggccccgugguggcccccaagcccaaggugaaccccuucagacccggcgacagcgagcccccccccgcccccggcgcccagagagcccagaugggcagagugggcgagauccccccccccccccccgaggacuucccccugcccccccccccccuggccggcgacggcgacgacgccgagggcgcccugggcggcgccuucccccccccccccccccccaucgaggagagcuucccccccgccccccuggaggaggagaucuuccccagccccccccccccccccgaggaggagggcggccccgaggcccccauccccccccccccccagcccagagagaaggugagcagcaucgaccuggagaucgacagccugagcagccugcuggacgacaugaccaagaacgaccccuucaaggccagagugagcagcggcuacgugcccccccccguggccacccccuucagcagcaagagcagcaccaagcccgccgccggcggcaccgccccccugccccccuggaagagccccagcagcagccagccccugccccaggugcccgcccccgcccagagccagacccaguuccacgugcagccccagccccagcccaagccccaggugcagcugcacgugcagagccagacccagcccgugagccuggccaacacccagcccagaggcccccccgccagcagccccgcccccgcccccaaguucagccccgugacccccaaguucacccccguggccagcaaguucagccccggcgcccccggcggcagcggcagccagcccaaccagaagcugggccaccccgaggcccugagcgccggcaccggcagcccccagccccccagcuucaccuacgcccagcagagagagaagcccagagugcaggagaagcagcaccccgugcccccccccgcccagaaccagaaccaggugagaagccccggcgcccccggcccccugacccugaaggagguggaggagcuggagcagcugacccagcagcugaugcaggacauggagcacccccagagacagaacguggccgugaacgagcugugcggcagaugccaccagccccuggccagagcccagcccgccgugagagcccugggccagcuguuccacaucgccugcuucaccugccaccagugcgcccagcagcugcagggccagcaguucuacagccuggagggcgcccccuacugcgagggcugcuacaccgacacccuggagaagugcaacaccugcggcgagcccaucaccgacagaaugcugagagccaccggcaaggccuaccacccccacugcuucaccugcguggugugcgccagaccccuggagggcaccagcuucaucguggaccaggccaacagaccccacugcgugcccgacuaccacaagcaguacgcccccagaugcagcgugugcagcgagcccaucaugcccgagcccggcagagacgagaccgugagagugguggcccuggacaagaacuuccacaugaagugcuacaagugcgaggacugcggcaagccccugagcaucgaggccgacgacaacggcugcuucccccuggacggccacgugcugugcagaaagugccacaccgccagagcccagaccuaa

SEQ ID NO: 26113 - RNA, 8886 nt, Artificial Sequence
  ZZEF1__Homo_sapiens__NP_055928
augggcaacgcccccagccacagcagcgaggacgaggccgccgccgccggcggcgagggcuggggcccccaccaggacugggccgccgugagcggcaccacccccggccccggcguggccgcccccgcccugccccccgccgccgcccugcuggagcccgccagacugagagaggccgccgccgcccugcugcccaccccccccugcgagagccuggugagcagacacagaggcgcccuguucagauggcuggaggagagacugggcagaggcgaggagagcgugacccuggagcaguucagagagcugcuggaggccagaggcgccggcugcagcagcgagcaguucgaggaggccuucgcccaguucgacgccgagggcgacggcaccguggacgccgagaacaugcuggaggcccugaagaacagcagcggcgccaaccugcagggcgagcugagccacaucaucagacagcugcaggccugcagccuggugcccggcuucaccgacaucuucagcgagagcaaggagggccuggacauccacagcagcaugauccugagauuccugcacagaaacagacugagcagcgccgugaugcccuaccccaugcuggagcacugcaacaacaugugcaccaugagaagcagcgugcugaaggagagccuggaccagcuggugcagaaggagaaggagagccccggcgaccugaccagaagccccgagauggacaagcugaagagcguggccaagugcuacgccuacaucgagaccagcagcaacagcgccgacaucgacaagaugaccaacggcgagaccagcagcuacuggcagagcgacggcagcgccugcagccacuggaucagacugaagaugaagcccgacguggugcugagacaccugagcaucgccguggccgccaccgaccagagcuacaugccccagcaggugaccguggccgugggcagaaacgccagcgaccugcaggaggugagagacgugcacauccccagcaacgugaccggcuacgugacccugcuggagaacgccaacgugagccagcuguacgugcagaucaacaucaagagaugccugagcgacggcugcgacaccagaauccacggccugagagccgugggcuuccagagagugaagaagagcggcgugagcgugagcgacgccagcgccaucugguacuggagccugcugaccagccuggugaccgccagcauggagaccaaccccgccuucgugcagaccgugcugcacaacacccagaaggcccugagacacaugcccccccugagccugagccccggcagcaccgacuucagcaccuuccugagccccaacgugcuggaggagguggacagcuuccugaucagaaucaccagcugcugcagcacccccgagguggagcugacccugcuggccuucgcccuggccagaggcagcguggccaaggugaugagcagccugugcaccaucaccgaccaccuggacacccaguacgacgccagcagccugauccugagcauggccagcgugagacagaaccugcugcugaaguacggcaagccccugcagcugacccugcaggccugcgacgugaagggcaaggaggacaagagcggccccgagaaccugcugguggagcccuggaccagagacggcuuccugaccgagaccggcaagaccagagccagcaccaucuucagcaccggcaccgagagcgccuuccaggugacccagaucagaaucauggugagaagaggcggcaucggcgcccagugcggccugguguucgccuacaacagcagcagcgacaaguucugcgccgaggagcacuucaagagauucgagaaguacgacaaguggaagcugcaggagcugagacaguucgugaagagcagaaucggcugcagcagcgacgaccugggcgaggacgaccccaucggcugguucgagcuggaggaggagugggacgaggccgacgugaagcugcagcagugcagaguggccaaguaccugauggugaaguuccugugcaccagacaggagagcgccgagagacugggcgugcagggccugaccaucagcggcuaccugagacccgccagagccgaggccgagcagagcgugaccugcgcccacugcagaaaggacaccgaggagagcgugugcggcgccacccugcugcugagaacccugcaguucauccagcagcuggcccacgaccuggugcagcagaaggagagcggccugaaguacaagagcuuccuggacuucgccggccuggaccugcagaucuucuggaacuucuacagcaagcugaagcagaaccccagagaggagugcgugagcgcccagacccugcugcugcagcugcugcagagcugcuucagcgugcugcagggcgacgugcuggccgccagcgaggaggagaaggcccccauccagagccccaagggcguggaggccgccaaggagcuguacacccaccugugcgacgugguggacaagguggacggcgacagcgugcccauggagauccugaagcaggaggugagaaacacccugcugaacggcgccgccaucuucuuccccaacagacagaccagaagaaaccaccuguucaccaugaugaacgugaccgagcaggagcacaagcagagccugcagcugaccuucagaagccugugcaccuacuucagcgacaaggaccccggcggccugcugcugcugcccgagaagaacgaccuggccaagaugaacaucagcgaggugcuggccgugauggacacccuggugagcguggccgccagagagugcgagcugcugaugcugagcggcgcccccggcgaggugggcagcgugcuguucagccuguucuggagcgugcagggcagccugcugagcuggugcuaccugcagcugaagagcaccgacagcggcgccaaggaccuggccguggaccugaucgagaaguacgugggccaguuccuggccagcaugagagccauccuggagagccuguucagccaguacagcggcaagaccaucguggagagacugugcaacagcguguucagcauggccgccagacagcuggugaucuuccugcuggacuucugcacccuggacaucccccacugcgugcugcugagagaguucagcgugcugaccgagcugcugaagaagcugugcagcggccccgagggcggccugagaaagcuggacguggagaccuggcagcaggagcagcccguggugcugcacaccuggaccaaggagagcgcccacaacuacgagaacaacugccacgaggugagcguguucgugagccccggcgccaccuacuucgagguggaguucgacgacagaugcgagaccgagaagagauacgacuaccuggaguucaccgacgccagaggcagaaagaccagauacgacaccaaggugggcaccgacaaguggcccaagaaggugaccuucaaggccggccccagacugcaguuccuguuccacagcgacagcagccacaacgaguggggcuacaaguucaccgugaccgccugcggccugcccgacguggccgugagcuggggccuggaccugcagcugcuggugagcagacugaugggcagacuggccagccagugcauggcccugaagagcgugagacagcugggcagcaacaugguggugccccaggccaagauggcccuggugcugagcagcccccuguggaagcccguguucagacaccaggugugccccgagcuggagcuggaggccagcuggcccacccacccccacagaaacagcaaggaggugaagaacauccccgacgaccccugcagacacuuccugcuggacuucgcccagagcgagcccgcccagaacuucugcggccccuacagcgagcuguucaagggcuucauccaggccugcagaaagcaggcccccaagaccgacaucguggccggcagcaccaucgaccaggccgugaacgccaccuucgccgcccugguguacagaacccccgaccuguacgagaagcugcagaaguacgugaacagcggcggcaagaucgcccugagcgaggaguucgcccagguguacagccuggccgacggcaucagaaucuggaugcuggagaugaagcagaagagccugaugagccugggcaacgaggccgaggagaagcacagcagcgaggccaccgaggugaaccccgagagccuggccaaggagugcaucgagaagagccugcugcugcugaaguuccugcccaccggcaucagcagcaaggagagcugcgagaagcuggagaccgccgacgagaccagccaccugcagccccugaacaagagacagagaaccagcagcgugguggaggagcacuuccaggccagcgugagccccaccgaggccgccccccccgccaccggcgaccagagccccggccugggcacccagcccaagcugcccagcagcagcggccugcccgccgccgacgugagccccgccaccgccgaggagccccugagccccagcacccccaccagaagaccccccuucaccagaggcagacugagacugcugagcuucagaagcauggaggaggccagacuggugcccaccgugaaggagaaguaccccgugcugaaggacgugauggacuucaucaaggaccagagccugagccacagaagcguggugaaggugcugagccugagaaaggcccaggcccagagcauccuggaggugcugaagaucacccagcacugcgccgagagccugggccagccccacugcuuccacccccccuucauccuguuccugcuggagcugcugaccugccagaaggacuucaccaacuacuucggccaccuggagggcugcggcgccgaccugcacaaggagaucagagacaccuacuaccagcuggugcuguuccuggugaaggccgugaagggcuucagcagccugaacgacagaagccugcugcccgcccugagcugcgugcagaccgcccugcugcaccugcuggacaugggcugggagcccaacgaccuggccuucuucguggacauccagcugcccgaccugcugaugaagaugagccaggagaacaucagcgugcacgacagcgugaucagccaguggagcgaggaggacgagcuggccgacgccaagcagaacagcgaguggauggacgagugccaggacggcauguucgaggccugguacgagaagaucgcccaggaggaccccgagaagcagagaaagaugcacauguucaucgccagauacugcgaccugcugaacguggacaucagcugcgacggcugcgacgagaucgcccccuggcacagauacagaugccugcagugcagcgacauggaccugugcaagaccugcuuccugggcggcgugaagcccgagggccacggcgacgaccacgagauggugaacauggaguucaccugcgaccacugccagggccugaucaucggcagaagaaugaacugcaacgugugcgacgacuucgaccugugcuacggcugcuacgccgccaagaaguacagcuacggccaccugcccacccacagcaucaccgcccaccccauggugaccaucagaaucagcgacagacagagacugauccagcccuacauccacaacuacagcuggcugcuguucgccgcccuggcccuguacagcgcccaccuggccagcgccgaggacguggacggcgagaagcuggacccccagaccagaagcagcgccaccacccugagaagccagugcaugcagcuggugggcgacugccugaugaaggcccaccagggcaagggccugaaggcccuggcccugcugggcgugcugcccgacggcgacagcagccuggaggaccaggcccugcccgugaccgugcccaccggcgccagcgaggagcagcuggagaagaaggccgugcagggcgccgagcugagcgaggccggcaacggcaagagagccgugcacgaggagaucagacccguggacuucaagcagagaaacaaggccgacaagggcgugagccugagcaaggaccccagcugccagacccagaucagcgacagccccgccgacgccagcccccccaccggccugcccgacgccgaggacagcgaggugagcagccagaagcccaucgaggagaaggccgugacccccagccccgagcagguguucgccgagugcagccagaagagaauccugggccugcuggccgccaugcugcccccccugaagagcggccccaccgugccccugaucgaccuggagcacgugcugccccugauguuccagguggugaucagcaacgccggccaccugaacgagaccuaccaccugacccugggccugcugggccagcugaucaucagacugcugcccgccgagguggacgccgccgugaucaaggugcugagcgccaagcacaaccuguucgccgccggcgacagcagcaucgugcccgacggcuggaagaccacccaccugcuguucagccugggcgccgugugccuggacagcagagugggccuggacugggccugcagcauggccgagauccugagaagccugaacagcgccccccuguggagagacgugaucgccaccuucaccgaccacugcaucaagcagcugcccuuccagcugaagcacaccaacaucuucacccugcuggugcuggugggcuucccccaggugcugugcgugggcaccagaugcguguacauggacaacgccaacgagccccacaacgugaucauccugaagcacuucaccgagaagaacagagccgugaucguggacgugaagaccagaaagagaaagaccgugaaggacuaccagcuggugcagaagggcggcggccaggagugcggcgacagcagagcccagcugagccaguacagccagcacuucgccuucaucgccagccaccugcugcagagcagcauggacagccacugccccgaggccguggaggccaccugggugcugagccuggcccugaagggccuguacaagacccugaaggcccacggcuucgaggagaucagagccaccuuccugcagaccgaccugcugaagcugcuggugaagaagugcagcaagggcaccggcuucagcaagaccuggcugcugagagaccuggagauccugagcaucaugcuguacagcagcaagaaggagaucaacgcccuggccgagcacggcgaccuggagcuggacgagagaggcgacagagaggaggagguggagagacccgugagcagccccggcgaccccgagcagaagaagcuggacccccuggagggccuggacgagcccaccagaaucugcuuccugauggcccacgacgcccugaacgccccccugcacauccugagagccaucuacgagcugcagaugaagaagaccgacuacuucuuccuggaggugcagaagagauucgacggcgacgagcugaccaccgacgagagaaucagaagccuggcccagagauggcagcccagcaagagccugagacuggaggagcagagcgccaaggccguggacaccgacaugaucauccugcccugccugagcagacccgccagaugcgaccaggccaccgccgagagcaaccccgugacccagaagcugaucagcagcaccgagagcgagcugcagcagagcuacgccaagcagagaagaagcaagagcgccgcccugcugcacaaggagcugaacugcaagagcaagagagccgugagagacuaccuguucagagugaacgaggccaccgccgugcuguacgccagacacgugcuggccagccugcuggccgaguggcccagccacgugcccgugagcgaggacauccuggagcugagcggccccgcccacaugaccuacauccuggacauguucaugcagcuggaggagaagcacgagugggagaagauccugcagaaggugcugcagggcugcagagaggacaugcugggcaccauggcccuggccgccugccaguucauggaggagcccggcauggaggugcaggugagagagagcaagcaccccuacaacaacaacaccaacuucgaggacaaggugcacauccccggcgccaucuaccugagcaucaaguucgacagccagugcaacaccgaggagggcugcgacgagcuggccaugagcagcagcagcgacuuccagcaggacagacacagcuucagcggcagccagcagaaguggaaggacuucgagcugcccggcgacacccuguacuacagauucaccagcgacaugagcaacaccgaguggggcuacagauucaccgugaccgccggccaccugggcagauuccagaccggcuucgagauccugaagcagaugcugagcgaggagagaguggugccccaccugccccuggccaagaucugggaguggcuggugggcguggccugcagacagaccggccaccagagacugaaggccauccaccugcugcugagaaucgugagaugcugcggccacagcgaccugugcgaccuggcccugcugaagccccuguggcagcuguucacccacauggaguacggccuguucgaggacgugacccagcccggcauccugcugccccugcacagagcccugaccgagcuguucuucgugaccgagaacagagcccaggagcugggcgugcugcaggacuaccugcuggcccugaccaccgacgaccaccugcugagaugcgccgcccaggcccugcagaacaucgccgccaucagccuggccaucaacuaccccaacaaggccaccagacuguggaacguggagugcuaa

SEQ ID NO: 26114 - RNA, 1515 nt, Artificial Sequence
  ZZZ3__Homo_sapiens__XP_011539507
auggccgccagcagaagcaccagagugaccagaagcaccgugggccugaacggccuggacgagagcuucugcggcagaacccugagaaacagaagcaucgcccaccccgaggagaucagcagcaacagccaggugagaagcagaagccccaagaagagacccgagcccgugcccauccagaagggcaacaacaacggcagaaccaccgaccugaagcagcagagcaccagagagagcugggugagccccagaaagagaggccugagcagcagcgagaaggacaacaucgagagacaggccaucgagaacugcgagagaagacagaccgagcccgugagccccgugcugaagagaaucaagagaugccugagaagcgaggcccccaacagcagcgaggaggacagccccaucaagagcgacaaggagagcguggagcagagaagcaccgugguggacaacgacgccgacuuccagggcaccaagagagccugcagaugccugauccuggacgacugcgagaagagagagaucaagaaggugaacgugagcgaggagggcccccugaacagcgccgugguggaggagaucaccggcuaccuggccgugaacggcguggacgacagcgacagcgccgugaucaacugcgacgacugccagcccgacggcaacaccaagcagaacagcaucggcagcuacgugcugcaggagaagagcguggccgagaacggcgacaccgacacccagaccagcauguuccuggacagcagaaaggaggacagcuacaucgaccacaaggugcccugcaccgacagccaggugcaggugaagcuggaggaccacaagaucgugaccgccugccugcccguggagcacgugaaccagcugaccaccgagcccgccaccggccccuucagcgagacccagagcagccugagagacagcgaggaggagguggacguggugggcgacagcagcgccagcaaggagcagugcaaggagaacaccaacaacgagcuggacaccagccuggagagcaugcccgccagcggcgagcccgagcccagccccgugcuggacugcgugagcgcccagaugaugagccugagcgagccccaggagcacagauacacccugagaaccagccccagaagagccgcccccaccagaggcagccccaccaagaacagcagccccuacagagagaacggccaguucgaggagaacaaccugagccccaacgagaccaacgccaccgugagcgacaacgugagccagagccccaccaaccccggcgagaucagccagaacgagaagggcaucugcugcgacagccagaacaacggcagcgagggcgugagcaagccccccagcgaggccagacugaacaucggccaccugcccagcgccaaggagagcgccagccagcacaucaccgaggaggaggacgacgaccccgacguguacuacuucgagagcgaccacguggcccugaagcacaacaaggaguacguguaa

SEQ ID NO: 26115 - RNA, 1245 nt, Artificial Sequence
  derived and/or modified sequence opt1 from 37135__Homo_sapiens__NP_443070
augagccaccacgacgacggcgccaccguggggcugggcauccagaugugcgagggguggcgcgucgaggccgcgcucuccuuccugccccaccagcggaaguggggcgagaccgccggggccgugauggccggcggcgugauggacaaggaguacgucggguucgccgcgcugccgaaccagcuccaccgcaagagcgugaagaagggcuucgacuucacgcugaugguggccggggaguccggccugggcaagagcacccucaucaacucccuguuccugaccaaccucuacgaggaccggcagguccccgaggccagcgcccgccugacccagacgcuggcgaucgagcggcgcgggguggagaucgaggagggcggggugaaggucaagcucacccugguggacacccccggcuucggggacuccguggacugcagcgacugcuggcugcccgucgugaaguucaucgaggagcaguucgagcaguaccuccgggacgaguccggccugaaccgcaagaacauccaggacagccgggugcacugcugccuguacuucaucuccccguucggccgcgggcuccggccccuggacgucgccuuccugcgcgccgugcacgagaaggugaacaucauccccgucaucggcaaggccgacgcccucaugccccaggagacccaggcgcugaagcagaagauccgggaccagcugaaggaggaggagauccacaucuaccaguucccggagugcgacagcgacgaggacgaggacuucaagcgccaggacgccgagaugaaggaguccauccccuucgccgugguggggagcugcgaggucgugcgggacggcgggaaccgccccgugcggggccgccgguacuccuggggcacggucgagguggagaacccccaccacugcgacuuccucaaccugcgccggaugcugguccagacccaccuccaggaccugaaggaggugacccacgaccugcucuacgagggguaccgcgcccgcugccugcagagccuggcccggccgggcgcgcgcgaccgggccucccgcagcaagcucucccggcagagcgccaccgagaucccccugcccaugcugccccucgccgacacggagaagcugauccgcgagaaggacgaggagcugcggcgcaugcaggagaugcucgagaagaugcaggcccagaugcagcagagccaggcgcagggggagcaguccgacgcccuguga

SEQ ID NO: 26116 - RNA, 1086 nt, Artificial Sequence
  derived and/or modified sequence opt1 from 37500__Homo_sapiens__NP_001008492
augagcaagcagcagcccacccaguucaucaacccggagacccccggcuacgugggguucgccaaccugcccaaccagguccaccgcaaguccgugaagaagggcuucgaguucacgcucaugguggucggggagagcggccuggggaaguccacccugaucaacagccucuuccugaccgaccuguaccccgagcgggugaucccgggcgccgcggagaagaucgagcgcaccgugcagaucgaggccuccacggucgagaucgaggagcggggcgugaagcuccgccugaccguggucgacacccccggguacggcgacgccaucaacugccgggacugcuucaagaccaucaucagcuacaucgacgagcaguucgagcgcuaccugcacgacgaguccgggcucaaccggcgccacaucaucgacaaccgggugcacugcugcuucuacuucaucagccccuucggccacgggcugaagccccuggacguggccuucaugaaggccauccacaacaaggucaacaucgugccggugaucgcgaaggccgacacgcucacccugaaggagcgcgagcggcugaagaagcgcauccucgacgagaucgaggagcacaacaucaagaucuaccaccuccccgacgccgaguccgacgaggacgaggacuucaaggagcagacccggcugcugaaggccagcauccccuucuccgucgugggcagcaaccagcugaucgaggcgaagggcaagaaggugcgcgggcggcuguaccccuggggcgucguggagguggagaacccggagcacaacgacuuccucaagcugcgcaccaugcugaucacgcacaugcaggaccuccaggaggucacccaggaccugcacuacgagaacuuccgguccgagcgccugaagcgcgggggccggaagguggagaacgaggacaugaacaaggaccagauccuccuggagaaggaggccgagcugcggcgcaugcaggagaugaucgcccgcaugcaggcccagaugcagaugcagaugcagggcggggacggcgacgggggcgcccucgggcaccacguguga

SEQ ID NO: 26117 - RNA, 1053 nt, Artificial Sequence
  derived and/or modified sequence opt1 from 37865__Homo_sapiens__NP_061979
augagcaagggccugcccgagacccgcaccgacgccgccauguccgagcucgugccggagccccggcccaagcccgcggucccgaugaagcccaugagcaucaacuccaaccugcugggguacaucggcaucgacacgaucaucgagcagaugcgcaagaagaccaugaagaccggguucgacuucaacaucaugguggugggccagagcgggcucggcaaguccacccuggucaacacgcuguucaagagccaggugucccggaaggccagcuccuggaaccgcgaggagaagauccccaagaccguggagaucaaggccaucggccacgucaucgaggagggcggggugaagaugaagcucaccgugaucgacacccccggguucggcgaccagaucaacaacgagaacugcugggagccgaucgagaaguacaucaacgagcaguacgagaaguuccugaaggaggaggucaacaucgcccggaagaagcgcauccccgacacgcgggugcacugcugccuguacuucaucagccccaccgggcacucccuccgcccccuggaccuggaguucaugaagcaccucagcaagguggucaacaucaucccggugaucgccaaggcggacaccaugacccuggaggagaaguccgaguucaagcagcgggugcgcaaggagcuggaggucaacggcaucgaguucuacccccagaaggaguucgacgaggaccucgaggacaagacggagaacgacaagauccggcaggagagcaugcccuucgccguggugggcuccgacaaggaguaccaggucaacgggaagcgcgugcugggccggaagacccccugggggaucaucgagguggagaaccugaaccacugcgaguucgcccuccugcgcgacuucgucauccggacccaccuccaggaccugaaggaggugacccacaacauccacuacgagacguaccgcgccaagcggcugaacgacaacggcggccugccgcccgugagcgucgacaccgaggagucccacgacagcaaccccuga

SEQ ID NO: 26118 - RNA, 1413 nt, Artificial Sequence
  derived and/or modified sequence opt1 from 38231__Homo_sapiens__NP_001185642
augcccggcuucuacagcgucaugaccgacgaggagaucaagcgcuuccuggaggacaccacggacgacggggagcucuccaaguucgucaaggacuucagcggcaacgccuccugccacccgcccgaggccaagaccugggcgagccggccccaggugcccgagccgcgcccccaggcccccgaccuguacgacgacgaccuggaguuccggcccccgucccgcccccagagcuccgacaaccagcaguacuucugcgcccccgcgccccucagcccguccgcccggccccgcagccccugggggaagcuggaccccuacgacuccagcgaggacgacaaggaguacgugggcuucgccacccugccgaaccagguccaccggaaguccgugaagaagggguucgacuucacccucaugguggccggcgagagcggccuggggaaguccacgcuggucaacagccucuuccugaccgaccuguaccgcgaccggaagcuccugggcgccgaggagcgcaucaugcagaccguggagaucaccaagcacgccguggacaucgaggagaaggggguccggcugcgccucacgaucguggacacccccggcuucggggacgcggugaacaacaccgagugcuggaagcccgucgccgaguacaucgaccagcaguucgagcaguacuuccgggacgaguccggccugaaccgcaagaacauccaggacaaccgggugcacugcugccuguacuucaucagccccuucggccacgggcuccgcccgcuggacguggaguucaugaaggcccugcaccagcgggucaacaucgugcccauccucgccaaggccgacacccugacgccgcccgagguggaccacaagaagcgcaagauccgggaggagaucgagcacuucggcaucaagaucuaccaguuccccgacugcgacuccgacgaggacgaggacuucaagcugcaggaccaggcgcucaaggagagcauccccuucgccgucaucgggagcaacaccgugguggaggcccgcggccggcgcguccgcggccggcuguaccccugggggaucguggagguggagaaccccggccacugcgacuucgucaagcugcgcaccaugcucgugcggacccacaugcaggaccugaaggacgucacgcgcgagacccacuacgagaacuaccgggcccagugcauccaguccaugacccgccugguggugaaggagcggaaccgcaacaagcucacccgggagagcgggacggacuucccgauccccgccgugcccccgggcaccgaccccgagaccgagaagcugauccgcgagaaggacgaggagcugcggcgcaugcaggagaugcuccacaagauccagaagcagaugaaggagaacuacuga

SEQ ID NO: 26119 - RNA, 1041 nt, Artificial Sequence
  derived and/or modified sequence opt1 from 38596__Homo_sapiens__NP_001009939
auggacagccuggccgcgccccaggaccgccucguggagcagcugcuguccccgcggacccaggcccagcgccggcucaaggacaucgacaagcaguacgucggcuucgccacccugcccaaccaggugcaccgcaagagcgugaagaagggguucgacuucacgcugauggucgccggcgaguccgggcucggcaagagcacccuggugcacucccuguuccucaccgaccuguacaaggaccggaagcugcucagcgccgaggagcgcaucucccagaccguggagauccugaagcacacggucgacaucgaggagaagggggugaagcugaagcucaccaucguggacacccccggcuucggcgacgccgucaacaacaccgagugcuggaagcccaucacggacuacguggaccagcaguucgagcaguacuuccgggacgagagcgggcugaaccgcaagaacauccaggacaaccgggugcacugcugccuguacuucaucuccccguucggccacgggcuccgccccgucgacgugggcuucaugaaggcgcugcacgagaaggugaacaucgucccccugaucgccaaggccgacugccucgugcccagcgagauccggaagcugaaggagcgcauccgggaggagaucgacaaguucgggauccacguguaccaguucccggagugcgacuccgacgaggacgaggacuucaagcagcaggaccgcgagcugaaggagagcgcccccuucgcggucaucggcuccaacaccgugguggaggccaagggccagcggguccgcgggcggcucuaccccuggggcaucguggagggggcccugcgccugcgggaggccgcccagcacgcgcacccccacgccuacgcccgcccgcagggccgggacgugcgccgcgcccuccgggagcugccccgcgcccugcaccccgcggacgaccagcagaccgaccccggccagccgcacggggagccccaccccgaccccgccgccgcccacccgggccggcgcgacuga

SEQ ID NO: 26120 - RNA, 1305 nt, Artificial Sequence
  derived and/or modified sequence opt1 from 38961__Homo_sapiens__NP_055944
auggccgccaccgacaucgcgcgccaggugggcgaggggugccggaccgucccccuggccggccacgugggguucgacagccucccggaccagcuggugaacaaguccgucagccagggcuucugcuucaacauccugugcgugggggagacgggccucggcaaguccacccugauggacacccuguucaacaccaaguucgagggggagcccgccacgcacacccagcccggcgugcagcuccagagcaacaccuacgaccugcaggaguccaacguccgccugaagcucaccaucgugagcacggugggguucggcgaccagaucaacaaggaggacuccuacaagcccaucgucgaguucaucgacgcccaguucgaggccuaccugcaggaggagcugaagauccggcgcgugcuccacaccuaccacgacagccggauccacgugugccuguacuucaucgcgccgaccgggcacucccucaagagccuggaccuggucaccaugaagaagcuggacuccaaggugaacaucauccccaucaucgccaaggccgacgccaucagcaaguccgagcucacgaaguucaagaucaagaucaccagcgagcugguguccaacggcguccagaucuaccaguuccccaccgacgacgagagcguggcggagaucaacggcaccaugaacgcccaccuccccuucgccgugaucggguccacggaggagcugaagaucggcaacaagaugaugcgcgcccggcaguacccgugggggaccguccagguggagaacgaggcccacugcgacuucgugaagcugcgcgagaugcugauccgggucaacauggaggaccuccgcgagcagacccacacccggcacuacgagcuguaccgccggugcaagcuggaggagaugggcuucaaggacacggaccccgacagcaagcccuucucccuccaggagaccuacgaggcgaagcgcaacgaguuccugggcgagcugcagaagaaggaggaggagaugcggcagauguucgugcagcgcgugaaggagaaggaggccgagcucaaggaggccgagaaggagcugcacgagaaguucgaccggcugaagaagcuccaccaggacgagaagaagaagcuggaggacaagaagaagucccuggacgacgaggucaacgccuucaagcagcgcaagaccgccgcggagcuccugcagagccaggggagccaggccggcgggagccagacccugaagcgggacaaggagaagaagaacaaccccuggcucugcacggaguga

SEQ ID NO: 26121 - RNA, 1311 nt, Artificial Sequence
  derived and/or modified sequence opt1 from 39326__Homo_sapiens__NP_001011553
augagcguguccgcccgcagcgccgcggccgaggagcgguccgucaacagcuccaccauggcccagcagaagaaccuggagggcuacgugggguucgccaaccuccccaaccagguguaccgcaagagcgucaagcggggcuucgaguucacccugaugguggugggggaguccggccuggggaaguccacgcucaucaacucccuguuccugaccgaccucuacagcccggaguaccccggccccucccaccgcaucaagaagaccguccagguggagcagagcaaggugcugaucaaggagggcgggguccagcugcuccugaccaucguggacacgcccggcuucggggacgccguggacaacuccaacugcuggcagccggucaucgacuacaucgacagcaaguucgaggacuaccugaacgcggagucccgggugaaccgccggcagaugcccgacaaccgcgugcagugcugccucuacuucaucgcccccagcggccacgggcugaagccccuggacaucgaguucaugaagcggcuccacgagaaggucaacaucaucccgcugaucgccaaggccgacacccugacccccgaggagugccagcaguucaagaagcagaucaugaaggagauccaggagcacaagaucaagaucuacgaguuccccgagaccgacgacgaggaggagaacaagcucgugaagaagaucaaggaccgccugccccuggcgguggucggcuccaacacgaucaucgaggugaacggcaagcgggugcgcgggcggcaguacccguggggcgucgccgagguggagaacggggagcacugcgacuucaccauccuccgcaacaugcugauccggacccacaugcaggaccugaaggacgugaccaacaacguccacuacgagaacuaccgcagccggaagcucgccgccgugacguacaacggcgucgacaacaacaagaacaagggccagcugaccaagagcccccuggcccagauggaggaggagcgccgggagcacguggcgaagaugaagaagauggagauggagauggagcaggucuucgagaugaaggugaaggagaaggugcagaagcucaaggacagcgaggccgagcugcagcgccggcacgagcagaugaagaagaaccuggaggcccagcacaaggagcucgaggagaagcgccgccaguucgaggacgagaaggccaacugggaggcccagcagcggauccuggagcagcagaacagcucccgcacccuggagaagaacaagaagaaggggaagaucuucuga

SEQ ID NO: 26122 - RNA, 1761 nt, Artificial Sequence
  derived and/or modified sequence opt1 from 40057__Homo_sapiens__NP_001106963
augaagaaguccuacagcggcgggacccgcaccagcuccggccggcugcgccggcucggggacagcuccggccccgcccugaagcgcagcuucgagguggaggaggucgagacgccgaacuccaccccgccccggcgcgugcagacgccccugcuccgggccaccguggcgagcuccacccagaaguuccaggaccugggggucaagaacagcgagcccuccgcccgccacguggacagccugucccagcggagccccaaggccucccuccgccggguggagcugagcggccccaaggccgccgagcccgucucccgccggaccgagcugagcaucgacaucuccagcaagcaggucgagaacgcgggcgccaucgggccgagccgcuucggccucaagcgggccgaggugcuggggcacaagacccccgagcccgcgccccgccggaccgagaucacgaucgugaagccgcaggaguccgcccaccgccggauggagccgcccgccagcaaggugcccgaggugcccaccgcccccgccaccgacgccgcgcccaagcgcgucgagauccagaugcccaagccggccgaggcccccaccgcccccucccccgcccagacgcuggagaacagcgagccggcgcccgugucccagcuccagagccggcuggagcccaagccccagccgcccguggccgaggccacgccccgcucccaggaggccaccgaggccgcgccgagcugcgucggcgacauggccgacacgccccgcgacgccgggcugaagcaggcccccgccucccggaacgagaaggcgcccguggacuucggcuacgugggcaucgacagcauccucgagcagaugcgccggaaggccaugaagcagggguucgaguucaacaucauggucgugggccaguccgggcugggcaagagcacccugaucaacacccucuucaaguccaagaucagccgcaaguccgugcagccgaccagcgaggagcggauccccaagaccaucgagaucaaguccaucacccacgacaucgaggagaagggcguccgcaugaagcugaccgugaucgacacccccggguucggcgaccacaucaacaacgagaacugcuggcagcccaucaugaaguucaucaacgaccaguacgagaaguaccugcaggaggaggugaacaucaaccggaagaagcgcaucccggacacccggguccacugcugccucuacuucauccccgccacggggcacagccugcgcccccuggacaucgaguucaugaagcggcucuccaagguggucaacaucgugcccgugaucgccaaggcggacacccugacccuggaggagcgcguccacuucaagcagcggaucaccgccgaccuccugagcaacggcaucgacguguacccgcagaaggaguucgacgaggacagcgaggaccgccuggugaacgagaaguuccgggagaugauccccuucgccgucgugggguccgaccacgaguaccaggugaacggcaagcgcauccucggccggaagacgaagugggggaccaucgaggucgagaacaccacccacugcgaguucgccuaccugcgcgaccugcucauccggacgcacaugcagaacaucaaggacaucaccagcuccauccacuucgaggccuaccgcgugaagcgccugaacgagggcagcuccgcgauggccaacgggauggaggagaaggagcccgaggcccccgagauguga

SEQ ID NO: 26123 - RNA, 1365 nt, Artificial Sequence
  derived and/or modified sequence opt1 from 40422__Homo_sapiens__NP_653311
auggccagcuccgagguggcccgccaccuccucuuccagagccacauggcgaccaagaccacgugcauguccagccagggcuccgacgacgagcagaucaagcgggagaacauccgcagccugaccauguccgggcacgucggcuucgagagccugcccgaccagcucgugaaccgguccauccagcagggguucugcuucaacauccugugcgugggcgagaccgggaucggcaagagcacccugaucgacacgcuguucaacaccaacuucgaggacuacgaguccagccacuucugcccgaacgucaagcugaaggcccagaccuacgagcugcaggaguccaacgugcagcucaagcugaccaucgugaacacggucggcuucggggaccagaucaacaaggaggagagcuaccagcccaucguggacuacaucgacgcccaguucgaggccuaccugcaggaggagcucaagaucaagcgcucccuguucaccuaccacgacagccggauccacgugugccuguacuucaucucccccaccggccacagccucaagacccuggaccugcucacgaugaagaaccuggacuccaaggucaacaucauccccgugaucgccaaggcggacaccgugagcaagaccgagcugcagaaguucaagaucaagcucaugagcgagcuggucuccaacggggugcagaucuaccaguucccgaccgacgacgacacgaucgccaaggugaacgccgccaugaacggccagcugcccuucgcggucguggggagcauggacgaggugaaggucggcaacaagauggugaaggcccgccaguaccccuggggcgugguccagguggagaacgagaaccacugcgacuucgugaagcuccgggagaugcugaucugcaccaacauggaggaccugcgcgagcagacccacacccggcacuacgagcucuaccgccggugcaagcuggaggagaugggguucacggacgucggccccgagaacaagccgguguccguccaggagaccuacgaggccaagcgccacgaguuccacggggagcggcagcgcaaggaggaggagaugaagcagauguucgugcagcgggugaaggagaaggaggccauccugaaggaggccgagcgcgagcuccaggcgaaguucgagcaccugaagcggcugcaccaggaggagcgcaugaagcucgaggagaagcggcgccugcuggaggaggagaucaucgccuucagcaagaagaaggccaccuccgagaucuuccacagccaguccuuccucgccaccggcagcaaccugcggaaggacaaggaccgcaagaacuccaacuuccuguga

SEQ ID NO: 26124 - RNA, 1290 nt, Artificial Sequence
  derived and/or modified sequence opt1 from 40787__Homo_sapiens__NP_060713
auggccguggccgucggccgccccagcaacgaggagcugcggaaccucucccugagcgggcacgugggcuucgacucccugccggaccagcucgugaacaagagcaccucccagggguucugcuucaacauccugugcgucggcgagaccgggaucggcaagagcacgcugauggacacccucuucaacaccaaguucgaguccgaccccgcgacccacaacgagcccggcgugcgccugaaggcccggagcuacgagcugcaggaguccaacgugcgccucaagcugacgaucgucgacaccgugggguucggcgaccagaucaacaaggacgacagcuacaagcccaucguggaguacaucgacgcccaguucgaggccuaccugcaggaggagcucaagaucaagcggucccuguucaacuaccacgacacccgcauccacgccugccuguacuucaucgcgccgaccgggcacagccucaagucccuggaccuggucacgaugaagaagcucgacagcaaggugaacaucauccccaucaucgccaaggccgacaccaucgccaagaacgagcugcacaaguucaaguccaagaucaugagcgagcugguguccaacggcguccagaucuaccaguuccccaccgacgaggagaccguggcggagaucaacgccacgaugagcgugcaccuccccuucgccgucgugggguccaccgaggaggugaagaucggcaacaagauggccaaggcccggcaguacccguggggcgucguccagguggagaacgagaaccacugcgacuucgugaagcugcgcgagaugcugauccgggugaacauggaggaccuccgcgagcagacccacacccggcacuacgagcuguaccgccggugcaagcuggaggagaugggguucaaggacacggaccccgacagcaagcccuucagccuccaggagaccuacgaggcgaagcgcaacgaguuccugggcgagcugcagaagaaggaggaggagaugcggcagauguucgugaugcgcgucaaggagaaggaggccgagcucaaggaggccgagaaggagcugcacgagaaguucgaccugcucaagcggacccaccaggaggagaagaagaagguggaggacaagaagaaggagcuggaggaggaggucaacaacuuccagaagaagaaggccgccgcgcagcugcuccagucccaggcccagcagagcggggcccagcagaccaagaaggacaaggacaagaagaacgccuccuucacguga

SEQ ID NO: 26125 - RNA, 939 nt, Artificial Sequence
  derived and/or modified sequence opt1 from 41153__Homo_sapiens__NP_001147930
auggacccccugcgccggagcccgucccccugccucagcucccagcccagcucccccagcaccccgcccugcgagaugcugggccccguggggaucgaggccguccuggaccagcucaagaucaaggccaugaagaugggcuucgaguucaacaucauggugguggggcaguccggccugggcaagagcaccauggucaacacccuguucaaguccaagguguggaaguccaacccgcccgggcucggcgugcccacgccccagacccugcagcugcacagccucacccacgucaucgaggagaagggggugaagcugaagcugaccgugaccgacacccccggcuucggggaccagaucaacaacgacaacugccuccgcccgcuggacaucgaguuccugcagcggcucugccgcaccgucaacguggugcccgucaucgcgcgggccgacagccugacgauggaggagcgcgaggccuuccggcgccggauccagcagaaccugcgcacccacugcaucgacguguacccccagaugugcuucgacgaggacaucaacgacaagauccucaacuccaagcugcgggaccgcauccccuucgccguggucggcgccgaccaggagcaccuggugaacgggcggugcgugcucggccgcaagaccaaguggggcaucaucgaggucgagaacauggcgcacugcgaguucccgcugcugcgggaccuccugauccgcagccaccuccaggaccugaaggacaucacccacaacauccacuacgagaacuaccgggugauccgccugaacgagucccaccuccugccccgggggcccggcugggugaaccuggcccccgccagcccggggcagcugacgacgccccgcaccuucaaggucugccggggcgcccacgacgacuccgacgacgaguucuga

SEQ ID NO: 26126 - RNA, 1299 nt, Artificial Sequence
  derived and/or modified sequence opt1 from 41883__Homo_sapiens__NP_997249
auggccgagcgcaccauggccaugcccacccagaucccggcggacggcgacacgcagaaggagaacaacauccggugccugaccaccaucgggcacuucggcuucgagugccuccccaaccagcuggugagccgcuccauccggcagggguucaccuucaacauccugugcgucggcgagacggggaucggcaagagcacccucaucgacacccuguucaacaccaaccugaaggacaacaaguccagccacuucuacuccaacgugggccuccagauccagacguacgagcugcaggagagcaacgugcagcugaagcucaccgucguggagaccgugggguacggcgaccagaucgacaaggaggccuccuaccagcccaucgucgacuacaucgacgcccaguucgaggccuaccugcaggaggagcugaagaucaagcgcagccucuucgaguaccacgacucccgggugcacgugugccuguacuucaucagccccaccgggcacucccucaagagccuggaccugcugacgaugaagaaccucgacuccaaggucaacaucaucccgcugaucgccaaggcggacaccaucagcaagaacgaccugcagaccuucaagaacaagaucauguccgagcucaucagcaacggcauccagaucuaccagcugcccaccgacgaggagacggccgcccaggccaacuccagcguguccgggcugcuccccuucgcgguggucggcagcaccgacgaggugaaggugggcaagcgcaugguccgggggcgccacuaccccuggggcgugcuccagguggagaacgagaaccacugcgacuucgucaagcugcgggacaugcugcugugcaccaacauggagaaccugaaggagaagacccacacgcagcacuacgagugcuaccgcuaccagaagcuccagaagaugggguucaccgacgugggcccgaacaaccagcccgugagcuuccaggagaucuucgaggccaagcggcaggaguucuacgaccagugccagcgcgaggaggaggagcugaagcagcgguucaugcagcgcgucaaggagaaggaggccaccuucaaggaggccgagaaggagcugcaggacaaguucgagcaccucaagaugauccagcaggaggagauccggaagcuggaggaggagaagaagcagcuggagggcgagaucaucgacuucuacaagaugaaggccgcguccgaggcccuccagacccagcugagcacggacaccaagaaggacaagcaccgcaagaaguga

SEQ ID NO: 26127 - RNA, 1488 nt, Artificial Sequence
  derived and/or modified sequence opt1 from A1BG__Homo_sapiens__NP_570602
augagcaugcugguggucuuccuccugcuguggggcgugaccugggggcccgugaccgaggccgccaucuucuacgagacgcagccgucccucugggcggagagcgagucccugcugaagccccucgccaacgucacccugaccugccaggcccaccuggagacccccgacuuccagcuguucaagaacggcguggcccaggagcccgugcaccucgacagcccggccaucaagcaccaguuccugcucacgggggacacccagggccgcuaccggugccgcuccgggcugagcaccggcuggacccagcuguccaagcuccuggagcugacgggccccaagagccuccccgcgcccuggcuguccauggccccggucagcuggaucacccccgggcugaagaccaccgccgugugccggggcgugcuccgcggggucacguuccugcugcggcgcgagggcgaccacgaguuccucgaggugcccgaggcccaggaggacguggaggcgaccuuccccguccaccagccggggaacuacuccugcagcuaccggaccgacggcgagggcgcccuguccgagcccagcgccaccgugacgaucgaggagcuggccgccccgccgccgcccgugcucaugcaccacggggaguccagccagguccugcaccccggcaacaaggugacccugaccugcguggcgccccucuccggggucgacuuccagcugcgccggggcgagaaggagcugcucgugccccgcagcuccaccagccccgaccggaucuucuuccaccugaacgccguggcccugggcgacgggggccacuacacgugccgcuaccggcuccacgacaaccagaacggguggagcggcgacuccgcccccgucgagcugauccugagcgacgagacccuccccgcccccgaguucucccccgagcccgagagcgggcgcgcgcugcggcugcgcugccucgcgccccuggagggcgcccgguucgcccuggugcgcgaggaccggggcgggcgccgggugcaccgcuuccaguccccggccggcaccgaggcccucuucgagcugcacaacaucagcgucgccgacuccgccaacuacagcugcguguacgucgaccugaagccgcccuucgggggcuccgcccccagcgagcgccucgagcugcacguggacgggcccccgccccggccccagcugcgcgccaccugguccggcgcggugcuggccggccgggacgccguccuccgcugcgaggggcccauccccgacgugacguucgagcugcugcgggagggcgagaccaaggccgugaagaccguccgcacccccggggcggccgccaaccucgagcugaucuucgugggcccgcagcacgccgggaacuaccggugccgcuaccggagcugggugccccacacguucgaguccgagcugagcgaccccgucgagcuccugguggccgaguccuga

SEQ ID NO: 26128 - RNA, 1761 nt, Artificial Sequence
  derived and/or modified sequence opt1 from A1CF__Homo_sapiens__NP_001185747
auggagagcaaccacaaguccggcgacgggcugagcggcacccagaaggaggccgcccuccgcgcgcuggugcagcggaccggguacucccugguccaggagaacggccagcgcaaguacggcgggcccccgcccgggugggacgccgccccgcccgagcggggcugcgagaucuucaucggcaagcucccccgcgaccuguucgaggacgagcugaucccccucugcgagaagaucgggaagaucuacgagaugcggaugaugauggacuucaacggcaacaaccgcggguacgccuucgugacguucagcaacaagguggaggccaagaacgcgaucaagcagcugaacaacuacgagauccggaacggccgccugcucggcgucugcgccuccguggacaacugccggcuguucgucgggggcauccccaagaccaagaagcgcgaggagauccugagcgagaugaagaaggugaccgagggggugguggacgucaucguguaccccuccgccgccgacaagaccaagaaccggggcuucgcguucguggaguacgagagccaccgcgccgccgccauggcccggcgcaagcuccugccgggccggauccagcugugggggcacggcaucgcggucgacugggccgagcccgagguggagguggacgaggacacgauguccagcgucaagauccucuacgugcgcaaccugaugcuguccaccagcgaggagaugaucgagaaggaguucaacaacaucaagcccggggccguggagcgggucaagaagauccgcgacuacgccuucgugcacuucuccaaccgggaggacgccguggaggcgaugaaggcccucaacggcaagguccuggacgggagccccaucgaggugacccuggccaagccgguggacaaggacuccuacguccgcuacacccggggcacgggcgggcgcggcaccaugcuccagggggaguacaccuacagccugggccagguguacgaccccaccacgaccuaccugggggcccccgucuucuacgcgccccagaccuacgccgccaucccgucccuccacuuccccgccaccaagggccaccugagcaaccgcgccaucauccgggcccccuccgugcgcggcgcggccggggugcggggccucgggggccgcggguaccucgccuacacgggccugggccggggguaccaggucaagggcgacaagcgcgaggacaagcuguacgacauccuccccgggauggagcugaccccgaugaaccccgugacccugaagccccagggcaucaagcucgcgccccagauccuggaggagaucugccagaagaacaacuggggccagccgguguaccagcugcacagcgccaucgggcaggaccagcggcagcuguuccuguacaagaucaccauccccgcccuggccagccagaaccccgccauccaccccuucacgccgcccaagcucuccgccuucgucgacgaggcgaagaccuacgccgccgaguacacccugcagacccugggcauccccacggacgggggcgacgggaccauggccaccgccgcggccgccgccaccgccuucccgggcuacgcggugcccaacgccacggcccccgugagcgccgcgcagcucaagcaggccgucacccugggccaggaccuggccgccuacaccaccuacgagguguaccccacguucgccgugaccgcgcgcggggacggcuacgggaccuucuga

SEQ ID NO: 26129 - RNA, 4425 nt, Artificial Sequence
  derived and/or modified sequence opt1 from A2M__Homo_sapiens__NP_000005
augggcaagaacaagcugcuccaccccagccuggugcugcuccugcugguccuccugccgaccgacgccuccgugagcgggaagccccaguacauggugcugguccccucccuccugcacaccgagacgaccgagaagggcugcgugcugcucagcuaccugaacgagaccgugaccgucuccgccagccuggaguccgugcgcgggaaccggagccucuucacggaccuggaggcggagaacgacgugcugcacugcgucgccuucgccgugcccaaguccagcuccaacgaggaggugauguuccucaccguccaggugaagggcccgacccaggaguucaagaagcgcaccacggugauggucaagaacgaggacagccugguguucgugcagaccgacaaguccaucuacaagcccgggcagaccgucaaguuccggguggugagcauggacgagaacuuccacccccugaacgagcucaucccccuggucuacauccaggacccgaagggcaaccgcaucgcccaguggcaguccuuccagcuggagggcgggcucaagcaguucagcuucccccuguccagcgagcccuuccagggcuccuacaagguggugguccagaagaaguccgggggccggaccgagcaccccuucacgguggaggaguucguccugccgaaguucgagguccaggugaccgugcccaagaucaucaccauccucgaggaggagaugaacgugagcgugugcgggcuguacaccuacggcaagcccguccccggccacgugacggugagcaucugccgcaaguacagcgacgccuccgacugccacggggaggacagccaggcguucugcgagaaguucuccggccagcugaacagccacgggugcuucuaccagcaggucaagaccaagguguuccagcucaagcggaaggaguacgagaugaagcugcacaccgaggcccagauccaggaggagggcaccguggucgagcugacgggccgccaguccagcgagaucacccggaccaucaccaagcucuccuucgugaagguggacagccacuuccgccaggggaucccguucuucggccagguccggcugguggacgggaagggcgugcccauccccaacaaggucaucuucauccgcgggaacgaggccaacuacuacuccaacgccacgaccgacgagcacggccuggugcaguucagcaucaacaccaccaacgugaugggcacgucccucaccguccgggugaacuacaaggaccgcagccccugcuacggguaccaguggguguccgaggagcacgaggaggcgcaccacaccgccuaccuggucuucagcccguccaagagcuucgugcaccuggagcccaugucccacgagcuccccugcggccacacccagacggugcaggcccacuacauccugaacgggggcacccugcucgggcugaagaagcugagcuucuacuaccucaucauggccaagggcggcaucguccggaccgggacccacggccugcuggugaagcaggaggacaugaaggggcacuucagcaucuccauccccgucaagagcgacaucgccccgguggcgcgccuccugaucuacgccgugcugcccacgggcgacgugaucggggacuccgccaaguacgacgucgagaacugccuggccaacaagguggaccucagcuucucccccagccagucccugcccgccagccacgcgcaccuccgggugaccgccgccccgcaguccgucugcgcccugcgcgccguggaccagagcgugcugcugaugaagcccgacgcggagcucuccgccagcuccgucuacaaccugcugcccgagaaggaccucaccggcuucccgggcccccugaacgaccaggacgacgaggacugcaucaaccggcacaacguguacaucaacgggaucaccuacacccccgugagcuccacgaacgagaaggacauguacagcuuccuggaggacaugggccucaaggccuucaccaacuccaagauccgcaagcccaagaugugcccgcagcugcagcaguacgagaugcacgggcccgagggccugcgggucggcuucuacgagagcgacgugauggggcgcggccacgcccgccucgugcacgucgaggagccccacaccgagaccgugcggaaguacuuccccgagacguggaucugggaccugguggucgugaacagcgccgggguggcggaggucggcgugaccgucccggacaccaucaccgaguggaaggccggggccuucugccuguccgaggacgccggccucggcaucagcuccacggcgagccugcgcgccuuccagcccuucuucguggagcugaccaugcccuacuccgugauccgcggggaggccuucacccucaaggccaccguccugaacuaccugcccaagugcauccgggugagcgugcagcucgaggccuccccggcguuccuggccguccccguggagaaggagcaggcgccccacugcaucugcgccaacggccggcagacggugagcugggccgucacccccaagucccuggggaacgugaacuucaccgugagcgccgaggcccucgagucccaggagcugugcggcaccgaggucccgagcgugcccgagcacgggcgcaaggacacggugaucaagccccugcucgucgagcccgagggccuggagaaggagaccaccuucaacucccugcucugcccgagcggcggggagguguccgaggagcugagccugaagcucccgcccaacguggucgaggaguccgcccgggccagcguguccgugcugggcgacauccuggggagcgccaugcagaacacccagaaccuccugcagaugcccuacggcugcggggagcagaacaugguccuguucgcgcccaacaucuacgugcucgacuaccugaacgagacgcagcagcugacccccgagaucaagagcaaggccaucggcuaccucaacaccggcuaccagcgccagcugaacuacaagcacuacgacggguccuacagcaccuucggcgagcgguacgggcgcaaccagggcaacacguggcugaccgccuucgugcucaagaccuucgcccaggcgcgggccuacaucuucaucgacgaggcccacaucacccaggcccugaucuggcugucccagcgccagaaggacaacgggugcuuccggagcuccggcagccuccugaacaacgccaucaagggcggggucgaggacgaggugacgcuguccgcguacaucaccaucgcccuccuggagaucccccugaccgugacccacccggucgugcgcaacgcccucuucugccuggagagcgccuggaagacggcccaggagggcgaccacgggucccacguguacaccaaggcgcugcucgccuacgccuucgcccuggccggcaaccaggacaagcggaaggagguccucaagagccugaacgaggaggcggugaagaaggacaacuccgugcacugggagcgcccccagaagcccaaggcccccgucggccacuucuacgagccgcaggcccccagcgccgagguggagaugaccuccuacgugcugcuggcguaccucaccgcccagcccgcccccacgagcgaggaccugaccuccgccaccaacaucgucaaguggaucaccaagcagcagaacgcccagggcggguucagcuccacccaggacacggugguggcgcugcacgcccucagcaaguacggggccgccaccuucacccggaccggcaaggccgcgcaggucacgauccaguccagcgggaccuucagcuccaaguuccagguggacaacaacaaccgccugcugcuccagcaggucagccugccggagcugcccggcgaguacuccaugaaggugaccggcgaggggugcguguaccuccagaccagccugaaguacaacauccugcccgagaaggaggaguuccccuucgcccucggcgugcagacgcugccgcagaccugcgacgagcccaaggcccacaccuccuuccagaucagccuguccgucagcuacaccgggucccggagcgccuccaacauggccaucguggacgugaagauggucagcggcuucaucccccucaagcccacggugaagaugcuggagcgcuccaaccacgugagccgcaccgaggucuccagcaaccacgugcugaucuaccucgacaaggucuccaaccagacccugagccuguucuucaccgugcuccaggacgugccgguccgggaccugaagcccgcgaucgugaagguguacgacuacuacgagacggacgaguucgccaucgccgaguacaacgcccccugcuccaaggaccuggggaacgccuga

SEQ ID NO: 26130 - RNA, 4365 nt, Artificial Sequence
  derived and/or modified sequence opt1 from A2ML1__Homo_sapiens__NP_653271
augugggcccagcugcuccugggcaugcuggcccucagccccgcgaucgccgaggagcugccgaacuaccuggugacccuccccgcccgccugaacuuccccuccguccagaaggugugccuggaccucagccccggguacuccgacgugaaguucaccgucacgcuggagaccaaggacaagacccagaagcugcucgaguacagcggccugaagaagcggcaccuccacugcaucuccuuccuggugccgccgcccgccgggggcaccgaggagguggccacgauccgcgucagcggggugggcaacaacaucuccuucgaggagaagaagaaggugcugauccagcggcagggcaacgggaccuucguccagaccgacaagccccuguacacccccggccagcaggucuacuuccgcaucgugacgauggacagcaacuucgugcccgugaacgacaaguacuccaugguggagcuccaggaccccaacagcaaccggaucgcgcaguggcuggaggucgugcccgagcaggggaucguggaccuguccuuccagcucgccccggaggccaugcugggcaccuacaccgucgccguggcggaggggaagaccuucggcacguucagcguggaggaguacguccugcccaaguucaagguggagguggucgagcccaaggagcucuccaccgugcaggagagcuuccuggucaagaucugcugccgcuacaccuacggcaagcccaugcugggggccguccagguguccgugugccagaaggccaacaccuacugguaccgggagguggagcgcgagcagcucccggacaagugccggaaccugagcggccagacggacaagaccgggugcuucuccgcccccguggacauggccaccuucgaccugaucggcuacgcguacagccaccagaucaacaucgucgccaccgugguggaggagggcacgggggucgaggccaacgccacccagaacaucuacaucagcccccagaugggcuccaugaccuucgaggacaccagcaacuucuaccaccccaacuucccguucuccgggaagauccgcgugcggggccacgacgacagcuuccucaagaaccaccugguguuccuggucaucuacgggacgaacggcaccuucaaccagacccucgugaccgacaacaacggccuggcccccuucacgcuggagaccuccggguggaacggcaccgacgugagccucgaggggaaguuccagauggaggaccuggucuacaaccccgagcaggucccccgcuacuaccagaacgcguaccugcaccuccggccguucuacuccaccacgcgcagcuuccugggcauccaccggcugaacgggccccucaagugcggccagccccaggaggugcugguggacuacuacaucgaccccgccgacgccuccccggaccaggagaucagcuucuccuacuaccugaucggcaaggggagccucgugauggagggccagaagcaccugaacuccaagaagaaggggcugaaggccagcuucucccucagccugaccuucaccucccgccuggcccccgaccccagccuggugaucuacgcgaucuucccguccggcggggucguggccgacaagauccaguucagcguggagaugugcuucgacaaccaggucucccucggcuucagccccagccagcagcugcccggcgccgagguggagcugcagcuccaggccgcccccgggucccugugcgcgcugcgggccguggacgagagcguccuccugcugcgcccggaccgggagcucuccaaccgcagcguguacggcauguuccccuucugguacgggcacuaccccuaccagguggccgaguacgaccagugccccgucuccggcccgugggacuucccccagccccugaucgaccccaugccgcagggccacagcucccagcggagcaucaucuggcgccccuccuucagcgaggggaccgaccuguucuccuucuuccgcgacgugggccucaagauccugagcaacgccaagaucaagaagcccguggacugcucccaccggagccccgaguacuccacggcgaugggggccggcgggggccacccggaggccuucgagagcuccacgccccugcaccaggccgaggacagccagguccgccaguacuuccccgagaccuggcucugggaccuguuccccaucggcaacagcgggaaggaggccgugcacgugaccgucccggacgcgaucaccgaguggaaggccauguccuucugcaccagccagucccggggcuucgggcugagccccaccgugggccucaccgccuucaagcccuucuucguggaccugacccugcccuacuccgucgugcgcggggagagcuuccggcucacggccaccaucuucaacuaccugaaggacugcauccgcgugcagaccgaccuggccaagucccacgaguaccagcucgagagcugggcggacucccagaccagcuccugccugugcgccgacgaggccaagacgcaccacuggaacaucaccgccgucaagcugggccacaucaacuucaccaucagcaccaagauccucgacuccaacgagccgugcggcgggcagaagggcuucgugccccagaaggggcggagcgacacgcugaucaagcccgugcuggucaagccggagggcgugcucguggagaagacccacuccagccugcugugccccaaggggaaggucgccuccgagagcgugucccucgagcugcccguggacaucguccccgacagcaccaaggcguacgugaccguccugggcgacaucaugggcacggcccuccagaaccuggacgggcuggugcagaugccgagcggcugcggggagcagaacaugguccucuucgcccccaucaucuacgugcugcaguaccuggagaaggccggccuccugaccgaggagauccgcucccgggcggugggguuccuggagaucggcuaccagaaggagcucauguacaagcacagcaacggcuccuacagcgccuucggggagcgcgacggcaacgggaacaccuggcugaccgccuucgugacgaagugcuucggccaggcccagaaguucaucuucaucgaccccaagaacauccaggacgcccugaaguggauggcgggcaaccagcuccccuccgggugcuacgccaacgucggcaaccugcugcacaccgccaugaagggcgggguggacgacgaggugagccucaccgccuacgucaccgccgcgcugcuggagauggggaaggacguggacgacccgauggugucccagggccuccggugccugaagaacagcgccacguccaccaccaaccuguacacccaggcccuccuggccuacaucuucagccuggccggcgagauggacauccgcaacauccuccugaagcagcuggaccagcaggcgaucaucuccggggagagcaucuacuggucccagaagcccacgcccagcuccaacgccagccccugguccgagccggccgccgucgacguggagcucaccgcguacgcccugcuggcccagcucaccaagcccagccugacccagaaggagaucgccaaggccacguccaucguggcguggcuggccaagcagcggaacgccuacggcggguucagcagcacccaggacaccgucguggcccuccaggcccuggcgaaguacgccaccacggccuacaugcccuccgaggagaucaaccugguggucaagagcaccgagaacuuccagcgcaccuucaacauccaguccgugaaccggcucguguuccagcaggacacccugcccaacgucccgggcauguacacccuggaggccagcgggcagggcugcguguacgugcagacgguccuccgcuacaacauccugccgcccaccaacaugaagaccuucucccugagcguggagaucggcaaggcccggugcgagcagcccaccagcccccgcucccucacgcugaccauccacaccuccuacguggggagccgguccagcuccaacauggcgaucgucgaggugaagaugcugagcggcuucucccccauggaggggaccaaccagcuccugcugcagcagccccucgugaagaaggucgaguucggcacggacacccugaacaucuaccuggacgagcucaucaagaacacccagaccuacacguucaccaucagccaguccgugcuggugaccaaccugaagcccgccaccaucaaggucuacgacuacuaccucccggacgagcaggccacgauccaguacagcgaccccugcgaguga

SEQ ID NO: 26131 - RNA, 1023 nt, Artificial Sequence
  derived and/or modified sequence opt1 from A4GNT__Homo_sapiens__NP_057245
augcgcaaggagcugcagcucagccuguccgugacccugcuccuggucugcggcuuccuguaccaguucacccucaagagcuccugccuguucugccugcccagcuucaagucccaccaggggcucgaggcccugcugagccaccggcgcggcaucguguuccucgagacguccgagcggauggagccgccccaccuggugagcugcuccgucgagagcgccgcgaagaucuaccccgaguggcccgugguguucuucaugaaggggcugaccgacuccaccccgaugcccagcaacuccaccuaccccgccuucagcuuccucuccgccaucgacaacgucuuccuguucccccuggacaugaagcgccuccuggaggacacgccgcuguucagcugguacaaccagaucaacgccuccgccgagcggaacuggcuccacaucagcuccgacgcgagccgccuggccaucaucuggaaguacggcgggaucuacauggacaccgacgugaucagcauccggcccauccccgaggagaacuuccuggccgcccaggcgucccgcuacagcuccaacggcaucuucggcuuccucccccaccacccguuccugugggagugcauggagaacuucguggagcacuacaacagcgccaucugggggaaccagggccccgagcugaugacccggaugcuccgcgucuggugcaagcuggaggacuuccaggagguguccgaccugcggugccucaacaucagcuuccugcacccccagcgcuucuaccccaucuccuaccgggaguggcgccgguacuacgaggugugggacaccgagccgagcuucaacgucuccuacgcccugcaccucuggaaccacaugaaccaggaggggcgcgccgugauccggggcagcaacacgcugguggagaaccuguaccgcaagcacugcccccggaccuaccgcgaccucaucaaggggcccgagggcuccgucaccggcgagcuggggcccggcaacaaguga

SEQ ID NO: 26132 - RNA, 1542 nt, Artificial Sequence
  derived and/or modified sequence opt1 from AAAS__Homo_sapiens__NP_001166937
augugcagccugggccucuucccgcccccgccgccccgcggccaggugacccuguacgagcacaacaacgagcuggucaccggcuccagcuacgagagcccgccgcccgacuuccgggggcaguggaucaaccuccccgugcugcagcugacgaaggacccccucaagacccccggccgccuggaccacgggacccggaccgccuucauccaccaccgcgagcaggucuggaagcggugcaucaacaucuggcgcgacgugggccuguucggcgugcucaacgagaucgccaacuccgaggaggagguguucgagugggucaagacggcguccgggugggcccuggcccugugccggugggccagcucccuccacggcagccuguucccccaccugucccuccgcagcgaggaccugaucgccgaguucgcccaggugaccaacugcaccaucgugcccucccugaagcaccggcuccagcgcaacgucgcgagccuggccuggaagccccuguccgccagcgugcucgcgguggccugccaguccugcauccugaucuggacccuggaccccacgagccucuccacccggcccagcuccgggugcgcccagguccugagccaccccggccacacccccgugaccagccuggccugggcccccuccgggggccgccuccugagcgcgucccccguggacgccgccauccgggucugggacgugagcacggagaccugcgugccccugccgugguuccgcggcgggggcgucaccaaccuccuguggucccccgacgggagcaagauccuggccaccacgcccuccgccguguuccgggugugggaggcgcagauguggaccugcgagcgcuggcccacccucagcggccggugccagaccggcugcugguccccggacgggagccgccugcuguucacgguccucggcgagccccugaucuacucccugagcuuccccgagcggugcggggagggcaaggggugcgugggcggcgccaaguccgccaccaucguggccgaccucagcgagaccaccauccagacgcccgacggggaggagcgccugggcggggaggcccacuccauggucugggacccgagcggcgagcggcuggcggugcucaugaaggggaagccccgcguccaggacggcaagcccgugauccugcuguuccgcacccggaacuccccgguguucgagcuccugcccugcggcaucauccagggggagcccggcgcccagccccagcugaucaccuuccacccgagcuucaacaagggggcccuccuguccgucggcuggagcaccgggcgcaucgcccacaucccccuguacuucgugaacgcccaguucccccgguucagccccgugcugggccgcgcgcaggagccgcccgccggcgggggcggguccauccacgaccucccccuguucacggagaccagccccaccuccgccccgugggacccccugcccgggcccccgcccguccucccccacagcccccacucccaccuguga

SEQ ID NO: 26133 - RNA, 2019 nt, Artificial Sequence
  derived and/or modified sequence opt1 from AACS__Homo_sapiens__NP_076417
augagcaaggaggagcgccccggccgggaggagauccuggagugccaggugaugugggagccggacuccaagaagaacacccagauggaccgcuuccgggccgccgucggggcggccugcggccucgcccuggagagcuacgacgaccuguaccacugguccguggagagcuacuccgacuucugggccgaguucuggaaguucagcgggaucguguucucccgcgucuacgacgaggugguggacaccagcaagggcaucgccgacguccccgagugguucaaggggucccggcucaacuacgcggagaaccugcugcgccacaaggagaacgaccggguggcccucuacaucgcccgcgagggcaaggaggagaucgugaaggucacguucgaggagcugcggcaggagguggcccuguucgcggccgccaugcgcaagaugggcgugaagaagggggaccgggucgugggcuaccuccccaacagcgagcacgccguggaggccaugcuggcggccgccuccaucggggccaucuggagcuccaccagccccgacuucggcgucaacggggugcuggaccgcuucucccagauccagccgaagcucaucuucagcguggaggccgucguguacaacggcaaggagcacaaccacauggagaagcugcagcaggucgugaagggccugcccgaccucaagaaggugguggucauccccuacguguccagccgggagaacaucgaccuguccaagauccccaacagcgucuuccuggacgacuuccucgcgaccgggaccagcgagcaggccccgcagcuggaguucgagcagcugcccuucucccacccccucuucaucauguucagcuccggcacgaccggggcccccaagugcauggugcacagcgccggcggcacccugauccagcaccugaaggagcaccuccugcacgggaacaugaccuccagcgacauccugcucugcuacacgaccgugggcuggaugauguggaacuggauggucucccugcuggccaccggggcggccauggugcucuacgacggcagcccgcuggugcccacccccaacguccugugggaccucguggaccgcaucgggaucacggugcuggucaccggcgccaaguggcuguccgugcucgaggagaaggccaugaagcccguggagacccacagccugcagaugcugcacaccauccucuccacgggcagcccgcugaaggcccaguccuacgaguacgucuaccggugcaucaagagcuccauccugcucgggagcaucuccggcgggaccgacaucaucagcugcuucaugggccacaacuucucccugcccguguacaagggggagauccaggcgcgcaaccugggcauggccguggaggccuggaacgaggagggcaaggccgucuggggcgagagcggggagcucgugugcaccaagcccauccccugccagccgacccacuucuggaacgacgagaacgggaacaaguaccggaaggcguacuucagcaaguuccccggcaucugggcccacggggacuacugccgcaucaaccccaagacgggcggcaucgugaugcuggggcgguccgacggcacccugaaccccaacgggguccgcuucggcagcuccgagaucuacaacaucguggagagcuucgaggagguggaggacucccucugcgucccgcaguacaacaaguaccgggaggagcgcgugauccuguuccugaagauggccagcggccacgccuuccagcccgaccuggugaagcgcauccgggacgccauccgcauggggcucuccgcgcggcacguccccagccugauccuggagaccaagggcauccccuacacccucaacgggaagaagguggagguggccgucaagcagaucaucgccggcaaggccguggagcagggcggggccuucuccaacccggagacgcuggaccuguaccgcgacauccccgagcuccagggcuucuga

SEQ ID NO: 26134 - RNA, 1200 nt, Artificial Sequence
  derived and/or modified sequence opt1 from AADAC__Homo_sapiens__NP_001077
augggccgcaagagccuguaccuccugaucguggggauccugaucgccuacuacaucuacacgccccucccggacaacgucgaggagcccuggcggaugauguggaucaacgcccaccugaagaccauccagaaccuggcgaccuucguggagcuccugggccugcaccacuucauggacuccuucaagguggucgggagcuucgacgaggugccgcccaccuccgacgagaacgugaccgucaccgagacgaaguucaacaacauccucgugcgcguguacguccccaagcgcaagagcgaggcccugcggcggggccuguucuacauccacgggggcggcuggugcgugggguccgccgcccucagcggcuacgaccugcugucccgcuggaccgccgaccggcucgacgcgguggucgugagcaccaacuaccgccuggcccccaaguaccacuuccccauccaguucgaggacguguacaacgcccugcggugguuccuccgcaagaagguccuggccaaguacggggugaaccccgagcggaucggcaucuccggggacagcgcgggcggcaaccuggccgccgccgugacccagcagcuccuggacgacccggacgucaagaucaagcugaagauccagucccucaucuaccccgcccugcagccccuggacguggaccuccccagcuaccaggagaacuccaacuuccuguuccugagcaagucccucauggugcgcuucuggagcgaguacuucacgaccgaccggucccuggagaaggcgaugcugagccgccagcacgucccgguggaguccagccaccucuucaaguucgugaacuggagcucccugcugcccgagcgguucaucaaggggcacgucuacaacaaccccaacuacggcagcuccgagcucgccaagaaguaccccggguuccuggacgugcgcgccgccccgcugcucgccgacgacaacaagcugcggggccugccccucaccuacgucaucacgugccaguacgaccugcugcgcgacgacggccucauguacgugacccggcugcgcaacaccggggugcaggucacccacaaccacguggaggacggcuuccacggggcguucagcuuccugggccucaagaucucccaccggcugaucaaccaguacaucgaguggcugaaggagaaccuguga

SEQ ID NO: 26135 - RNA, 948 nt, Artificial Sequence
  derived and/or modified sequence opt1 from AAGAB__Homo_sapiens__NP_078942
auggccgccggcgugcccugcgcgcuggucaccagcugcuccagcguguucuccggggaccagcucgugcagcacauccugggcaccgaggaccugaucgucgaggugacgagcaacgacgccgugcgcuucuacccguggaccaucgacaacaaguacuacuccgccgacaucaaccucugcgucgugcccaacaaguuccuggugaccgccgagaucgccgagagcguccaggcguucgugguguacuucgacuccacccagaaguccgggcuggacagcgucagcuccuggcucccccuggccaaggccuggcugcccgaggugaugauccucgugugcgaccgggucagcgaggacggcaucaaccgccagaaggcccaggaguggugcaucaagcacggguucgagcugguggagcuguccccggaggagcuccccgaggaggacgacgacuuccccgagagcacgggcgugaagcggaucguccaggcgcugaacgccaacgugugguccaacguggucaugaagaacgaccgcaaccagggcuucagccugcucaacucccugaccgggaccaaccacagcaucggcuccgccgaccccugccacccggagcagccccaccuccccgccgccgacagcaccgagagccuguccgaccaccgcgggggcgcgagcaacacgaccgacgcccagguggacuccaucguggaccccaugcuggaccuggacauccaggagcucgccagccugaccaccgggggcggcgacgucgagaacuucgagcggcuguucuccaagcucaaggagaugaaggacaaggccgccacgcugccgcacgagcagcggaaggugcacgcggagaaggucgccaaggccuucuggauggccaucgggggcgaccgcgacgagaucgaggggcugagcuccgacgaggagcacuga

SEQ ID NO: 26136 - RNA, 2886 nt, Artificial Sequence
  derived and/or modified sequence opt1 from AAK1__Homo_sapiens__NP_055726
augaagaaguucuucgacagccgccgggagcagggcggguccggccuggggagcggcuccagcgggggcggcggguccaccagcggccucggguccggcuacaucgggcgcguguucggcaucggccggcagcaggucaccguggacgaggugcuggccgaggggggcuucgccaucgucuuccuggugcgcacgagcaacgggaugaagugcgcgcucaagcggauguucgugaacaacgagcacgaccugcaggucugcaagcgcgagauccagaucaugcgggaccuguccggccacaagaacaucgugggcuacaucgacagcuccaucaacaacgugagcuccggggacgucugggaggugcucauccugauggacuucugccgcggcgggcagguggucaaccugaugaaccagcggcuccagaccggcuucaccgagaacgaggugcugcagaucuucugcgacaccugcgaggccguggcccgccugcaccagugcaagacgcccaucauccaccgggaccucaaggucgagaacauccugcugcacgaccgcgggcacuacgugcucugcgacuucggcagcgccaccaacaaguuccagaacccgcagaccgagggcgugaacgccgucgaggacgagaucaagaaguacaccacgcuguccuaccgggcgcccgagauggugaaccuguacagcgggaagaucaucaccaccaaggccgacaucugggcccucggcugccugcuguacaagcucugcuacuucacccugcccuucggggagucccagguggccaucugcgacggcaacuucacgauccccgacaacagccgcuacucccaggacaugcacugccugauccgguacaugcucgagccggaccccgacaagcgccccgacaucuaccaggucagcuacuucagcuucaagcugcugaagaaggagugccccaucccgaacgugcagaacucccccauccccgcgaagcuccccgagccggugaaggccagcgaggccgccgccaagaagacccagcccaaggcgcggcugaccgaccccauccccaccacggagaccuccaucgccccgcgccagcggcccaaggccgggcagacccagcccaaccccggcauccugccgauccagcccgcccucaccccccgcaagcgggccacgguccagcccccgccccaggcggccggcagcuccaaccagcccgggcugcuggccagcgugccccagccgaagccccaggcccccccgucccagccccucccccagacccaggccaagcagccccaggcgccgcccaccccccagcagacccccagcacgcaggcccagggccugccggcccaggcccaggccaccccccagcaccagcagcagcuguuccucaagcagcagcagcagcagcagcagccccccccggcgcagcagcagcccgccgggaccuucuaccagcagcagcaggcccagacccagcaguuccaggccguccaccccgcgacgcagcagcccgccaucgcccaguucccgguggugucccagggcgggagccagcagcagcugaugcagaacuucuaccagcagcagcagcagcagcagcagcagcagcagcagcagcagcuggccaccgcccuccaccagcagcagcugaugacccagcaggcggcccugcagcagaagcccaccauggccgccggccagcagccccagccccagccggccgcggccccccagcccgcccccgcccaggagccggccauccaggcgcccguccgccagcagcccaaggugcagacgaccccgccccccgccgugcagggccagaaggucgggucccucacccccccgagcucccccaagacccagcgcgccggccaccggcgcauccugagcgacgugacgcacuccgccguguucgggguccccgcgagcaaguccacccagcugcuccaggccgccgccgccgaggcgagccugaacaaguccaagagcgccaccaccacccccagcggcuccccgcggacgagccagcagaacguguacaaccccuccgagggcagcaccuggaaccccuucgacgacgacaacuucuccaagcugaccgccgaggagcuccugaacaaggacuucgccaagcugggggagggcaagcaccccgagaagcuggggggcagcgccgagucccucaucccgggguuccagagcacccagggcgacgcguucgccacgaccuccuucagcgccggcaccgccgagaagcgcaaggggggccagaccguggacuccgggcugccccugcucagcgucuccgaccccuucaucccccugcaggugccggacgcccccgagaagcugaucgagggccucaagagccccgacacgucccugcugcuccccgaccugcugccgaugaccgaccccuucgggagcaccuccgacgcggugaucgagaaggccgacgucgccguggagagccucauccccggccuggagcccccggugccccagcggcugcccagccagaccgaguccgucacgagcaaccgcaccgacucccucaccggcgaggacagccugcuggacugcucccuccugagcaaccccaccacggaccugcucgaggaguucgccccgaccgcgaucuccgcccccgugcacaaggccgccgaggacagcaaccugaucuccggguucgacgugcccgagggcagcgacaaggucgccgaggacgaguucgacccgauccccgugcugaucaccaagaacccccaggggggccacucccggaacagcuccgggagcuccgagagcucccuccccaaccuggcgcgcagccugcuccugguggaccagcugaucgaccucuga

SEQ ID NO: 26137 - RNA, 759 nt, Artificial Sequence
  derived and/or modified sequence opt1 from AANAT__Homo_sapiens__NP_001160051
auggagccccagagcaugaagggccagaagcgcccguucgggggccccuggcggcugaaggugcucgggggcccgcccuggcugcgccggacccugcccaagcucgggcgccccaaggaggcccccgucgcccggauguccacccagagcacgcacccccugaagccggaggcgccccgccugccgcccggcauccccgagucccccagcugccagcggcgccacacccuccccgccuccgaguuccggugccugacccccgaggacgccgugagcgccuucgagaucgagcgcgaggccuucaucuccgugcugggcgucugcccgcucuaccuggacgagauccggcacuuccugacccucugccccgagcugagccuggggugguucgaggagggcugccucguggcguucaucaucgggucccugugggacaaggagcgccugaugcaggagagccucacgcugcaccgguccggcgggcacaucgcccaccuccacgugcuggccguccaccgcgccuuccggcagcagggccgcggccccauccugcuguggcgguaccuccaccaccuggggagccagcccgcggugcgccgggccgcccugaugugcgaggacgcccucgugccguucuacgagcgcuucuccuuccacgccgucggccccugcgcgaucaccguggggagccugaccuucauggagcugcacugcucccuccggggccaccccuuccugcgccgcaacagcggcugcuga

SEQ ID NO: 26138 - RNA, 468 nt, Artificial Sequence
  derived and/or modified sequence opt1 from AARD__Homo_sapiens__NP_001020528
augggccccggggacuuccgccggugccgcgagcggaucagccagggccugcaggggcucccgggccgcgccgagcugugguucccgccccggcccgccugcgacuucuucggggacggccgcuccaccgacauccaggaggaggcgcuggccgccagcccccuccuggaggaccugcggcgccggcucacccgcgccuuccagugggccgugcagcgggcgaucucccgccggguccaggaggccgccgccgcggccgccgcccgcgaggagcagagcuggacgggcguggaggccacccuggcgcggcugcgcgccgagcucguggagaugcacuuccagaaccaccagcuggcccggacccugcucgaccugaacaugaagguccagcagcugaagaaggaguacgagcucgagaucaccuccgacagccagucccccaaggacgacgccgccaaccccgaguga

SEQ ID NO: 26139 - RNA, 2958 nt, Artificial Sequence
  derived and/or modified sequence opt1 from AARS2__Homo_sapiens__NP_065796
auggccgccagcguggcggccgccgcccgccggcugcgccgggccauccgccggucccccgcguggcgcggccucagccaccggccgcuguccagcgagccgcccgccgccaaggccuccgcgguccgcgccgccuuccugaacuucuuccgggaccgccacgggcaccggcucgugcccagcgccuccgugcgcccccggggcgaccccagccugcuguucgucaacgccgggaugaaccaguucaagcccaucuuccucggcaccguggacccccgcuccgagauggcgggguuccggcgcguggccaacagccagaagugcguccgggccggcggccaccacaacgaccuggaggacguggggcgcgaccugucccaccacaccuucuucgagaugcucggcaacugggccuucgggggcgaguacuucaaggaggaggccugcaacauggcgugggagcugcugacccagguguacgggaucccggaggagcggcucuggaucagcuacuucgacggcgaccccaaggccggccuggaccccgaccuggagacgcgcgacaucuggcucucccuggggguccccgccagccgggugcuguccuucggcccgcaggagaacuucugggagaugggggacaccggccccugcggccccugcaccgagauccacuacgaccucgccgggggcgugggggcgccccagcuggucgagcuguggaaccucguguucaugcagcacaaccgcgaggccgacggcagccugcagccgcugccccagcgccacguggacacggggaugggccucgagcggcuggucgccgugcugcagggcaagcacuccaccuacgacaccgaccucuucagcccccugcugaacgccauccagcaggggugccgcgcgcccccguaccucggccgggugggggucgccgacgagggccgcaccgacacggccuaccgggugguggccgaccacauccgcacccuguccgucugcaucagcgacgggguguuccccggcaugagcggcccgccccuggugcuccggcgcauccugcggcgcgccguccgguucuccauggagauccugaaggccccgcccggguuccucggcagccuggugcccgucgugguggagacccugggggacgcguaccccgagcuccagcgcaacuccgcccagaucgccaaccuggucagcgaggacgaggccgccuuccuggcgucccucgagcggggccgccggaucaucgaccgcacccugcggacgcuggggcccagcgacauguuccccgccgagguggccuggucccucagccugugcggcgaccugggccucccccuggacaugguggagcugaugcuggaggagaaggggguccagcucgacuccgccggccuggagcgccuggcccaggaggaggcgcagcaccgggcccgccaggccgagccggugcagaagcaggggcucuggcuggacgugcacgcccugggcgagcuccagcgccagggcgucccgcccaccgacgacagccccaaguacaacuacucccugcggcccagcggguccuacgaguucgggaccugcgaggcccaggugcugcagcucuacaccgaggacgggacggcgguggccagcgucggcaaggggcagcgcugcggccugcugcucgaccggaccaacuucuacgccgagcagggcgggcaggccuccgaccgcggcuaccuggugcgggcggggcaggaggacgugcuguuccccgucgcccgcgcccaggugugcggcggguucauccuccacgaggccguggcccccgagugccugcggcugggcgaccagguccagcuccacguggacgaggcguggcgccugggcugcauggccaagcacaccgccacccaccuccugaacugggcccugcggcagacgcuggggcccggcaccgagcagcaggggagccaccucaacccggagcagcugcgccuggacgugaccacccagacgccccucacccccgagcagcugcgggccgucgagaacaccgugcaggaggcggugggccaggacgaggccgucuacauggaggaggugccccuggcccucaccgcccaggugccggggcugcgcucccuggacgaggucuaccccgaccccgugcggguggucagcgugggcgugcccgucgcccacgcgcucgacccggccucccaggccgcccugcagacgagcguggagcugugcugcggcacccaccuccugcgcaccggggcggugggcgaccuggucaucaucggggaccggcagcucagcaagggcaccacgcgccugcuggccgugaccggggagcaggcccagcaggcccgggagcucggccagucccuggcccaggaggugaaggcggccaccgagcgccugagccucggcucccgggacgucgccgaggcccugcgccugagcaaggacaucgggcggcucaucgaggccguggagaccgcggugaugccccaguggcagcgccgcgagcugcuggccacggucaagaugcuccagcggcgcgccaacaccgccauccggaagcugcagaugggccaggccgcgaagaagacccaggagcugcucgagcgccacuccaaggggccccugaucguggacaccgugagcgccgagucccugagcguccucgugaaggugguccggcagcugugcgagcaggcccccuccaccagcgugcugcuccuguccccgcagcccaugggcaaggugcugugcgccugccaggucgcccagggcgcgaugcccacguucaccgccgaggccugggcccucgcggugugcagccacaugggcggcaaggccugggggucccgcgucguggcccagggcaccgggagcaccacggaccuggaggccgcccuguccaucgcgcagaccuacgcccucagccagcuguga

SEQ ID NO: 26140 - RNA, 2907 nt, Artificial Sequence
  derived and/or modified sequence opt1 from AARS__Homo_sapiens__NP_001596
auggacagcacccugaccgccuccgagauccgccagcgguucaucgacuucuucaagcgcaacgagcacacguacgugcacagcuccgccaccaucccccucgacgacccgacccugcuguucgcgaacgccggcaugaaccaguucaagcccaucuuccucaacaccaucgaccccagccaccccauggccaagcugucccgggccgccaacacgcagaagugcauccgcgccgggggcaagcacaacgaccuggacgacgucgggaaggacguguaccaccacaccuucuucgagaugcucggcagcugguccuucggggacuacuucaaggagcuggcgugcaagauggcccuggagcuccugacccaggaguucggcaucccgaucgagcggcuguacgugaccuacuucggcggggacgaggccgcgggccucgaggccgaccuggagugcaagcagaucuggcagaaccuggggcucgacgacacgaagauccugcccggcaacaugaaggacaacuucugggagaugggggacaccggccccugcggccccugcagcgagauccacuacgaccgcaucgggggccgggacgccgcccaccuggucaaccaggacgacccgaacgugcucgagaucuggaaccugguguucauccaguacaaccgcgaggccgacgggauccugaagccccuccccaagaaguccaucgacaccggcaugggccuggagcggcuggucagcgugcuccagaacaagauguccaacuacgacaccgaccuguucgugcccuacuucgaggcgauccagaaggggacgggcgcccgcccguacaccgggaaggucggcgccgaggacgccgacgggaucgacauggccuaccgggugcuggcggaccacgcccgcaccaucaccguggcccucgccgacggcggccggcccgacaacacggggcgcggcuacguccugcggcgcauccugcggcgcgccgugcgguacgcgcacgagaagcucaacgccagccgcggguucuucgccacccugguggacgucguggugcagucccugggcgacgccuuccccgagcucaagaaggaccccgacauggucaaggacaucaucaacgaggaggaggugcaguuccugaagacccugagccgggggcgccgcauccucgaccggaagauccagucccugggcgacagcaagaccaucccgggcgacacggccuggcugcucuacgacaccuacggguuccccguggaccugaccggccugaucgcggaggagaaggggcucgucguggacauggacggcuucgaggaggagcgcaagcuggcccagcugaagucccaggggaagggcgccggcggggaggaccucaucaugcuggacaucuacgccaucgaggagcugcgggcgcgcggccucgaggugaccgacgacagccccaaguacaacuaccaccuggacuccagcgggagcuacgucuucgagaacacgguggccaccgucauggcccugcggcgcgagaagauguucguggaggagguguccaccggccaggagugcggcgucgugcuggacaagaccugcuucuacgccgagcagggcgggcagaucuacgacgagggguaccucgugaaggucgacgacagcuccgaggacaagacggaguucaccgugaagaacgcccaggugcggggcggguacguccugcacaucggcaccaucuacggcgaccugaaggugggggaccagguguggcuguucaucgacgagccccgccggcgcccgaucaugagcaaccacaccgcgacgcacauccugaacuucgcccugcgguccguccucggcgaggccgaccagaaggggagccugguggcccccgaccgccugcgguucgacuucaccgccaagggcgcgauguccacccagcagaucaagaaggccgaggagaucgccaacgagaugaucgaggccgccaaggcgguguacacccaggacugcccccucgccgccgccaaggcgauccaggggcugcgcgccgucuucgacgagacguaccccgacccggugcggguggucagcaucggcgugcccguguccgagcugcucgacgaccccagcggccccgccgggucccugaccagcgucgaguucugcggcgggacccaccuccgcaacuccagccacgccggcgccuucgugaucgugaccgaggaggcgaucgccaaggggauccggcgcaucgucgccgugaccggcgccgaggcccagaaggcgcuccggaaggccgagucccugaagaagugccugagcgugauggaggccaaggucaaggcccagacggccccgaacaaggacgugcagcgcgagaucgcggaccucggcgaggcccuggccaccgccgugaucccccaguggcagaaggacgagcugcgcgagacccucaagucccugaagaaggucauggacgaccuggaccgggcgagcaaggccgacgugcagaagcgcgugcucgagaagaccaagcaguucaucgacuccaaccccaaccagccgcuggucauccuggagauggagagcggggccagcgccaaggcccucaacgaggcgcugaagcuguucaagaugcacagcccccagacguccgccaugcuguucaccguggacaacgaggccggcaagaucacgugccucugccaggugccccagaacgccgccaaccgggggcugaaggcguccgaguggguccagcaggucagcggccucauggacgggaagggcggcgggaaggacguguccgcccaggccaccggcaagaacguggggugccugcaggaggcccugcagcucgccaccagcuucgcgcagcugcgccugggcgacgugaagaacuga

SEQ ID NO: 26141 - RNA, 2997 nt, Artificial Sequence
  derived and/or modified sequence opt1 from AASDH__Homo_sapiens__NP_001273597
augaagaagugcaaccugaaguacauccugguggagaagaagcagaucaacaaguucaagagcuuccacgagacccugcugaacuacgacaccuucacggucgagcacaacgaccucgugcuguuccgccugcacuggaagaacaccgaggugaaccucaugcugaacgacggcaaggagaaguacgagaaggagaagaucaaguccaucagcuccgagcacgucaacgaggagaaggccgaggagcacauggaccugcggcucaagcacugccuggccuacgugcugcacaccagcgggaccacgggcauccccaagaucgugcgcgucccgcacaagugcaucgugcccaacauccagcacuuccgggugcuguucgacaucacccaggaggacguccuguuccuggcgagcccccucaccuucgaccccagcgugguggagaucuuccuggcccuguccagcggggccucccuccugaucgucccgaccagcgugaagcugcuccccuccaagcuggccagcgugcuguucucccaccaccgcgucacggugcuccaggccacccccacccugcugcggcgcuucggcagccagcucaucaaguccaccgugcugagcgcgacgaccucccugcggguccucgcccucgggggcgaggccuuccccagccugaccgugcuccgcuccuggcggggcgaggggaacaagacccagaucuucaacguguacggcaucacggaggucagcagcugggccaccaucuaccgcaucccggagaagacccugaacuccacccugaagugcgagcuccccgugcagcugggguucccccugcucggcacgguggucgaggugcgggacaccaacggguucaccauccaggagggcagcggccaggucuuccucgggggccgcaaccgggugugcuuccuggacgacgaggugaccgucccccuggggacgaugcgcgcgaccggcgacuucgugaccgugaaggacggcgagaucuucuuccuggggcggaaggacucccagaucaagcgccacggcaagcggcugaacaucgagcucguccagcaggucgccgaggagcugcagcaggucgagagcugcgccgugaccugguacaaccaggagaagcugauccucuucaugguguccaaggacgccagcgugaaggaguacaucuucaaggagcugcagaaguaccugccgucccacgccgugcccgacgagcuggugcucaucgacagccugcccuucacgucccacgggaagaucgacgugagcgagcugaacaagaucuaccucaacuacaucaaccugaaguccgagaacaagcugagcggcaaggaggaccucugggagaagcugcaguaccuguggaaguccacccucaaccugcccgaggaccugcuccgcgucccggacgagagccuguuccugaacuccgggggcgacagccucaaguccauccggcugcugagcgagaucgagaagcucgugggcaccuccgugcccgggcugcuggagaucauccucagcagcuccauccuggagaucuacaaccacauccugcagaccgucgugcccgacgaggacgugacguuccgcaagagcugcgcgaccaagcggaagcucuccgacaucaaccaggaggaggccagcggcaccucccugcaccagaaggccaucaugaccuucacgugccacaacgagaucaacgccuucgucgugcugagccgcgggucccagauccucagccugaacuccacccgcuuccugaccaagcucggccacugcagcuccgccugccccagcgacuccgugagccagaccaacauccagaaccugaaggggcugaacuccccgguccucaucggcaagagcaaggaccccuccugcguggcgaaggugagcgaggagggcaagcccgccaucgggacccagaagauggagcugcacguccgguggcgcagcgacacgggcaagugcguggacgccagcccccugguggucaucccgaccuucgacaaguccuccaccaccguguacaucgggagccacucccaccggaugaaggccguggacuucuacagcggcaaggucaagugggagcagauccucggggaccgcaucgaguccagcgccugcguguccaagugcggcaacuucaucguggucggcugcuacaacgggcugguguacgugcugaaguccaacuccggcgagaaguacuggauguucacgaccgaggacgcggucaagagcuccgccaccauggaccccaccacggggcucaucuacaucggcagccacgaccagcacgccuacgcccuggacaucuaccggaagaagugcguguggaaguccaagugcggcgggaccguguucagcucccccugccugaaccucaucccccaccaccuguacuucgccacccugggcgggcuccugcuggcggucaacccggccaccggcaacgugaucuggaagcacagcugcgggaagccccucuucuccagcccccagugcugcagccaguacaucugcaucggcugcguggacggcaaccugcugugcuucacgcacuucggggagcaggucuggcaguucuccaccagcggcccgaucuucuccagccccugcaccucccccagcgagcagaagaucuucuucgggucccacgacugcuucaucuacugcugcaacaugaagggccaccuccaguggaaguucgagaccacgagccgcguguacgccacccccuucgccuuccacaacuacaacggguccaacgagaugcugcuggcggccgccagcaccgacggcaagguguggauccucgagucccagagcggccagcugcaguccgucuacgagcugccgggggagguguucagcucccccgugguccucgagagcaugcugaucaucggcugccgggacaacuacguguacugccuggaccuccucgggggcaaccagaaguga

SEQ ID NO: 26142 - RNA, 930 nt, Artificial Sequence
  derived and/or modified sequence opt1 from AASDHPPT__Homo_sapiens__NP_056238
augguguuccccgccaagcgcuucugccuggucccgagcauggagggcgugcggugggccuucuccugcgggaccuggcuccccagccgcgcggaguggcugcuggccgugcgguccauccagcccgaggagaaggagcgcaucggccaguucgucuucgcccgggacgccaaggccgcgauggccgggcgccucaugauccggaagcugguggccgagaagcugaacauccccuggaaccacauccgccuccagcggaccgccaagggcaagccggugcuggcgaaggacagcuccaaccccuaccccaacuucaacuucaacaucagccaccagggggacuacgccguccuggccgccgagcccgagcuccaggugggcaucgacaucaugaagacguccuucccgggccgcgggagcauccccgaguucuuccacaucaugaagcggaaguucaccaacaaggagugggagaccauccgcuccuucaaggacgaguggacccagcuggacauguucuaccggaacugggcccugaaggagagcuucaucaaggcgaucggcguggggcucggcuucgagcugcagcgccuggaguucgaccucagcccccugaaccuggacaucgggcaggucuacaaggagacgcgccucuuccuggacggcgaggaggagaaggagugggccuucgaggaguccaagaucgacgagcaccacuucguggccguggcccugcggaagcccgacggcucccggcaccaggacgucccgagccaggacgacuccaagcccacccagcgccaguucaccauccucaacuucaacgaccugaugagcuccgccgugcccaugacccccgaggacccgagcuucugggacugcuucugcuucacggaggagauccccauccggaacgggaccaaguccuga

SEQ ID NO: 26143 - RNA, 2781 nt, Artificial Sequence
  derived and/or modified sequence opt1 from AASS__Homo_sapiens__NP_005754
augcuccaggugcaccgcaccggccuggggcggcugggcgucagccuguccaaggggcuccaccacaaggccgugcuggccgugcgccgggaggacgucaacgcgugggagcgccgggcgccccuggccccgaagcacaucaagggcaucaccaaccucggguacaaggugcugauccagcccagcaaccgccgggccauccacgacaaggacuacgugaaggccggcggcauccugcaggaggacaucuccgaggccugccucauccugggggucaagcgcccgcccgaggagaagcugaugagccggaagacguacgccuucuucucccacaccaucaaggcccaggaggccaacaugggccuccuggacgagauccugaagcaggagauccgccucaucgacuacgagaagaugguggaccaccgcggggugcgggucguggcguucggccagugggccgggguggccggcaugaucaacauccugcacggcauggggcugcggcuccuggcccugggccaccacacccccuucaugcacaucgggauggcccacaacuaccgcaacagcucccaggcgguccaggccgugcgggacgccggcuacgagaucagccucggccugaugcccaaguccaucgggccccugaccuucguguucacgggcaccgggaacgucagcaagggcgcccaggccaucuucaacgagcuccccugcgaguacguggagccgcacgagcugaaggaggugucccagaccggggaccugcgcaaggucuacggcaccgugcucagccggcaccaccaccuggugcgcaagacggacgcggucuacgaccccgccgaguacgacaagcaccccgagcgguacaucucccgcuucaacaccgacaucgcccccuacacgaccugccugaucaacggcaucuacugggagcagaacaccccgcggcuccugacccgccaggacgcccagagccugcucgcccccgggaaguucucccccgcgggcguggaggggugccccgcccugccgcacaagcugguggccaucugcgacaucagcgccgacaccggcggguccaucgaguucaugaccgagugcacgaccaucgagcaccccuucugcauguacgacgccgaccagcacaucauccacgacagcgucgagggcuccggcauccucaugugcagcaucgacaaccugcccgcgcagcugcccaucgaggccaccgagugcuucggggacaugcucuacccguacguggaggagaugauccugagcgacgccacccagccccuggagucccagaacuucagccccgucgugcgcgacgccgugaucacguccaacggcacccuccccgacaaguacaaguacauccagacccugcgggagagccgcgagcgggcgcagucccugagcauggggacccgccggaagguccucgugcugggcuccggguacaucagcgagccggugcuggaguaccucucccgcgacggcaacaucgagaucacggucggcagcgacaugaagaaccagaucgagcagcuggggaagaaguacaacaucaaccccguguccauggacaucugcaagcaggaggagaagcugggcuuccugguggccaagcaggaccucgucaucagccugcugcccuacgugcuccacccccugguggccaaggccugcaucaccaacaaggucaacauggugaccgccuccuacaucaccccggcgcugaaggagcucgagaaguccguggaggacgccgggaucacgaucaucggcgagcugggccuggaccccgggcucgaccacaugcuggccauggagaccaucgacaaggccaaggaggucggcgccaccaucgagagcuacaucagcuacugcgggggccugcccgcgccggagcacuccaacaacccccuccgguacaaguucagcuggucccccgugggggugcugaugaacgucaugcagagcgccaccuaccugcucgacggcaagguggugaacgucgccggcgggaucagcuuccuggacgccgugacguccauggacuucuuccccggccugaaccucgagggguacccgaaccgcgacagcaccaaguacgccgagaucuacggcaucuccagcgcgcacacccugcugcgggggacccuccgcuacaagggcuacaugaaggcccugaacggcuucgugaagcuggggcucaucaaccgggaggcccugcccgccuuccgccccgaggcgaacccccugacguggaagcagcuccugugcgaccuggucggcaucuccccgagcuccgagcacgacgugcucaaggaggccgugcugaagaagcucgggggcgacaacacccagcuggaggccgccgaguggcuggggcugcucggcgacgagcaggucccccaggccgagagcauccuggacgcgcuguccaagcaccucgugaugaagcugagcuacggccccgaggagaaggacaugaucgugaugcgggacuccuucgggauccgccaccccagcggccaccuggagcacaagaccaucgaccucgucgccuacggggacaucaacggcuucuccgccauggccaagaccguggggcugccgaccgccauggcggccaagaugcugcucgacggcgagaucggcgccaaggggcugaugggccccuucagcaaggagaucuacgggcccauccuggagcggaucaaggccgagggcaucaucuacacgacccaguccaccaucaagcccuga

SEQ ID NO: 26144 - RNA, 1683 nt, Artificial Sequence
  derived and/or modified sequence opt1 from AATF__Homo_sapiens__NP_036270
auggccggcccccagccccuggcccuccagcuggagcagcugcucaacccccgccccagcgaggcggaccccgaggccgacccggaggaggccaccgccgcccgggugaucgaccgcuucgacgagggggaggacggcgagggggacuuccuggucgugggcuccauccggaagcuggcgagcgccucccuccuggacaccgacaagcgcuacugcgggaagacgaccagccggaaggccuggaacgaggaccacugggagcagacccugcccggcuccagcgacgaggagaucuccgacgaggagggcagcggggacgaggacuccgagggccucgggcuggaggaguacgacgaggacgaccugggcgccgcggaggagcaggagugcggggaccaccgcgagagcaagaagucccggagccacuccgccaagacccccggcuucagcgugcaguccaucagcgacuucgagaaguucacgaagggcauggacgaccucggguccagcgaggaggaggaggacgaggaguccggcauggaggagggggacgacgccgaggacagccagggcgagagcgaggaggaccgcgccggcgaccggaacuccgaggacgacggggucgugaugaccuucagcuccgugaaggucagcgaggagguggagaagggccgcgccgugaagaaccagaucgcgcugugggaccagcugcucgaggggcggaucaagcugcagaaggcccugcucaccaccaaccagcugccccagccggacgucuucccccuguucaaggacaagggcgggcccgaguucuccagcgcccucaagaacucccacaaggcccugaaggcccugcuccgcagccuggugggccugcaggaggagcuccuguuccaguaccccgacacgcgguaccugguggacggcaccaagccgaacgcgggguccgaggagaucagcuccgaggacgacgagcucgucgaggagaagaagcagcagcgccggcgcgugcccgccaagcggaagcuggagauggaggacuaccccagcuucauggccaagcgcuucgccgacuucaccguguaccggaaccgcacccugcagaaguggcacgacaagacgaagcucgccuccggcaagcuggggaagggcuucggggcguucgagcggagcauccugacccagaucgaccacauccucauggacaaggagcgccugcugcgccggacccagaccaagcgcuccgucuaccgggugcucggcaagcccgagccggccgcccagcccgugcccgagagccugcccggcgagccggagauccugccccaggcccccgccaacgcgcaccucaaggaccuggacgaggagaucuucgacgacgacgacuucuaccaccagcugcuccgcgagcugaucgagcggaagacguccagccuggaccccaacgaccaggucgccauggggcgccaguggcucgccauccagaagcugcgguccaagauccacaagaagguggaccgcaaggccagcaagggccggaagcugcgcuuccacgugcugagcaagcuccuguccuucauggcgccgaucgaccacaccaccaugaacgacgacgcccggaccgagcuguaccgcagccucuucgggcagcugcacccgcccgacgagggccacggggacuga

SEQ ID NO: 26145 - RNA, 4125 nt, Artificial Sequence
  derived and/or modified sequence opt1 from AATK__Homo_sapiens__NP_001073864
augagcuccagcuucuucaaccccuccuucgccuucagcucccacuucgacccggacggcgccccccugagcgagcucuccuggcccagcucccuggcgguggucgccgugagcuucuccgggcuguucgccgugaucguccucaugcuggccugccugugcugcaagaagggcgggaucggcuucaaggaguucgagaacgccgagggggacgaguacgcggccgaccucgcccagggcagccccgccaccgcggcccagaacggcccggacguguacgugcugccccugaccgaggucucccuccccauggccaagcagcccgggcgcagcgugcagcugcugaaguccacggacgugggccggcacagccuccuguaccugaaggagaucgggcgcggcugguucgggaaggucuuccucggcgaggugaacuccggcaucagcuccgcccagguggucgugaaggagcugcaggccagcgcgagcgugcaggagcagaugcaguuccuggaggagguccagccguaccgggcccucaagcacuccaaccugcugcagugccucgcccagugcgccgaggugacccccuaccugcuggugauggaguucugcccccucggggaccugaagggcuaccugcgcagcugccgggucgccgaguccauggcgcccgacccgcgcacccuccagcggauggccugcgagguggccugcggggugcugcaccugcaccgcaacaacuucguccacagcgaccucgcccugcggaacugccugcucaccgccgaccugacggugaagaucggcgacuacggccuggcgcacugcaaguaccgcgaggacuacuucgugaccgccgaccagcucugggucccccugcgguggaucgcccccgagcugguggacgagguccacuccaaccuccuggugguggaccagaccaagagcgggaacgucuggucccugggcgugaccaucugggagcucuucgagcuggggacgcagcccuacccgcagcacagcgaccagcaggugcuggccuacaccguccgcgagcagcagcucaagcugcccaagccccagcugcagcucacccuguccgaccggugguacgaggugaugcaguucugcuggcugcagcccgagcagcgcccgaccgccgaggaggugcaccugcuccugagcuaccugugcgcgaagggcgccacggaggccgaggaggaguucgagcggcgcuggcggucccuccgccccgggggcggcggggucggccccgggcccggcgccgcggggccgaugcugggcggcgugguggagcuggccgccgccagcuccuucccccuccuggagcaguucgccggggacggcuuccacgcggacggggacgacguccugaccgugaccgagaccagccggggccucaacuucgaguacaagugggaggccgggcgcggcgccgaggccuuccccgccacgcugucccccggccggaccgcgcgccugcaggagcucugcgccccggacggggccccccccggcguggucccggugcugagcgcccacucccccagccugggguccgaguacuucauccgccucgaggaggccgcgcccgccgccggccacgaccccgacugcgccggcugcgcgccgagcccccccgccaccgccgaccaggacgacgacagcgacggguccaccgccgccagccuggcgauggagccccugcucggccacgggccgcccguggacguccccuggggccggggggaccacuacccccgccggucccuggcccgcgacccgcugugccccagccggucccccagccccuccgccggcccgcucagccuggccgagggcggggccgaggacgcggacuggggcguggccgccuucugccccgccuucuucgaggacccccuggggacguccccccucggcagcuccggggccccgccccugccccugaccggcgaggacgagcucgaggaggugggcgcgcgccgggccgcccagcgcgggcacuggcggagcaacgucuccgccaacaacaacagcggcucccgcugccccgagagcugggacccgguguccgcggggggccacgccgaggggugccccagccccaagcagaccccgcgggccagccccgagcccggcuaccccggcgagccgcugcuggggcuccaggccgccuccgcgcaggagcccggcugcugccccgggcugccccaccugugcagcgcccagggccucgccccggcccccugccuggugacccccuccuggacggagaccgccagcuccgggggcgaccacccccaggcggagccgaagcuggccaccgaggccgagggcaccacggggccccgccucccccugcccagcgucccgucccccagccaggagggcgccccccugcccuccgaggaggccagcgcgccggacgcccccgacgcccuccccgacucccccaccccggccaccgggggcgaggugagcgccaucaagcuggcguccgcccugaacggcagcuccagcucccccgagguggaggcccccagcuccgaggacgaggacaccgccgaggcgacgagcgggaucuucaccgacaccagcuccgacggccuccaggcccggcgccccgacgucgugccggccuuccggagccugcagaagcagguggggacccccgacucccuggacagccucgacauccccuccagcgccuccgacggcggguacgaggucuucagcccguccgccacgggccccagcggcgggcagccccgcgcgcuggacuccggcuacgacaccgagaacuacgagagccccgaguucgugcugaaggaggcccaggaggggugcgagccgcaggccuucgccgagcucgccuccgagggcgaggggcccggccccgagacccggcugagcaccucccugagcggccucaacgagaagaaccccuaccgcgacuccgcguacuucagcgaccuggaggccgaggccgaggccaccuccgggccggagaagaagugcggcggggaccgggcccccggccccgagcuggggcuccccagcacgggccagccgagcgagcaggugugccugcgccccggcgucuccggggaggcgcagggcagcgggcccggcgaggugcugcccccgcuccugcagcuggagggcuccagccccgagcccuccaccugccccagcgggcucgugccggagccccccgagccccagggcccggccaagguccgccccgggcccucccccagcugcucccaguucuuccugcugaccccggugccccuccggagcgagggcaacuccagcgaguuccaggggcccccgggccugcuguccggccccgccccccagaagcgcauggggggccccgggaccccgcgggccccccuccgccuggcgcugcccggccuccccgccgcccuggaggggcggccggaggaggaggaggaggacagcgaggacuccgacgagagcgacgaggagcugcgcugcuacuccgugcaggagcccagcgaggacuccgaggaggaggcccccgccguccccgugguggucgcggagagccagagcgcccggaaccuccgcucccugcugaagaugccgagccuccuguccgagacguucugcgaggaccuggagcggaagaagaaggccgugagcuucuucgacgacgugaccgucuaccucuucgaccaggagucccccacccgcgagcugggcgagcccuuccccggcgccaaggagagcccgcccaccuuccugcgggggucccccggcagccccuccgccccgaaccgcccccagcaggcggacgggagccccaacggcuccacggccgaggaggggggcggcuucgccugggacgacgacuucccccucaugaccgccaaggccgcguucgccauggcccuggacccggccgcgcccgcccccgccgccccgacccccacccccgcccccuucagccgguucacgguguccccggcgcccaccagccgcuucuccaucacccacgugagcgacuccgacgccgagagcaagcgggggcccgaggccggcgccgggggcgaguccaaggaggccuga

SEQ ID NO: 26146 - RNA, 1503 nt, Artificial Sequence
  derived and/or modified sequence opt1 from ABAT__Homo_sapiens__XP_011520703
auggccagcaugcugcucgcccagcgccuggcgugcuccuuccagcacagcuaccggcugcucgugcccggcucccgccacaucagccaggccgccgccaaggucgacguggaguucgacuacgacgggccgcugaugaagaccgaggugcccggcccccggucccaggagcugaugaagcagcucaacaucauccagaacgccgaggcgguccacuucuucugcaacuacgaggagagccgcgggaacuaccugguggacguggacggcaaccggaugcuggaccucuacucccagaucagcuccguccccaucggguacagccacccggcccugcugaagcucauccagcagccccagaacgccuccauguucgugaaccgccccgcccugggcauccugcccccggagaacuucguggagaagcuccggcagagccugcuguccgucgcgcccaagggcaugagccagcucaucaccauggccugcggguccugcagcaacgagaacgcccugaagacgaucuucaugugguaccgcuccaaggagcggggccagcgcggguucagccaggaggagcuggagaccugcaugaucaaccaggcccccggcugccccgacuacuccauccucagcuucaugggggccuuccacggccggaccaugggcugccuggcgaccacgcacagcaaggccauccacaagaucgacaucccguccuucgacuggcccaucgcccccuucccccgccugaaguacccgcucgaggaguucgugaaggagaaccagcaggaggaggcccggugccuggaggagguggaggaccugaucgucaaguaccgcaagaagaagaagaccguggccgggaucaucguggagcccauccagagcgagggcggggacaaccacgcguccgacgacuucuuccggaagcuccgcgacaucgcccggaagcacggcugcgccuuccuggucgacgaggugcagaccggcgggggcugcaccgggaaguucugggcccacgagcacuggggccuggacgaccccgccgacgugaugacguucagcaagaagaugaugaccgggggcuucuuccacaaggaggaguuccgccccaacgcgccguaccggaucuucaacaccuggcucggcgaccccuccaagaaccugcugcucgccgaggucaucaacaucaucaagcgcgaggaccugcugaacaacgccgcccacgccgggaaggcgcuccugaccggccugcucgaccugcaggcccgguacccccaguucaucagccgcgugcgcgggcggggcacguucugcuccuucgacacccccgacgacagcauccgcaacaagcugauccucaucgcccggaacaagggggugguccugggcggcugcggggacaaguccauccgcuuccggccgacccugguguuccgcgaccaccacgcccaccucuuccugaacaucuucagcgacauccuggcggacuucaaguga

SEQ ID NO: 26147 - RNA, 6834 nt, Artificial Sequence
  derived and/or modified sequence opt1 from ABCA12__Homo_sapiens__NP_056472
auguucaccuacaucaagaucaucaccagcggcgacagcgacaacaucacgcacguguggaacgaggacgacgggcagacccugagccccagcagccucgccgcccagcugcugauccucgagaacuucgaggacgcgcugcugaacaucagcgccaacagcccguacauccccuaccucgccugcgugcgcaacgugaccgacagccuggcccggggcagccccgagaaccugcgccuccugcaguccaccauccgguucaagaaguccuuccugcgcaacggguccuacgaggacuacuucccgcccgugcccgagguccucaagagcaagcugucccagcugcggaaccucacggagcugcugugcgagagcgagaccuucucccucaucgagaaguccugccagcuguccgacaugagcuucggcucccugugcgaggagagcgaguucgaccuccagcugcuggaggccgcggagcucgggaccgagaucgccgccagccugcuguaccacgacaacgugaucuccaagaaggugcgcgaccuccugaccggcgaccccagcaagaucaaccugaacauggaccaguuccucgagcaggcccugcagaugaacuaccuggagaacaucacgcagcucauccccaucaucgaggcgaugcugcacgucaacaacuccgccgacgccagcgagaagccgggccagcugcucgagauguucaagaacguggaggagcugaaggaggaccugcggcgcaccaccgggauguccaaccggaccaucgacaagcuccuggccauccccauccccgacaaccgcgccgagaucaucagccagguguucuggcugcacuccugcgacacgaacaucaccacccccaagcucgaggacgcgaugaaggaguucugcaaccugagccuguccgagcggagccgccaguccuaccucaucggccugacccugcuccacuaccugaacaucuacaacuucacguacaaggucuucuucccgcggaaggaccagaagcccguggagaagaugauggagcuguucauccgccugaaggagauccucaaccagauggccagcgggacccacccccugcuggacaagaugcggucccucaagcagaugcaccucccccgcagcgugccgcugacccaggccauguaccgguccaaccgcaugaacacgccccagggcagcuucuccaccaucagccaggcccucugcucccaggggaucaccaccgaguaccugaccgccaugcugcccagcagccagcggcccaagggcaaccacacgaaggacuuccucaccuacaagcugaccaaggagcagaucgcguccaaguacggcaucccgaucaacagcacccccuucugcuucucccuguacaaggacaucaucaacaugcccgccgggcccgucaucugggccuuccucaagccgaugcugcugggccgcauccucuacgcccccuacaaccccgugacgaaggccaucauggagaaguccaacgugacccugcggcagcuggcggagcuccgcgagaagucccaggaguggauggacaagagcccccuguucaugaacuccuuccaccuccugaaccaggccaucccgaugcugcagaacacccugcgcaaccccuucguccagguguucgugaaguucagcgucgggcucgacgccguggagcugcugaagcagaucgacgagcucgacauccugcggcugaagcucgagaacaacaucgacaucaucgaccagcugaacacccuguccagccucacggugaacaucuccagcugcguccuguacgaccgcauccaggccgccaagaccaucgacgagauggagcgggaggcgaagcgccuguacaaguccaacgagcuguucggcagcgugaucuucaagcugcccuccaaccggagcuggcaccgcggcuacgacuccgggaacguguuccugccgcccgucaucaaguacaccauccggaugagccucaagaccgcccagacgacccgcagccugcggaccaagaucugggcccccggcccccacaacuccccgagccacaaccagaucuacgggcgcgccuucaucuaccugcaggacuccaucgagcgggcgaucaucgagcuccagaccggccgcaacagccaggagaucgccgugcagguccaggccauccccuaccccugcuucaugaaggacaacuuccugaccuccgugagcuacucccugcccaucgugcucauggucgccugggugguguucaucgccgcguucgucaagaagcugguguacgagaaggaccugcggcuccacgaguacaugaagaugaugggggugaacagcugcucccacuucuucgccuggcugaucgagagcgucggcuuccugcucgugacgaucgugauccugaucaucauccugaaguucggcaacauccucccgaagaccaacggguucauccuguuccuguacuucuccgacuacagcuucuccgucaucgccaugagcuaccucaucuccguguucuucaacaacaccaacaucgccgcccugaucggcagccugaucuacaucaucgcguucuuccccuucaucgugcucgucaccguggagaacgagcuguccuacgugcugaaggucuucaugagccuccugucccccacggccuucagcuacgccagccaguacaucgcccgcuacgaggagcaggggaucggccugcagugggagaacauguacaccucccccgugcaggacgacaccaccagcuucggguggcucugcugccugauccuggccgacuccuucaucuacuuccucaucgcgugguacgugcggaacgucuucccgggcacguacggcauggccgcccccugguacuuccccauccugcccagcuacuggaaggagcgcuucgggugcgccgaggugaagccggagaaguccaacggccugauguucaccaacaucaugaugcagaacaccaaccccagcgcgucccccgaguacauguucagcuccaacaucgagcccgagccgaaggaccucaccgugggggucgcccugcacggcgugacgaagaucuacgggagcaagguggccgucgacaaccugaaccucaacuucuacgagggccacaucaccucccugcugggccccaacggggccggcaagaccaccacgaucagcaugcucaccgggcuguucggcgccuccgcgggcaccaucuucguguacgggaaggacaucaagaccgaccugcacacggugcggaagaacaugggcgucugcaugcagcacgacguccuguucagcuaccugaccaccaaggagcaccuccuccuguacggguccaucaaggugccccacuggaccaagaagcagcugcacgaggaggucaagcgcacgcucaaggacaccggccuguacagccaccggcacaagcgcguggggacccuguccggcggcaugaagcgcaagcucagcaucuccaucgcccugaucgggggcagccggguggucauccuggacgagcccagcaccgggguggacccgugcucccgccggagcaucugggacgugaucuccaagaacaagacggcccgcaccaucauccucagcacccaccaccuggacgaggccgagguccuguccgaccggaucgccuuccuggagcagggcgggcuccgcugcugcggcagccccuucuaccugaaggaggcguucggcgacggguaccaccugacccucacgaagaagaagucccccaaccugaacgccaacgccgugugcgacaccauggccgugaccgccaugauccagagccaccuccccgaggcguaccugaaggaggacaucggcggggagcuggucuacgugcugccgcccuucuccaccaaggugagcggcgccuaccucucccugcugcgggcccucgacaacgggaugggcgaccugaacaucggcugcuacgggaucagcgacacgaccgucgaggagguguuccugaaccucaccaaggagucccagaagaacagcgccaugucccuggagcaccugacccagaagaagaucggcaacagcaacgcgaacgggaucuccacccccgacgaccucagcguguccagcagcaacuucacggaccgcgacgacaagauccugacccggggcgagcgccuggacggguucggccuccugcugaagaagaucauggccauccucaucaagcgguuccaccacacccgccggaacuggaagggccugaucgcccaggucauccugccgaucguguucgugaccacggccauggggcucggcacccugcgcaacuccagcaacuccuaccccgagauccagaucagccccucccuguacgggaccagcgagcagaccgccuucuacgcgaacuaccaccccuccacggaggcccucgucagcgccaugugggacuucccgggcaucgacaacaugugccugaacaccuccgaccugcagugccucaacaaggacagccuggagaaguggaacaccuccggcgagcccaucaccaacuucggggugugcagcugcuccgagaacguccaggagugccccaaguucaacuacuccccgccccaccggcgcacguacuccagccaggugaucuacaaccugaccggccagcggguggagaacuaccucaucuccaccgccaacgaguucguccagaagcgcuacgggggcuggagcuucgggcugccccugaccaaggaccuccgguucgacaucacgggcgugcccgccaaccgcacccuggcgaaggugugguacgaccccgagggcuaccacucccugccggccuaccucaacagccugaacaacuuccugcuccgggucaacaugagcaaguacgacgccgcccgccacgggaucaucauguacucccaccccuaccccggcgugcaggaccaggagcaggccaccaucagcucccugaucgacauccugguggcgcucagcauccugaugggguacuccgucaccacggccagcuucgugaccuacgugguccgcgagcaccagaccaaggccaagcagcugcagcacaucuccggcaucggggugaccugcuacugggugacgaacuucaucuacgacauggucuucuaccucgugcccguggccuucagcaucggcaucaucgccaucuucaagcugccggcguucuacuccgagaacaaccugggcgccgucagccuccugcugcuccuguucggguacgccaccuucuccuggauguaccugcucgccggccuguuccacgagaccgggauggcguucaucaccuacgugugcgugaaccuguucuucggcaucaacagcaucgucucccucagcgugguguacuuccuguccaaggagaagcccaacgaccccacgcuggagcucaucagcgagacccugaagcggaucuuccugaucuucccccaguucugcuucggguacggccucaucgagcugucccagcagcagagcguccuggacuuccucaaggccuacggcguggaguacccgaacgagaccuucgagaugaacaagcugggggccauguucguggcccuggucucccagggcaccauguucuucagccuccgccugcugaucaacgagagccucaucaagaagcugcggcuguucuuccgcaaguucaacuccagccacgugcgggagacgaucgacgaggacgaggacgugcgcgccgagcggcuccgcgucgaguccggggcggccgaguucgaccuggugcagcuguacugccucaccaagaccuaccagcugauccacaagaagaucaucgccgugaacaacaucagcaucggcauccccgccggcgagugcuucgggcugcucggcgucaacggggccggcaagaccacgaucuucaagaugcugaccggggacaucauccccuccagcggcaacauccugauccggaacaagaccggcucccucgggcacguggacagccacuccagccuggugggcuacugcccccaggaggacgcgcuggacgaccucgucaccguggaggagcaccuguacuucuacgcccgcgugcacgggaucccggagaaggacaucaaggagaccguccacaagcugcuccggcgccugcaccugaugcccuucaaggaccgggccacguccaugugcagcuacggcaccaagcgcaagcucuccaccgcccuggcccugaucgggaagcccagcauccugcuccuggacgagccguccagcggcauggaccccaaguccaagcggcaccuguggaagaucaucagcgaggaggugcagaacaagugcagcgugauccucaccucccacagcauggaggagugcgaggcgcugugcacgcgccuggccaucauggucaacggcaaguuccagugcaucgggucccuccagcacaucaagagccgguucggccgcggguucaccgugaaggugcaccugaagaacaacaaggucaccauggagacccugacgaaguucaugcagcuccacuuccccaagaccuaccugaaggaccagcaccuguccaugcucgaguaccacgugcccgugaccgccggcggggucgccaacaucuucgaccugcuggagaccaacaagacggcgcucaacaucaccaacuuccuggugagccagaccacccuggaggagguguucaucaacuucgccaaggaccagaaguccuacgagacggccgacaccagcucccagggcagcaccaucuccgucgacagccaggacgaccagauggaguccuga

SEQ ID NO: 26148 - RNA, 15177 nt, Artificial Sequence
  derived and/or modified sequence opt1 from ABCA13__Homo_sapiens__NP_689914
auggggcacgccgggugccaguucaaggcccugcucuggaagaacuggcugugccggcugcggaaccccguccuguuccuggccgaguucuucuggcccugcauccuguucgugauccucaccgugcugcgcuuccaggagccgccccgguaccgcgacaucugcuaccugcagccccgggaccuccccagcugcggcgugauccccuucguccagucccugcugugcaacaccgggagccgcugccggaacuucagcuacgagggcagcauggagcaccacuuccgccucagccgguuccagacggccgccgaccccaagaaggugaacaaccuggccuuccugaaggagauccaggaccucgccgaggagauccacgggaugauggacaaggccaagaaccugaagcgccuguggguggagcggagcaacacccccgacuccagcuacggcagcagcuucuucaccauggaccucaacaagaccgaggaggugauccugaagcuggagagccuccaccagcagccccacaucugggacuuccugcugcuccugccccgccugcacacgagccacgaccacguggaggacggcauggacguggccgugaaccuccugcagaccauccugaacagccucaucagccuggaggaccuggacuggcucccccugaaccagaccuucagccaggugagcgagcuggugcucaacgugaccaucagcacgcugaccuuccugcagcagcacgggguggccgugaccgagcccguguaccaccucagcaugcagaacaucgugugggacccccagaaggugcaguacgaccugaagucccaguucggcuucgacgaccugcacaccgagcagauccucaacagcagcgccgagcugaaggagauccccacggacaccucccuggagaagauggugugcagcgugcucuccagcaccuccgaggacgaggcggagaagugggggcacgugggcgggugccaccccaaguggagcgaggccaagaacuaccugguccacgccguguccuggcugcggguguaccagcaggucuucgugcaguggcagcagggcagccuccugcagaagacccugacgggcauggggcacucccuggaggcccuccgcaaccaguucgaggaggagagcaagcccuggaaggucguggaggcccugcacaccgcgcugcuccugcugaacgacucccucagcgccgacggccccaaggacaaccacaccuuccccaagauccugcagcaccuguggaagcuccagucccugcugcagaaccucccccaguggcccgcccugaagcgguuccugcagcucgacggggcccugcgcaacgccaucgcgcagaaccugcacuucgugcaggagguccucaucugccuggagaccagcgccaacgacuucaagugguucgagcugaaccagcucaagcuggagaaggacguguucuucugggagcugaagcagaugcucgccaagaacgccgugugccccaacggccgguucuccgagaaggaggucuuccugccgcccggcaacagcuccaucuggggcgggcugcaggggcuccugugcuacugcaacagcuccgagacgagcgugcugaacaagcuccugggcagcguggaggacgccgaccgcauccugcaggaggucaucaccuggcacaagaacauguccgugcucauccccgaggaguaccuggacuggcaggagcuggagaugcagcucagcgaggcgucccugagcugcacccggcuguuccuccugcugggggccgaccccucccccgagaacgacguguucagcuccgacugcaagcaccagcucgucagcaccgugaucuuccacacgcuggagaagacccaguucuuccuggagcaggccuacuacuggaaggccuucaagaaguucauccgcaagaccugcgagguggcccaguacgucaacaugcaggaguccuuccagaaccggcuccuggcguuccccgaggagagccccugcuucgaggagaacauggacuggaagaugaucuccgacaacuacuuccaguuccugaacaaccuccucaagagcccgaccgccuccaucagccgcgcccugaacuucacgaagcaccuccugaugauggagaagaagcugcacacccucgaggacgagcagaugaacuuccugcuguccuucguggaguucuucgagaagcuccugcugcccaaccucuucgacagcuccaucgugcccagcuuccacagccugccgucccugaccgaggacauccucaacaucagcucccuguggaccaaccaccucaagagccucaagcgcgaccccuccgccacggacgcgcagaagcugcuggaguucggcaacgaggucaucuggaagaugcagacccucggcagccacuggauccggaaggagcccaagaaccugcugcgcuucaucgagcucauccuguucgagaucaaccccaagcugcucgagcugugggccuacgggaucuccaagggcaagcgggccaagcuggagaacuucuucacccuccugaacuucagcgugccggagaacgagauccuguccaccagcuucaacuucucccagcuguuccacagcgacuggcccaagucccccgccaugaacaucgacuucgugcgccugagcgaggccaucaucacgucccugcacgaguucggguuccucgagcaggagcagaucagcgaggcgcugaacaccgucuacgccauccggaacgccuccgaccuguucagcgcccucuccgagccccagaagcaggagguggacaagauccugacccacauccaccugaacguguuccaggacaaggacagcgcccuccugcugcagaucuacagcuccuucuaccgcuacaucuacgagcuccugaacauccagagccggggcuccagccugaccuuccugacccagaucuccaagcacauccucgacaucaucaagcaguucaacuuccagaacaucagcaaggcguucgccuuccuguucaagacggccgagguccugggcgggaucuccaacgugagcuacugccagcagcuccuguccaucuucaacuuccuggagcuccaggcccagagcuucauguccaccgaggggcaggagcuggaggugauccacaccacccugacggggcucaagcagcugcugaucaucgacgaggacuuccgcaucagccucuuccaguacaugucccaguucuucaacagcuccgucgaggaccugcuggacaacaagugccucaucagcgacaacaagcacaucuccagcgugaacuacuccaccagcgaggagagcuccuucguguucccgcuggcccagaucuucagcaaccuguccgcgaacgucagcguguucaacaaguucauguccauccacugcaccgugagcuggcuccagauguggaccgagaucugggagacgaucucccagcuguucaaguucgacaugaacgucuucaccagccugcaccacggcuucacccagcuccuggacgagcuggaggacgacgugaagguguccaagagcugccaggggauccuccccacccacaacgucgcccggcugauccugaaccucuucaagaacgugacgcaggccaacgacuuccacaacugggaggacuuccuggaccugcgcgacuuccucguggcccugggcaacgcgcuggucuccgugaagaagcucaaccuggagcaggucgagaagucccuguucaccauggaggccgcccuccaccagcugaagaccuuccccuucaacgaguccaccagccgggaguuccugaacucccuccuggaggucuucaucgaguucagcuccacgagcgaguacaucgugcgcaaccuggacuccaucaacgacuuccucagcaacaaccugaccaacuacggggagaaguucgagaacaucaucaccgagcugcgggaggccaucguguuccuccgcaacgucagccacgaccgggaccuguucuccugcgccgacaucuuccagaacgugaccgagugcauccuggaggacggcuuccucuacgugaacacgagccagcgcaugcugcggauccuggacacccucaacuccaccuucagcuccgagaacaccaucagcucccugaagggcugcaucgucuggcuggacgugaucaaccaccucuaccugcugagcaacuccagcuucucccaggggcaccuccagaacauccugggcaacuuccgcgacaucgagaacaagaugaacagcauccugaagaucgugacguggguccucaacaucaagaagccccugugcuccagcaacgggucccacaucaacugcgugaacaucuaccugaaggacgucaccgacuuccucaacaucgugcugaccaccguguucgagaaggagaagaagccgaaguucgagauccugcucgcgcugcugaacgacagcacgaagcagguccggauguccaucaacaaccucaccaccgacuucgacuucgccagccaguccaacuggcgcuacuucaccgagcugauccugcgccccaucgagaugagcgacgagauccccaaccaguuccagaacaucuggcuccaccugaucacgcugggcaaggaguuccagaagcucgugaagggcaucuacuucaacauccuggagaacaacagcuccagcaagaccgagaaccugcucaacaucuucgccaccucccccaaggagaaggacgugaacagcgucgggaacuccaucuaccaccuggccagcuaccuggccuucucccucagccacgaccugcagaacuccccgaagaucaucaucagccccgagaucaugaaggcgaccggccuggggauccagcucauccgggacguguucaacucccugaugcccgugguccaccacacgagcccccagaacgccggcuacaugcaggcccugaagaaggugaccuccgugaugcgcacccucaagaaggccgacaucgaccugcuggucgaccagcucgagcaggucagcgugaaccugauggacuucuucaagaacaucuccagcgucgggaccggcaaccugguggugaaccuccuggucggccugauggagaaguucgccgacuccagccacuccuggaacgugaaccaccuccugcagcugagccgccuguucccgaaggacguggucgacgcggugaucgacguguacuacguccugccccacgccgugcgccugcugcagggggugcccggcaagaacaucaccgaggggcucaaggacgucuacagcuucacgcugcugcacggcaucaccaucuccaacaucaccaaggaggacuucgccaucgugaucaagauccuccuggacaccaucgagcuggugagcgacaagcccgacaucaucuccgaggcccucgcgugcuucccggucguguggugcuggaaccacacgaacagcggguuccggcagaacuccaagaucgaccccugcaacgugcacggccugaugagcuccagcuucuacggcaaggucgccuccauccuggaccacuuccaccucagcccccagggggaggacuccccgugcagcaacgaguccagccgcauggagaucacccggaagguggugugcaucauccacgagcuggucgacuggaacuccauccugcucgagcugagcgagguguuccacgugaacaucucccuggucaagaccgugcagaaguucuggcacaagauccuccccuucgugccgcccagcaucaaccagacccgcgacagcaucuccgagcugugcccgagcggcuccaucaagcaggucgcccugcagaucaucgagaagcucaagaacgugaacuucacgaaggugaccagcggggagaacauccuggacaagcuguccagccucaacaagauccugaacaucaacgaggacaccgagaccuccguccagaacaucaucagcuccaaccuggagcggacggugcagcucaucagcgaggacuggucccuggagaaguccacccacaaccugcucucccuguucaugaugcugcagaacgccaacgugaccggcagcucccucgaggcccugagcuccuucaucgagaaguccgagacccccuacaacuucgaggagcuguggcccaaguuccagcagaucaugaaggaccucacgcaggacuuccgcauccggcaccuccuguccgagaugaacaaggggaucaagagcaucaacagcauggcgcuccagaagaucacccugcaguucgcccacuuccuggagauccucgacucccccagccugaagacccuggagaucaucgaggacuuccuccuggucaccaagaacuggcugcaggaguacgccaacgaggacuacucccgcaugaucgagacccuguucaucccggugaccaacgagagcuccaccgaggacaucgcccugcuggccaaggcgaucgccaccuucuggggcagccucaagaacaucucccgggccggcaacuucgacguggccuuccugacgcaccuccugaaccaggagcagcugaccaacuucagcgucgugcagcuccuguucgagaacauccugaucaaccugaucaacaaccucgccgggaacucccaggaggcggccuggaaccugaacgacaccgaccugcagaucaugaacuucaucaaccucauccugaaccacaugcagagcgagaccucccgcaagacgguccugagccuccgguccaucguggacuucaccgagcaguuccugaagaccuucuucagccuguuccucaaggaggacuccgagaacaagaucagccugcugcucaaguacuuccacaaggacgugaucgccgagauguccuucguccccaaggacaagauccuggagauccugaagcucgaccaguuccugacccugaugauccaggaccgccucaugaacaucuucagcucccugaaggagacgaucuaccaccugaugaaguccagcuucauccucgacaacggcgaguucuacuucgacacccaccaggggcugaaguucaugcaggaccuguucaacgcccuccugcgggagaccuccaugaagaacaagaccgagaacaacaucgacuucuucacgguggugagccagcuguucuuccacgucaacaaguccgaggaccucuucaagcugaaccaggaccugggcagcgcccuccaccuggugcgcgagugcuccaccgagauggcgcggcugcucgacaccauccugcacagccccaacaaggacuucuacgcccuguaccccacccuccaggaggugauccuggccaaccugaccgaccuccuguucuucaucaacaacuccuucccgcugcgcaaccgggccacgcuggagaucaccaagcgccucgucggggcgaucagccgcgccuccgaggagagccacgugcugaagccccugcucgagauguccggcacccuggugaugcugcucaacgacagcgccgaccugcgggaccuggccaccuccauggacagcaucgucaagcuccugaagcuggugaagaagguguccggcaagaugagcacggucuucaagacccacuucaucuccaacaccaaggacagcgugaaguucuucgacacccucuacuccaucaugcagcagagcgugcagaaccuggucaaggagaucgccacgcugaagaagaucgaccacuucaccuucgagaagaucaacgaccuccuggugcccuuccuggaccucgcguucgagaugaucgggguggagcccuacaucagcuccaacagcgacaucuucuccaugagcccguccauccugagcuacaugaaccaguccaaggacuucagcgacauccuggaggagaucgccgaguuccucaccuccgucaagaugaaccuggaggacaugcgcagccuggccguggccuucaacaacgagacccagacguucuccauggacagcgugaaccuccgggaggagauccugggcugccugguccccaucaacaacaucaccaaccagauggacuuccucuaccccaaccccaucuccacccacagcgggccgcaggacaucaagugggagaucauccacgaggugauccccuuccuggacaagauccugucccagaacagcaccgagaucggcuccuuccucaagauggugaucugccugacgcuggaggcccucuggaagaaccugaagaaggacaacuggaacgucagcaacgugcugaugaccuucacccagcaccccaacaaccuccugaagaccaucgagacggugcuggaggcguccagcggcaucaagagcgacuacgagggggaccucaacaagucccuguacuucgacacgccccugagccagaacaucacccaccaccagcucgagaaggccauccacaacguccugucccgcaucgcccuguggcggaagggccuccuguucaacaacagcgaguggaucaccuccacgcgcacccuguuccagccccuguucgagaucuucaucaaggccaccaccgggaagaacgugacgagcgagaaggaggagcggaccaagaaggagaugaucgacuuccccuacuccuucaagcccuucuucugccuggagaaguaccugggcggccuguucgugcugaccaaguacuggcagcagaucccccugaccgaccagagcgucguggagaucugcgagguguuccagcagacggucaagccguccgaggccauggagaugcuccagaaggugaagaugauggugguccgcgugcugaccaucguggcggagaaccccagcuggaccaaggacauccugugcgccacccucuccugcaagcagaacggcauccggcaccugauccugagcgccauccagggcgucacgcucgcccaggaccacuuccaggagaucgagaagaucugguccagccccaaccagcugaacugcgagucccugagcaagaaccucuccagcacccuggaguccuucaagagcagccuggagaacgcgaccgggcaggacugcaccucccagccgcgccucgagacggugcagcagcaccuguacaugcuggccaagagccucgaggagaccugguccagcggcaaccccaucaugaccuuccuguccaacuucaccgugaccgaggacgucaagaucaaggaccugaugaagaacaucacgaagcucaccgaggagcugcggagcuccauccagaucagcaacgagaccauccacuccauccuggaggccaacaucagccacuccaagguccucuucagcgcccugaccguggcccuguccgggaagugcgaccaggagauccuccaccuccugcucacguuccccaagggcgagaaguccuggaucgcggccgaggagcugugcucccugcccgggagcaaggucuacucccucaucgugcugcugagccgcaaccucgacgugcgggccuucaucuacaagacccugaugccgagcgaggccaacggccugcucaacucccugcuggacaucgucagcucccucagcgcccugcuggcgaaggcccagcacguguucgaguaccugcccgaguuccuccacaccuucaagaucaccgcccugcuggagacgcucgacuuccagcaggucucccagaacgugcaggcccgcagcuccgccuucggcagcuuccaguucgugaugaagauggucugcaaggaccaggcguccuuccugagcgacuccaacauguucaucaaccugccccgggugaaggagcuccuggaggacgacaaggagaaguucaacauccccgaggacagcaccccguucugccugaagcucuaccaggagauccugcagcugcccaacggggcccucguguggaccuuccugaagcccauccugcacggcaagauccucuacacccccaacacgccggagaucaacaaggucauccagaaggccaacuacaccuucuacaucguggacaagcugaagacccuguccgagacccuccuggagaugagcucccuguuccagcgcagcggguccggccagauguucaaccagcuccaggaggcccugcggaacaaguucgugcgcaacuucgucgagaaccagcugcacaucgacguggacaagcucacggagaagcugcagaccuacgggggccugcucgacgagauguucaaccacgcgggcgccgggcgguuccgcuuccugggcagcauccuggugaaccucuccagcugcgucgcccugaaccgcuuccaggcccugcagagcguggacauccucgagaccaaggcccacgagcugcugcagcagaacuccuuccucgcgagcaucaucuucuccaacagccuguucgacaagaacuuccgguccgagagcgugaagcugccgccccacgucuccuacaccauccgcacgaacgugcucuacagcgugcggaccgacgucgugaagaaccccuccuggaaguuccacccgcagaaccugcccgccgacggguucaaguacaacuacguguucgcgccccugcaggacaugaucgagcgcgccaucauccucguccagaccggccaggaggcccuggagcccgcggcccagacccaggccgccccguaccccugccacacgagcgaccuguuccucaacaacgugggcuucuucuucccccugaucaugaugcugaccuggaugguguccgucgccagcauggugcggaagcucguguacgagcaggagauccagaucgaggaguacaugcgcaugauggggguccaccccgugauccacuuccuggcgugguuccuggagaacauggccgugcucaccaucuccagcgccacccuggccaucguccugaagacguccggcaucuucgcccacagcaacaccuucaucguguuccucuuccugcuggacuucgggauguccguggucaugcucagcuaccugcuguccgcguucuucagccaggccaacaccgccgcccucugcaccagccugguguacaugaucuccuuccugccguacaucgugcuccugguccugcacaaccagcucagcuucgugaaccagacguuccugugccugcucuccaccaccgcguucggccaggggguguucuucaucaccuuccuggagggccaggagacgggcauccaguggaacaacauguaccaggcccuggagcagggcgggaugaccuucgggugggucugcuggaugauccucuucgacagcucccuguacuuccugugcggcugguaccucagcaaccugauccccgggaccuucggccugcggaagcccugguacuuccccuucaccgccuccuacuggaaguccgugggcuuccucguggagaagcgccaguacuuccuguccagcucccuguucuucuucaacgagaacuucgacaacaaggggagcucccuccagaaccgggagggcgagcuggaggggagcgccccgggcgucacccugguguccgugacgaaggaguacgaggggcacaaggccgucgugcaggaccucagccugaccuucuaccgcgaccagaucaccgcgcugcucggcaccaacggcgccgggaagacgaccaucaucuccaugcugaccggccugcacccgcccaccagcgggacgaucaucaucaacggcaagaaccuccagaccgaccugucccgggugcgcauggagcugggggucugcccgcagcaggacauccuccuggacaaccugaccgugcgggagcaccuccugcuguucgccagcaucaaggcgccccaguggaccaagaaggagcugcaccagcaggucaaccagacgcuccaggacgucgaccugacccagcaccagcacaagcagacccgcgcccugagcggcggccucaagcggaagcugucccuggggaucgcguucaugggcaugagccgcaccgugguccucgacgagcccacguccgggguggaccccugcagccggcacucccugugggacauccugcucaaguaccgcgagggccggaccaucaucuucaccacccaccaccuggacgaggccgaggcccugagcgaccgcguggccguccuccagcacggccggcugcgcugcugcgggccgcccuucugccugaaggaggccuacggccaggggcuccgccugacgcugacccggcagcccuccgugcucgaggcgcacgaccugaaggacauggccugcgugaccagccugaucaagaucuacaucccccaggccuuccucaaggacuccagcggcuccgagcugaccuacacgaucccgaaggacaccgacaaggccugccugaagggccucuuccaggcgcuggacgagaaccugcaccagcuccaccugaccggcuacggcaucagcgacaccacgcuggaggaggucuuccucaugcugcugcaggacuccaacaagaagucccacaucgcccucgggaccgaguccgagcugcagaaccaccgccccaccggccaccugagcggguacugcggcucccucgcccggcccgccaccgugcagggggugcagcugcugcgcgcccaggucgcggccauccucgcccggcgccugcggcgcacgcugcgggccggcaagagcacccucgccgaccugcugcuccccgugcuguucguggcgcuggccaugggccucuucaugguccgcccgcuggccaccgaguacccgccccugcggcucacccccgggcacuaccagcgcgccgagacguacuucuucuccagcggcggggacaaccuggaccugacccgggugcuccugcgcaaguuccgggaccaggaccugccgugcgccgaccucaacccccgccagaagaacagcuccugcuggcggaccgaccccuucagccaccccgaguuccaggacuccugcggcugccugaagugcccgaaccgcagcgcguccgcccccuaccugaccaaccaccucgggcacacccugcugaaccucagcggcuucaacauggaggaguaccugcuggcccccuccgagaagccccggcucggcggguggagcuucggccugaagaucccguccgaggccgggggcgcgaacgggaacaucagcaagccgcccacgcuggccaaggugugguacaaccagaagggcuuccacucccucccgagcuaccugaaccaccugaacaaccucauccuguggcagcaccucccgcccaccgucgacuggcgccaguacggcaucacccucuacucccaccccuacgggggcgcccugcugaacgaggacaagauccucgagagcauccgccagugcgggguggcccugugcaucgugcugggcuucuccauccucagcgccuccaucggcagcuccgucgugcgggaccgcgugaucggggcgaagcggcugcagcacaucagcggccugggguaccgcauguacugguucaccaacuuccucuacgacaugcuguucuaccuggucagcgugugccucugcguggccgucaucguggccuuccagcugacggccuucaccuuccggaagaaccuggccgcgaccgcccuccugcugucccucuucggcuacgccacccugccguggauguaccugaugagccgcaucuucuccagcuccgacguggccuucaucagcuacgucucccucaacuucaucuucgggcugugcacgaugcugaucaccaucaugccccggcugcucgccaucaucagcaaggcgaagaaccugcagaacaucuacgacgugcugaaguggguguucaccaucuucccccaguucugccucggccagggccuggucgagcugugcuacaaccagaucaaguacgaccucacccacaacuucgggaucgacuccuacgugagccccuucgagaugaacuuccugggcuggaucuucgugcagcuggccucccaggggacgguccuccugcugcuccgcgugcugcugcacugggaccuccugcgguggccgcgcggccacagcacccugcaggggaccgugaaguccagcaaggacaccgacgucgagaaggaggagaagcggguguucgagggccgcacgaacggcgacauccucgugcuguacaaccuguccaagcacuaccggcgcuucuuccagaacaucaucgccguccaggacaucagccucgggauccccaagggcgagugcuucgggcugcugggcgugaacggggccggcaaguccaccaccuucaagaugcucaacggcgaggugagccugaccagcgggcacgccaucauccggacgcccaugggcgacgcggucgaccuguccagcgccgggaccgccggcgugcucaucggcuacugcccccagcaggacgcccuggacgagcugcucaccgggugggagcaccuguacuacuacugcucccugcgcggcaucccgcggcagugcauccccgagguggcgggggaccucauccgccggcugcaccuggaggcccacgccgacaagcccgucgccaccuacagcggcgggacgaagcgcaagcucuccaccgcccuggcgcuggugggcaagcccgacauccuccugcuggacgagccgagcuccggcauggaccccugcagcaagcgguaccucuggcagaccaucaugaaggaggugcgcgaggggugcgccgccguccugaccucccacagcauggaggagugcgaggcccugugcacgcgccucgccaucauggugaacggcuccuucaagugccuggggagcccccagcacaucaagaaccgguucggcgacggguacaccgugaaggucuggcugugcaaggaggcgaaccagcacugcaccguguccgaccaccucaagcuguacuuccccggcauccaguucaagggccagcaccugaaccuccuggaguaccacgucccgaagcgcugggggugccuggccgaccucuucaaggugaucgagaacaacaagaccuuccugaacaucaagcacuacagcaucaaccagacgacccuggagcaggucuucaucaacuucgccuccgagcagcagcagacccuccagagcacccuggaccccuccacggacagccaccacacccaccaccuccccaucuga

SEQ ID NO: 26149 - RNA, 6786 nt, Artificial Sequence
  derived and/or modified sequence opt1 from ABCA1__Homo_sapiens__NP_005493
auggccugcuggccccagcugcgccugcugcuguggaagaaccucaccuuccggcgccggcagaccugccagcugcugcucgaggucgccuggccccuguucaucuuccugauccucaucagcguccgccugagcuacccgcccuacgagcagcacgagugccacuuccccaacaaggcgaugcccagcgccggcacgcugcccugggugcaggggaucaucugcaacgccaacaaccccugcuuccgguaccccaccccgggcgaggcccccgggguggucggcaacuucaacaaguccaucguggcccgccucuucagcgacgcgcggcgccugcugcucuacucccagaaggacaccagcaugaaggacaugcggaaggugcugcgcacccugcagcagaucaagaaguccagcuccaaccucaagcugcaggacuuccuggucgacaacgagacguucagcggguuccucuaccacaaccugucccugcccaagagcaccguggacaagaugcuccgggccgacgugauccugcacaaggucuuccugcagggcuaccagcuccaccugaccucccugugcaacggcagcaaguccgaggagaugauccagcucggggaccaggaggugagcgagcugugcggccugccccgcgagaagcucgccgccgcggagcgggugcugcgcuccaacauggacauccugaagccgauccuccggacccugaacagcacgucccccuuccccagcaaggagcuggccgaggccaccaagacccuccugcacagccuggggacccucgcccaggagcuguucuccaugcgcagcugguccgacaugcggcaggaggucauguuccugacgaacgugaacagcuccagcuccagcacccagaucuaccaggccgugucccgcaucgucugcggccaccccgagggcgggggccucaagaucaagagccugaacugguacgaggacaacaacuacaaggcgcuguucgggggcaacgggaccgaggaggacgccgagaccuucuacgacaacuccacgaccccguacugcaacgaccucaugaagaaccuggagagcagcccccucagccggaucaucuggaaggcccugaagccccuccuggugggcaagauccuguacacccccgacaccccggccacgcgccaggugauggccgaggucaacaagaccuuccaggagcucgcgguguuccacgaccuggagggcaugugggaggagcugucccccaagaucuggaccuucauggagaacagccaggagauggaccucgugcggaugcugcuggacucccgcgacaacgaccacuucugggagcagcagcucgacgggcuggacuggaccgcccaggacaucgucgccuuccuggccaagcaccccgaggacgugcagagcuccaacggcagcguguacacguggcgcgaggccuucaacgagaccaaccaggcgauccggaccaucagccgcuucauggagugcgucaaccucaacaagcuggagcccaucgccaccgagguguggcugaucaacaaguccauggagcuccuggacgagcggaaguucugggccgggaucgucuucacgggcaucaccccggggagcaucgagcugccccaccacgugaaguacaagauccgcauggacaucgacaacguggagcggaccaacaagaucaaggacggcuacugggaccccggcccccgcgccgacccguucgaggacaugcgguacgucuggggcggcuucgccuaccuccaggacgugguggagcaggcgaucauccgcguccugaccgggacggagaagaagaccggcguguacaugcagcagaugcccuaccccugcuacguggacgacaucuuccugcgggucaugucccgcagcaugccccuguucaugacccuggccuggaucuacuccguggccgugaucaucaaggggaucgucuacgagaaggaggcccggcugaaggagaccaugcgcaucaugggccucgacaacagcauccugugguucuccugguucaucagcucccugaucccccuccuggugagcgcgggccugcucguggucauccugaagcuggggaaccuccugcccuacuccgaccccagcgugguguucgucuuccuguccguguucgccguggucacgauccuccagugcuuccugaucagcacccuguucucccgggccaaccucgccgccgcgugcggcgggaucaucuacuucacccuguaccugccguacgugcucugcguggccuggcaggacuacgucggcuucacccugaagaucuucgccagccugcucucccccguggccuucggguucggcugcgaguacuucgcccuguucgaggagcagggcaucggggugcagugggacaaccuguucgagagccccgucgaggaggacggcuucaaccucaccacgagcguguccaugaugcuguucgacaccuuccuguacggggugaugaccugguacaucgaggcggucuuccccggccaguacggcaucccgcgccccugguacuuccccugcaccaagagcuacugguucggggaggaguccgacgagaagucccaccccggcuccaaccagaagcggaucagcgagaucugcauggaggaggagccgacgcaccucaagcuggggguguccauccagaaccuggugaaggucuaccgcgacggcaugaagguggccguggacgggcucgcccugaacuucuacgagggccagaucaccagcuuccugggccacaacggggccggcaagaccaccacgauguccauccucaccgggcuguucccgcccaccagcggcaccgccuacauccuggggaaggacauccgguccgagaugagcacgauccgccagaaccucggcgucugcccccagcacaacgugcuguucgacaugcugaccguggaggagcacaucugguucuacgcgcggcucaagggccuguccgagaagcacgucaaggccgagauggagcagauggcccuggacguggggcucccgagcuccaagcucaagagcaagaccucccagcugagcggcgggaugcagcgcaagcucuccguggcccuggcguucgucggcgggagcaagguggugauccuggacgagcccaccgccggcgucgaccccuacagccgccggggcaucugggagcuccugcugaaguaccgccaggggcggacgaucauccucuccacccaccacauggacgaggccgacgugcugggcgaccgcaucgccaucaucagccacgggaagcugugcugcgugggcuccagccucuuccugaagaaccagcuggggaccggcuacuaccucacccuggucaagaaggacguggaguccagccuguccagcugccggaacuccagcuccacggugagcuaccucaagaaggaggacuccgucagccaguccagcuccgacgccggccuggggagcgaccacgaguccgacacccugaccaucgacgugagcgcgaucagcaaccucauccgcaagcacgucuccgaggcccggcugguggaggacaucggccacgagcugaccuacgugcuccccuacgaggccgccaaggagggggccuucgucgagcuguuccacgagaucgacgaccgccugagcgaccucggcaucuccagcuacggcaucuccgagacgacccuggaggagaucuuccugaagguggcggaggagagcgggguggacgccgagaccuccgacggcacccugccggcccggcgcaaccggcgcgccuucggggacaagcagagcugccuccggcccuucacggaggacgacgccgcggaccccaacgacuccgacaucgaccccgagagccgcgagaccgaccugcuguccggcauggacgggaagggcagcuaccaggucaagggcuggaagcucacccagcagcaguucguggcccugcuguggaagcggcuccugaucgcccgccggucccgcaagggguucuucgcccagaucgugcugccggcggucuucgugugcaucgcccucguguucagccugaucgugccgcccuucggcaaguacccgucccuggagcuccagcccuggauguacaacgagcaguacaccuucgugagcaacgacgcccccgaggacacggggacccuggagcugcucaacgcccugaccaaggaccccggcuucgggacccggugcauggagggcaacccgauccccgacacgcccugccaggccggcgaggaggaguggaccaccgcgcccgugccgcagaccaucauggaccuguuccagaacgggaacuggaccaugcagaaccccucccccgccugccagugcagcuccgacaagaucaagaagaugcuccccgucugcccgcccggcgccgggggccugccgccgccccagcgcaagcagaacacggccgacauccugcaggaccucaccgggcggaacaucagcgacuaccuggugaagaccuacgugcagaucaucgccaagagccugaagaacaagaucugggucaacgaguuccgcuacggcggcuucucccucggggugagcaacacccaggcgcugccgcccucccaggaggugaacgacgccaucaagcagaugaagaagcaccugaagcucgccaaggacagcuccgccgaccgcuuccugaacagccugggccgguucaugacggggcucgacaccaagaacaacgucaaggugugguucaacaacaagggcuggcacgccaucuccagcuuccugaacgugaucaacaacgcgauccugcgcgccaaccuccagaagggcgagaaccccucccacuacgggaucaccgccuucaaccacccccugaaccugaccaagcagcagcucagcgaggucgcccugaugacgaccuccguggacgugcuggucagcaucugcgugaucuucgccauguccuucgugcccgcgagcuucgucguguuccucauccaggagcggguguccaaggccaagcaccuccaguucaucagcggcgucaagcccgugaucuacuggcuguccaacuucgugugggacaugugcaacuacgucgugcccgccacccucgugaucaucaucuucaucugcuuccagcagaaguccuacgucuccagcaccaaccugccggugcuggcccuccugcugcuccuguacggguggagcaucacgccccugauguaccccgcguccuucguguucaagauccccagcaccgccuacgucgugcucaccuccgugaaccuguucaucggcaucaacgggagcgucgccaccuucgugcuggagcuguucacggacaacaagcugaacaacaucaacgacauccugaaguccguguuccucaucuucccgcacuucugccugggccgcggccugaucgacauggucaagaaccaggccauggccgacgcgcucgagcgguucggggagaaccgcuucgugagcccccuguccugggaccuggugggccggaaccucuucgccauggccgucgaggggguggucuucuuccugaucaccgugcugauccaguaccgcuucuucauccggccccgcccggugaacgccaagcucagcccccugaacgacgaggacgaggacguccggcgcgagcggcagcgcauccuggacggcgggggccagaacgacauccucgagaucaaggagcugaccaagaucuaccggcgcaagcggaagcccgccguggaccgcaucugcgugggcaucccgcccggggagugcuucggccugcucggggucaacggcgcggggaaguccagcaccuucaagaugcugacgggcgacaccaccgugacccggggcgacgccuuccugaacaagaacuccauccucagcaacauccacgaggugcaccagaacaugggguacugcccccaguucgacgccaucacggagcugcugaccggccgcgagcacgucgaguucuucgcccuccugcgcggggugcccgagaaggaggugggcaaggucggggagugggccauccggaagcugggccucgugaaguacggcgagaaguacgcggggaacuacuccggcgggaacaagcgcaagcugagcaccgccauggcccugaucggcgggccgcccguggucuuccucgacgagcccaccacggggauggaccccaaggcccggcgcuuccuguggaacugcgcgcuguccguggugaaggagggccggagcgucgugcucaccucccacagcauggaggagugcgaggcccugugcacccgcauggccaucauggugaacgggcgguuccgcugccugggcuccguccagcaccucaagaaccgguucggggacggcuacaccaucguggugcgcaucgccggcagcaaccccgaccugaagcccguccaggacuucuucgggcuggccuuccccggcagcgugcucaaggagaagcaccggaacaugcugcaguaccagcugcccuccagccucuccagccuggcgcgcaucuucuccauccugagccaguccaagaagcggcuccacaucgaggacuacagcgugucccagacgacccuggaccaggucuucgugaacuucgccaaggaccagagcgacgacgaccaccugaaggaccugucccuccacaagaaccagaccguggucgacguggccgugcugaccagcuuccugcaggacgagaaggucaaggaguccuacguguga

SEQ ID NO: 26150 - RNA, 7311 nt, Artificial Sequence
  derived and/or modified sequence opt1 from ABCA2__Homo_sapiens__NP_001597
augggcuuccugcaccagcugcagcugcugcucuggaagaacgugacccugaagcgccggagccccuggguccuggccuucgagaucuucaucccccucgugcuguucuucauccugcucgggcugcgccagaagaagcccaccaucuccgugaaggaggucagcuucuacaccgccgcgccccugaccuccgccggcauccuccccgugaugcagagccugugccccgacgggcagcgggacgaguucggcuuccugcaguacgccaacuccaccgugacccagcuccuggagcgccuggaccgggucguggaggaggggaaccucuucgaccccgcccgccccagccugggcuccgagcuggaggcccuccggcagcaccuggaggcccugagcgccggccccgggacguccggcagccaccucgaccgcuccaccgugagcuccuucagccuggacuccgucgcccggaacccccaggagcuguggcgcuuccucacccagaaccugagccugcccaacuccaccgcccaggcgcuccuggccgcccggguggacccgcccgagguguaccaccuccuguucgggcccagcuccgcccuggacagccagagcggccugcacaaggggcaggagcccuggucccgccucggcggcaacccccuguuccggauggaggagcugcuccuggcccccgcgcugcucgagcagcugacgugcacccccgggagcggcgagcuggggcgcauccucaccguccccgagucccagaagggcgcccugcagggcuaccgggacgccgugugcagcgggcaggccgccgcgcgcgcccggcgcuucuccggccugagcgccgagcuccggaaccagcuggacguggccaaggucucccagcagcuggggcuggacgcccccaacggcagcgacuccagcccccaggcgcccccgccccggcggcuccaggcccugcugggggaccuccuggacgcccagaaggugcugcaggacguggacguccucuccgcccuggcccugcuccugccccagggcgcgugcaccggccgcacgccggggccgcccgccagcggcgccgggggcgccgcgaacgggaccggcgccggcgccgugauggggcccaacgccaccgccgaggagggcgcgccguccgccgccgcccuggccacccccgacacgcuccaggggcagugcagcgcguucgugcagcugugggccggccugcagcccauccucugcgggaacaaccgcaccaucgagccggaggcccugcggcgcggcaacauguccagccugggcuucaccuccaaggagcagcggaaccucgggcugcugguccaccucaugaccagcaaccccaagauccuguacgcccccgccggcuccgagguggaccgcgugauccugaaggcgaacgagacguucgccuucgucgggaacgugacccacuacgcccaggucuggcucaacaucagcgccgagauccggagcuuccuggagcagggccgccugcagcagcaccuccgguggcugcagcaguacguggcggagcugcgccuccaccccgaggcccugaaccugucccucgacgagcugccgcccgcccugcggcaggacaacuucagccuccccuccggcauggcccugcugcagcagcucgacaccaucgacaacgccgcgugcggguggauccaguucaugagcaagguguccgucgacaucuucaagggcuuccccgacgaggagagcaucgugaacuacacccugaaccaggccuaccaggacaacgugacggucuucgccuccgugaucuuccagacccgcaaggacgggagccugccgccccacgugcacuacaagauccggcagaacuccagcuucaccgagaagaccaacgagauccgccgggccuacuggcgccccggccccaacaccgggggccgguucuacuuccucuacggcuucgucuggauccaggacaugauggagcgcgccaucaucgacaccuucguggggcacgacguggucgagccgggcuccuacgugcagauguuccccuaccccugcuacacccgggacgacuuccuguucgugaucgagcacaugaugccccugugcauggucaucagcuggguguacuccguggcgaugaccauccagcacaucgucgccgagaaggagcaccgccucaaggaggugaugaagacgauggggcugaacaacgccgugcacugggucgccugguucaucaccggcuucgugcagcugagcaucuccgugaccgcccucaccgcgauccugaaguacgggcagguccugaugcacagccacguggugaucaucuggcuguuccuggccgucuacgccguggccacgaucauguucugcuuccugguguccguccucuacagcaaggcgaagcuggccagcgccugcggcggcaucaucuacuuccuguccuacgugccguacauguacguggccauccgggaggaggucgcccacgacaagaucaccgcguucgagaagugcaucgccagccucauguccaccaccgccuucgggcugggcagcaaguacuucgcccuguacgagguggccggggugggcauccaguggcacaccuucucccagagccccgucgagggggacgacuucaaccuccugcuggcggugacgaugcucaugguggacgccgucguguacggcauccugaccugguacaucgaggccgugcaccccggcauguacgggcugccccgcccgugguacuucccccuccagaaguccuacuggcugggcagcgggcgcaccgaggccugggagugguccuggcccugggcccggacgccccgccugagcgucauggaggaggaccaggcgugcgccauggagucccggcgcuucgaggagacgcggggcauggaggaggagccgacccaccucccccugguggugugcgucgacaagcugaccaagguguacaaggacgacaagaagcucgcccugaacaagcugagccucaaccuguacgagaaccagguggucuccuuccuggggcacaacggcgccggcaagaccacgaccaugagcauccucaccgggcuguucccgcccaccuccggcagcgccacgaucuacgggcacgacauccgcaccgagauggacgagauccggaagaaccugggcaugugcccccagcacaacgugcuguucgaccgccugaccguggaggagcaccugugguucuacucccggcucaagagcauggcgcaggaggagauccgccgggagauggacaagaugaucgaggaccuggagcuguccaacaagcgccacagccucguccagacccugagcggcgggaugaagcggaagcuguccguggccaucgccuucgucggcgggagccgcgccaucauccucgacgagcccacggcgggcguggaccccuacgcccggcgcgccaucugggaccugauccugaaguacaagcccgggcggaccauccuccuguccacccaccacauggacgaggccgaccugcugggcgaccgcaucgccaucaucagccacggcaagcucaagugcugcgggagcccccucuuccugaagggcaccuacggggacggcuaccggcucacgcuggugaagcgccccgcggagcccgggggcccgcaggagcccggccuggccagcagcccgcccgggcgggccccgcucagcuccugcagcgagcugcaggucucccaguucauccgcaagcacguggccagcugccugcucguguccgacaccagcaccgagcuguccuacauccugcccagcgaggccgcgaagaagggcgccuucgagcgccucuuccagcaccuggagcggucccuggacgcccuccaccugagcuccuucgggcugauggacaccacgcucgaggaggucuuccugaaggugagcgaggaggaccagagccuggagaacuccgaggccgacgugaaggagagccgcaaggacguccuccccggcgccgaggggcccgcguccggcgagggccacgccgggaaccuggcccggugcagcgagcugacccagucccaggccagccuccaguccgcgagcuccgugggcagcgcccgcggggacgagggcgccggcuacaccgacguguacggggacuaccggccgcuguucgacaacccccaggaccccgacaacgucucccugcaggagguggaggccgaggcccucagccgcgugggccaggggucccggaagcuggacggcggguggcugaagguccgccaguuccacggccuccuggugaagcgguuccacugcgcgcgccggaacagcaaggcccuguucucccagauccuccugcccgccuucuucgugugcgucgccaugaccguggcccugagcgugccggagaucggcgaccugccgccccucguccugucccccagccaguaccacaacuacacgcagccgcgcgggaacuucauccccuacgcgaacgaggagcggcgcgaguaccggcuccgccugucccccgacgccagcccccagcagcuggugagcaccuuccggcucccguccggcgugggggcgaccugcguccugaagucccccgccaacggcucccuggggcccacccucaaccugagcuccggcgagagccgccugcucgccgcgcgguucuucgacuccaugugccuggagagcuucacgcagggccugccgcucuccaacuucgugccgccgccgcccagccccgcccccuccgacagccccgccucccccgacgaggaccugcaggccuggaacgugagccugccgcccaccgcggggcccgagauguggaccuccgccccgagccucccccgccugguccgcgagcccgugcggugcacgugcuccgcccagggcacgggguucagcugccccuccagcgugggcgggcacccgccccagaugcgcgucgugaccggcgacauccugaccgacaucaccggccacaacgugagcgaguaccuccuguucaccuccgaccgguuccgccugcaccgguacggggccaucacguucggcaacguccucaagagcauccccgccuccuucgggacccgcgcgcccccgauggugcggaagaucgccgugcgccgggccgcccaggucuucuacaacaacaagggcuaccacagcaugcccaccuaccugaacucccugaacaacgccauccuccgcgcgaaccugcccaagagcaaggggaaccccgccgccuacggcaucaccgugacgaaccacccgaugaacaagaccuccgccagccugucccucgacuaccugcugcagggcaccgacguggucaucgccaucuucaucaucguggcgaugagcuucgugcccgccuccuucgucguguuccucguggccgagaaguccaccaaggccaagcaccuccaguucgucagcgggugcaaccccaucaucuacuggcuggccaacuacgugugggacaugcucaacuaccuggugcccgcgacgugcugcgucaucauccuguucguguucgaccucccggccuacaccagccccaccaacuuccccgccgugcugucccuguuccuccuguacggcuggagcaucaccccgaucauguaccccgccuccuucugguucgagguccccagcuccgcguacguguuccugaucgucaucaaccucuucaucgggaucacggccaccguggccaccuuccugcugcagcuguucgagcacgacaaggaccugaagguggucaacagcuaccucaagagcugcuuccucaucuuccccaacuacaaccugggccacggccugauggagauggccuacaacgaguacaucaacgaguacuacgccaagaucgggcaguucgacaagaugaaguccccguucgagugggacaucgugacccggggccucguggcgauggccgucgaggggguggugggcuuccugcugacgaucaugugccaguacaacuuccuccgccggccccagcgcaugcccgucagcaccaagcccguggaggacgacguggacgucgccuccgagcggcagcgcgugcugcgcggggacgccgacaacgacauggugaagaucgagaaccugaccaaggucuacaagagccgcaagaucggccggauccucgccguggaccgccugugccugggcgugcggccgggggagugcuucggccuccugggggucaacggcgcggggaagaccuccacguucaagaugcugaccggcgacgagagcaccaccggcggggaggccuucgugaacggccacuccgugcugaaggagcuccugcagguccagcagagccugggguacugcccccagugcgacgcccucuucgacgagcugacggcccgcgagcaccuccagcucuacacccgccugcggggcaucuccuggaaggacgaggcccgcguggugaagugggcgcuggagaagcucgagcugaccaaguacgccgacaagcccgccgggaccuacagcggcggcaacaagcggaagcuguccacggccaucgcgcucaucggguaccccgccuucaucuuccuggacgagccgaccaccggcauggaccccaaggcccgccgguuccuguggaaccucauccuggaccugaucaagaccgggcgcagcgucgugcucacgucccacagcauggaggagugcgaggcccugugcacccggcuggccaucauggugaacggccgccuccggugccugggguccauccagcaccugaagaaccgcuucggcgacggcuacaugaucaccguccggaccaagagcucccagagcgugaaggacgugguccgcuucuucaaccggaacuuccccgaggcgaugcucaaggagcgccaccacacgaaggugcaguaccagcugaaguccgagcacaucucccuggcccagguguucagcaagauggagcaggucuccggggugcucggcaucgaggacuacagcgugucccagaccacccuggacaacgucuucgugaacuucgccaagaagcagagcgacaaccuggagcagcaggagaccgagcccccguccgcccuccagagcccccuggggugccugcucucccugcugcggccccgcagcgcccccaccgagcuccgggcgcugguggccgacgagccggaggaccuggacacggaggacgagggccucaucuccuucgaggaggagcgcgcccagcugagcuucaacaccgacacccugugcuga

SEQ ID NO: 26151 - RNA, 5115 nt, Artificial Sequence
  derived and/or modified sequence opt1 from ABCA3__Homo_sapiens__NP_001080
auggccgugcugcgccagcucgcccugcugcucuggaagaacuacacccugcagaagcggaaggugcuggugaccgugcucgagcuguuccugccccuccuguucagcggcauccugaucuggcuccgccugaagauccagagcgagaacgucccgaacgcgaccaucuaccccgggcagagcauccaggagcugccccucuucuucaccuucccgccgcccggcgacaccugggagcuggccuacauccccucccacagcgacgccgccaagaccgugacggagaccgugcggcgcgcccuggucaucaacaugcgggugcgcggguuccccuccgagaaggacuucgaggacuacauccgguacgacaacugcagcuccagcgugcucgcggccgucguguucgagcaccccuucaaccacuccaaggagccccugccccuggccgugaaguaccaccuccgcuucagcuacacccggcgcaacuacauguggacccagacgggcuccuucuuccugaaggagaccgagggguggcacaccaccagccuguucccccucuucccgaaccccggcccccgggagcccacguccccggacggcggggagcccggcuacauccgcgagggguuccuggccguccagcacgcgguggaccgggccaucauggaguaccacgccgacgccgccacccgccagcuguuccagcggcucaccgugaccaucaagcgcuuccccuacccgcccuucaucgcggaccccuuccuggucgccauccaguaccagcugccccuccugcugcuccugagcuucacguacaccgcccugaccaucgcccgggccguggugcaggagaaggagcgccggcucaaggaguacaugcgcaugaugggccuguccagcuggcugcacugguccgcgugguuccuccuguucuuccuguuccuccugaucgccgccagcuucaugacccuccuguucugcgucaaggugaagcccaacguggccguccugucccggagcgacccgagccuggugcucgccuuccugcugugcuucgcgaucuccacgaucagcuucuccuucauggugagcaccuucuucuccaaggccaacauggccgccgccuucgggggcuuccuguacuucuucaccuacauccccuacuucuucgucgcgccccgcuacaacuggaugacccucagccagaagcugugcuccugccugcucagcaacguggccauggccaugggcgcccagcugaucgggaaguucgaggcgaagggcauggggauccaguggcgcgaccugcucucccccgucaacguggacgacgacuucugcuucggccaggugcugggcaugcugcuccuggacagcguccuguacgggcucgugacgugguacauggaggccguguucccgggccaguucggggucccccagcccugguacuucuucaucaugccguccuacuggugcggcaagccccgggccguggccgggaaggaggaggaggacagcgaccccgagaaggcccugcgcaacgaguacuucgaggcggagcccgaggaccugguggccggcaucaagaucaagcaccucuccaaggucuuccgggugggcaacaaggaccgcgccgccgugcgggaccugaaccugaaccucuacgaggggcagaucaccguccugcugggccacaacggggccggcaagaccaccacgcucagcaugcugaccgggcuguucccgcccaccuccggccgcgcguacaucagcggcuacgagaucucccaggacauggugcagauccggaagucccucgggcugugcccccagcacgacauccuguucgacaaccucaccguggccgagcaccuguacuucuacgcccagcugaagggccucucccgccagaagugccccgaggaggucaagcagaugcugcacaucaucgggcuggaggacaaguggaacagccggagccgcuuccucuccggcgggaugcggcgcaagcugagcaucggcaucgcccugaucgccggcuccaaggugcucauccuggacgagccgacgagcgggauggacgcgaucucccggcgcgccaucugggaccugcuccagcggcagaaguccgaccgcaccaucgugcugaccacccacuucauggacgaggccgaccugcucggcgaccggaucgccaucauggcgaagggggagcugcagugcugcggcuccagccuguuccucaagcagaaguacggcgccggguaccacaugacgcuggucaaggagccccacugcaaccccgaggacaucucccagcuggugcaccaccacgugcccaacgccacccucgagagcuccgccggcgccgagcugagcuucauccugccgcgcgaguccacccaccgguucgagggccuguucgcgaagcuggagaagaagcagaaggagcugggcaucgccagcuucggggccuccaucaccaccauggaggaggucuuccuccgcgugggcaagcugguggacagcuccauggacauccaggccauccagcugcccgcccuccaguaccagcacgagcgccgggcgagcgacugggccgucgacagcaaccugugcggcgccauggaccccuccgacgggaucggcgcccugaucgaggaggagcgcacggccgugaagcucaacaccgggcuggcgcugcacugccagcaguucugggccauguuccucaagaaggccgccuacagcuggcgggaguggaagaugguggcggcccagguccuggugccccugaccugcgugacccucgcccugcuggccaucaacuacuccagcgagcuguucgacgacccgaugcugcgccugacgcucggcgaguacgggcggaccgucgugcccuucuccgugcccggcaccagccagcugggccagcagcuguccgagcaccucaaggacgcccugcaggcggaggggcaggagccccgcgagguccugggcgaccucgaggaguuccugaucuuccgggccagcguggagggcggcggguucaacgagcgcugccugguggccgccuccuuccgggacgucggggagcgcaccguggugaacgcccucuucaacaaccaggcguaccacagcccggccacggcccuggccgucguggacaaccuccuguucaagcugcugugcggcccccacgccuccaucguggucagcaacuucccccagccccgguccgcgcuccaggccgccaaggaccaguucaacgaggggcgcaagggcuucgacaucgcccugaaccuccucuucgccauggcguuccuggccagcaccuucuccauccuggccgugagcgagcgggccgugcaggcgaagcacguccaguucguguccggggugcacgucgccagcuucuggcucuccgcccugcugugggaccugaucagcuuccucaucccgagccugcugcuccuggugguguucaaggccuucgacguccgcgccuucacccgggacggccacauggcggacacccugcuccugcugcuccuguacgggugggccaucaucccccugauguaccucaugaacuucuucuuccugggcgccgccacggccuacacccgccugaccaucuucaacauccucuccggcaucgcgaccuuccugauggugacgaucaugcggauccccgccgucaagcuggaggagcucagcaagacccuggaccacguguuccuggugcucccgaaccacugccuggggauggccgucuccagcuucuacgagaacuacgagacccgccgguacugcaccuccagcgagguggccgcccacuacugcaagaaguacaacauccaguaccaggagaacuucuacgcgugguccgcccccggcguggggcgcuucgucgccagcauggccgcguccggcugcgccuaccugauccuccuguuccugaucgagacgaaccuccugcagcggcugcgcggcauccucugcgcccugcgccggcgccggacccugaccgagcucuacacccgcaugcccgugcugcccgaggaccaggacguggccgacgagcggacgcgcauccuggccccgagccccgacucccuccugcacacgccccugaucaucaaggagcucagcaaggucuacgagcagcgggugccccugcuggcgguggaccgccucucccuggccguccagaagggggagugcuucggccugcucggguucaacggcgccgggaagaccaccacguucaagaugcugaccggcgaggagagccugaccuccggcgacgccuucgucggcgggcaccggaucagcuccgacguggggaagguccgccagcggaucggguacugcccgcaguucgacgcccuccuggaccacaugaccgggcgcgagaugcuggugauguacgcgcggcuccgcggcauccccgagcggcacaucggcgccugcguggagaacacgcugcgcgggcugcuccuggagccccacgccaacaagcugguccggaccuacagcggcgggaacaagcgcaagcucuccaccggcaucgcccugaucggggagcccgccgugaucuuccuggacgagccgagcaccggcauggaccccguggcgcggcgccuccugugggacacggucgcccgcgcccgggagagcggcaaggccaucaucaucaccucccacagcauggaggagugcgaggcgcugugcacccgccucgccaucauggugcaggggcaguucaagugccugggcagcccccagcaccucaagagcaaguucggguccggcuacagccuccgggccaaggugcaguccgagggccagcaggaggcccuggaggaguucaaggccuucgucgaccugaccuuccccgggagcgugcucgaggacgagcaccagggcauggugcacuaccaccuccccgggcgcgaccuguccugggcgaaggucuucggcauccuggagaaggccaaggagaaguacgggguggacgacuacagcgugucccagaucagccuggagcaggucuuccuguccuucgcccaccuccagccgcccaccgccgaggagggccgguga

SEQ ID NO: 26152 - RNA, 4929 nt, Artificial Sequence
  derived and/or modified sequence opt1 from ABCA5__Homo_sapiens__NP_758424
augagcaccgccauccgcgaggugggcgucuggcggcagacccgcacgcugcuccugaagaacuaccugaucaagugccggaccaagaaguccagcgugcaggagauccucuucccccuguucuuccuguucuggcucauccugaucuccaugaugcacccgaacaagaaguacgaggaggugcccaacaucgagcugaaccccauggacaaguucacccucagcaaccugauccugggguacacccccgucacgaacaucaccuccagcaucaugcagaagguguccaccgaccaccucccggacgugaucaucaccgaggaguacacgaacgagaaggagaugcugaccagcucccugagcaagcccuccaacuucgucggcgugguguucaaggacagcauguccuacgagcuccgcuucuuccccgacaugauccccgucagcuccaucuacauggacagccgggccgggugcuccaagagcugcgaggcggcccaguacugguccagcggcuucaccgugcugcaggccagcaucgacgccgccaucauccagcugaagaccaacgugucccucuggaaggagcuggagagcacgaaggcggucaucaugggggagaccgccgugguggagaucgacaccuucccgcgcggcgucauccugaucuaccucgugaucgccuucucccccuucggcuacuuccuggccauccacaucguggcggagaaggagaagaagaucaaggaguuccugaagaucauggggcuccacgacaccgccuucuggcugagcuggguccugcucuacacgucccugaucuuccugaugagccuccugauggccgugaucgccaccgccucccugcuguucccccagagcuccagcaucgugaucuuccugcuguucuuccucuacggccuguccagcgucuucuucgcgcugaugcucacgccccuguucaagaaguccaagcacguggggaucguggaguucuucgucaccguggccuucggcuucaucgggcugaugaucauccucaucgagagcuucccgaagucccuggucuggcuguucagccccuucugccacugcaccuucgugaucggcaucgcccaggugaugcaccucgaggacuucaacgagggcgccuccuucagcaaccugaccgccgggcccuacccccugaucaucaccaucaucaugcucacccugaacuccaucuucuacguccugcuggcgguguaccucgaccaggugaucccgggcgaguucgggcugcggcgcagcagccuguacuuccucaagcccuccuacuggagcaaguccaagcggaacuacgaggagcugagcgagggcaacgucaacggcaacaucuccuucagcgagaucaucgagcccguguccagcgaguucguggggaaggaggccauccgcaucuccggcauccagaagacguaccggaagaagggggagaacgucgaggcccugcgcaaccucagcuucgacaucuacgagggccagaucaccgcccugcuggggcacuccggcaccggcaagagcacccucaugaacauccugugcgggcugugcccgcccuccgacggcuucgccagcaucuacgggcaccggguguccgagaucgacgagauguucgaggcgcgcaagaugaucggcaucugcccccagcucgacauccacuucgacgugcugacggucgaggagaaccugagcauccucgccuccaucaaggggauccccgccaacaacaucauccaggaggugcagaaggugcugcuggaccucgacaugcagaccaucaaggacaaccaggccaagaagcugagcggcggccagaagcggaagcugagccucgggaucgccguccugggcaaccccaagauccugcuccuggacgagccgaccgcggggauggaccccugcucccgccacaucguguggaaccugcucaaguaccggaaggccaaccgcgugaccgucuucagcacgcacuucauggacgaggccgacauccuggccgaccggaaggcggugaucucccagggcaugcugaagugcguggggagcuccauguuccucaagagcaaguggggcaucggcuaccgccuguccauguacaucgacaaguacugcgccaccgagagccuguccagccucgucaagcagcacauccccggggccacccugcugcagcagaacgaccagcagcucguguacucccugcccuucaaggacauggacaaguucagcggccuguucuccgcccucgacagccacuccaaccugggggugaucagcuacggcgucuccaugaccacgcuggaggacguguuccucaagcuggagguggaggccgagaucgaccaggcggacuacagcgucuucacccagcagccgcuggaggaggagauggacuccaagagcuucgacgagauggagcagagccuccugauccuguccgagaccaaggccgcccucgugagcaccaugucccuguggaagcagcagauguacaccaucgccaaguuccacuucuucacgcugaagcgggagagcaaguccgugcgcagcguccuccugcugcuccugaucuucuucaccgugcagaucuucauguuccuggugcaccacuccuucaagaacgccgucgugcccaucaagcucgugcccgaccuguacuuccugaagccgggcgacaagccccacaaguacaagaccagccuccugcugcagaacuccgcggacagcgacaucuccgaccucaucagcuucuucaccucccagaacaucauggucacgaugaucaacgacagcgacuacguguccguggcgccccacagcgccgcccugaacgucaugcacuccgagaaggacuacguguucgccgccguguucaacagcaccauggucuacucccugcccauccucgugaacaucaucagcaacuacuaccuguaccaccugaacgugaccgagaccauccagaucuggagcacgccguucuuccaggagaucaccgacaucgucuucaagaucgagcucuacuuccaggccgcccugcuggggaucaucgugaccgccaugccgcccuacuucgcgauggagaacgccgagaaccacaagaucaaggccuacacccagcucaagcuguccggccugcuccccagcgccuacuggaucgggcaggccguggucgacaucccccuguucuucaucauccugauccucaugcugggcucccugcucgcguuccacuacgggcuguacuucuacacggugaaguuccuggccguggucuucugccucaucggcuacgugcccagcgucauccuguucaccuacaucgccuccuucaccuucaagaagauccugaacaccaaggaguucuggagcuucaucuacuccguggccgcccucgcgugcaucgccaucacggagaucaccuucuucaugggcuacaccaucgccaccauccugcacuacgccuucugcaucaucauccccaucuacccccugcucgggugccugaucagcuucaucaagaucuccuggaagaacgugcgcaagaacgucgacacguacaacccgugggaccggcugagcguggccgugaucucccccuaccuccagugcguccuguggaucuuccugcugcaguacuacgagaagaaguacggcgggcgcagcauccggaaggaccccuucuuccgcaaccucuccaccaagagcaagaaccggaagcugcccgagccgcccgacaacgaggacgaggacgaggacgugaaggcggagcgccugaaggugaaggagcucaugggcugccagugcugcgaggagaagcccuccaucauggucagcaaccugcacaaggaguacgacgacaagaaggacuuccugcucucccggaaggugaagaagguggccaccaaguacaucagcuucugcgucaagaagggggagauccugggccugcucggccccaacggggccggcaaguccaccaucaucaacauccuggugggggacaucgagccgacgagcggccagguguuccugggggacuacagcuccgagaccagcgaggacgacgacucccucaagugcaugggcuacugcccccagaucaacccccuguggcccgacaccacccugcaggagcacuucgagaucuacggcgccgucaaggggaugagcgcguccgacaugaaggaggugaucagccgcaucacgcacgcccucgaccugaaggagcaccuccagaagaccgugaagaagcucccggccggcaucaagcggaagcugugcuucgcccuguccaugcucgggaacccccagaucacccugcuggacgagcccagcaccggcauggacccgaaggccaagcagcacauguggcgcgcgauccggacggccuucaagaaccgcaagcgggccgccauccucaccacccacuacauggaggaggccgaggcggucugcgaccgcguggccaucaugguguccgggcagcugcggugcaucggcaccguccagcaccucaagagcaaguucggcaagggguacuuccuggagaucaagcugaaggacuggaucgagaaccuggagguggaccgccuccagcgggagauccaguacaucuuccccaacgccucccgccaggagagcuucuccagcauccuggccuacaagauccccaaggaggacgugcagucccugagccaguccuucuucaagcucgaggaggccaagcacgcguucgccaucgaggaguacagcuucucccaggccacgcuggagcaggucuucguggagcugaccaaggagcaggaggaggaggacaacagcugcggcacccucaacagcacccuguggugggagcggacccaggaggaccgcguggucuucuga

SEQ ID NO: 26153 - RNA, 4854 nt, Artificial Sequence
  derived and/or modified sequence opt1 from ABCA6__Homo_sapiens__NP_525023
augaacaugaagcagaaguccguguaccagcagaccaaggcccugcucugcaagaacuuccugaagaaguggcgcaugaagcgggagucccugcucgaguggggccugagcauccugcucgggcugugcaucgcccuguucuccagcuccaugcgcaacguccaguuccccggcauggcgccgcagaaccucgggcggguggacaaguucaacagcuccagccugaugguggucuacacccccaucuccaaccugacgcagcagaucaugaacaagaccgcccucgcgccccugcugaagggcaccagcgugaucggggcccccaacaagacccacauggacgagauccuccuggagaaccugccguacgccaugggcaucaucuucaacgagacguucuccuacaagcucaucuucuuccagggcuacaacagcccccuguggaaggaggacuucuccgcccacugcugggacggguacggcgaguucagcugcacccugaccaaguacuggaaccgcggguucguggcccuccagaccgccaucaacacggccaucaucgagaucaccaccaaccaccccgucauggaggagcugauguccgugaccgcgaucacgaugaagacccugcccuucaucaccaagaaccuccugcacaacgagauguucauccuguucuuccuccugcacuucagcccgcugguguacuucaucucccucaacgucaccaaggagcggaagaaguccaagaaccugaugaagaugaugggccugcaggacagcgccuucuggcucagcugggggcugaucuacgccggcuucaucuucaucaucagcaucuucgugacgaucaucaucaccuucacccagaucaucgugaugaccggcuucauggucaucuucauccuguucuuccucuacgggcugucccugguggcccucguguuccugaugagcguccugcucaagaaggccgugcugacgaaccugguggucuuccuccugacccuguucuggggcugccucggguucaccguguucuacgagcagcugcccuccagccuggaguggauccugaacaucugcucccccuucgcguucaccacgggcaugauccagaucaucaagcucgacuacaaccugaacggcgugaucuuccccgacccgagcggggacuccuacaccaugaucgccaccuucagcaugcugcuccuggacggccugaucuaccuccugcuggcccucuacuucgacaagauccugcccuacggggacgagcgccacuacagcccccuguucuuccucaacagcuccagcugcuuccagcaccagcggaccaacgccaaggucaucgagaaggagaucgacgccgagcaccccuccgacgacuacuucgagccgguggcgcccgaguuccagggcaaggaggccauccgcauccggaacgugaagaaggaguacaagggcaagagcgggaaggucgaggcccugaagggccuccuguucgacaucuacgaggggcagaucacggccauccugggccacuccggggccggcaagagcucccugcucaacauccugaacgggcugagcgugcccaccgagggcuccgucaccaucuacaacaagaaccucagcgagaugcaggaccuggaggagauccgcaagaucaccggcgugugcccccaguucaacgugcaguucgacauccugacggucaaggagaaccucagccuguucgcgaagaucaaggggauccaccugaaggagguggagcaggaggugcagcggauccuccuggagcuggacaugcagaacauccaggacaaccucgccaagcaccuguccgagggccagaagcgcaagcugaccuucgggaucaccauccucggcgacccgcagauccugcugcucgacgagcccaccacggggcuggaccccuucagccgggaccaggucuggucccugcuccgcgagcggcgcgccgaccacgugauccuguucagcacccaguccauggacgaggccgacauccuggccgaccggaaggugaucaugagcaacggccgccucaagugcgcgggcuccagcauguuccugaagcggcgcugggggcugggcuaccaccucucccugcaccggaacgagaucugcaaccccgagcagaucaccagcuucaucacccaccacaucccggacgccaagcugaagaccgagaacaaggagaagcucgucuacacgcugccccuggagcgcaccaacaccuuccccgaccucuucuccgaccuggacaagugcagcgaccagggggugaccggcuacgacaucuccaugagcacgcugaacgagguguucaugaagcucgagggccaguccaccaucgagcaggacuucgagcaggucgagaugauccgcgacagcgagucccugaacgagauggagcuggcccacagcagcuucuccgagaugcagaccgccgugagcgacauggggcucuggcggaugcaggucuucgcgauggcccgccugcgguuccugaagcucaagcgccagaccaaggugcugcugacgcuccugcugguguucggcaucgccaucuucccccucaucguggagaacaucauguacgccaugcugaacgagaagaucgacugggaguucaagaacgagcuguacuuccucuccccggggcagcugccccaggagccccggaccagccugcucaucaucaacaacaccgaguccaacaucgaggacuucaucaagagccugaagcaccagaacauccugcucgaggucgacgacuucgagaaccgcaacggcaccgacgggcuguccuacaacggcgccaucaucgugagcggcaagcagaaggacuaccgguucuccguggucugcaacacgaagcgccugcacugcuucccgauccucaugaacaucaucagcaacgggcugcugcagauguucaaccacacccagcacauccggaucgaguccagccccuucccccucucccacaucggccuguggaccgggcugcccgacggcagcuucuuccucuuccuggugcugugcuccaucagcccguacaucaccaugggguccaucagcgacuacaagaagaacgcgaagucccagcucuggaucagcggccuguacacgagcgccuacuggugcggccaggcccugguggacgucuccuucuucauccucauccugcugcucauguaccugaucuucuacaucgagaacaugcaguaccugcugaucaccagccagaucguguucgcccucgugaucgucacccccggguacgccgcgucccugguguucuucaucuacaugaucagcuucaucuuccgcaagcggcgcaagaacuccggccuguggagcuucuacuucuucuucgccuccaccaucauguucagcaucacgcucaucaaccacuucgaccuguccauccugaucaccaccauggugcucguccccagcuacacccugcugggguucaagacguuccucgaggugcgggaccaggagcacuaccgcgaguuccccgaggccaacuucgagcuguccgccaccgacuuccuggugugcuucaucccguacuuccagacccuccuguucgucuucgugcugcggugcauggagcucaagugcggcaagaagcgcaugcggaaggaccccguguuccgcaucagcccccagucccgggacgccaagcccaacccggaggagcccaucgacgaggacgaggacauccagaccgagcgcauccgcacggcgaccgcccugaccaccagcauccuggacgagaagcccgucaucaucgccuccugccuccacaaggaguacgccgggcagaagaaguccugcuucagcaagcggaagaagaagaucgcggcccgcaacaucagcuucugcgugcaggagggcgagauccugggccugcucgggcccaacggcgccgggaaguccagcagcauccggaugaucuccggcaucacgaagccgaccgccggggagguggagcugaagggcugcagcuccguccugggccaccucggguacugcccccaggagaacgugcuguggcccaugcugacccuccgcgagcaccuggagguguacgccgcggucaagggccugcggaaggccgacgcccgccucgccaucgcccggcuggugagcgcguucaagcugcacgagcagcucaacgugcccguccagaagcugaccgccgggaucacgcgcaagcugugcuucgugcucucccugcugggcaacagcccggugcuccugcuggacgagcccuccaccggcaucgaccccaccgggcagcagcagauguggcaggccauccaggccgucgugaagaacaccgagcggggcgugcuccugaccacgcacaaccuggccgaggcggaggcccucugcgaccgcgucgccaucauggugagcgggcggcugcgcugcaucggcuccauccagcaccugaagaacaagcucgggaaggacuacauccuggagcugaaggucaaggagaccagccaggugacccucgugcacaccgagauccugaagcuguucccccaggccgcgggccaggagcgguacuccagccuccugacguacaagcugccggucgccgacguguacccccucucccagaccuuccacaagcuggaggccgugaagcacaacuucaaccuggaggaguacagccucucccagugcacccuggagaaggucuuccuggagcucagcaaggagcaggaggugggcaacuucgacgaggagaucgacaccacgaugcgcuggaagcugcugccccacuccgacgagccguga

SEQ ID NO: 26154 - RNA, 6441 nt, Artificial Sequence
  derived and/or modified sequence opt1 from ABCA7__Homo_sapiens__NP_061985
auggccuucuggacccagcugaugcuccugcuguggaagaacuucauguaccgccgccgccagcccgugcagcuccugguggagcugcucuggccccuguuccuguucuucauccucguggccgugcggcacucccacccgccccucgagcaccacgagugccacuuccccaacaagccccugcccuccgcgggcaccguccccuggcuccaggggcugaucugcaacgugaacaacacgugcuucccccagcugacccccggcgaggagcccgggcgccucuccaacuucaacgacucccuggugagccggcugcucgccgacgcccgcaccguccugggcggggccuccgcccaccggacccuggccggccucggcaagcugaucgccacccugcgcgccgcccggagcaccgcgcagccccagcccaccaagcagagcccccucgagccgcccaugcuggacguggccgagcugcucaccucccugcugcgcacggagucccucgggcuggcccugggccaggcccaggagccccuccacagccugcuggaggccgcggaggaccucgcccaggagcugcuggcccuccggucccugguggagcugcgcgcccuccugcagcggccgcgcgggaccagcggcccccuggagcuccuguccgaggcccugugcagcguccgggggcccuccagcaccgugggccccucccucaacugguacgaggcgagcgaccugauggagcuggugggccaggagccggaguccgcccugcccgacagcagccucucccccgccugcagcgagcugaucggggcccuggacucccacccccucagccgccugcuguggcggcgccucaagccgcugauccugggcaagcuccuguucgcccccgacacccccuucacgcggaagcugauggcgcaggucaaccgcaccuucgaggagcucacccugcugcgggacgugcgcgaggugugggagaugcucgggccccgcaucuucaccuucaugaacgacuccagcaacgucgccaugcugcagcggcugcuccagaugcaggacgagggccgccggcagccgcgccccggcgggcgggaccacauggaggcccugcgcuccuuccuggaccccggcagcgggggcuacuccuggcaggacgcccacgccgacguggggcaccucgugggcacgcugggccgggucaccgagugccugagccucgacaagcuggaggcggccccguccgaggccgcccuggugagccgcgcgcuccagcugcuggccgagcaccgguucugggccgggguggucuuccucggccccgaggacuccagcgaccccaccgagcaccccaccccggaccuggggcccggccacgugcgcaucaagauccggauggacaucgacguggucacgcgcaccaacaagauccgggaccgcuucugggaccccgggcccgccgccgacccgcugaccgaccuccgguacguguggggcggcuucgucuaccugcaggaccugguggagcgcgcggccgugcggguccucuccggggccaacccccgcgccggccuguaccugcagcagaugcccuaccccugcuacguggacgacguguuccuccggguccugagccgcucccugccccuguuccugacccuggccuggaucuacagcgugacgcucaccgugaaggcggucgugcgcgagaaggagacccggcugcgcgacaccaugcgggccauggggcugucccgcgccgugcucuggcugggcugguuccugagcugccucgggcccuuccugcugagcgccgcccuccugguccuggugcucaagcugggcgacauccugcccuacucccaccccggcguggucuuccucuuccuggcggccuucgccguggccacggugacccagagcuuccugcucuccgcguucuucagccgggccaaccuggccgccgccugcgggggccuggcguacuucucccucuaccugccguacguccugugcguggccuggcgcgaccggcuccccgccgggggccgcguggccgccagccugcugucccccgucgcguucggcuucgggugcgagagccucgcccugcuggaggagcagggcgagggggcccaguggcacaacgugggcacccggcccaccgccgacguguucucccucgcccaggucagcgggcugcugcuccuggacgcggcccuguacggccucgccacgugguaccuggaggccgugugcccgggccaguacgggauccccgagcccuggaacuuccccuuccgccgguccuacuggugcggcccgcggccgcccaagagcccggcgcccugccccacgccccuggacccgaaggugcucgucgaggaggcgccgcccgggcugucccccggcgugagcgugcggucccuggagaagcgcuucccggggagcccccagcccgcccuccggggccugucccuggacuucuaccagggccacaucaccgccuuccucgggcacaacggcgccgggaagaccacgacccugagcauccugagcggccucuucccgcccuccgggggcagcgcguucauccugggccacgacguccgcuccagcauggccgccauccggccccaccugggggugugcccccaguacaacgugcuguucgacaugcucaccgucgacgagcacgugugguucuacggccgccugaaggggcuguccgccgccguggucggccccgagcaggaccggcuccugcaggacguggggcuggugagcaagcaguccguccagacccgccaccucagcggcggcaugcagcggaagcuguccguggcgaucgccuucgucgggggcagccaggucgugauccuggacgagcccaccgccgggguggaccccgccucccgccgcggcaucugggagcuccugcugaaguaccgggagggccgcacgcucauccugagcacccaccaccuggacgaggccgagcuccugggggaccgggucgcggugguggccggcgggcgccugugcugcugcggcagcccccuguuccugcggcgccaccuggggagcggcuacuaccucacccuggucaaggcccggcugccccucaccacgaacgagaaggccgacaccgacauggagggcuccguggacacccgccaggagaagaagaacgggagccagggcucccggguggggaccccgcagcugcuggcccucguccagcacugggugcccggcgcgcgccuggucgaggagcugccccacgagcucgugcuggugcugcccuacacgggggcccacgacggcagcuucgccacccucuuccgggagcuggacacccgccuggccgagcuccggcugaccggcuacgggaucuccgacacgagccuggaggagaucuuccucaaggucguggaggagugcgcggccgacaccgacauggaggacggcagcugcgggcagcaccugugcaccggcaucgccgggcuggacgugacccuccgccugaagaugccgccccaggagacggcccuggagaacggcgagcccgccggcuccgcgcccgagaccgaccaggggagcggcccggacgccgucgggcgggugcagggcugggcccucacccgccagcagcugcaggcccugcuccugaagcgguuccugcucgcccgccggucccgccgcggccuguucgcgcagaucgugcugcccgcccucuucgucgggcuggcccugguguucagccucaucgugcccccguucggccacuaccccgcccugcggcugucccccaccauguacggggcccaggucagcuucuucuccgaggacgcgcccggcgacccggggcgcgcccggcuccuggaggcccugcuccaggaggccggccuggaggagccgcccgugcagcacagcucccaccgcuucagcgcgcccgaggugccggccgaggucgccaaggugcuggccuccggcaacuggacgcccgagagccccucccccgccugccagugcagccggccgggggcgcgccggcuccugcccgacugccccgccgccgccggcgggcccccgccgccccaggccgugaccggcuccggggaggucgugcagaaccugaccggccgcaaccucagcgacuuccuggugaagaccuacccccggcugguccgccagggccucaagacgaagaagugggugaacgaggugcgguacgggggcuucucccucgggggccgcgacccggggcugcccagcggccaggagcucggccgguccgucgaggagcugugggcgcugcucagcccccugcccgggggcgcccuggaccgcgugcucaagaaccugaccgccugggcccacagccuggacgcccaggacucccucaagaucugguucaacaacaagggguggcacagcaugguggcguucgucaaccgggccuccaacgccauccugcgcgcccaccucccgcccggccccgcgcggcacgcccacagcaucaccacccugaaccacccccugaaccugacgaaggagcagcucuccgagggggcccugauggccagcuccguggacgugcuggucagcaucugcgugguguucgccauguccuucguccccgcgagcuucacccucgugcugaucgaggagcgcgugacccgggccaagcaccuccagcucaugggcggccugucccccacccuguacuggcucgggaacuuccugugggacaugugcaacuaccugguccccgccugcaucguggugcugaucuuccucgccuuccagcagcgcgccuacgucgcgccggccaaccugcccgcccugcuccugcugcuccugcuguacggcuggagcaucacgccccucauguaccccgccuccuucuucuucagcgugccguccaccgccuacgugguccugaccugcaucaaccuguucaucgggaucaacggcagcauggcgaccuucgugcucgagcuguucuccgaccagaagcugcaggaggugagccggauccucaagcaggucuuccugaucuucccccacuucugccugggccgcgggcucaucgacauggugcgcaaccaggccauggccgacgccuucgagcggcugggcgaccgccaguuccagagcccccugcggugggagguggucgggaagaaccuccuggccauggugauccagggcccccuguuccuccuguucacgcugcuccugcagcaccgcagccagcugcucccgcagccccgggugcgcagccugccccugcucggggaggaggacgaggacgucgcgcgggagcgcgagcgggugguccagggcgccacccagggcgacgugcuggugcugcgcaaccucaccaaggucuaccgggggcagcgcaugcccgccguggaccggcugugccugggcaucccgcccggggagugcuucggccuccugggggugaacggcgccggcaagaccuccaccuuccgcauggucacgggggacacccuggcgagccggggcgaggccgugcucgccgggcacuccguggcccgcgagcccagcgccgcgcaccuguccaugggcuacugcccccagagcgacgccaucuucgagcugcucaccgggcgggagcaccuggagcugcucgcccgccugcggggcgucccggaggcccagguggcccagaccgcgggcuccgggcuggcccgccucggccugagcugguacgccgaccgccccgccgggacguacuccggcgggaacaagcggaagcuggccaccgcgcucgcccuggugggcgaccccgccgucguguuccuggacgagcccaccaccggcauggacccgagcgcccgccgguuccucuggaacucccugcuggcggugguccgcgaggggcggagcgugaugcucacgucccacagcauggaggagugcgaggcccugugcucccgccuggccaucauggugaacggccgguuccgcugccucgggagcccccagcaccugaagggccgguucgccgccggccacacccugacccuccgcguccccgcggcccggucccagcccgccgccgccuucguggcggccgaguucccgggggccgagcugcgcgaggcccacggcgggcggcugcgcuuccagcugccgcccggcgggcggugcgcccuggcgcgcguguucggcgagcuggccguccacggcgccgagcacgggguggaggacuucagcgugucccagaccaugcucgaggaggucuuccuguacuucagcaaggaccagggcaaggacgaggacacggaggagcagaaggaggccggggugggcguggacccggcgcccgggcugcagcaccccaagcgggucagccaguuccucgacgaccccuccaccgccgagaccgugcuguga

SEQ ID NO: 26155 - RNA, 4875 nt, Artificial Sequence
  derived and/or modified sequence opt1 from ABCA9__Homo_sapiens__NP_525022
augagcaagcgccggauguccgugggccagcagaccugggcccugcucugcaagaacugccugaagaaguggcgcaugaagcggcagacccugcucgaguggcuguucagcuuccugcucgugcuguuccuguaccucuucuucuccaaccugcaccaggugcacgacacgccccagaugagcuccauggaccuggggcgcguggacagcuucaacgacaccaacuacgucaucgccuucgcgccggaguccaagaccacccaggagaucaugaacaagguggccagcgcccccuuccucaagggccggacgaucaugggguggcccgacgagaaguccauggacgagcuggaccugaacuacagcaucgacgccgugcgcgucaucuucaccgacaccuucuccuaccaccucaaguucagcuggggccaccggauccccaugaugaaggagcaccgcgaccacuccgcccacugccaggcggugaacgagaagaugaagugcgaggggagcgaguucugggagaagggcuucguggccuuccaggccgccaucaacgcggccaucaucgagaucgccaccaaccacuccgucauggagcagcugaugagcgugacgggcgugcacaugaagauccugccguucgucgcccagggcgggguggccaccgacuucuucaucuucuucugcaucaucuccuucagcaccuucaucuacuacguguccgucaacgugacccaggagcggcaguacaucacgagccucaugaccaugauggggcugcgcgagagcgcguucuggcuguccuggggccucauguacgccggguucauccugaucauggccacccugauggcccucaucgugaaguccgcccagaucgucgugcugaccggcuucgugauggucuucacgcuguuccuccuguacggccugucccucaucacccuggcguuccugaugagcgugcucaucaagaagcccuuccugaccgggcugguggucuuccuccugaucguguucuggggcauccugggguuccccgcccucuacacccggcugcccgccuuccuggaguggacgcucugccugcuguccccguucgccuucaccgucggcauggcccagcucauccaccuggacuacgacgugaacagcaacgcgcaccuggacuccagccagaaccccuaccucaucaucgccacccuguucaugcugguguucgacacccugcucuaccugguccugacgcucuacuucgacaagauccugcccgccgaguacggccaccgcugcagcccccuguucuuccucaagagcugcuucugguuccagcacgggcgggccaaccacguggugcuggagaacgagaccgacuccgacccgacccccaacgacugcuucgagcccgucagccccgaguucugcggcaaggaggccauccgcaucaagaaccugaagaaggaguacgcggggaagugcgagcggguggaggcccucaagggcguggucuucgacaucuacgaggggcagaucaccgcccugcugggccacuccggcgccgggaagacgacccuccugaacauccugagcggccucuccgugccgaccagcggguccgugaccgucuacaaccacacgcugagccgcauggcggacaucgagaacaucuccaaguucaccggcuucugcccccagagcaacgugcaguucggguuccugaccgugaaggagaaccuccggcuguucgccaagaucaagggcauccugccccacgaggucgagaaggaggugcagcgcgugguccaggagcucgagauggagaacauccaggacauccuggcccagaaccugagcggcgggcagaaccggaagcucaccuucggcaucgccauccugggggacccccaggugcugcuccuggacgagccgacggccggccuggacccccucucccgccaccggaucuggaaccugcugaaggagggcaagagcgaccgcgugauccucuucuccacccaguucaucgacgaggcggacauccuggccgaccgcaaggucuucaucagcaacgggaagcugaagugcgccggcuccagccucuuccugaagaagaagugggggaucggcuaccaccugucccuccaccugaacgagcggugcgaccccgagagcaucaccucccuggugaagcagcacaucagcgacgccaagcucaccgcccaguccgaggagaagcugguguacauccugccccucgagcgcaccaacaaguucccggagcuguaccgggaccuggaccgcugcagcaaccaggggaucgaggacuacggcgucuccaucacgacccucaacgagguguuccugaagcuggagggcaagagcaccaucgacgaguccgacaucgggaucuggggccagcuccagaccgacggggcgaaggacaucggcagccugguggagcuggagcagguccucuccagcuuccacgagacgcggaagaccaucagcgggguggcccuguggcgccagcaggucugcgccaucgccaaggugcgguuccugaagcucaagaaggagcgcaagucccuguggaccauccugcuccuguucggcaucagcuucaucccccagcugcucgagcaccuguucuacgaguccuaccagaaguccuaccccugggagcugucccccaacaccuacuuccucagcccgggccagcagccccaggacccccugacgcaccuccuggugaucaacaagaccggguccaccaucgacaacuuccugcacagccugcggcgccagaacaucgccaucgagguggacgcguucggcacccggaacgggacggacgacccguccuacaacggcgccaucaucgucagcggggacgagaaggaccaccgcuucuccaucgccugcaacaccaagcggcucaacugcuuccccgugcugcuggacgugaucagcaacggccuccugggcaucuucaacuccagcgagcacauccagaccgaccgcuccaccuucuucgaggagcacauggacuacgaguacggguaccggagcaacacguucuucuggauccccauggccgcguccuucacccccuacaucgccaugagcuccaucggcgacuacaagaagaaggcccacagccagcugcgcaucagcgggcucuacccguccgccuacugguucggccaggcccuggucgacgugagccuguacuuccucauccugcugcucaugcagaucauggacuacaucuucucccccgaggagaucaucuucaucauccagaaccugcugauccagauccucugcagcaucggguacguguccagccuggucuuccugaccuacgugaucuccuucaucuuccggaacggccgcaagaacagcggcaucugguccuucuucuuccucaucguggucaucuucagcaucguggcgaccgaccugaacgaguacggguuccugggccucuucuucgggacgaugcugaucccgcccuucacccugaucggcucccuguucaucuucagcgagaucucccccgacagcauggacuaccucggggccuccgagagcgagaucguguaccuggcccugcucauccccuaccugcacuuccugaucuuccucuucauccugcggugccuggagaugaacugccgcaagaagcucaugcgcaaggaccccgucuuccggaucagcccccgcagcaacgccaucuucccgaaccccgaggagcccgagggcgaggaggaggacauccagauggagcggaugcgcaccgugaacgccauggcggugcgggacuucgacgagacccccgucaucaucgccuccugccugcgcaaggaguacgccggcaagaagaagaacugcuucagcaagcggaagaagaagaucgccacgcgcaacgugagcuucugcgugaagaagggggaggucaucggccugcucgggcacaacggcgccggcaaguccaccaccaucaagaugaucaccggggacacgaagccgaccgcgggccaggugauccugaaggggagcggcgggggcgagccccugggcuuccucggguacugcccccaggagaacgcccuguggcccaaccugaccguccggcagcaccucgagguguacgccgccgugaagggccugcgcaagggggacgcgaugaucgccaucacccggcuggucgacgcccucaagcugcaggaccagcugaaggccccggugaagacgcucuccgagggcaucaagcgcaagcugugcuucgugcugagcauccucgggaaccccuccgucgugcugcuggacgagcccagcaccggcauggaccccgagggccagcagcagauguggcaggucauccgggccaccuuccgcaacaccgagcgcggggcgcuccugacgacccacuacauggccgaggccgaggccgugugcgaccggguggccaucaugguguccggccggcugcgcugcaucgggagcauccagcaccucaaguccaaguucggcaaggacuaccugcuggagaugaagcucaagaaccuggcgcagauggagccgcugcacgccgagauccuccggcuguucccccaggccgcccagcaggagcgcuucagcucccugauggucuacaagcuccccguggaggacgugcggccgcugagccaggccuucuucaagcuggagaucgucaagcaguccuucgaccucgaggaguacagccugucccagagcacccuggagcaggucuuccucgagcuguccaaggagcaggagcugggggaccucgaggaggacuucgaccccagcgugaaguggaagcugcugcuccaggaggagcccuga

SEQ ID NO: 26156 - RNA, 3966 nt, Artificial Sequence
  derived and/or modified sequence opt1 from ABCB11__Homo_sapiens__NP_003733
augagcgacuccgugauccugcgcagcaucaagaaguucggcgaggagaacgacggguucgaguccgacaagagcuacaacaacgacaagaagucccggcuccaggacgagaagaagggcgacgggguccgcgugggcuucuuccagcuguuccgguucagcuccagcaccgacaucuggcugauguucguggggucccucugcgccuuccugcacggcaucgcccagcccggcguccugcucaucuucgggaccaugacggacguguucaucgacuacgacguggagcugcaggagcugcagaucccgggcaaggcgugcgucaacaacaccaucguguggaccaacagcucccucaaccagaacaugaccaacgggacgcgcugcggccugcugaacaucgagagcgagaugaucaaguucgccuccuacuacgccgggaucgccguggccguccucaucaccggcuacauccagaucugcuucugggugaucgcggccgcccggcagauccagaagaugcgcaaguucuacuuccggcgcaucaugcggauggagaucggcugguucgacugcaacagcgugggggagcugaacacccgcuucuccgacgacaucaacaagaucaacgacgccaucgcggaccagauggcccuguucauccagcggaugaccagcacgaucugcggcuuccuccugggguucuuccgcggcuggaagcugacccucgucaucaucuccgugagcccccugaucggcaucggggccgccaccaucggccuguccgugagcaaguucaccgacuacgagcucaaggccuacgcgaaggccggggucguggccgacgaggugaucagcuccaugcggacggucgccgccuucggcggggagaagcgcgagguggagcgguacgagaagaaccugguguucgcgcagcgcuggggcauccggaagggcaucgucaugggguucuucaccggcuucguguggugccugaucuuccucugcuacgcccuggccuucugguacgggagcacccuggugcucgacgagggcgaguacacccccgggacgcugguccagaucuuccuguccgugaucgucggcgcccucaaccugggcaacgccagccccugccuggaggcguucgccaccgggcgcgccgccgccaccuccaucuucgagaccaucgaccggaagccgaucaucgacugcaugagcgaggacggcuacaagcucgaccgcaucaagggggagaucgaguuccacaacgugacguuccacuaccccucccggcccgaggugaagauccugaacgaccugaacauggucaucaagcccggcgagaugaccgcgcucguggggccgagcggcgccggcaaguccaccgcccugcagcugauccagcgcuucuacgaccccugcgaggggauggugaccgucgacggccacgacauccgcagccucaacauccaguggcugcgggaccagaucgggaucguggagcaggagcccgugcuguucuccacgaccaucgccgagaacauccgcuacggccgggaggacgcgaccauggaggacaucguccaggccgccaaggaggccaacgccuacaacuucaucauggaccucccccagcaguucgacacccuggugggcgagggcggcgggcagaugagcggcgggcagaagcagcgcguggcgaucgcccgggcccugauccgcaacccgaagauccuccugcuggacauggccacguccgcccucgacaacgagagcgaggcgaugguccaggaggugcuguccaagauccagcacgggcacaccaucaucagcguggcccaccggcuguccaccguccgcgccgccgacaccaucaucggcuucgagcacgggacggccguggagcggggcacccacgaggagcugcucgagcgcaaggggguguacuucacccuggucacccugcagagccagggcaaccaggcgcucaacgaggaggacaucaaggacgccacggaggacgacaugcuggcccggaccuucucccgcgggagcuaccaggacagccugcgggccuccauccgccagcggagcaagucccagcucagcuaccuggugcacgagccgccccuggcgguggucgaccacaaguccaccuacgaggaggaccgcaaggacaaggacauccccgugcaggaggagguggagcccgcccccguccggcgcauccucaaguucagcgcccccgaguggcccuacaugcuggugggcuccgugggcgccgccgucaacgggaccgugaccccgcuguacgcguuccucuucagccagauccugggcacguucuccauccccgacaaggaggagcagcggagccagaucaacggggugugccuccuguucgucgccaugggcugcgugucccuguucacccaguuccugcagggguacgccuucgccaagagcggcgagcuccugaccaagcgccugcgcaaguucggcuuccgggccaugcucgggcaggacaucgcgugguucgacgaccugcgcaacucccccggcgcccugaccacgcggcucgccaccgacgccagccaggugcagggggccgcgggcucccagaucgggaugaucgucaacagcuucaccaacgugaccguggccaugaucaucgccuucuccuucagcuggaagcugagccuggucauccucugcuucuuccccuuccuggcccuguccggcgcgacgcagacccgcaugcucaccggcuucgccagccgggacaagcaggcccuggagaugguggggcagaucaccaacgaggcccuguccaacauccgcacgguggccggcaucgggaaggagcggcgcuucaucgaggcgcucgagaccgagcuggagaagccguucaagaccgccauccagaaggccaacaucuacggcuucugcuucgccuucgcccagugcaucauguucaucgcgaacagcgccuccuaccgguacggcggguaccugaucagcaacgagggccuccacuucuccuacgucuuccgcgugaucagcgccgugguccuguccgccaccgcccuggggcgggcguucagcuacacgcccuccuacgccaaggccaagaucagcgccgcccgcuucuuccagcuccuggaccggcagccgcccaucuccguguacaacaccgcgggcgagaagugggacaacuuccaggggaagaucgacuucguggacugcaaguucaccuaccccagccgccccgacucccagguccugaacggccucagcguguccaucagccccggccagacccuggccuucgugggguccagcggcugcggcaagagcacguccauccagcugcucgagcgguucuacgacccggaccaggggaaggucaugaucgacgggcacgacagcaagaaggugaacgugcaguuccugcgcuccaacaucggcaucgucagccaggagcccgugcuguucgccugcuccaucauggacaacaucaaguacggcgacaacaccaaggagauccccauggagcgggucaucgccgcggccaagcaggcccagcuccacgacuucgugaugagccugcccgagaaguacgagaccaacguggggucccagggcagccagcugucccgcggggagaagcagcggaucgccaucgcccgcgcgaucguccgggacccgaagauccuccugcuggacgaggccaccagcgcccucgacacggaguccgagaagaccguccagguggcccuggacaaggcccgcgagggccggaccugcaucgugaucgcgcaccgccugagcaccauccagaacgccgacaucaucgccgugauggcccaggggguggucaucgagaagggcacgcacgaggagcucauggcccagaagggcgcguacuacaagcuggugaccaccgggucccccaucagcuga

SEQ ID NO: 26157 - RNA, 3843 nt, Artificial Sequence
  derived and/or modified sequence opt1 from ABCB1__Homo_sapiens__NP_000918
auggaccuggagggcgaccgcaacgggggcgccaagaagaagaacuucuucaagcucaacaacaagagcgagaaggacaagaaggagaagaagcccaccguguccgucuucagcauguuccgguacuccaacuggcuggacaagcuguacauggugguggggacccucgccgcgaucauccacggcgccgggcugccgcugaugaugcucgucuucggcgagaugacggacaucuucgccaacgccggcaaccuggaggaccugaugagcaacaucaccaaccgcuccgacaucaacgacaccggguucuucaugaaccucgaggaggacaugacccgguacgccuacuacuacagcggcaucggggcgggcgugcugguggccgccuacauccaggucuccuucuggugccuggccgcggggcgccagauccacaagauccggaagcaguucuuccacgccaucaugcgccaggagaucggcugguucgacgugcacgacgugggcgagcucaacacgcggcugaccgacgacgucagcaagaucaacgaggggaucggcgacaagaucgggauguucuuccaguccauggccaccuucuucaccggcuucaucgugggcuucacgcgcggguggaagcugacccucgugauccuggccaucagccccguccugggccucuccgccgcggugugggccaagauccugagcuccuucaccgacaaggagcugcucgccuacgccaaggccggggcgguggccgaggagguccuggccgccauccggaccgugaucgccuucggcgggcagaagaaggagcuggagcgcuacaacaagaaccucgaggaggcgaagcggaucggcaucaagaaggccaucacggccaacaucagcaucggcgccgccuuccugcugaucuacgcguccuacgcccucgccuucugguacgggaccacccuggugcugagcggcgaguacuccaucgggcagguccucaccguguucuucagcgugcugaucggcgccuucuccgucgggcaggcgagccccagcaucgaggccuucgccaacgcccgcggcgccgcguacgagaucuucaagaucaucgacaacaagcccuccaucgacagcuacuccaagagcggccacaagccggacaacaucaaggggaaccuggaguuccggaacgugcacuucuccuaccccagccgcaaggaggugaagauccucaagggccugaaccugaagguccaguccgggcagacgguggcccucgucggcaacagcgggugcggcaaguccaccaccgugcagcugaugcagcggcuguacgaccccaccgagggcauggugagcgucgacgggcaggacauccgcacgaucaacgugcgguuccuccgcgagaucaucggcguggucucccaggagcccgugcuguucgccaccaccaucgccgagaacauccgguacgggcgcgagaacgugaccauggacgagaucgagaaggccgucaaggaggcgaacgccuacgacuucaucaugaagcugccgcacaaguucgacacgcucgugggcgagcggggcgcccagcugagcgggggccagaagcagcgcaucgccaucgcccgcgcgcuggugcggaaccccaagauccuccugcuggacgaggccaccuccgcccucgacaccgagagcgaggccgucguccagguggcgcuggacaaggcccgcaaggggcggaccacgaucgugaucgcccaccgccuguccaccgugcggaacgccgacgugaucgccggcuucgacgacggggucaucguggagaagggcaaccacgacgagcugaugaaggagaagggcaucuacuucaagcucgugaccaugcagaccgcggggaacgaggucgagcuggagaacgccgccgacgagagcaaguccgagaucgacgcccuggagaugagcuccaacgacagccgcagcucccucauccggaagcgcagcacgcggcgcuccgugcggggcagccaggcccaggaccgcaagcuguccaccaaggaggcgcuggacgagagcaucccgcccguguccuucuggcggaucaugaagcucaaccugaccgaguggcccuacuucgucguggggguguucugcgccaucaucaacggcgggcugcagcccgccuucgccaucaucuucagcaagaucaucggcgucuucacccgcaucgacgaccccgagacgaagcggcagaacuccaaccucuucagccugcuguuccucgcccugggcaucaucuccuucaucaccuucuuccugcagggguucaccuucggcaaggcgggggagauccucaccaagcgccugcgguacaugguguuccgcagcaugcugcggcaggacguguccugguucgacgaccccaagaacaccacgggcgcccucaccacccgccuggccaacgacgccgcgcaggucaagggggccaucggcagccgccuggccgugaucacccagaacaucgccaaccucggcacggggaucaucaucuccuucaucuacggcuggcagcugacccugcuccugcuggccaucgugccgaucaucgcgaucgccggggucguggagaugaagaugcucagcggccaggcccugaaggacaagaaggagcuggagggguccggcaagaucgccaccgaggccaucgagaacuuccggaccguggucagccucacgcaggagcagaaguucgagcacauguacgcgcagagccuccaggugcccuaccgcaacucccugcggaaggcccacaucuucggcaucaccuucagcuucacccaggccaugauguacuucuccuacgccgggugcuuccgcuucggcgccuaccugguggcgcacaagcugaugagcuucgaggacguccugcucguguucuccgccguggucuucggggccauggccgugggccaggugagcuccuucgcccccgacuacgcgaaggccaagaucagcgccgcccacaucaucaugaucaucgagaagacgccccugaucgacuccuacagcaccgagggccugaugccgaacacccucgaggggaacgucaccuucggcgaggugguguucaacuaccccacccggcccgacauccccguccugcaggggcugucccucgaggugaagaagggccagacgcuggcgcugguggggagcuccggcugcggcaagagcaccgucgugcagcuccuggagcgcuucuacgacccgcuggccgggaagguccuccuggacggcaaggagaucaagcggcugaacgugcaguggcuccgcgcccaccuggggaucgugucccaggagcccauccuguucgacugcagcaucgccgagaacaucgccuacggcgacaacucccgggucgugagccaggaggagaucgugcgcgcggccaaggaggccaacauccacgccuucaucgagucccuccccaacaaguacagcaccaaggucggggacaagggcacccagcugagcggcgggcagaagcagcggaucgccaucgcgcgcgcccuggugcggcagccccacauccuccugcuggacgaggccacguccgcccucgacaccgagagcgagaaggugguccaggaggcccuggacaaggcgcgcgagggccggaccugcaucgugaucgcccaccgccuguccaccauccagaacgccgaccucaucguggucuuccagaacgggcgggugaaggagcacggcacgcaccagcagcugcuggcccagaaggggaucuacuucagcaugguguccguccaggcgggcaccaagcgccaguga

SEQ ID NO: 26158 - RNA, 3840 nt, Artificial Sequence
  derived and/or modified sequence opt1 from ABCB4__Homo_sapiens__NP_000434
auggaccuggaggccgccaagaacggcaccgcguggcgccccaccagcgccgagggggacuucgagcucggcaucuccagcaagcagaagcggaagaagacgaagaccgugaagaugaucgggguccugacccuguuccgcuacuccgacuggcaggacaagcuguucaugagccucggcaccaucauggccaucgcccacggguccggccugccgcucaugaugaucguguucggcgagaugacggacaaguucguggacaccgccgggaacuucagcuuccccgucaacuucucccugagccugcucaaccccggcaagauccuggaggaggagaugacccgguacgcguacuacuacuccgggcugggcgccggggugcucguggccgccuacauccaggucagcuucuggacccuggcggccggccgccagauccggaagauccgccagaaguucuuccacgccauccugcggcaggagaucggcugguucgacaucaacgacacgaccgagcucaacacccgccugaccgacgacaucuccaagaucagcgaggggaucggcgacaagguggggauguucuuccaggccguggccacguucuucgcgggcuucaucgucggcuucauccggggguggaagcugacccucgugaucauggccaucucccccauccugggccugagcgccgccgugugggccaagauccucuccgcguucagcgacaaggagcuggccgccuacgccaaggccggggcggucgccgaggaggcccugggcgccauccgcaccgugaucgccuucgggggccagaacaaggagcucgagcgguaccagaagcaccuggagaacgcgaaggagaucggcaucaagaaggccaucuccgccaacaucagcauggggaucgccuuccugcucaucuacgcguccuacgcccuggccuucugguacggcagcacccuggugaucagcaaggaguacacgaucgggaacgccaugaccgucuucuucuccauccucaucggcgccuucagcguggggcaggcggccccgugcaucgacgccuucgccaacgcccgcggcgcggccuacgugaucuucgacaucaucgacaacaaccccaagaucgacuccuucagcgagcggggccacaagcccgacuccaucaaggggaaccuggaguucaacgacguccacuucagcuaccccucccgcgccaacgugaagauccugaagggccucaaccugaaggugcagagcgggcagaccgucgcccuggugggcuccagcgggugcggcaaguccaccacggugcagcucauccagcggcuguacgacccggacgagggcaccaucaacaucgacgggcaggacauccgcaacuucaacgucaacuaccugcgggagaucaucggcguggucagccaggagcccguccucuucuccaccaccaucgccgagaacaucugcuacgggcgcggcaacgugacgauggacgagaucaagaaggcggugaaggaggccaacgccuacgaguucaucaugaagcugccccagaaguucgacacccuggugggcgagcgcggggcccagcucagcggcgggcagaagcagcggaucgcgaucgcccgggcccuggugcgcaaccccaagauccugcuccuggacgaggccaccuccgcccuggacaccgagagcgaggcggagguccaggccgcccucgacaaggcccgcgagggccggacgaccaucgugaucgcccaccgccuguccaccgugcggaacgcggacgucaucgccggguucgaggacggcgugaucguggagcagggcagccacuccgagcugaugaagaaggagggggucuacuucaagcuggugaacaugcagaccagcggcagccagauccaguccgaggaguucgagcucaacgacgagaaggccgccacgcgcauggccccgaacggguggaagucccggcuguuccgccacagcacccagaagaaccugaagaacagccagaugugccagaagucccucgacguggagaccgacggccuggaggcgaacgucccgcccgugagcuuccugaaggugcucaagcugaacaagaccgaguggcccuacuucgucguggggacggugugcgccaucgccaacggcggccugcagcccgccuucuccgucaucuucagcgagaucaucgcgaucuucgggcccggcgacgacgccgugaagcagcagaagugcaacaucuucucccucaucuuccuguuccuggggaucaucagcuucuucaccuucuuccuccagggcuucaccuucgggaaggccggcgagauccugacccggcgccugcgguccauggccuucaaggccaugcuccgccaggacaugagcugguucgacgaccacaagaacuccaccggcgcgcugagcacgcggcuggccaccgacgccgcccaggugcagggggccaccggcacccgccucgcgcugaucgcccagaacaucgccaaccuggggacgggcaucaucaucuccuucaucuacggguggcagcucacccugcugcuccuggccgucgugcccaucaucgccgugagcggcaucgucgagaugaagcugcucgcgggcaacgccaagcgggacaagaaggagcuggaggccgccgggaagaucgccaccgaggcgaucgagaacauccgcaccguggugucccugacgcaggagcggaaguucgagagcauguacgucgagaagcucuacggccccuaccgcaacagcgugcagaaggcccacaucuacgggaucaccuucuccaucagccaggccuucauguacuucuccuacgccggcugcuuccgguucggcgcguaccugaucgugaacgggcacaugcgcuuccgggacgucauccugguguucagcgccaucguguucggcgccgucgcccucgggcacgccuccagcuucgcgccggacuacgccaaggccaagcuguccgccgcccaccuguucaugcuguucgagcgccagccccucaucgacagcuacuccgaggagggccugaagcccgacaaguucgaggggaacaucaccuucaacgaggugguguucaacuaccccacccgcgcgaacgucccggugcuccagggccugagccuggaggugaagaagggccagacgcucgcccuggucggguccagcggcugcgggaaguccaccguggugcagcugcucgagcgguucuacgacccccuggccggcaccguccugcucgacgggcaggaggccaagaagcugaacgugcaguggcugcgcgcccagcucggcaucgugagccaggagcccauccuguucgacugcuccaucgcggagaacaucgccuacggcgacaacagccgggucgugucccaggacgagaucgugagcgccgccaaggcggccaacauccaccccuucaucgagacccugccgcacaaguacgagacgcgcgucggggacaagggcacccagcucuccgggggccagaagcagcggaucgccaucgcccgcgcccugauccggcagccccagauccugcuccuggacgaggcgaccagcgcccuggacaccgagagcgagaaggugguccaggaggcccucgacaaggcccgcgaggggcggacgugcaucgugaucgcccaccgccuguccaccauccagaacgcggaccugaucguggucuuccagaacggccgggugaaggagcacggcacccaccagcagcuccuggcccagaaggggaucuacuucagcaugguguccguccaggccggcacccagaaccuguga

SEQ ID NO: 26159 - RNA, 3774 nt, Artificial Sequence
  derived and/or modified sequence opt1 from ABCB5__Homo_sapiens__NP_001157413
auggagaacagcgagcgcgccgaggagaugcaggagaacuaccagcggaacggcaccgccgaggagcagcccaagcugcgcaaggaggcggugggguccaucgagaucuuccgguucgccgacggccucgacaucacccugaugauccuggggauccucgccagccuggucaacggcgccugccugccgcucaugccccuggugcugggggagauguccgacaaccucaucagcggcugccuggugcagacgaacaccaccaacuaccagaacugcacccagucccaggagaagcugaacgaggacaugacgcuccugacccuguacuacgucggcaucgggguggccgcgcucaucuucggcuacauccagaucagccuguggaucaucaccgccgcccgccagaccaagcggauccgcaagcaguucuuccacuccgugcuggcccaggacaucgggugguucgacagcugcgacaucggcgagcucaacacgcggaugaccgacgacaucgacaagaucuccgacgggaucggcgacaagaucgcgcugcuguuccagaacaugagcaccuucuccaucggccucgccgucgggcuggugaagggcuggaagcugacccucgugacgcugagcaccagcccccugaucauggccuccgccgccgcgugcucccgcauggucaucagccucaccuccaaggagcugagcgccuacuccaaggccggggccguggccgaggaggugcugagcagcauccggaccgucaucgcguuccgcgcccaggagaaggagcuccagcgguacacgcagaaccugaaggacgccaaggacuucggcaucaagcgcaccaucgccuccaaggugagccugggcgccguguacuucuucaugaacgggaccuacggccucgcguucugguacgggaccucccugauccugaacggcgagcccggguacacgaucggcaccguccucgccguguucuucagcgugauccacuccagcuacugcaucggcgccgccgucccgcacuucgagaccuucgccaucgcgcgcggggccgccuuccacaucuuccaggugaucgacaagaagcccuccaucgacaacuucagcaccgccggcuacaagcccgaguccaucgaggggacgguggaguucaagaacgucagcuucaacuaccccucccggccgagcaucaagauccugaagggccugaaccuccggaucaaguccggggagaccguggcgcuggugggccugaacggcagcgggaaguccaccgucgugcagcuccugcagcgccuguacgaccccgacgacggcuucaucauggucgacgagaacgacauccgggcccucaacgugcgccacuaccgggaccacaucgggguggucagccaggagcccgugcuguucggcaccacgaucuccaacaacaucaaguacgggcgcgacgacgugaccgacgaggagauggagcgggccgcccgcgaggccaacgcguacgacuucaucauggaguuccccaacaaguucaacacccuggucggcgagaagggcgcccagaugagcgggggccagaagcagcgcaucgccaucgcccgggcccucgugcgcaacccgaagauccugauccuggacgaggcgaccuccgcccuggacagcgagagcaaguccgccgugcaggccgcccucgagaaggcgagcaaggggcggacgaccaucgucguggcccaccgccuguccaccauccggagcgccgaccugaucgugacccucaaggacggcaugcuggccgagaagggcgcgcacgccgagcugauggccaagcgcgggcucuacuacucccuggucaugagccaggacaucaagaaggccgacgagcagauggaguccaugacguacagcaccgagcggaagaccaacucccugccccuccacagcgugaaguccaucaagagcgacuucaucgacaaggccgaggaguccacccagagcaaggagaucucccugcccgaggugagccugcucaagauccugaagcugaacaagcccgaguggccguucgucgugcucggcacccuggcguccgugcugaacgggacgguccaccccguguucagcaucaucuucgccaagaucaucaccauguucggcaacaacgacaagaccacccucaagcacgacgccgagaucuacagcaugaucuucgugauccugggggucaucugcuucguguccuacuucaugcagggccuguucuacggccgcgccggggagauccucacgaugcggcugcgccaccuggccuucaaggcgaugcucuaccaggacaucgccugguucgacgagaaggagaacagcaccggcgggcugaccaccauccuggccaucgacaucgcccagauccagggcgccacggggucccggaucggcgugcucacccagaacgcgaccaacaugggccugagcgucaucaucuccuucaucuacgggugggagaugaccuuccugauccucagcaucgcccccgugcuggccgugacgggcaugaucgagaccgccgcgaugaccggguucgccaacaaggacaagcaggagcugaagcacgccggcaagaucgccaccgaggcccucgagaacauccgcacgaucgucucccugacccgggagaaggcguucgagcagauguacgaggagaugcugcagacccagcaccgcaacaccagcaagaaggcccagaucaucggguccugcuacgccuucagccacgccuucaucuacuucgccuacgcggccggcuuccgguucggcgccuaccucauccaggccgggcgcaugacgcccgagggcauguucaucguguucaccgccaucgcguacggggccauggccaucggcgagacccuggugcuggccccggaguacuccaaggccaagagcggggcggcccaccucuucgcccugcuggagaagaagcccaacaucgacucccggagccaggagggcaagaagcccgacacgugcgagggcaaccucgaguuccgcgaggucuccuucuucuaccccugccggccggacguguucauccugcgcgggcugagccucuccaucgagcgcggcaagaccguggccuucgucgggagcuccggcugcggcaagagcaccagcgugcagcugcugcagcggcucuacgaccccgugcaggggcagguccuguucgacggcguggacgcgaaggagcugaacgugcaguggcuccgcucccagaucgccaucgucccccaggagcccgugcuguucaacugcagcaucgccgagaacaucgccuacggggacaacucccggguggucccgcuggacgagaucaaggaggccgcgaacgccgccaacauccacagcuucaucgagggccuccccgagaaguacaacacccagguggggcugaagggcgcccagcuguccggcgggcagaagcagcgccucgccaucgcgcgggcccugcugcagaagcccaagauccuccugcuggacgaggccaccagcgcccucgacaacgacuccgagaaggugguccagcacgcccuggacaaggcgcgcacgggccggaccugccugguggugacccaccgccucagcgccauccagaacgccgaccugaucgucgugcugcacaacgggaagaucaaggagcagggcacccaccaggagcuccugcggaaccgcgacaucuacuucaagcuggugaacgcccaguccguccaguga

SEQ ID NO: 26160 - RNA, 2529 nt, Artificial Sequence
  derived and/or modified sequence opt1 from ABCB6__Homo_sapiens__NP_005680
auggugaccgucggcaacuacugcgaggccgaggggcccgugggcccggccuggaugcaggacgggcugagccccugcuucuucuucacccucgugcccuccacgcgcauggcgcugggcacccuggcccucguccuggcccugcccugccggcgccgggagcgcccggccggggccgacagccucuccuggggcgcgggcccccggaucagccccuacgugcugcagcugcuccuggccacccugcaggccgcccucccccuggcggggcuggccggccgcguggggaccgcccggggcgccccgcuccccuccuaccugcugcucgccagcguccuggagucccuggcgggggccugcggccucuggcugcuggugguggagcgcagccaggcccggcagcgccucgccaugggcaucuggaucaaguuccggcacucccccgggcugcugcuccuguggacggucgccuucgcggccgagaaccuggcccucgugagcuggaacagcccccagugguggugggcccgcgccgaccugggccagcagguccaguucucccugugggugcuccgguacgugguguccgggggccuguucguccugggccucugggcgccggggcugcgcccccagagcuacacccuccaggugcacgaggaggaccaggacguggagcggucccagguccgcagcgccgcccagcaguccaccuggcgggacuucggccgcaagcugcggcugcugagcggguaccucuggccccgcggcucccccgcccugcagcugguggugcucaucugccuggggcugaugggccucgagcgggcccugaacguccuggugccgaucuucuaccgcaacaucgugaaccugcucaccgagaaggcgcccuggaacagccuggccuggacggucaccagcuacguguuccugaaguuccuccagggcgggggcaccggguccaccggcuucgucagcaaccugcgcacguuccuguggauccgggugcagcaguucaccucccgccggguggagcuccugaucuucagccaccuccacgagcugucccugcgcuggcaccuggggcggcgcaccggcgagguccuccggaucgccgaccgcggcaccagcuccgugacggggcugcugagcuaccucguguucaacgucauccccacccuggccgacaucaucaucggcaucaucuacuucuccauguucuucaacgcgugguucgggcugaucguguuccucugcaugagccuguaccugacccucaccaucguggucacggaguggcggaccaaguuccgccgggccaugaacacccaggagaacgccacccgcgcccgggccguggacucccugcugaacuucgagacggugaaguacuacaacgcggagagcuacgaggucgagcgcuaccgggaggccaucaucaaguaccagggccucgaguggaaguccagcgccucccuggugcugcucaaccagacccagaaccuggugaucgggcugggccuccuggccggcagccugcucugcgccuacuucgucaccgagcagaagcuccaggugggggacuacgugcuguucggcaccuacaucauccagcuguacaugccccugaacugguucgggacguacuaccgcaugauccagaccaacuucaucgacauggagaacauguucgaccugcucaaggaggagaccgaggucaaggaccugccgggcgcgggcccccugcgguuccagaaggggcgcaucgaguucgagaacgugcacuucuccuacgccgacggccgggagacccuccaggacgugagcuucacggucaugcccgggcagacccuggcccuggugggccccuccggggccggcaagagcaccauccuccgccugcuguuccgcuucuacgacaucagcuccggcugcauccggaucgacgggcaggacaucagccaggugacccaggccucccuccgcagccacaucggcgucgugccgcaggacacggugcuguucaacgacaccaucgcggacaacauccgguacgggcgcgucaccgccggcaacgacgagguggaggccgccgcgcaggccgccgggauccacgacgccaucauggccuuccccgagggcuaccggacccaggugggcgagcgcgggcugaagcucuccggcggggagaagcagcgggucgcgaucgcccgcaccauccugaaggcccccggcaucauccugcucgacgaggccacgagcgcccuggacaccuccaacgagcgggcgauccaggccagccuggccaaggugugcgccaaccgcaccaccaucguggucgcccaccggcucuccacgguggugaacgcggaccagauccuggucaucaaggacgggugcaucguggagcgcggccggcacgaggcccugcucagccgcggcgggguguacgccgacauguggcagcugcagcagggccaggaggagaccuccgaggacaccaagccccagaccauggagcgguga

SEQ ID NO: 26161 - RNA, 2259 nt, Artificial Sequence
  derived and/or modified sequence opt1 from ABCB7__Homo_sapiens__NP_001258625
auggcccugcucgccaugcacagcuggcgcugggcggccgccgccgccgcguucgagaagcggcgccacuccgccauccugauccggccccuggugagcgucuccggcagcgggccgcaguggcgcccccaccagcucggcgcccuggggaccgcccgggcguaccagauccccgagucccugaaguccaucaccuggcagcgccucggcaaggggaacuccggccaguuccuggacgccgccaaggcccuccagguguggccccucaucgagaagcggacgugcuggcacggccacgccgggggcgggcugcacaccgacccgaaggagggccugaaggacguggacacccgcaagaucaucaaggcgaugcucagcuacgucuggcccaaggaccggcccgaccugcgcgcccggguggccaucucccugggguuccucggcggcgccaaggccaugaacaucgugguccccuucauguucaaguacgcgguggacagccugaaccagauguccgggaacaugcugaaccucagcgacgccccgaacaccguggccacgauggccaccgccguccugaucggcuacggggugucccgcgcgggcgccgccuucuucaacgaggugcggaacgccgucuucggcaagguggcccagaacagcauccgccggaucgcgaagaacguguuccugcaccuccacaaccuggaccugggguuccaccucucccgccagaccggcgcccugagcaaggccaucgaccgggggacccgcggcaucuccuucguccugagcgcccucguguucaaccugcugcccaucauguucgaggugaugcucgucuccggggugcuguacuacaagugcggcgcgcaguucgcccuggugacgcucggcacccuggggaccuacaccgccuucacggucgccgugacccgguggcgcacccgguuccgcaucgagaugaacaaggccgacaacgacgcgggcaacgccgccaucgacagccugcucaacuacgagaccgugaaguacuucaacaacgagcgcuacgaggcccagcgguacgacggguuccugaagacguacgagaccgccagccugaaguccaccagcacccucgcgaugcugaacuucggccaguccgccaucuucagcgucgggcugacggccaucauggugcucgccucccagggcaucgucgccggcacccugaccgugggggaccuggugauggucaacggccuccuguuccagcugagccucccccugaacuuccuggggaccguguaccgcgagacgcggcaggcgcugaucgacaugaacacccucuucacccugcugaagguggacacccagaucaaggacaaggucauggccagcccccuccagaucacgccgcagaccgccaccguggccuucgacaacgugcacuucgaguacaucgagggccagaagguccugagcgggaucuccuucgaggugcccgcgggcaagaagguggccaucgucggcgggagcggcuccggcaagagcaccaucgugcgccugcuguuccgguucuacgagccccagaagggguccaucuaccuggccggccagaacauccaggacgugagccuggagucccuccgccgggccgucgggguggugccccaggacgccguccuguuccacaacacgaucuacuacaaccugcucuacggcaacaucagcgcguccccggaggagguguacgccguggccaagcuggccgggcugcacgacgccauccuccgcaugccccacggcuacgacacccaggucggggagcggggccugaagcugagcggcggggagaagcagcgcguggcgaucgcccgggccauccucaaggacccgcccgugauccuguacgacgaggccaccuccagccuggacagcaucaccgaggagacgauccucggcgccaugaaggacgucgugaagcaccgcaccuccaucuucaucgcgcaccggcugagcaccguggucgacgccgacgagaucaucgugcuggaccaggggaagguggccgagcgcggcacccaccacgggcuccuggccaacccccacuccaucuacagcgagauguggcacacccaguccagccggguccagaaccacgacaaccccaagugggaggcgaagaaggagaacaucuccaaggaggaggagcgcaagaagcugcaggaggagaucgugaacagcgugaagggcugcggcaacugcuccugcuga

SEQ ID NO: 26162 - RNA, 2208 nt, Artificial Sequence
  derived and/or modified sequence opt1 from ABCB8__Homo_sapiens__NP_001269220
augcuggugcaccucuuccgcgucggcauccgcgggggccccuucccggggcggcugcugccgccccugcgguuccagaccuucagcgccgugcgcaacaccuggcggaacggcaagacggggcagcugcacaaggccgagggcgaguacuccgacggcuaccgcagcuccagccugcuccgggcgguggcccaccuccgcucccagcugugggcccaccucccccgggccccgcuggcgccccgcuggagccccuccgccuggugcugggucgggggcgcccugcucgggcccauggugcugagcaagcacccccaccugugccucguggcccugugcgaggccgaggaggcgccgcccgccuccagcacgccccacgucgugggcucccgguucaacuggaagcuguucuggcaguuccuccacccccaccuccuggugcugggggucgccguggugcuggcccugggcgccgcgcucgucaacgugcagaucccccugcugcucggccagcugguggaggucguggccaaguacacccgcgaccacguggggagcuucaugaccgagucccagaaccugagcacccaccuccugauccuguacggcguccaggggcuccugaccuucggcuaccuggugcuccugucccacgugggcgagcggauggccgucgacaugcgccgggcccuguucagcucccuccugcgccaggacaucaccuucuucgacgccaacaagaccgggcagcuggugagccggcucacgaccgacgugcaggaguucaaguccagcuucaagcuggucaucagccagggccugcgcuccugcacccagguggcggggugccucgucagccuguccaugcugagcacccggcucacgcugcugcugaugguggccacccccgcccucaugggcguggggacccugaugggcuccggccugcgcaagcucagccggcagugccaggagcagaucgcccgcgccaugggggucgcggacgaggcccugggcaacgugcgcaccgugcgggccuucgccauggagcagcgcgaggaggagcgguacggggccgagcuggaggcgugccgcugccgggccgaggagcucggccgcgggaucgcccuguuccagggccuguccaacaucgccuucaacugcaugguccucggcacgcuguucaucgggggcagccugguggcggggcagcagcucaccggcggggaccugauguccuuccugguggccagccagaccguccagcgguccauggccaaccucagcgugcuguucggccaggugguccgcggccuguccgccggggcccggguguucgaguacauggcgcucaaccccugcaucccgcugagcggcgggugcugcgugcccaaggagcagcugcgcggcuccgucaccuuccagaacgugugcuucagcuaccccugccggcccggcuucgaggugcucaaggacuucacgcugacccugccgcccgggaagaucgucgcccucgugggccaguccgggggcgggaagaccaccguggccagccugcuggagcgcuucuacgaccccacggccggcgucgugaugcucgacggccgggaccugcgcacccuggaccccuccuggcuccggggccagguggucggguucaucagccaggagccggugcuguucgggaccaccaucauggagaacauccgcuucggcaagcuggaggccagcgacgaggagguguacacggcggcccgggaggccaacgcccacgaguucaucaccuccuuccccgagggguacaacaccgucgugggcgagcgcggcaccacgcucagcgggggccagaagcagcggcuggccaucgcgcgcgcccugaucaagcagcccaccgugcucauccuggacgaggccaccuccgcccuggacgcggagagcgagcgcgucgugcaggaggcccucgaccgggccuccgccgggcgcaccgugcuggucaucgcccaccggcugagcacggugcgcggcgcgcacugcaucguggucauggccgacgggcgggugugggaggccggcacccacgaggagcuccugaagaagggcgggcuguacgccgagcucauccgccggcaggcccuggacgcgccccgcaccgccgccccgccgcccaagaagcccgagggcccccggucccaccagcacaagagcuga

SEQ ID NO: 26163 - RNA, 2112 nt, Artificial Sequence
  derived and/or modified sequence opt1 from ABCB9__Homo_sapiens__NP_001229942
augcgccuguggaaggccguggucgugacccucgccuucaugagcguggacaucugcgucaccacggcgaucuacguguucucccaccuggaccggagccugcucgaggacauccgccacuucaacaucuucgacuccgugcuggaccugugggccgccugccucuaccggagcugccugcugcucggcgccaccaucggggucgccaagaacuccgcgcugggcccccgccggcugcgcgccagcuggcucgugaucacccuggugugccuguucgucgggaucuacgccauggugaagcuccugcuguucuccgaggugcggcgcccgauccgggaccccugguucugggcccucuucgucuggaccuacaucagccugggcgcguccuuccugcucugguggcugcugagcacggugcgccccgggacccaggcccucgagcccggcgccgccaccgaggccgagggcuucccgggguccggccggcccccgcccgagcaggcgagcggggccacccugcagaagcugcucuccuacacgaagcccgacguggccuuccuggucgccgccagcuucuuccugaucguggcggcccucggcgagaccuuccugcccuacuacaccgggcgcgccaucgacggcaucgugauccagaaguccauggaccaguucagcaccgccgucgugaucgugugccugcucgccaucggcuccagcuucgcggccgggauccggggcgggaucuucacgcugaucuucgcccgccugaacauccggcuccgcaacugccuguuccggucccuggucagccaggagaccagcuucuucgacgagaaccgcaccggcgaccucaucucccggcugaccagcgacacgaccaugguguccgaccuggugagccagaacaucaacgucuuccuccgcaacaccgugaaggucaccggcgugguggucuucauguucucccugagcuggcagcugucccucgugacguucaugggguuccccaucaucaugauggugagcaacaucuacggcaaguacuacaagcggcuguccaaggagguccagaacgcccuggcccgcgcgagcaacaccgccgaggagaccaucuccgccaugaagaccgugcgcagcuucgccaacgaggaggaggaggcggagguguaccuccggaagcugcagcaggucuacaagcugaaccgcaaggaggccgccgccuacauguacuacguguggggguccggccugacgcuccuggugguccaggugagcauccuguacuacgggggccaccucgugaucuccggccagaugaccagcgggaaccugaucgccuucaucaucuacgaguucguccugggcgacugcauggagaacguguccuucagccucucccccgggaaggugaccgcgcuggucggcccgagcgggagcggcaaguccagcugcgugaacauccuggagaacuucuacccccucgagggcgggcgggugcugcuggacggcaagcccaucuccgccuacgaccacaaguaccuccaccgcgucaucagccuggugucccaggagcccgugcuguucgcccggagcaucaccgacaacaucuccuacgggcucccgacgguccccuucgagauggugguggaggccgcccagaaggcgaacgcccacggcuucaucauggagcugcaggacggguacagcaccgagaccggcgagaagggcgcccagcuguccgggggccagaagcagcgcgucgccauggcccgggcgcucgugcgcaacccgcccgugcugauccuggacgaggccaccagcgcccucgacgccgaguccgaguaccugauccagcaggcgauccacgggaaccugcagaagcacacgguccucaucaucgcccaccggcugagcaccguggagcacgcccaccugaucgugguccucgacaagggccgcguggugcagcagggcacccaccagcagcugcuggcccagggcgggcucuacgccaagcugguccagcggcagaugcuggggcuccagcccgcggccgacuucaccgccggccacaacgagcccguggccaacgggucccacaaggccuga

SEQ ID NO: 26164 - RNA, 4479 nt, Artificial Sequence
  derived and/or modified sequence opt1 from ABCC10__Homo_sapiens__NP_001185863
auggagcgccugcucgcccagcugugcggcagcuccgccgcguggccccugccgcucugggagggggacaccaccggccacugcuucacgcagcuggugcugagcgcccucccccacgcccugcuggccguccucuccgccugcuaccuggggacgccccggagccccgacuacauccugccgugcucccccggcuggcgccuccggcuggcggccagcuuccugcucuccguguucccccugcuggaccuccugcccguggcccugccgcccggggccggccccggccccaucgggcucgagguccuggcgggcugcguggccgccguggccuggaucagccacucccuggcccucuggguccuggcgcacagcccgcacgggcacucccgcggcccccuggcccucgcccugguggcccugcuccccgcccccgcgcuggugcugaccguccucuggcacugccagcgggggacccugcugccgccccuccugcccggccccauggcccgccugugccuccugauccugcagcucgccgcccugcuggccuacgcgcucggcugggccgcccccgggggcccccgggagcccugggcccaggagccccugcugccggaggaccaggagcccgagguggccgaggacggggagagcuggcucucccgcuucagcuacgcguggcuggcgccccugcuggcccggggcgccugcggcgagcuccgccagccccaggacaucugccggcugccgcaccgccugcagcccaccuaccucgcccggguguuccaggcccacuggcaggagggggcccgccuguggcgggcccuguacggcgccuucgggcgcugcuaccucgcgcugggccugcucaagcuggucgggaccaugcugggcuucuccggcccccuccugcugagccuccuggugggguuccuggaggagggccaggagccgcucucccacgggcugcuguacgcccucggccuggccgggggcgccgugcugggcgccguccuccagaaccaguacggguacgagguguacaaggugacccugcaggcgcggggcgccguccugaacauccucuacugcaaggcccugcagcuggggcccagccgcccgcccaccggcgaggcccucaaccugcuggggacggacuccgagcggcuccugaacuucgccggcagcuuccacgaggcguggggccugccgcuccagcuggccaucacccuguaccuccuguaccagcaggucgggguggccuucgucggcgggcugauccucgcccugcugcucgugcccgugaacaaggucaucgcgacccgcaucauggccagcaaccaggagaugcugcagcacaaggacgcccgggugaagcuggucaccgagcuccuguccggcauccgcgugaucaaguucugcggcugggagcaggcccugggggcccgcguggaggcgugccgggcccgcgagcucggccggcugcgcgucaucaaguaccuggacgccgccugcguguaccucugggccgcgcugcccguggugaucagcaucgugaucuucaucacguacgugcugauggggcaccagcucaccgccaccaaggucuucaccgcccuggcccuggugcggaugcucauccugccccugaacaacuucccgugggugaucaacggccuccuggaggccaaggucucccuggaccgcauccagcuguuccucgaccugcccaaccacaacccccaggcguacuacagccccgacccgcccgccgagcccuccacggugcucgagcugcacggggcccuguucagcugggaccccgugggcaccucccucgagaccuucaucagccaccuggaggucaagaagggcaugcugguggggaucgugggcaaggucgggugcggcaaguccagccuccuggccgcgaucgccggggagcugcaccggcuccgcggccacguggccgugcggggccuguccaagggguucggccuggccacccaggagccguggauccaguucgccacgauccgcgacaacauccucuucgggaagaccuucgacgcgcagcuguacaaggagguccuggaggccugcgcccucaacgacgaccugagcauccugcccgccggcgaccagaccgaggugggggagaagggcgugacccucuccggcgggcagcgggcccgcaucgcgcuggcccgggccgucuaccaggagaaggagcuguaccuccuggacgacccccuggccgccguggacgcggacguggccaaccaccuccugcaccgcugcauccugggcaugcugagcuacacgacccggcuccugugcacccaccgcaccgaguaccuggagcgggccgacgccguccuccugauggaggccgggcgccugauccgggcggggcccccguccgagauccucccccuggugcaggccgugcccaaggccugggccgagaacgggcaggagagcgacuccgcgacggcccagagcguccagaaccccgagaagaccaaggagggccuggaggaggagcaguccaccagcggccgccuccugcaggaggagagcaagaaggagggggccguggcccugcacguguaccaggccuacuggaaggcggucggccaggggcucgcccuggccauccuguucucccuccugcugaugcaggccacccgcaacgccgcggacugguggcucagccacuggaucucccagcugaaggccgagaacagcucccaggaggcccagccgagcacgucccccgccagcaugggccuguucagcccccagcuccugcuguucuccccgggcaaccucuacauccccguguucccccugcccaaggccgcgccgaacggguccagcgacauccgguucuaccugaccguguacgccaccaucgccggcgucaacucccucugcacccugcugcgcgccguccucuucgcggccgggacgcugcaggccgccgccacccugcaccggcgccuccugcaccgggugcugauggcgcccgugaccuucuucaacgccacccccaccggccgcauccucaaccgguucagcuccgacguggccugcgccgacgacagccugcccuucauccugaacauccuccuggccaacgcggccgggcugcucggccugcuggccgugcucggcuccgggcugccguggcugcuccugcugcucccgccccugagcaucauguacuaccacguccagcgccacuaccgggccagcucccgcgagcugcggcgccucggcagccugacgcugagcccccucuacucccaccuggccgacacccuggcggggcucuccgugcugcgggccaccggcgccaccuaccgcuucgaggaggagaaccugcggcuccuggagcugaaccagcgcugccaguucgccacgagcgcgaccaugcaguggcucgacauccggcugcagcugaugggggccgccguggucuccgccaucgccggcaucgcgcucgugcagcaccagcagggccuggccaaccccgggcuggugggccucagccuguccuacgcccugagccucaccgggcugcuguccggccucgucagcuccuucacccagacggaggccaugcuggugagcguggagcgccuggaggaguacacgugcgaccucccccaggagccccaggggcagccccugcagcugggcaccggcuggcucacccagggcggcgucgaguuccaggacgugguccuggccuaccggccggggcugcccaacgcgcucgacggcgugaccuucugcgugcagcccggcgagaagcuggggaucgucggccgcaccggguccggcaagagcucccugcuccuggugcuguuccggcuccuggagcccagcuccgggcgcgugcugcucgacggcgucgacaccagccagcuggagcuggcccagcuccgcagccagcuggccaucaucccgcaggagcccuuccuguucuccggcaccgugcgggagaaccuggacccccaggggcuccacaaggaccgcgcccuguggcaggcccugaagcagugccaccucagcgaggugaucacguccaugggcgggcuggacggcgagcugggggagggcggccggagccucucccuggggcagcgccagcugcucugccuggcgcgggcccugcucaccgacgccaagauccugugcaucgacgaggccaccgccagcgucgaccagaagaccgaccagcugcuccagcagacgaucugcaagcgcuucgcgaacaagaccgugcugaccaucgcccaccggcugaacaccauccucaacuccgaccgcgugcugguccugcaggccggccgggugguggagcucgacagccccgccacgcugcgcaaccagccgcacucccuguuccagcagcuccugcagagcucccagcaggggguccccgcgagccugggcgggcccuga

SEQ ID NO: 26165 - RNA, 4149 nt, Artificial Sequence
  derived and/or modified sequence opt1 from ABCC11__Homo_sapiens__NP_115972
augacccgcaagcggaccuacugggugcccaacagcuccggcgggcuggucaaccgcggcaucgacaucggggacgacauggugagcggccucaucuacaagacguacacccugcaggacgggccguggucccagcaggagcggaaccccgaggcccccggccgcgccgcggugcccccguggggcaaguacgacgccgcccugcggaccaugauccccuuccgccccaagccccgguucccggcgccccagccccucgacaacgccgggcuguucagcuaccugaccgucuccuggcucacgccccugaugauccagagccugcgcucccggcucgacgagaacaccaucccgccccugagcgugcacgacgcguccgacaagaacgugcagcgccugcaccggcucugggaggaggaggucagccgccggggcaucgagaaggccuccgugcugcuggugaugcuccgcuuccagcggacccgccugaucuucgacgcccugcucgggaucugcuucugcaucgccagcguccugggccccauccugaucauccccaagauccucgaguacuccgaggagcagcuggggaacguggugcacggcgucggccugugcuucgcccucuuccugagcgagugcgugaagucccugagcuucuccagcuccuggaucaucaaccagcggaccgccauccgcuuccgggccgccgugagcagcuucgccuucgagaagcucauccaguucaaguccgucauccacaucacgagcggggaggcgaucuccuucuucaccggcgacgugaacuaccuguucgagggggugugcuacggcccgcugguccucaucacgugcgccagccuggugaucugcuccaucagcuccuacuucaucaucggcuacaccgccuucaucgccauccugugcuaccuccugguguucccccuggccgucuucaugacccgcauggcggugaaggcccagcaccacaccagcgagguguccgaccagcggauccgcgucaccagcgaggugcugaccugcaucaagcugaucaagauguacacgugggagaagcccuucgccaagaucaucgaggaccugcgccggaaggagcgcaagcuccuggagaagugcgggcugguccagucccucaccagcaucacccuguucaucauccccaccguggccacggccguguggguccugauccacaccucccucaagcugaagcugaccgcgagcauggccuucuccaugcucgccagccugaaccugcugcggcucuccguguucuucgugccgaucgccgucaagggccugaccaacagcaaguccgccgugaugcgcuucaagaaguucuuccugcaggagagccccguguucuacguccagacgcuccaggaccccagcaaggcgcugguguucgaggaggccacccuguccuggcagcagaccugccccgggaucgugaacggcgcccucgagcuggagcggaacgggcacgccagcgagggcaugacccgcccgcgggacgcgcugggccccgaggaggaggggaacucccucggccccgagcugcacaagaucaaccuggucgugagcaaggggaugaugcucggcgugugcgggaacacgggcuccggcaagagcucccugcugagcgccauccucgaggagaugcaccuccuggagggguccgucggcgugcaggggagccucgccuacgugccccagcaggccuggaucgucuccggcaacauccgcgagaacauccugaugggcggggccuacgacaaggcgcgguaccuccaggugcuccacugcugcagccugaaccgcgaccuggagcuccugccguucggcgacaugaccgagaucggggagcggggccugaaccucuccgggggccagaagcagcgcaucagccuggcccgggccguguacuccgaccgccagaucuaccugcucgacgacccccugagcgccgucgacgcccacgugggcaagcacaucuucgaggagugcaucaagaagacccugcgggggaagaccgugguccucgugacgcaccagcugcaguaccuggaguucugcggccagaucauccuccuggagaacgggaagaucugcgagaacggcacccacuccgagcugaugcagaagaaggggaaguacgcgcagcucauccagaagaugcacaaggaggccaccagcgacaugcugcaggacaccgccaagaucgccgagaagcccaagguggagagccaggcccuggcgacgucccucgaggagagccugaacggcaacgccgucccggagcaccagcugacccaggaggaggagauggaggagggcucccucagcuggcgcguguaccaccacuacauccaggccgccgggggcuacaugguguccugcaucaucuucuucuucgucgugcugaucguguuccugaccaucuucagcuucugguggcucuccuacuggcuggagcaggggagcggcaccaacuccagccgggaguccaacgggaccauggcggaccugggcaacaucgccgacaacccccagcucagcuucuaccagcuggucuacggccugaacgcccuccugcugaucugcgugggggugugcuccagcggcaucuucacgaaggucacccgcaaggccuccaccgcccuccacaacaagcuguucaacaagguguuccggugccccaugagcuucuucgacaccauccccaucgggcgccugcucaacugcuucgcgggcgaccuggagcagcuggaccagcuccugccgaucuucuccgagcaguuccuggugcucagccugauggucaucgccgugcugcucaucguguccguccugagccccuacauccugcucaugggggccaucaucauggugaucugcuucaucuacuacaugauguucaagaaggccaucggcguguucaagcgccuggagaacuacagccggagcccccuguucucccacauccucaacucccugcagggccugagcuccauccacgucuacgggaagacggaggacuucaucagccaguucaagcgccucaccgacgcccagaacaacuaccugcugcuguuccuguccagcacccgguggauggcgcugcgccucgagaucaugaccaaccuggugacgcuggccguggcccucuucgucgccuucggcaucuccagcacccccuacuccuucaaggugauggccgugaacaucguccugcagcuggcgagcuccuuccaggccaccgcccggaucgggcucgagaccgaggcccaguucacggcgguggagcgcauccugcaguacaugaagaugugcgucagcgaggccccgcugcacauggagggcaccuccugcccccagggguggccccagcacggcgagaucaucuuccaggacuaccacaugaaguaccgggacaacacccccaccgugcuccacggcaucaaccugacgauccgcgggcacgagguggucggcaucguggggcggaccggcagcggcaaguccagccuggggauggcccuguuccgccucguggagccgauggccggccggauccugaucgacggggucgacaucugcuccaucggccuggaggaccuccgcagcaagcugagcgugaucccccaggaccccgugcugcucuccgggaccauccgguucaaccuggaccccuucgaccgccacaccgaccagcagaucugggacgcccuggagcggacguuccucaccaaggcgaucagcaaguucccgaagaagcugcacaccgacgucguggagaacggcggcaacuucuccgugggggagcgccagcugcucugcaucgcccgggccguccugcgcaacagcaagaucauccugaucgacgaggccaccgccuccaucgacauggagacggacacccucauccagcggaccauccgcgaggcguuccagggcugcaccgugcuggugaucgcccaccgggucacgaccgugcugaacugcgaccacauccucgugauggggaacggcaaggucguggaguucgaccgccccgaggugcugcgcaagaagcccgggagccuguucgccgcccucauggccaccgcgaccuccagccugcgguga

SEQ ID NO: 26166 - RNA, 4080 nt, Artificial Sequence
  derived and/or modified sequence opt1 from ABCC12__Homo_sapiens__NP_150229
auggugggcgaggggcccuaccugaucagcgaccucgaccagcgcggccggcgccgguccuucgccgagcgcuacgacccgagccugaagaccaugauccccguccggcccugcgcccgccuggcgcccaacccgguggacgacgccgggcuccuguccuucgccaccuucagcuggcugacgcccgugauggucaagggcuaccggcagcgccucaccguggacacccugccgccccuguccaccuacgacagcuccgacacgaacgccaagcgguuccgcgugcucugggacgaggaggucgcccggguggggcccgagaaggcgagccugucccacguggucuggaaguuccagcgcacccgggugcugauggacaucguggccaacauccucugcaucaucauggccgccaucggccccgucauccugauccaccagauccugcagcagaccgagcgcaccagcggcaagguguggguggggaucggccucugcaucgcgcuguucgccacggaguucaccaaggucuucuucugggcccuggccugggccaucaacuaccggaccgcgauccgccucaagguggcccuguccacccugguguucgagaaccucgucagcuucaagacgcugacccacaucuccgugggggaggugcugaacauccucagcuccgacagcuacucccuguucgaggccgcccuguucugcccccuccccgccaccaucccgauccugauggucuucugcgcggccuacgccuucuucauccugggccccaccgcccucaucgggaucagcguguacgugaucuucauccccguccagauguucauggccaagcugaacuccgcguuccggcgcagcgccauccuggugacggacaagcggguccagaccaugaacgaguuccucacgugcauccgccugaucaagauguacgccugggagaaguccuucaccaacacgauccaggacauccggcgccgcgagcggaagcugcucgagaaggccggcuucgugcaguccggcaacagcgcccuggcgcccaucguguccaccaucgccaucguccugacccucagcugccacauccugcugcgccggaagcucaccgccccgguggccuucuccgugaucgcgauguucaacgucaugaaguucagcaucgccauccugcccuucuccaucaaggccauggccgaggccaacgugagccugcgccggaugaagaagauccucaucgacaaguccccgcccagcuacaucacgcagcccgaggaccccgacaccgugcugcugcucgcgaacgccacccugaccugggagcacgaggccucccgcaagagcacgcccaagaagcugcagaaccagaagcggcaccugugcaagaagcagcgcagcgaggccuacagcgagcgguccccgcccgccaagggggcgaccggccccgaggagcagagcgacucccucaagagcguccugcacuccaucagcuucguggugcgcaaggggaagauccugggcaucugcggcaacgucgggagcggcaaguccagccuccuggccgcccugcucgggcagaugcagcugcagaagggcgugguggccgucaacgggacccuggccuacgugucccagcaggcguggaucuuccacggcaacgugcgggagaacauccucuucggcgagaaguacgaccaccagcgcuaccagcacaccguccgggugugcgggcugcagaaggaccugagcaaccuccccuacggcgaccugaccgagaucggggagcgcggccugaaccucuccgggggccagcggcagcgcaucagccuggcccgggccguguacuccgaccgccagcuguaccuccuggacgacccccugagcgccgucgacgcgcacgugggcaagcacguguucgaggagugcaucaagaagacccuccgggggaagaccgucgugcuggugacccaccagcugcaguuccucgaguccugcgacgaggucauccugcuggaggacggcgagaucugcgagaaggggacgcacaaggagcucauggaggagcgcggccgcuacgccaagcugauccacaaccugcgggggcuccaguucaaggacccggagcaccuguacaacgccgccaugguggaggccuucaaggagagccccgcggagcgcgaggaggacgccggcaucaucgugcuggcccccggcaacgagaaggacgaggggaaggaguccgagaccggcagcgaguucgucgacaccaaggugccggagcaccagcucauccagaccgagagcccccaggaggggaccgugacguggaagaccuaccacaccuacaucaaggccuccggcggcuaccugcugucccucuucaccgucuuccuguuccugcucaugaucgggagcgccgcguucuccaacugguggcugggccuguggcucgacaaggggagccggaugacgugcggcccccaggggaaccgcaccaugugcgaggugggcgccgugcuggccgacaucggccagcacgucuaccaguggguguacaccgccagcaugguguucaugcuggucuucggggugaccaagggcuucguguucacgaagaccacccucauggccuccagcucccugcacgacaccgucuucgacaagauccucaagagccccauguccuucuucgacacgaccccgaccgggcggcugaugaaccgcuucagcaaggacauggacgagcuggacgugcggcugcccuuccacgcggagaacuuccuccagcaguucuucaugguggucuucauccuggugauccuggccgccguguuccccgccguccuccuggugguggcgucccuggccgucggcuucuucauccuccugcgcaucuuccaccgcggggugcaggagcugaagaaggucgagaacgugagccggucccccugguucacccacaucacgagcuccaugcagggccucggcaucauccacgccuacgggaagaaggagagcugcaucaccuaccaccuccuguacuucaacugcgcccugcggugguucgcccugcgcauggacgugcugaugaacauccucaccuucaccgucgcgcugcuggugacgcucuccuucagcuccaucagcaccuccagcaagggccugucccugagcuacaucauccagcucagcgggcugcuccaggugugcguccggaccggcaccgagacgcaggccaaguucaccuccguggagcugcugcgcgaguacaucuccacgugcgugccggagugcacccacccccugaaggucgggaccugccccaaggacuggcccagccggggcgagaucaccuuccgcgacuaccagaugcgguaccgcgacaacaccccgcucgugcuggacagccugaaccucaacauccaguccggccagaccguggggaucgucggccggacggggagcggcaaguccagccuggggauggcccuguuccgccucguggagcccgccuccggcaccaucuucaucgacgagguggacaucugcauccugagccuggaggaccuccggaccaagcugaccgucaucccccaggaccccgugcuguucgugggcacgguccgcuacaaccucgacccguucgagucccacaccgacgagaugcuguggcagguccuggagcgcaccuucaugcgggacaccaucaugaagcuccccgagaagcugcaggccgaggugaccgagaacggggagaacuucagcgugggcgagcgccagcugcugugcguggcgcgggcccuccugcgcaacuccaagaucauccugcucgacgaggccacggccagcauggacuccaagaccgacacccuggugcagaacaccaucaaggacgccuucaaggggugcacgguccugaccaucgcgcaccggcucaacaccgugcugaacugcgaccacgugcuggucauggagaacggcaaggugaucgaguucgacaagcccgaggugcucgccgagaagcccgacagcgccuucgccaugcugcuggccgcggagguccgccucuga

SEQ ID NO: 26167 - RNA, 4596 nt, Artificial Sequence
  derived and/or modified sequence opt1 from ABCC1__Homo_sapiens__NP_004987
auggcccugcgcggcuucugcagcgccgacggguccgacccccucugggacuggaacgugaccuggaacaccagcaacccggacuucacgaagugcuuccagaacaccguccuggugugggugcccugcuucuaccugugggcgugcuuccccuucuacuuccucuaccugucccggcacgaccgcggcuacauccagaugacgccccugaacaagaccaagaccgcccucggguuccugcuguggaucgucugcugggccgaccucuucuacagcuucugggagcggucccgcggcaucuuccuggccccgguguuccuggugagccccacccuccuggggaucaccaugcugcucgccaccuuccugauccagcuggagcggcgcaagggcguccaguccagcggcaucaugcucacguucuggcugguggcgcuggugugcgcccucgccauccugcgguccaagaucaugaccgcccugaaggaggacgcgcaggucgaccucuuccgcgacaucaccuucuacguguacuucagccugcugcucauccagcuggugcuguccugcuucagcgaccggagcccccucuucagcgagaccauccacgaccccaacccgugccccgaguccagcgccuccuuccugagccgcaucacguucugguggaucaccgggcugaucguccggggcuaccgccagccccucgagggguccgaccuguggagccugaacaaggaggacaccagcgagcaggucgugcccgugcucgugaagaacuggaagaaggagugcgccaagacccggaagcagccggugaaggucguguacuccagcaaggaccccgcccagcccaaggaguccagcaagguggacgccaacgaggaggucgaggcgcugaucgugaaguccccgcagaaggaguggaaccccagccuguucaaggugcucuacaagacguucggccccuacuuccugauguccuucuucuucaaggccauccacgaccugaugauguucagcgggccccagauccucaagcugcugaucaaguucgucaacgacaccaaggcccccgacuggcagggcuacuucuacaccgugcuccuguucgucaccgccugccugcagacgcucgugcugcaccaguacuuccacaucugcuucguguccggcaugcgcaucaagaccgccgucaucggggcgguguaccggaaggcccuggugaucaccaacagcgcccgcaaguccagcaccgucggcgagaucgugaaccugauguccguggacgcccagcgguucauggaccucgccacguacaucaacaugaucuggagcgcgccgcugcaggucauccuggcccucuaccugcuguggcucaaccuggggcccuccgugcuggccggcguggccgucauggugcucauggugcccgucaacgccgugauggcgaugaagaccaagaccuaccagguggcccacaugaaguccaaggacaaccgcaucaagcugaugaacgagauccugaacggcaucaagguccucaagcuguacgccugggagcuggccuucaaggacaaggugcucgcgauccggcaggaggagcugaaggugcugaagaaguccgccuaccucagcgccgucgggaccuucacgugggugugcacccccuuccugguggcccugugcaccuucgccgucuacgugaccaucgacgagaacaacauccucgacgcgcagacggccuucgugucccuggcccuguucaacauccuccgcuucccgcugaacauccugcccauggucaucagcagcaucgugcaggccuccgugagccucaagcggcugcgcaucuuccugucccacgaggagcucgagcccgacagcaucgagcgccggcccgucaaggacggcgggggcaccaacuccaucaccgugcgcaacgccaccuucacgugggcgcggagcgacccgcccacccugaacgggaucaccuucuccauccccgagggcgcccugguggccgucgugggccagguggggugcggcaagagcucccuccugagcgcccugcucgccgagauggacaaggucgaggggcacguggcgaucaagggcuccguggccuacgucccgcagcaggccuggauccagaacgacagccugcgcgagaacauccuguucgggugccagcucgaggagcccuacuaccgguccgugauccaggccugcgcgcugcugcccgaccucgagauccugcccagcggcgaccgcaccgagaucggcgagaagggggugaaccuguccggcgggcagaagcagcgggucagccucgcccgcgccguguacuccaacgccgacaucuaccuguucgacgacccgcugagcgccguggacgcgcacgucggcaagcacaucuucgagaacgugaucgggcccaagggcaugcucaagaacaagacccggauccuggugacgcacagcauguccuaccugccccaggucgacgugaucaucgugaugagcggcgggaagaucuccgagaugggcagcuaccaggagcuccuggcccgcgacggggccuucgccgaguuccugcggaccuacgccuccaccgagcaggagcaggacgcggaggagaacggcgucaccggcgugagcgggcccggcaaggaggccaagcagauggagaacgggaugcucgucacggacuccgccggcaagcagcugcagcgccagcugagcuccagcuccagcuacuccggggacaucagccggcaccacaacuccaccgccgagcuccagaaggccgaggcgaagaaggaggagaccuggaagcugauggaggccgacaaggcccagaccggccaggugaagcugagcguguacugggacuacaugaaggccaucggccucuucaucuccuuccugagcaucuuccuguucaugugcaaccacgucuccgcgcucgccagcaacuacuggcugagccuguggacggacgacccgaucgugaacgggacccaggagcacaccaaggugcgccucuccgucuacggcgcccuggggaucagccagggcaucgccguguucggguacuccauggccgugagcaucggcggcauccuggcgucccggugccuccacgucgaccugcugcacagcauccuccgcucccccaugagcuucuucgagcggacccccuccgggaaccuggugaaccgcuucagcaaggagcuggacacgguggacuccaugauccccgaggucaucaagauguucaugggcagccucuucaacgugaucggggccugcaucgugauccugcuggccaccccgaucgccgccaucaucaucccgccccucggccugaucuacuucuucguccagcgguucuacguggcguccagccgccagcugaagcgccucgaguccgugagccggucccccgucuacagccacuucaacgagacccugcuggggguguccgugauccgcgccuucgaggagcaggagcgguucauccaccagagcgaccucaaggucgacgagaaccagaaggccuacuaccccagcaucguggccaaccgcuggcuggccgugcggcuggagugcgucggcaacugcaucgugcuguucgcggcccuguucgccgugaucucccgccacagccuguccgccggccucgucgggcugagcguguccuacagccuccaggugaccacguaccucaacuggcugguccggauguccagcgagauggagaccaacaucguggccguggagcgccugaaggaguacuccgagaccgagaaggaggcgcccuggcagauccaggagaccgccccgcccagcuccuggccccaggucggccggguggaguuccgcaacuacugccugcgguaccgcgaggaccucgacuucgugcugcggcacaucaacgucacgaucaacgggggcgagaagguggggaucgugggccgcaccggcgccggcaagagcucccugacccucgggcuguuccggaucaacgagagcgccgagggggagaucaucaucgacggcaucaacaucgcgaagaucggccugcacgaccuccgcuucaagaucaccaucaucccccaggaccccguccuguucuccgggagccugcggaugaaccucgaccccuucucccaguacagcgacgaggagguguggacgucccuggagcuggcccaccucaaggacuucgugagcgcccugccggacaagcuggaccacgagugcgccgagggcggggagaaccucagcgucggccagcgccagcuggugugccuggcccgggcgcuccugcgcaagaccaagauccuggugcucgacgaggccaccgccgccgucgaccuggagaccgacgaccugauccaguccacgauccggacccaguucgaggacugcaccgugcucaccaucgcccaccgccugaacacgaucauggacuacacccgcgugaucguccuggacaagggggagauccaggaguacggcgcgcccagcgaccuccugcagcagcggggccuguucuacuccauggccaaggacgccgggcucguguga

SEQ ID NO: 26168 - RNA, 4638 nt, Artificial Sequence
  derived and/or modified sequence opt1 from ABCC2__Homo_sapiens__NP_000383
augcuggagaaguucugcaacagcaccuucuggaacuccagcuuccucgacucccccgaggccgaccugccgcugugcuucgagcagaccgugcucgucuggaucccccugggcuuccuguggcuccuggcccccuggcagcugcuccacguguacaagagccgcacgaagcgguccagcaccaccaagcuguaccuggcgaagcaggucuucgugggguuccuccugauccuggccgccaucgagcucgcccuggugcugaccgaggacuccggccaggccacggugcccgcgguccgcuacaccaacccgagccucuaccuggggaccuggcugcucgugcugcugauccaguacucccggcaguggugcgugcagaagaacagcugguuccucucccuguucuggauccugagcauccucugcggcaccuuccaguuccagacgcugauccgcacccugcuccagggggacaacuccaaccuggccuacagcugccuguucuucaucuccuacggcuuccagauccucauccugaucuucagcgccuucuccgagaacaacgagagcuccaacaaccccagcagcaucgccuccuuccugagcuccaucaccuacagcugguacgacuccaucauccucaagggcuacaagcggccccugacccuggaggacgucugggagguggacgaggagaugaagacgaagacccucgugagcaaguucgagacccacaugaagcgcgagcugcagaaggcgcggcgcgcccugcagcggcgccaggagaaguccagccagcagaacuccggggcccggcuccccggccugaacaagaaccagagccagucccaggacgcccugguccucgaggacguggagaagaagaagaagaaguccgggaccaagaaggacgugccgaaguccuggcugaugaaggcccuguucaagacguucuacaugguccuccucaagagcuuccugcugaagcuggugaacgacaucuucaccuucgugagcccccagcugcugaagcuccugaucagcuucgcguccgaccgcgacaccuaccuguggaucggcuaccucugcgccauccugcuguucaccgccgcccucauccagagcuucugccugcagugcuacuuccagcugugcuucaagcucggggucaaggugcggacggccaucauggcguccguguacaagaaggcccugacccugagcaaccucgcccgcaaggaguacaccgucggcgagaccgugaaccugaugagcguggacgcccagaagcugauggacgucacgaacuucaugcacaugcucugguccagcgugcugcagaucguccuguccaucuucuuccucuggcgggagcugggccccagcgugcuggccggggugggcgucauggugcucgugauccccaucaacgcgauccuguccaccaagagcaagaccauccaggucaagaacaugaagaacaaggacaagcgccugaagaucaugaacgagauccucuccgggaucaagauccugaaguacuucgccugggagccgagcuuccgggaccaggugcagaaccugcgcaagaaggagcucaagaaccugcuggccuucucccagcuccagugcguggucaucuucguguuccagcugacccccgugcuggucagcguggugacguucuccgucuacgugcucguggacagcaacaacauccuggacgcccagaaggccuucaccuccaucacccuguucaacauccuccgguucccccugagcaugcugcccaugaugaucuccagcaugcuccaggcguccgucagcaccgagcgccuggagaaguaccugggcggcgacgaccucgacacgagcgccauccggcacgacugcaacuucgacaaggccaugcaguucuccgaggccagcuucaccugggagcacgacuccgaggcgaccgugcgcgacgugaaccuggacaucauggccgggcagcuggucgccgugaucggcccgguggggagcggcaaguccagccucaucuccgccaugcugggggagauggagaacguccacggccacaucaccaucaagggcacgaccgccuacgugccccagcagagcuggauccagaacgggaccaucaaggacaacauccuguucggcaccgaguucaacgagaagcgcuaccagcagguccucgaggcgugcgcccugcugcccgaccucgagaugcugcccgggggcgaccuggccgagaucggggagaagggcaucaaccucuccggcgggcagaagcagcggaucagccuggcccgcgccaccuaccagaaccuggacaucuaccuccuggacgacccgcuguccgcgguggacgcccacgugggcaagcacaucuucaacaaggugcucgggcccaacggccugcugaaggggaagacgcggcuccuggucacccacagcaugcacuuccugccccagguggacgagaucgugguccucggcaacggcaccaucguggagaagggguccuacagcgcccugcuggccaagaagggcgaguucgccaagaaccucaagaccuuccugcgccacacggggcccgaggaggaggcgaccgugcacgacggcuccgaggaggaggacgacgacuacggccugaucagcuccgucgaggagaucccggaggacgccgccagcaucaccaugcggcgcgagaacuccuuccggcgcacccucagccggagcucccgcagcaacgggcggcaccugaagucccugcgcaacagccucaagacgcggaacgugaacucccugaaggaggacgaggagcuggugaagggccagaagcucaucaagaaggaguucaucgagaccgggaaggucaaguucagcaucuaccuggaguaccugcaggccaucggccucuucuccaucuucuucaucauccuggcguucgugaugaacagcguggccuucaucggguccaaccuguggcucagcgccuggaccuccgacagcaagaucuucaacuccaccgacuaccccgccagccagcgcgacaugcgggucggcguguacggcgcccuggggcuggcgcagggcaucuucguguucaucgcccacuucugguccgccuucggguucguccacgccagcaacauccuccacaagcagcugcugaacaacauccuccgcgcccccaugcgguucuucgacacgacccccaccggccgcaucgugaaccgguucgcgggggacaucuccaccguggacgacacgcugccgcagagccugcgcuccuggaucacgugcuuccugggcaucaucagcacccucgucaugaucugcauggccacccccguguucaccaucaucgugaucccccugggcaucaucuacgucagcgugcagauguucuacgucuccaccagccgccagcugcggcgccucgacuccgugacccggagcccgaucuacucccacuucagcgagaccguguccgggcugcccgucauccgcgccuucgagcaccagcagcgguuccugaagcacaacgaggugcgcaucgacacgaaccagaagugcguguucagcuggaucaccuccaaccgguggcucgccauccgccuggagcuggucggcaaccucaccguguucuucagcgcccugaugauggugaucuaccgggacacccuguccggggacacggucggcuucgugcucagcaacgcgcugaacaucacccagacccugaacuggcucgugcgcaugaccuccgagaucgagacgaacaucgucgccguggagcggaucaccgaguacaccaagguggagaacgaggcccccugggucaccgacaagcggcccccgcccgacuggcccagcaaggggaagauccaguucaacaacuaccaggugcgcuaccgccccgagcuggaccuggugcuccggggcaucacgugcgacaucggcuccauggagaagaucggggucgugggccgcaccggggccggcaagagcucccugaccaacugccuguuccggauccucgaggcggccgggggccagaucaucaucgacggcguggacaucgccagcaucgggcugcacgaccugcgcgagaagcucaccaucaucccgcaggaccccauccuguucuccggcagccugcggaugaaccucgaccccuucaacaacuacagcgacgaggagaucuggaaggcccuggagcuggcccaccucaaguccuucgucgcgagccugcagcuggggcucucccacgaggugaccgaggccggcggcaaccugagcaucgggcagcgccagcugcucugccugggccgggcccugcuccgcaaguccaagauccuggugcuggacgaggccacggccgcggucgaccucgagaccgacaaccugauccagaccaccauccagaacgaguucgcccacugcacggugaucaccaucgcccaccgccugcacaccaucauggacagcgacaaggugaugguccucgacaacgggaagaucaucgagugcggcucccccgaggagcugcugcagaucccggggcccuucuacuucauggccaaggaggccggcaucgagaacgugaacagcaccaaguucuga

SEQ ID NO: 26169 - RNA, 1719 nt, Artificial Sequence
  derived and/or modified sequence opt1 from ABCC3__Homo_sapiens__NP_001137542
auggacgcccugugcggcagcggggagcucggcuccaaguucugggacagcaaccuguccgugcacaccgagaaccccgaccugaccccgugcuuccagaacagccuccuggccuggguccccugcaucuaccuguggguggcgcuccccugcuaccugcuguaccuccgccaccacugccggggguacaucauccugucccaccugagcaagcucaagauggugcugggcguccugcucuggugcguguccugggccgaccuguucuacagcuuccacgggcuggugcacggccgcgcccccgccccggucuucuucgugacgccccucguggucggcgugaccaugcugcuggccacccuccugauccaguacgagcggcugcagggggugcaguccagcggcguccucaucaucuucugguuccugugcguggugugcgcgaucguccccuuccgcuccaagauccugcucgccaaggccgagggggagaucagcgaccccuuccgguucaccacguucuacauccacuucgcccuggugcuguccgcgcucauccuggccugcuuccgcgagaagccgcccuucuucagcgccaagaacguggaccccaaccccuacccggagaccuccgccggcuuccugagccgccucuucuucuggugguucaccaagauggccaucuacggguaccggcacccccuggaggagaaggaccuguggucccucaaggaggaggaccggagccagauggucgugcagcagcugcuggaggcguggcgcaagcaggagaagcagaccgcccggcacaaggccuccgccgcccccggcaagaacgcgagcggcgaggacgaggugcuccugggggcccgcccccggccgcgcaagcccagcuuccugaaggcccuccuggccacguucggcuccagcuuccugaucuccgccugcuucaagcucauccaggaccugcugagcuucaucaacccccagcuccuguccauccugauccgguucaucagcaaccccauggcgccguccugguggggguuccuggucgccggccucauguuccugugcagcaugaugcagucccugauccuccagcacuacuaccacuacaucuucgugaccggcgugaaguuccgcaccgggaucaugggcgucaucuaccggaaggcccuggugaucaccaacagcgucaagcgcgccuccacggugggggagaucgugaaccugaugagcgucgacgcccagcgguucauggaccucgcgcccuuccugaaccugcucugguccgcgccccugcagaucauccuggccaucuacuuccucuggcagaaccugggccccagcgugcuggccgggguggccuucaugguccuccugaucccgcugaacggcgccguggccgugaagaugcgcgccuuccaggucaagcagaugaagcucaaggacucccggaucaagcugaugagcgagauccugaacggcaucaaggugcucaagcuguacgccugggagcccuccuuccugaagcaggucgaggggauccgccagggcgagcuccagcugcugcgcaccgcggccuaccuccacaccaccacgaccuucaccuggaugugcagccccuuccuggugcggcuggggaccggccucgggcccugccugcagggcuccggcugcccggggauggcccgcgcccacuggacgcugcccuga

SEQ ID NO: 26170 - RNA, 2580 nt, Artificial Sequence
  derived and/or modified sequence opt1 from ABCC4__Homo_sapiens__NP_001098985
augcugcccguguaccaggaggucaagccgaacccccuccaggacgccaaccugugcagccgcguguucuucugguggcugaacccccucuucaagaucggccacaagcggcgccuggaggaggacgacauguacuccgugcugcccgaggaccggagccagcaccucggggaggagcugcagggcuucugggacaaggagguccugcgcgccgagaacgacgcgcagaagccgucccucacccgggccaucaucaagugcuacuggaaguccuaccuggugcuggggaucuucacccucaucgaggagagcgccaaggugauccagcccaucuuccugggcaagaucaucaacuacuucgagaacuacgaccccauggacagcgucgcccugaacacggccuacgcguacgccaccgugcucaccuucugcacccugauccuggccauccuccaccaccuguacuucuaccacgugcagugcgccgggaugcgccugcgggucgcgaugugccacaugaucuaccgcaaggcccuccggcuguccaacauggccaugggcaagacgaccaccggccagaucgugaaccugcucagcaacgacgugaacaaguucgaccaggucaccguguuccugcacuuccugugggccgggccccuccaggccaucgcggugacggcccugcuguggauggagaucggcaucuccugccucgccgggauggccguccugaucauccugcucccgcugcagagcugcuucggcaagcuguucuccagccuccgcuccaagaccgccaccuucaccgacgcgcggauccgcacgaugaacgaggugaucaccgggauccggaucaucaagauguacgccugggagaaguccuucagcaaccugaucaccaaccugcgcaagaaggagaucagcaagauccuccgguccagcugccugcgcggcaugaaccuggccuccuucuucagcgccagcaagaucaucguguucgucaccuucacgaccuacgugcuccugggcuccgugaucaccgccagccgggucuucguggcggugacccuguacggggccguccgccucacggugacccuguucuuccccuccgccaucgagcgggucagcgaggccaucguguccauccgccggauccagaccuuccugcuccuggacgagaucagccagcgcaaccgccagcugcccuccgacggcaagaagauggugcacguccaggacuucaccgccuucugggacaaggcgagcgagacgcccacccugcaggggcucuccuucaccgugcggccgggcgagcugcuggccguggucggccccgugggggccggcaagagcucccuccugagcgccgugcugggggagcucgcgcccucccacggccuggucagcgugcacgggcgcaucgccuacgugucccagcagcccugggucuucagcggcacccugcgguccaacauccucuucggcaagaaguacgagaaggagcgcuacgagaaggugaucaaggccugcgcccugaagaaggaccugcagcuccuggaggacggggaccugacggugaucggcgaccgggggaccacccucagcggcgggcagaaggcccgcgucaaccuggcgcgggccguguaccaggacgccgacaucuaccugcucgacgacccgcuguccgccguggacgccgaggucagccgccaccuguucgagcucugcaucugccagauccugcacgagaagaucaccauccuggugacgcaccagcuccaguaccugaaggcggccagccagauccugauccucaaggacggcaagauggugcagaagggcaccuacaccgaguuccugaaguccgggaucgacuucggcagccugcucaagaaggacaacgaggaguccgagcagccgcccguccccgggacccccacgcugcggaaccgcaccuucagcgaguccagcguguggucccagcagagcucccggcccagccugaaggacggcgcccucgagucccaggacaccgagaacgugcccgucacccugagcgaggagaaccgcuccgaggggaaggugggcuuccaggccuacaagaacuacuuccgggccggcgcgcacuggaucguguucaucuuccugauccuccugaacaccgccgcccaggucgccuacgugcugcaggacugguggcucagcuacugggcgaacaagcaguccaugcugaacgugacggucaacgggggcgggaacgugaccgagaagcuggaccucaacugguaccugggcaucuacagcggccugaccguggccaccguccucuucgggaucgcccgcucccugcugguguucuacgugcucgucaacagcagccagacgcugcacaacaagauguucgaguccauccugaaggcccccguccucuucuucgaccggaacccgaucggccgcauccugaaccgguucagcaaggacaucgggcaccuggacgaccuccugccccugaccuuccucgacuucauccagcgcugggaccuggccgugcuguccuggcucgugagcaacuccuga

SEQ ID NO: 26171 - RNA, 627 nt, Artificial Sequence
  derived and/or modified sequence opt1 from ABCC5__Homo_sapiens__NP_001018881
augaaggacaucgacaucggcaaggaguacaucauccccagcccgggguaccgcuccgugcgggagcgcaccagcaccuccggcacgcaccgggaccgcgaggacagcaaguuccggcgcacccggccccuggagugccaggacgcccucgagaccgccgcgcgcgccgaggggcugucccuggacgccagcaugcacucccagcuccggauccuggacgaggagcaccccaagggcaaguaccaccacgggcugagcgcccucaagcccauccgcaccacguccaagcaccagcacccggucgacaacgccggccuguucagcugcaugaccuucuccuggcugagcucccucgcgcggguggcccacaagaagggcgagcugagcauggaggacguguggucccugagcaagcacgaguccagcgacgucaacugccgccggcucgagcgccuguggcaggaggagcugaacgagguggggcccgacgccgccucccuccggcgcguggucuggaucuucugccggacccgccugauccugagcaucgugugccucaugaucacccagcuggcgggcuucagcgggcccaacuuccaggacggcugcauccugcgguccgaguga

SEQ ID NO: 26172 - RNA, 300 nt, Artificial Sequence
  derived and/or modified sequence opt1 from ABCC6__Homo_sapiens__NP_001072996
auggccgcccccgcggagccgugcgccggccaggggguguggaaccagaccgagcccgagcccgccgccaccagccugcucucccugugcuuccugcgcacggccggcgugugggugcccccgauguaccucugggugcuggggcccaucuaccuccuguucauccaccaccacggccggggguaccugcgcaugagcccccuguucaaggcgaagauggucgccgccauccccggcucccucgagccgggcaacgugcgggggcgccagggcaccggguggaaccuggucaagagcuga

SEQ ID NO: 26173 - RNA, 4746 nt, Artificial Sequence
  derived and/or modified sequence opt1 from ABCC8__Homo_sapiens__NP_000343
augccccuggccuucugcggcagcgagaaccacuccgccgcguaccgcguggaccaggggguccucaacaacggcugcuucguggacgcccugaacguggucccgcacguguuccuccucuucaucaccuuccccauccuguucaucggguggggcagccaguccagcaaggugcacauccaccacuccaccuggcugcacuuccccgggcacaaccuccgguggauccugacguucaugcuccuguucguccuggugugcgagaucgccgagggcauccugagcgacggcgugaccgagucccaccaccuccaccuguacaugcccgccgggauggccuucauggcggccgucaccagcgugguguacuaccacaacaucgagaccuccaacuucccgaagcugcucaucgcccugcuggucuacuggacgcucgccuucaucaccaagaccaucaaguucgugaaguuccuggaccacgcgaucggcuucagccagcugcgcuucugccucaccgggcugcuggugauccucuacggcaugcugcugcucgucgaggugaacgugauccggguccgccgguacaucuucuucaagacgccccgcgaggugaagccgcccgaggaccugcaggaccugggggugcgguuccuccagcccuucgucaaccugcuguccaagggcaccuacugguggaugaacgccuucaucaagaccgcccacaagaagcccaucgaccuccgcgccaucggcaagcugcccaucgccaugcgggcgcugaccaacuaccagcgccucugcgaggccuucgacgcccaggugcggaaggacauccaggggacgcagggcgcccgcgccaucuggcaggcgcugagccacgccuucgggcggcgccuggugcucuccagcaccuuccggauccuggccgaccugcucggcuucgccggcccccugugcaucuucgggaucgucgaccaccugggcaaggagaacgacguguuccagccgaagacccaguuccucggggucuacuucguguccagccaggaguuccuggccaacgcguacgugcuggccguccuccuguuccuggcccugcuccugcagcgcaccuuccugcaggccuccuacuacguggccaucgagacgggcaucaaccuccgcggggcgauccagaccaagaucuacaacaagaucaugcaccugagcaccuccaaccugagcaugggcgagaugaccgccggccagaucugcaaccucguggccaucgacacgaaccagcugaugugguucuucuuccugugccccaaccucugggccaugcccguccagaucaucgugggggugauccugcuguacuacauccucggcgucagcgcgcugaucggggccgccgugaucauccugcucgcccccgugcaguacuucgucgccaccaagcugucccaggcgcagcggagcacccuggaguacuccaacgagcggcucaagcagaccaacgagaugcugcgcggcaucaagcugcucaagcuguacgccugggagaacaucuuccggacgcgcguggagaccacccgccggaaggagaugaccagccugcgcgccuucgccaucuacacguccaucagcaucuucaugaacaccgccaucccgaucgcggccgugcucaucaccuucgucgggcacguguccuucuucaaggaggccgacuucagccccuccguggccuucgccagccugucccuguuccacauccucgucacgccccuguuccugcucagcuccguggugcggagcaccgucaaggcgcugguguccgugcagaagcugagcgaguuccucuccagcgccgagauccgcgaggagcagugcgcgccccacgagccgacgccccagggccccgccuccaaguaccaggccgucccccugcggguggugaaccgcaagcggccggcccgcgaggacugccggggccugaccgggccccuccagagccugguccccagcgccgacggcgacgccgacaacugcugcgugcagaucaugggcggguacuucaccuggacccccgacgggaucccgacccuguccaacaucaccauccgcaucccccggggccagcucaccaugaucgugggccaggucgggugcggcaagagcucccugcugcucgccgcgcugggggagaugcagaaggugagcggcgccguguucugguccagccugcccgacuccgagaucggcgaggacccgagccccgagcgcgagaccgccacggaccucgacauccggaagcgcgggcccgucgccuacgccucccagaagcccuggcugcugaacgcgaccguggaggagaacaucaucuucgagagcccguucaacaagcagcgguacaagauggugaucgaggccugcucccuccagcccgacaucgacauccugccccacggcgaccagacccagaucggggagcgcggcaucaaccugagcgggggccagcggcagcgcaucuccgucgcccgggcccucuaccagcacgccaacgugguguuccuggacgaccccuucagcgcgcuggacauccaccucuccgaccaccugaugcaggccggcauccuggagcuccugcgcgacgacaagcgcaccgucgugcuggugacgcacaagcuccaguaccugccgcacgccgacuggaucaucgccaugaaggacgggaccauccagcgggagggcacccugaaggacuuccagcgcagcgagugccagcuguucgagcacuggaagacccugaugaaccggcaggaccaggagcuggagaaggagacggucaccgagcgcaaggcgaccgagccgccccaggggcucucccgggccaugagcagccgcgacggccugcugcaggacgaggaggaggaggaggaggaggccgccgaguccgaggaggacgacaaccucagcuccaugcugcaccagcgggccgagauccccuggcgcgcgugcgccaaguaccugagcuccgccgggauccuccugcugagccuccugguguucucccagcugcucaagcacauggugcuggucgccaucgacuacuggcuggccaaguggaccgacagcgcgcucacgcugacccccgccgcccggaacugcucccugagccaggagugcacccucgaccagaccguguacgccaugguguucacgguccugugcucccugggcaucgugcucugccuggugaccagcgucaccguggaguggaccggccugaaggucgccaagcgccuccaccggucccugcugaaccgcaucauccucgcgcccaugcgguucuucgagacgacgccccuggggagcauccugaaccgcuucuccagcgacugcaacaccaucgaccagcacauccccuccacccuggagugccucagccgguccacccugcugugcgugagcgcccucgccgugaucagcuacgucaccccgguguuccugguggcccugcucccccuggccaucgucugcuacuucauccagaaguacuuccgcguggcgucccgggaccugcagcagcucgacgacaccacccagcugccccugcucagccacuucgccgagacgguggagggccugaccaccauccgcgccuuccgguacgaggcccgcuuccagcagaagcugcucgaguacaccgacuccaacaacaucgcgagccuguuccugacggccgccaaccgguggcucgagguccgcauggaguacaucggggccugcguggugcugaucgccgcggucaccuccaucagcaacucccugcaccgcgagcucagcgccggccugguggggcugggccucaccuacgcccugaugguguccaacuaccugaacuggaugguccggaaccucgccgacauggagcugcagcugggcgccgugaagcgcauccacgggcuccugaagaccgaggcggagagcuacgagggccugcucgcccccucccugaucccgaagaacuggcccgaccaggggaagauccagauccagaaccugagcgugcgguacgacuccagccucaagcccguccugaagcacgugaacgcccugaucgcccccggccagaagaucgggaucugcggccgcacgggcuccggcaagagcuccuucagccucgccuucuuccggaugguggacaccuucgaggggcacaucaucaucgacgggaucgacaucgcgaagcugccgcugcacacccuccgcucccggcugagcaucauccugcaggaccccguccucuucagcggcaccauccgcuucaaccuggaccccgagcggaagugcuccgacagcacccugugggaggcccucgagaucgcccagcugaagcugguggugaaggcccucccgggcgggcuggacgcgaucaucacggagggcggggagaacuucucccagggccagcgccagcuguucugccucgcccgggccuucguccgcaagaccagcaucuucaucauggacgaggccaccgccuccaucgacauggcgaccgagaacauccugcagaagguggugaugacggccuucgccgaccggaccgucgugaccaucgcccaccgcgugcacaccauccugagcgccgaccucgucaucgugcugaagcgcggggcgauccuggaguucgacaagcccgagaagcuccugucccggaaggacagcguguucgccuccuucguccgggccgacaaguga

SEQ ID NO: 26174 - RNA, 4650 nt, Artificial Sequence
  derived and/or modified sequence opt1 from ABCC9__Homo_sapiens__NP_005682
augagccuguccuucugcggcaacaacaucagcuccuacaacaucaacgacggggugcuccagaacagcugcuucgucgacgcccugaaccuggugccccacguguuccuccuguucaucaccuucccgauccuguucaucggcugggggucccagagcuccaagguccagauccaccacaacaccuggcuccacuuccccggccacaaccugcgcuggauccugacguucgcccuccuguucgugcacgugugcgagaucgcggaggggaucgucagcgacucccggcgcgagagccggcaccuccaccuguucaugcccgccgugaugggcuucguggccaccaccaccuccaucgucuacuaccacaacaucgagacgagcaacuuccccaagcugcugcucgcccuguuccuguacugggugauggccuucaucaccaagaccaucaagcucgugaaguacugccaguccggccuggacaucagcaaccugcgcuucugcaucaccgggaugauggucauccucaacggccugcugauggcgguggagaucaacgugauccggguccgccgguacguguucuucaugaacccgcagaaggugaagccgcccgaggaccuccaggaccuggggguccgcuuccugcagcccuucgugaaccuccuguccaaggccacguacugguggaugaacacccugaucaucagcgcccacaagaagcccaucgaccucaaggccaucggcaagcugcccaucgcgaugcgggccgugaccaacuacgucugccugaaggacgccuacgaggagcagaagaagaagguggccgaccaccccaaccgcacccccuccaucuggcucgccauguaccgggcguucgggcgcccgauccugcugagcuccacguuccgguaccucgccgaccugcugggcuucgccggcccccucugcaucagcgggaucgugcagcgcgucaacgagacccagaacggcaccaacaacaccacggggaucagcgagacccuguccagcaaggaguuccuggagaacgccuacgugcucgccguccugcuguuccucgcgcugauccugcagcggaccuuccuccaggccuccuacuacgugaccaucgagacgggcaucaaccugcgcggcgcccugcuggccaugaucuacaacaagauccuccggcugagcaccuccaaccugagcaugggggagaugacccucggccagaucaacaaccugguggccaucgagaccaaccagcugaugugguuccucuuccugugccccaaccugugggcgaugcccguccagaucaucaugggggugauccuccuguacaaccugcucggcuccagcgcccuggugggggccgccgucaucgugcugcucgccccgauccaguacuucaucgcgacgaagcuggccgaggcccagaaguccacccuggacuacagcaccgagcgccucaagaagaccaacgagauccugaagggcaucaagcugcucaagcuguacgccugggagcacaucuucugcaaguccguggaggagacgcggaugaaggagcugagcucccucaagaccuucgcgcuguacaccagccuguccaucuucaugaacgccgccauccccaucgccgccguccucgcgaccuucgugacgcacgccuacgccagcggcaacaaccugaagcccgccgaggccuucgcgucccugagccucuuccacauccuggugacgccccuguuccuccuguccaccgucgugcgcuucgccgugaaggccaucaucagcguccagaagcugaacgaguuccuccugagcgacgagaucggggacgacuccuggcggaccggcgagagcucccugccguucgagagcugcaagaagcacaccggggugcagcccaagaccaucaaccgcaagcagcccggccgcuaccaccucgacuccuacgagcagagcacccggcgccugcggcccgccgagaccgaggacaucgccaucaaggugaccaacggguacuucuccuggggcagcggccuggcgacgcucuccaacaucgacauccgcaucccgaccgggcagcugaccaugaucgucggccagguggggugcggcaagagcucccugcuccuggccauccugggggagaugcagacccucgagggcaaggugcacuggagcaacgucaacgaguccgagcccagcuucgaggccacgcggucccgcaaccgguacagcguggccuacgcggcccagaagcccuggcugcugaacgccaccguggaggagaacaucaccuucggcucccccuucaacaagcagcgcuacaaggccgucaccgacgccugcagccuccagccggacaucgaccugcugcccuucggggaccagacggagaucggcgagcgggggaucaaccucagcggcggccagcgccagcggaucugcguggcgcgcgcccuguaccagaacaccaacaucguguuccuggacgaccccuucuccgcccucgacauccaccugagcgaccaccugaugcaggaggggauccucaaguuccugcaggacgacaagcggacccugguccucgugacccacaagcugcaguaccugacgcacgccgacuggaucaucgccaugaaggacggcuccgugcuccgcgaggggacccugaaggacauccagaccaaggacgucgagcuguacgagcacuggaagacccucaugaaccggcaggaccaggagcuggagaaggacauggaggcggaccagacgacccuggagcgcaagacccuccggcgcgccauguacagccgggaggccaaggcccagauggaggacgaggacgaggaggaggaggaggaggaggacgaggacgacaacauguccaccgugaugcgccugcgcacgaagaugccguggaagaccugcuggcgguaccugaccagcggcggguucuuccuccugauccugaugaucuucuccaagcuccugaagcacagcgugaucgucgccaucgacuacuggcuggcgaccuggacguccgaguacagcaucaacaacaccggcaaggccgaccagaccuacuacguggccggcuucuccauccucugcggggccggcaucuuccugugccuggugaccagccucacggucgaguggauggggcugaccgcggccaagaaccugcaccacaaccuccugaacaagaucauccugggccccauccgcuucuucgacaccacgccccucgggcugauccugaaccgguucuccgccgacaccaacaucaucgaccagcacaucccgcccacccucgagagccugacccgcuccacccugcugugccucagcgccaucggcaugaucuccuacgccacgcccguguuccugguggcgcugcucccccugggcgucgccuucuacuucauccagaaguacuuccggguggccagcaaggaccugcaggagcucgacgacuccacccagcugccccugcucugccacuucagcgagaccgccgaggggcugaccaccauccgcgccuuccggcacgagacgcgcuucaagcagcggaugcuggagcucaccgacaccaacaacaucgcguaccuguuccugagcgccgccaaccgcuggcucgaggugcggaccgacuaccugggcgccugcaucguccugacggccuccaucgcgagcaucuccgggagcuccaacagcggccucguggggcugggccugcucuacgcccugaccaucaccaacuaccugaacugggugguccgcaaccucgccgaccuggaggugcagaugggcgccgugaagaaggucaacuccuuccugaccauggagagcgagaacuacgaggggacgauggacccgucccaggugcccgagcacuggccccaggagggcgagaucaagauccacgaccucugcgugcgguacgagaacaaccugaagcccguccugaagcacgugaaggccuacaucaagccggggcagaaggucggcaucugcgggcgcaccggcagcggcaaguccagccucucccuggcguucuuccggaugguggacaucuucgacgggaagaucgugaucgacggcaucgacaucagcaagcugccccuccacacccugcgcucccggcugagcaucauccuccaggaccccauccuguucuccgggagcauccgcuucaaccuggaccccgagugcaagugcaccgacgaccggcucugggaggcccuggagaucgcccagcugaagaacauggucaagucccucccgggcggccuggacgccguggugacggagggcggggagaacuucagcgucgggcagcgccagcuguucugccucgcgcgggccuucgugcgcaagagcuccauccugaucauggacgaggccaccgccagcaucgacauggccaccgagaacauccugcagaagguggucaugaccgcguucgccgaccgcacgguggugaccaucgcccaccgggucuccagcaucauggacgccggccucgugcugguguucuccgaggggauccuggucgagugcgacaccgugcccaaccuccuggcccacaagaacggccuguucagcacccucgugaugacgaacaaguga

SEQ ID NO: 26175 - RNA, 2238 nt, Artificial Sequence
  derived and/or modified sequence opt1 from ABCD1__Homo_sapiens__NP_000024
augcccgugcugagccgcccgcggcccuggcgcggcaacacccucaagcggaccgccguccugcuggcccucgcggccuacggggcccacaagguguacccccuggugcgccagugccuggcccccgcccggggccuccaggcgccggccggggagcccacgcaggaggccuccggcgucgccgcggccaaggccgggaugaaccgcguguuccugcagcggcugcucuggcugcugcgccuccuguucccccgggugcugugccgcgagaccggccuccuggcccugcacagcgccgcgcucgucucccggaccuuccugagcguguacguggcccgccuggacggccggcucgcccgcugcaucguccggaaggacccccgcgccuucggguggcagcugcugcaguggcuccugaucgcccugccggcgaccuucgugaacuccgccauccgguaccucgagggccagcuggcccugagcuuccgcucccggcucguggcccacgccuaccgccuguacuucagccagcagacguacuaccgggucuccaacauggacgggcgccugcgcaaccccgaccagagccucaccgaggacgugguggcguucgccgccuccgucgcccaccuguacagcaaccugaccaagccccuccuggacguggccgugaccuccuacacgcugcuccgggcggcccgcagccggggcgccgggaccgccuggcccuccgcgaucgccggccuggucguguuccugaccgccaacgugcuccgcgccuucagcccgaaguucggcgagcuggucgccgaggaggcgcggcgcaagggggagcugcgguacaugcacucccgcgugguggccaacagcgaggagaucgccuucuacggcgggcacgaggucgagcucgcccugcugcagcgguccuaccaggaccucgccagccagaucaaccugauccugcuggagcgccucugguacgugaugcuggagcaguuccugaugaaguacgucuggagcgcguccggccuccugaugguggccgugcccaucaucaccgccacgggcuacagcgaguccgacgccgaggccgucaagaaggcggcccuggagaagaaggaggaggagcucgugagcgagcggaccgaggccuucaccaucgcccgcaaccugcugaccgcggccgccgacgccaucgagcggaucauguccagcuacaaggaggugacggagcucgccggguacaccgcgcgcguccacgagauguuccagguguucgaggacgugcagcggugccacuucaagcgcccccgggagcuggaggacgcccaggccggcuccgggaccaucggccgcagcgggguccggguggagggcccccugaagauccgcggccagguggucgacguggagcaggggaucaucugcgagaacaucccgaucgugacccccuccggcgaggucgugguggccagccucaacauccgcgucgaggaggggaugcaccuccugaucacgggccccaacgggugcggcaaguccagccuguuccggauccugggcgggcuguggcccaccuacggcggggugcucuacaagccgccgccccagcgcauguucuacaucccccagcggcccuacauguccgugggcagccugcgcgaccaggucaucuaccccgacuccguggaggacaugcagcggaagggguacagcgagcaggaccuggaggccauccucgacgugguccaccuccaccacauccugcagcgcgagggcggcugggaggcgaugugcgacuggaaggacgugcuguccgggggcgagaagcagcggaucgggauggcccgcauguucuaccaccggcccaaguacgcccugcuggacgagugcaccagcgccguguccaucgacgucgagggcaagaucuuccaggccgcgaaggacgccggcaucgcccuccugagcaucacccaccgccccagccuguggaaguaccacacgcaccuccugcaguucgacggggagggcggguggaaguucgagaagcuggacuccgccgcgcggcucagccugaccgaggagaagcagcgccuggagcagcagcucgccggcaucccgaagaugcagcggcgccugcaggagcugugccagauccucggggaggccguggcccccgcccacgugcccgcgccgagcccccagggccccggcgggcugcagggcgccuccaccuga

SEQ ID NO: 26176 - RNA, 2223 nt, Artificial Sequence
  derived and/or modified sequence opt1 from ABCD2__Homo_sapiens__XP_011536329
augacccacaugcugaacgccgccgcggaccgcgugaaguggacccggagcuccgccgccaagcgcgccgccugccucgucgcggccgccuacgcccugaagacgcuguaccccaucaucggcaagcggcucaagcagagcgggcacggcaagaagaaggcggccgccuacccggccgccgagaacaccgagauccugcacugcaccgagaccaucugcgagaagcccucccccggggugaacgcggacuucuucaagcagcugcucgagcugcgcaagauccuguuccccaagcucgugacgaccgagaccggcuggcugugccugcacagcgucgcccucaucucccggaccuuccugagcaucuacguggccgggcuggacggcaagaucgugaaguccaucgucgagaagaagccgcgcacguucaucaucaagcucaucaaguggcugaugaucgccauccccgccaccuucgugaacagcgcgauccgguaccuggagugcaagcucgcccuggccuuccgcacccggcugguggaccacgccuacgagaccuacuucacgaaccagaccuacuacaaggucaucaacauggacggccgccucgccaaccccgaccagucccugaccgaggacaucaugauguucagccaguccguggcgcaccuguacagcaaccucaccaagcccauccuggacgugaugcugacguccuacacccucauccagaccgccaccagccgcggggccuccccgaucggccccacgcugcuggccgggcucgucguguacgccaccgcgaaggugcugaaggccugcagccccaaguucggcaagcuggucgccgaggaggcccaccggaagggguaccuccgguacgugcacucccgcaucaucgcgaacguggaggagaucgccuucuaccggggccacaaggucgagaugaagcagcugcagaaguccuacaaggcccuggccgaccagaugaaccucauccugagcaagcgccugugguacaucaugaucgagcaguuccucaugaaguacguguggagcagcuccggccugaucaugguggccauccccaucaucaccgcgaccggguucgccgacggcgaggacgggcagaagcaggucauggugagcgagcggacggaggccuucaccaccgcccgcaaccugcucgccuccggcgcggacgccaucgagcggaucaugagcuccuacaaggaggugaccgagcuggccggcuacacggcccgcgucuacaacauguucuggguguucgacgaggucaagcgggggaucuacaagcgcaccgccgugauccaggagagcgagucccacagcaagaacggcgcgaagguggagcugccgcucuccgacacccuggccaucaaggggaaggucaucgacguggaccacggcaucaucugcgagaacgugcccaucaucacccccgccggggaggucguggccagccgccugaacuucaagguggaggagggcaugcaccuccugaucacgggccccaacgggugcggcaaguccagccuguuccggauccuguccgggcucuggccggucuacgagggcgugcuguacaagcccccgccccagcacauguucuacaucccccagcgccccuacaugagccuggggucccuccgggaccaggugaucuaccccgacagcgucgacgacaugcacgacaagggcuacaccgaccaggaccuggagcgcauccugcacaacgugcaccucuaccacaucgugcagcgggagggcgggugggacgcggucauggacuggaaggacgugcuguccggcggggagaagcagcgcaugggcauggcccggauguucuaccacaagcccaaguacgcccugcucgacgagugcaccagcgccguguccaucgacgucgaggggaagaucuuccaggccgcgaagggcgccggcaucagccugcugagcaucacccaccgcccgucccucuggaaguaccacacgcaccuccugcaguucgacggggagggcggguggcgguucgagcagcuggacaccgccauccgccugacccugagcgaggagaagcagaagcucgagucccagcuggccggcauccccaagaugcagcagcggcugaacgagcucugcaagauccugggcgaggacagcgugcugaagaccaucaagaacgaggacgagaccuccuga

SEQ ID NO: 26177 - RNA, 1044 nt, Artificial Sequence
  derived and/or modified sequence opt1 from ABCD3__Homo_sapiens__XP_011540179
augggcuucaucgacagcaucaucgccaaguaccuggccaccguggucggguaccucguggugucccgccccuuccuggaccugagccacccgcggcaccucaaguccacccacagcgagcugcuggaggacuacuaccaguccggccgcaugcuccugcggaugagccaggcgcuggggcgcaucguccucgccggccgggagaugacgcgccuggccggguucaccgcccggaucaccgagcugaugcagguccucaaggaccugaaccacggcaaguacgagcgcaccauggugucccagcaggagaagggcaucgaggggguccaggugaucccccugauccccggcgccggggagaucaucaucgcggacaacaucaucaaguucgaccacgugccccucgccacgccgaacggcgacgugcugauccgggaccugaacuucgaggugcgcagcggggccaacgugcucaucugcggccccaacggcugcgggaaguccagccuguuccggguccugggcgagcucuggccccuguucgggggccgccugaccaagcccgagcggggcaagcuguucuacgugccgcagcgccccuacaugacccucgggacccugcgggaccaggugaucuaccccgacggccgcgaggaccagaagcggaaggggaucuccgaccucguccugaaggaguaccuggacaacgugcagcucggccacauccuggagcgcgagggcgggugggacagcgugcaggacuggauggacguccuguccggcggggagaagcagcggauggccauggcgcgccucuucuaccacaagccccaguucgccauccuggacgagugcacgagcgccguguccguggacgucgagggcuacaucuacagccacugccggaagguggggaucacccuguucaccgugucccaccgcaagagccucuggaagcaccacgaguacuaccugcacauggacggccgcgggaacuacgaguucaagcagaucaccgaggacacggucgaguucggcuccuga

SEQ ID NO: 26178 - RNA, 1821 nt, Artificial Sequence
  derived and/or modified sequence opt1 from ABCD4__Homo_sapiens__NP_005041
auggccguggccggccccgcgccgggggccggcgcccgcccccggcuggaccuccaguuccugcagcgcuuccugcagauccucaagguccuguuccccagcugguccagccagaacgcccugauguuccucacccugcugugccucacccugcuggagcaguucgugaucuaccagguggggcucauccccucccaguacuacggcguccuggggaacaaggaccuggagggcuucaagacgcucaccuuccuggccgugaugcugaucgugcucaacagcacccugaaguccuucgaccaguucacgugcaaccugcucuacgucagcuggcggaaggaccugaccgagcaccuccaccgccuguacuuccggggccgcgcguacuacacccugaacgugcugcgggacgacaucgacaacccggaccagcgcaucucccaggacguggagcgguucugccgccagcucagcuccauggccagcaagcugaucaucucccccuucacccuggucuacuacaccuaccagugcuuccagagcacgggguggcucggccccguguccaucuucggguacuucauccugggcaccguggucaacaagacccugauggggcccaucgugaugaagcucgugcaccaggagaagcuggagggcgacuuccgguucaagcacaugcagauccgcgucaacgccgagccggccgcguucuaccgggccggccacguggagcacaugcgcaccgaccggcgccugcagcggcuccugcagacgcagcgcgagcugaugagcaaggagcucuggcuguacaucgggaucaacaccuucgacuaccugggcuccauccucagcuacguggucaucgccauccccaucuucuccgggguguacggcgaccugagccccgccgagcuguccacccucgugagcaagaacgccuucgucugcaucuaccugaucagcugcuucacccagcugaucgaccucuccacgacccugagcgacguggcgggcuacacccaccggaucgggcagcugcgcgagacccugcucgacaugucccucaagagccaggacugcgagauccugggcgaguccgagugggggcuggacacgcccccgggcuggcccgccgccgagcccgccgacaccgccuuccugcuggagcgggugagcaucuccgcgcccagcuccgacaagccgcucaucaaggaccugagccugaagaucuccgaggggcagagccuccugaucaccggcaacaccggcacggggaagaccucccugcuccgcguccugggcgggcuguggaccagcacccgcggcuccgugcagaugcucacggacuucgggccccacggcguccuguuccugccccagaagcccuucuucaccgacggcacccuccgggagcaggucaucuacccgcugaaggagguguaccccgacagcggguccgccgacgacgagcgcauccugcgguuccucgagcuggccggccugagcaaccucguggcccgcaccgaggggcuggaccagcaggucgacuggaacugguacgacgugcugucccccggcgagaugcagcggcucagcuucgcccgccuguucuaccugcagcccaaguacgcggugcucgacgaggccacgagcgcccugaccgaggagguggaguccgagcuguaccggaucgggcagcagcucggcaugaccuucaucagcgugggccaccgccagucccuggagaaguuccacagccugguccucaagcugugcgggggcgggcggugggagcugaugcgcaucaagguggaguga

SEQ ID NO: 26179 - RNA, 1800 nt, Artificial Sequence
  derived and/or modified sequence opt1 from ABCE1__Homo_sapiens__NP_002931
auggccgacaagcugacccgcaucgccaucgugaaccacgacaagugcaagcccaagaagugccggcaggagugcaagaaguccugcccggucgugcgcaugggcaagcucugcaucgaggugacgccccagagcaagaucgcguggaucagcgagacccugugcaucgggugcggcaucugcaucaagaagugccccuucggggcccuguccaucgucaaccuccccagcaaccuggagaaggagaccacccaccgguacugcgccaacgccuucaagcugcaccgccucccgaucccccggcccggcgaggugcuggggcuggugggcaccaacggcaucgggaaguccacggcccucaagauccuggcgggcaagcagaagcccaaccuggggaaguacgacgacccgcccgacuggcaggagauccucaccuacuuccgcggcagcgagcugcagaacuacuucaccaagauccuggaggacgaccucaaggccaucaucaagccccaguacgucgaccagauccccaaggccgccaaggggaccgugggcuccauccuggaccggaaggacgagacgaagacccaggcgaucgugugccagcagcuggaccucacccaccugaaggagcgcaacgucgaggaccugagcggcggggagcuccagcgguucgccugcgccguggugugcauccagaaggccgacaucuucauguucgacgagccguccagcuaccuggacgucaagcagcgccugaaggccgcgaucaccauccggucccucaucaaccccgaccgcuacaucaucgugguggagcacgaccugagcguccuggacuaccucuccgacuucaucugcugccuguacggcgugcccagcgccuacgggguggucacgaugcccuucuccgugcgggagggcaucaacaucuuccuggacggcuacgugccgaccgagaaccuccgcuuccgggacgccagccuggucuucaagguggccgagaccgccaacgaggaggaggugaagaagaugugcauguacaaguaccccgggaugaagaagaagaugggcgaguucgagcuggcgaucgucgccggggaguucaccgacuccgagaucauggugaugcucggcgagaacgggacgggcaagaccaccuucauccgcaugcuggccggccggcugaagcccgacgagggcggggagguccccgugcucaacgugagcuacaagccgcagaagaucucccccaagagcaccgggagcguccgccagcugcugcacgagaagauccgggacgccuacacgcacccccaguucgugaccgacgugaugaagccccuccagaucgagaacaucaucgaccaggagguccagacccuguccggcggggagcugcagcgcguggcccucgcgcugugccugggcaagccggccgacguguaccucaucgacgagcccagcgccuaccuggacuccgagcagcggcugauggccgcccgcgucgugaagcgcuucauccuccacgcgaagaagaccgccuucguggucgagcacgacuucaucauggccacguaccuggccgaccgggugaucguguucgacggcguccccagcaagaacaccguggcgaacagcccccagacccugcuggccgggaugaacaaguuccucagccagcuggagaucaccuuccgccgggacccgaacaacuaccgcccccggaucaacaagcugaacuccaucaaggacguggagcagaagaaguccggcaacuacuucuuccucgacgacuga

SEQ ID NO: 26180 - RNA, 2538 nt, Artificial Sequence
  derived and/or modified sequence opt1 from ABCF1__Homo_sapiens__NP_001020262
augcccaaggccccgaagcagcagccgcccgagcccgaguggaucggcgacggggagagcaccucccccagcgacaagguggucaagaagggcaagaaggacaagaagaucaagaagaccuucuucgaggagcuggccguggaggacaagcaggcgggggaggaggagaaggugcucaaggagaaggagcagcagcagcagcagcagcagcagcagcagaagaagaagcgcgacacgcggaagggccgccggaagaaggacgucgacgacgacggggaggagaaggagcugauggagcgccugaagaagcucuccgugcccaccagcgacgaggaggacgaggugcccgcccccaagccgcggggcggcaagaagaccaagggcgggaacgucuucgccgcccugauccaggaccaguccgaggaggaggaggaggaggagaagcacccgcccaagcccgccaagcccgagaagaaccgcaucaacaaggcggugagcgaggagcagcagcccgcccugaaggggaagaagggcaaggaggagaaguccaaggggaaggccaagccccagaacaaguucgccgcgcucgacaacgaggaggaggacaaggaggaggagaucaucaaggagaaggagcccccgaagcagggcaaggagaaggccaagaaggccgagcagggcagcgaggaggagggggagggcgaggaggaggaggaggagggcggggaguccaaggccgacgaccccuacgcccaccugagcaagaaggagaagaagaagcugaagaagcagauggaguacgagcgccagguggcgucccucaaggccgccaacgccgccgagaacgacuucagcgucucccaggcggagaugagcucccggcaggccaugcuggagaacgccagcgacaucaagcuggagaaguucuccaucagcgcccacggcaaggagcuguucgugaacgccgaccucuacaucguggcggggcggcgcuacggccuggucgggcccaacggcaaggggaagaccacgcuccugaagcacaucgccaaccgggcccuguccaucccgcccaacaucgacgugcuccugugcgagcaggagguggucgccgacgagacccccgccgugcaggcggugcugcgcgccgacaccaagcggcucaagcugcuggaggaggagcgccggcuccagggccagcuggagcagggcgacgacaccgccgccgagcgccuggagaaggucuacgaggagcuccgggcgacgggggccgccgccgccgaggcgaaggcccgccggauccuggccggccugggguucgaccccgagaugcagaaccgccccacccagaaguucagcggcggguggcggaugcgcgugagccucgcccgcgcccuguucauggagccgacccugcucaugcuggacgagcccaccaaccaccuggaccucaacgcggugaucuggcugaacaacuaccugcagggcuggcggaagacgcuccugaucgucucccacgaccagggcuuccuggacgacgugugcaccgacaucauccaccucgacgcccagcgccugcacuacuaccgggggaacuacaugaccuucaagaagauguaccagcagaagcagaaggagcugcucaagcaguacgagaagcaggagaagaagcugaaggagcugaaggccggcggcaagagcaccaagcaggccgagaagcagacgaaggaggcccucacccgcaagcagcagaagugccggcgcaagaaccaggacgaggagucccaggaggcgcccgagcugcugaagcggcccaaggaguacaccgugcgcuucaccuucccggacccgccgccccugagcccgcccguccucgggcugcacggggugacguucggcuaccagggccagaagccccuguucaagaaccucgacuucgggaucgacauggacucccggaucugcaucgucggccccaacggggugggcaagagcacccugcugcuccugcugaccggcaagcucacccccacgcacggggagaugcgcaagaaccaccggcugaagaucggcuucuucaaccagcaguacgccgagcagcugcgcauggaggagacccccaccgaguaccuccagcggggguucaaccugcccuaccaggacgcccgcaagugccugggccgguucgggcucgagucccacgcccacaccauccagaucugcaagcugagcggcggccagaaggcgcgcguggucuucgccgagcuggccugccgggagcccgacgugcucauccuggacgagcccacgaacaaccuggacaucgaguccaucgacgcccucggggaggccaucaacgaguacaagggcgcggugaucgucgugagccacgacgcccgccugaucaccgagaccaacugccagcuguggguggucgaggagcaguccgugagccagaucgacggggacuucgaggacuacaagcgggaggugcucgaggcccugggcgaggucauggugucccgcccccgcgaguga

SEQ ID NO: 26181 - RNA, 1905 nt, Artificial Sequence
  derived and/or modified sequence opt1 from ABCF2__Homo_sapiens__NP_005683
augcccagcgaccuggccaagaagaaggccgcgaagaagaaggaggccgccaaggcccgccagcggccgcgcaagggccacgaggagaacggggacguggucaccgagccccagguggccgagaagaacgaggcgaacggccgggagaccacggagguggaccuccugaccaaggagcuggaggacuucgagaugaagaaggccgccgcccgcgcggucaccggggugcucgccucccaccccaacagcaccgacgugcacaucaucaaccugucccugacguuccacggccaggagcuccugagcgacaccaagcuggagcucaacuccgggcggcgcuacggccugaucggccugaacgggaucggcaagagcaugcuccuguccgccaucgggaagcgggagguccccaucccggagcacaucgacaucuaccaccugacccgcgagaugccgcccagcgacaagacgccccuccacugcgugauggagguggacaccgagcgggccaugcuggagaaggaggccgagcgccuggcgcacgaggacgccgagugcgagaagcucauggagcuguacgagcggcuggaggagcucgacgccgacaaggccgagaugcgcgccucccggauccugcacggccugggguucacccccgcgaugcagcgcaagaagcucaaggacuucagcggcggcuggcggaugcgcgucgcccuggcccgggcccuguucauccgccccuucaugcuccugcuggacgagcccaccaaccaccucgaccuggacgccugcguguggcuggaggaggagcucaagaccuucaagcggauccuggugcuggucucccacagccaggacuuccucaacggggugugcacgaacaucauccacaugcacaacaagaagcugaaguacuacaccggcaacuacgaccaguacgugaagacccgccuggagcucgaggagaaccagaugaagcgguuccacugggagcaggaccagaucgcgcacaugaagaacuacaucgcccgcuucgggcacggcuccgccaagcuggcccgccaggcccagagcaaggagaagacccugcagaagaugauggcguccggccucacggagcgggucgugagcgacaagacccuguccuucuacuucccgcccugcgggaagaucccgccgcccgugaucaugguccagaacgugagcuucaaguacaccaaggacggccccugcaucuacaacaaccuggaguucgggaucgaccucgacacccgcguggcccuggucggccccaacggggccggcaaguccacgcugcucaagcugcugaccggcgagcugcuccccaccgacgggaugauccggaagcacagccacgugaagaucggccgcuaccaccagcaccuccaggagcagcuggaccuggaccugagcccccuggaguacaugaugaagugcuaccccgagaucaaggagaaggaggagaugcggaagaucaucgggcgcuacggccucaccgggaagcagcaggucucccccauccggaaccugagcgacggccagaagugccgcgugugccuggccuggcucgcguggcagaacccccacaugcuguuccuggacgagcccacgaaccaccucgacaucgagaccaucgacgcccuggccgacgccaucaacgaguucgagggcgggaugaugcuggugucccacgacuuccggcucauccagcaggucgcccaggagaucugggugugcgagaagcagaccaucaccaaguggccgggcgacauccuggcguacaaggagcaccucaagagcaagcugguggacgaggagccccagcugacgaagcgcacccacaacgucugcacccugacccucgccucccugccccggcccuga

SEQ ID NO: 26182 - RNA, 2037 nt, Artificial Sequence
  derived and/or modified sequence opt1 from ABCG1__Homo_sapiens__NP_004906
auggccugccugauggccgcguucagcgugggcaccgccaugaacgccuccagcuacuccgccgagaugaccgagcccaagagcgucugcguguccguggacgaggucgugagcuccaacauggaggccacggagaccgaccuccugaacgggcaccugaagaagguggacaacaaccucaccgaggcgcagcgcuucagcucccugccgcggcgcgccgccgucaacaucgaguuccgggaccugagcuacuccgugcccgagggccccugguggcgcaagaagggguacaagacccuccugaagggcaucagcgggaaguucaacuccggcgagcugguggccaucaugggccccagcggggcgggcaaguccacgcucaugaacauccuggccggguaccgggagaccggcaugaagggggccguccugaucaacggccucccgcgcgaccugcggugcuuccgcaaggugagcugcuacaucaugcaggacgacaugcugcucccccaccugaccgugcaggaggccaugauggucuccgcccaccugaagcuccaggagaaggacgagggccggcgcgagauggugaaggagauccugaccgcgcuggggcuccugagcugcgccaacacgcggaccggcucccugagcgggggccagcgcaagcggcucgccaucgcccuggagcuggugaacaacccgcccgucauguucuucgacgagcccaccagcggccucgacuccgccagcugcuuccagguggugucccugaugaaggggcuggcgcagggcgggcgcagcaucaucugcaccauccaccagcccuccgccaagcuguucgagcuguucgaccagcuguacguccucagccagggccagugcguguaccgggggaaggugugcaaccugguccccuaccugcgcgaccucggccugaacugccccacguaccacaacccggccgacuucgugauggagguggccuccggcgaguacggggaccagaacagccggcugguccgcgccgugcgggagggcaugugcgacuccgaccacaagcgcgaccucgggggcgacgcggaggucaaccccuuccuguggcaccggcccagcgaggaggugaagcagaccaagcgccugaaggggcuccgcaaggacuccagcuccauggagggcugccacagcuucuccgccagcugccugacccaguucugcauccuguucaagcggaccuuccucuccaucaugcgcgacagcgugcugacgcaccuccggaucaccucccacaucggcaucgggcuccugaucggccugcuguaccucgggaucggcaacgaggccaagaagguccugagcaacagcggguuccuguucuucuccaugcuguuccucauguucgccgcccugaugcccaccgugcucaccuucccgcuggagaugggcguguuccugcgcgagcaccucaacuacugguacagccugaaggcguacuaccuggccaagacgauggccgacguccccuuccagaucauguuccccguggccuacugcuccaucguguacuggaugaccagccagcccuccgacgcgguccgguucguccucuucgccgcccugggcaccaugaccagccugguggcccagucccucgggcugcugaucggcgccgcgagcacgucccuccagguggccaccuucguggggccggugaccgccauccccguccugcuguucagcggcuucuucguguccuucgacaccauccccacguaccuccaguggaugagcuacaucuccuacgugcgcuacggcuucgagggggucauccugagcaucuacggccuggaccgggaggaccuccacugcgacaucgacgagaccugccacuuccagaaguccgaggccauccugcgcgagcuggacguggagaacgccaagcucuaccuggacuucaucgugcuggggaucuucuucaucagccuccggcugaucgcguacuucguccugcgcuacaagauccgggccgagcgcuga

SEQ ID NO: 26183 - RNA, 1836 nt, Artificial Sequence
  derived and/or modified sequence opt1 from ABCG2__Homo_sapiens__NP_001244315
augagcuccagcaacguggaggucuucauccccgugucccagggcaacaccaacggguucccggccaccgccagcaacgaccugaaggcguucacggagggcgccgugcucuccuuccacaacaucugcuaccgcgucaagcucaagagcggguuccugcccugccggaagcccguggagaaggagauccucuccaacaucaacggcaucaugaagcccgggcugaacgccauccugggcccgaccggcgggggcaagagcucccuccuggacgugcuggccgcccgcaaggaccccagcgggcucuccggcgacguccugaucaacggggcgccccggcccgccaacuucaagugcaacagcggcuacguggugcaggacgacgucgugaugggcacccugaccgugcgcgagaaccuccaguucuccgccgcccugcggcuggcgacgaccaugaccaaccacgagaagaacgagcgcaucaaccgggucauccaggagcucgggcuggacaagguggccgacagcaaggugggcacccaguucauccgcggggucuccggcggcgagcggaagcgcacgagcaucgggauggagcugaucaccgacccguccauccucuuccuggacgagcccaccaccggccuggacagcuccacggccaacgccgugcuccugcugcucaagcggaugagcaagcaggggcgcaccaucaucuucagcauccaccagccccgguacuccaucuucaagcuguucgacagccugacccuccuggccuccggccgccugauguuccacgggcccgcgcaggaggcccucggcuacuucgagagcgccggcuaccacugcgaggccuacaacaacccggccgacuucuuccuggacaucaucaacggggacuccaccgcgguggcccugaaccgggaggaggacuucaaggccacggagaucaucgagcccagcaagcaggacaagccccucaucgagaagcuggccgagaucuacgucaacuccagcuucuacaaggagaccaaggccgagcugcaccagcucuccggcggggagaagaagaagaagaucaccguguucaaggagaucagcuacaccacguccuucugccaccagcugcgcugggugagcaagcgguccuucaagaaccugcucggcaacccccaggcgagcaucgcccagaucaucgucaccguggugcuggggcuggucaucggcgccaucuacuucggccucaagaacgacuccaccgggauccagaaccgcgccggcgugcuguucuuccugaccacgaaccagugcuucagcuccgucagcgccguggagcuguucguggucgagaagaagcuguucauccacgaguacaucuccggguacuaccgggugagcagcuacuuccugggcaagcuccuguccgaccugcugccgaugcgcaugcuccccagcaucaucuucacgugcaucguguacuucaugcuggggcugaagcccaaggcggacgccuucuucgucaugauguucacccucaugaugguggccuacuccgccagcuccauggcgcuggccaucgccgccggccagagcguggucuccguggccacccugcucaugaccaucugcuucguguucaugauggucugcuggagcaucucccagccccugcaccugggcugccacggguucagcaccuccgcguuccacgacauggaccuccggcugugcagcaucaugaacuucugggacaagaccuccgcccaggacagcaugcagcaggagaccauccuggugacgaugcagcacgugcucgccaagaacaucugguga

SEQ ID NO: 26184 - RNA, 1941 nt, Artificial Sequence
  derived and/or modified sequence opt1 from ABCG4__Homo_sapiens__NP_001135977
auggccgagaaggcccuggaggcggugggcugcgggcucggccccggggccgucgccauggccgugacccuggaggacggcgccgagccgcccgugcugaccacgcaccucaagaaggucgagaaccacaucaccgaggcgcagcgcuucagccaccuccccaagcgguccgccguggacaucgaguucguggagcugagcuacuccguccgcgaggggcccugcuggcggaagcgcggcuacaagacccuccugaagugccugagcggcaaguucugccggcgcgagcucaucgggaucaugggcccguccggggccggcaagagcaccuucaugaacauccuggccggguaccgggaguccggcaugaagggccagauccuggugaacgggcgcccccgggagcuccgcacguuccggaagaugagcugcuacaucaugcaggacgacaugcugcugccccaccucaccgugcuggaggcgaugauggucuccgccaaccugaagcucagcgagaagcaggaggugaagaaggagcuggugaccgagauccugaccgcccucggccugauguccugcagccacacgcgcaccgcccugcucuccgggggccagcggaagcgccuggccaucgcgcuggagcucgucaacaacccgcccgugauguucuucgacgagcccaccagcggccuggacuccgccagcugcuuccagguggucucccugaugaagucccucgcccagggcgggcggaccaucaucugcacgauccaccagcccagcgccaagcuguucgagauguucgacaagcuguacauccucagccaggggcagugcaucuucaagggcguggugaccaaccugauccccuaccugaaggggcucggccugcacugcccgaccuaccacaaccccgccgacuucaucaucgaggucgcgagcggcgaguacggggaccugaaccccaugcuguuccgcgccgugcagaacggccugugcgccauggccgagaagaaguccagccccgagaagaacgaggugccggcccccugcccgcccugcccgcccgaggucgaccccaucgagucccacaccuucgcgacgagcacccugacccaguucugcauccucuucaagcggaccuuccuguccauccugcgcgacacggugcucacccaccuccgguucaugagccacguggucaucggggugcugaucggccuccuguaccugcacaucggggacgacgccuccaaggucuucaacaacaccggcugccuguucuucagcaugcuguuccugauguucgccgcccugaugcccaccgugcucacguucccccuggagauggccguguucaugcgcgagcaccugaacuacugguacucccucaaggcguacuaccuggccaagaccauggccgacguccccuuccagguggugugccccgucguguacugcagcaucguguacuggaugaccggccagcccgccgagaccucccgguuccuccucuucagcgcgcuggccacggccaccgcccuggucgcccagucccucgggcugcugaucggcgcggccagcaacucccuccagguggccaccuucguggggccggucaccgccauccccgugcugcuguucagcggcuucuucguguccuucaagacgauccccaccuaccuccaguggagcuccuaccugagcuacguccgcuacggguucgagggcgugauccugaccaucuacggcauggagcgcggggaccugaccugccuggaggagcggugcccguuccgcgagccccagagcauccugcgggcccucgacguggaggacgcgaagcuguacauggacuuccugguccucggcaucuucuuccuggcccugcgccuccuggccuaccuggugcuccgguaccgcgugaaguccgagcgguga

SEQ ID NO: 26185 - RNA, 1956 nt, Artificial Sequence
  derived and/or modified sequence opt1 from ABCG5__Homo_sapiens__NP_071881
augggcgaccugagcucccucacccccgggggcagcauggggcuccaggugaaccgcggcucccagagcucccuggagggggccccggccaccgcgcccgagccccacagccucggcauccugcacgccuccuacagcgucucccaccgggugcgccccuggugggacaucacgagcugccggcagcaguggacccgccagauccugaaggacgugucccucuacgucgagagcggccagaucaugugcauccugggguccagcggcuccgggaagaccacccugcucgacgccaugagcggccggcuggggcgcgccggcacguuccugggcgagguguacgugaacgggcgggcccuccgccgggagcaguuccaggacugcuucuccuacguccugcagagcgacacccugcucuccagccugaccgugcgcgagacccugcacuacacggcgcuccuggccauccggcgcggcaacccggggagcuuccagaagaagguggaggccgucauggccgagcugucccucagccacguggcggaccggcugaucggcaacuacucccugggcgggaucagcaccggcgagcgccggcgcguguccaucgccgcccagcuccugcaggaccccaaggucaugcuguucgacgagcccaccaccgggcucgacugcaugacggccaaccagaucguggugcugcuggucgagcucgcccggcgcaaccggaucguggugcugaccauccaccagccccgcagcgagcuguuccagcuguucgacaagaucgcgauccuguccuucggcgagcugaucuucugcgggaccccggccgagaugcucgacuucuucaacgacugcggcuaccccugccccgagcacagcaaccccuucgacuucuacauggaccugaccuccgucgacacgcagagcaaggagcgggagaucgagaccuccaagcgcgugcagaugaucgagagcgccuacaagaaguccgccaucugccacaagacccugaagaacaucgagcgcaugaagcaccucaagacccugccgauggugcccuucaagacgaaggacagccccggcgucuucuccaagcugggggugcuccugcggcgcgugacccggaaccugguccgcaacaagcucgccgugaucacccggcugcugcagaaccucaucaugggccuguuccugcuguucuucguccuccgcgugcggagcaacgugcugaagggggcgauccaggaccgcgucggccugcucuaccaguucgugggggccacccccuacacgggcaugcugaacgccgugaaccuguucccgguccuccgggccguguccgaccaggagagccaggacggccuguaccagaaguggcagaugaugcuggccuacgcgcuccacgugcugcccuucuccgucguggccaccaugaucuucagcagcgugugcuacuggacccuggggcuccaccccgaggucgcccgcuucggcuacuucuccgccgcccugcuggcgccccaccucaucggggaguuccugacccuggugcuccugggcaucgugcagaacccgaacaucgucaacagcgugguggcccugcucuccaucgccgggguccuggugggcagcggcuuccugcggaacauccaggagaugcccauccccuucaagaucaucuccuacuucacguuccagaaguacugcagcgagauccucguggucaacgaguucuacgggcugaacuucacgugcggcuccagcaacguguccgugaccaccaaccccaugugcgccuucacccaggggauccaguucaucgagaagaccugcccgggcgcgaccagccgcuucaccaugaacuuccugauccucuacuccuucauccccgcccuggucauccugggcaucgugguguucaagauccgggaccaccucaucagccgcuga

SEQ ID NO: 26186 - RNA, 2022 nt, Artificial Sequence
  derived and/or modified sequence opt1 from ABCG8__Homo_sapiens__NP_071882
auggccggcaaggccgcggaggagcgcgggcugcccaagggcgccaccccgcaggacaccagcgggcuccaggaccggcuguucuccagcgaguccgacaacagccuguacuucacguacuccggccagcccaacacccucgaggugcgcgaccugaacuaccaggucgaccuggccagccaggugcccugguucgagcagcucgcccaguucaagaugcccuggaccuccccgagcugccagaacuccugcgagcuggggauccagaaccugagcuucaaggugcgguccggccagaugcucgccaucaucggcagcuccgggugcggccgcgcgagccugcuggacgucaucaccgggcggggccacgggggcaagaucaaguccggccagaucuggaucaacgggcagcccagcagcccccagcucgugcgcaagugcguggcccacguccggcagcacaaccagcugcugcccaaccucacggugcgcgagacccuggccuucaucgcccagaugcggcugccgcgcaccuucucccaggcgcagcgggacaagcgcguggaggacgucaucgccgagcuccggcugcgccagugcgccgacacccgggugggcaacauguacgugcgcgggcuguccggcggcgagcggcgccgggucagcaucggggugcagcuccuguggaaccccggcauccugauccucgacgagcccacgagcgggcuggacuccuucaccgcccacaaccuggugaagacccucagccgccuggccaagggcaaccggcugguccucaucucccugcaccagccccgcagcgacaucuuccgccuguucgaccucgugcugcugaugaccuccgggacgccgaucuaccucggcgcggcccagcacauggugcaguacuucaccgccaucggcuaccccugcccccgguacagcaaccccgccgacuucuacgucgaccugaccuccaucgaccgccggagccgcgagcaggagcuggccacccgggagaaggcgcagucccucgccgcccuguuccuggagaaggugcgcgaccucgacgacuuccuguggaaggccgagacgaaggaccuggacgaggacacgugcguggagagcuccgucaccccgcucgacaccaacugccugcccagccccaccaagaugcccggggccgugcagcaguucaccacccugauccggcgccagaucuccaacgacuuccgggaccucccgacccugcugauccacggcgcggaggccugccugaugagcaugacgaucggguuccucuacuucggccacggguccauccagcugagcuucauggacaccgccgcccuccuguucaugaucggcgcccugauccccuucaacgugauccuggacgucaucuccaagugcuacagcgagcgcgcgaugcucuacuacgagcuggaggacggccuguacaccaccgggcccuacuucuucgccaagauccucggcgagcugcccgagcacugcgccuacaucaucaucuacgggaugccgacguacuggcuggccaaccuccggcccggccugcagcccuuccugcuccacuuccugcugguguggcucgucguguucugcugccgcaucauggcgcuggccgccgccgcccugcuccccaccuuccacauggcguccuucuucagcaacgcccuguacaacagcuucuaccuggccgggggcuucaugaucaaccucuccagccuguggaccgugccggccuggaucuccaaggucagcuuccugcgguggugcuucgagggccucaugaagauccaguucucccgccggaccuacaagaugccccuggggaaccugacgaucgccgugagcggcgacaagauccucuccgugauggagcuggacagcuacccccuguacgcgaucuaccucaucgucaucgggcuguccggcggcuucauggugcuguacuacgugagccuccgcuucaucaagcagaagccgucccaggacugguga

SEQ ID NO: 26187 - RNA, 1089 nt, Artificial Sequence
  derived and/or modified sequence opt1 from ABHD12B__Homo_sapiens__NP_001193602
auggacgcccaggacugccaggccgcggccagccccgagccgcccggcccgcccgcccgcuccugcguggccgccuggugggacauggucgaccggaaccugcgcuacuucccccacagcugcuccaugcucgggcggaagaucgcggcccuguacgacagcuucaccuccaagagccugaaggagcacguguuccucccccugaucgacaugcugaucuacuucaacuucuucaaggcccccuuccucguggaccugaagaagcccgagcugaagaucccgcacaccgucaacuucuaccuccgcguggagcccggcgugaugcuggggaucuggcacacgguccccuccugccggggcgaggacgccaaggggaaggacugcugcugguacgaggcggcccugcgcgacggcaaccccaucaucguguaccuccacggcagcgccgagcaccgggccgccucccaccgccugaagcuggugaagguccucagcgacgggggcuuccacgugcuguccguggacuaccggggguucggcgacagcaccgggaagcccaccgaggagggccugaccacggacgcgaucugcgucuacgaguggaccaaggcccgcuccggcaucacccccgugugccucugggggcacagccugggcaccgggguggccacgaacgccgccaagguccuggaggagaagggcugccccguggacgcgaucgugcucgaggcccccuucaccaacaugugggucgccuccaucaacuacccgcugcugaagaucuaccggaacauccccggcuuccuccgcacccugauggacgcccugcggaaggacaagaucaucuuccccaacgacgagaacgugaaguuccucagcagcccccugcugauccuccacggggaggacgaccgcaccgugccgcuggaguacggcaagaagcuguacgagaucgcccggaacgcguaccgcaacaaggagcgggucaagauggugaucuucccgcccggguuccagcacaaccuccugugcaagucccccacgcugcucaucaccgugcgcgacuuccuguccaagcaguggagcuga

SEQ ID NO: 26188 - RNA, 1197 nt, Artificial Sequence
  derived and/or modified sequence opt1 from ABHD12__Homo_sapiens__NP_001035937
augcgcaagcggaccgagcccguggcccuggagcacgagcgcugcgccgcggccggcagcuccagcuccgggagcgccgccgccgcgcucgacgccgacugccggcugaagcagaaccugcgccucaccggcccggccgccgcggagccccggugcgccgccgacgccgggaugaagcgcgcccugggccggcgcaagggggucuggcugcggcuccgcaagauccuguucugcgugcugggccucuacaucgcgauccccuuccugaucaagcugugccccggcauccaggccaagcucaucuuccugaacuucgugcgggucccguacuucaucgaccugaagaagccccaggaccaggggcucaaccacacgugcaacuacuaccugcagcccgaggaggacgugaccaucggcguguggcacaccguccccgccgugugguggaagaacgcccaggggaaggaccagaugugguacgaggacgcccuggcguccagccacccgaucauccucuaccugcacggcaacgccgggacccgcggcggcgaccaccggguggagcuguacaagguccucuccagccugggguaccacguggugacguucgacuaccgcggcuggggcgacuccgucgggacccccagcgagcggggcaugaccuacgacgcccugcacguguucgacuggaucaaggcccgcuccggggacaaccccguguacaucuggggccacagccucgggaccggcgucgccacgaaccuggugcggcgccugugcgagcgggagaccccgcccgacgcgcucauccuggagucccccuucaccaacauccgcgaggaggccaagagccaccccuucuccgugaucuaccgguacuuccccggguucgacugguucuuccuggacccgaucaccagcuccggcaucaaguucgccaacgacgagaacgucaagcacaucagcugcccccuccugauccugcacgccgaggacgaccccguggugcccuuccagcucggccgcaagcuguacuccaucgccgcgccggcccgcagcuuccgggacuucaagguccaguucgugcccuuccacagcgaccugggguaccgccacaaguacaucuacaagucccccgagcucccccggauccugcgcgaguuccugggcaagagcgagccggagcaccagcacuga

SEQ ID NO: 26189 - RNA, 1578 nt, Artificial Sequence
  derived and/or modified sequence opt1 from ABHD16A__Homo_sapiens__NP_001170986
augcccccgcccgcccuguuccucagcucccuguacccccgccuggaguuccagaacgacuucuaccggagcugcauccgccgguccagcccccagccgccgcccaaccucgccuggcgccccgagucccuguacagcggcgagcuggccgggggcggguaccucucccugagcaaggugguccccuucucccacuacgcgggcacccugcuccugcugcucgccgggguggccugccugcggggcaucggccgcuggaccaacccccaguaccggcaguucaucaccauccuggaggccacccaccgcaaccagagcuccgagaacaagcggcagcucgcgaacuacaacuucgacuuccgcagcuggcccguggacuuccacugggaggagcccuccagccggaaggagucccgcgggggcccgagccggcgcggggucgcccugcugcggcccgagccccuccaccgcggcaccgccgacacccugcugaaccgggugaagaagcuccccugccagaucacguccuaccugguggcccacacccuggggcgccggaugcucuacccgggcagcgucuaccugcugcagaaggcgcucaugcccgugcugcugcagggccaggcccgccucguggaggagugcaacgggcggcgcgccaagcugcuggccugcgacggcaacgagaucgacaccauguucgucgaccgccgggggaccgccgagccccagggccagaagcucgugaucugcugcgagggcaacgcgggguucuacgaggugggcugcgucuccacgccccuggaggccggguacagcgugcugggcuggaaccacccgggguucgccggcagcaccggcgugcccuucccccagaacgaggccaacgccauggacgucguggugcaguucgcgauccaccgccucggguuccagccccaggacaucaucaucuacgccugguccaucggcggguucaccgccaccugggccgccaugagcuacccggacgucuccgcgaugauccuggacgccagcuucgacgaccuggugccccucgcccugaaggugaugcccgacuccuggcggggccuggucacgcgcaccgugcggcagcaccucaaccugaacaacgccgagcagcugugccgcuaccaggggcccgugcuccugauccggcgcaccaaggacgagaucaucaccacgaccgucccggaggacaucaugagcaaccggggcaacgaccugcuccugaagcugcugcagcaccgcuacccccgggugauggccgaggagggccuccgcgucgugcggcaguggcuggaggcguccagccagcuggaggaggccuccaucuacagccgcugggagguggaggaggacuggugccucuccguccugcggagcuaccaggccgagcacgggcccgacuucccgugguccgugggcgaggacaugagcgccgacgggcgccggcagcuggcgcuguuccuggcccgcaagcaccuccacaacuucgaggccacccacugcacgccccuccccgcccagaacuuccagaugcccuggcaccuguga

SEQ ID NO: 26190 - RNA, 867 nt, Artificial Sequence
  derived and/or modified sequence opt1 from ABHD17B__Homo_sapiens__NP_001020951
augaacaaccugagcuucuccgagcucugcugccuguucugcugcccgcccugccccggcaagaucgccagcaagcuggccuuccucccgcccgaccccaccuacacccugaugugcgacgaguccgggagccgcuggacgcugcaccucuccgagcgggcggacuggcaguacagcucccgcgagaaggacgccaucgagugcuucaugacccggaccagcaagggcaaccgcaucgccugcauguucgugcggugcucccccaacgccaaguacacccugcuguucagccacgggaacgccgucgaccucggccagauguccagcuucuacaucgggcugggcucccgcaucaacugcaacaucuucagcuacgacuacuccggcuacggggcgagcuccggcaagcccacggagaagaaccuguacgccgacaucgaggccgccuggcucgcgcugcggacccgcuacgggauccggcccgagaacgugaucaucuacggccagagcaucgggaccgugccguccgucgaccuggccgcccgcuacgagagcgccgccgugauccuccacagcccccugaccuccggcaugcggguggcguuccccgacacgaagaagaccuacugcuucgacgccuuccccaacaucgacaagaucagcaagaucaccuccccgguccugaucauccacggcaccgaggacgaggugaucgacuucagccacgggcucgcccuguucgagcgcugccagcggcccguggagccccugugggucgagggcgccgggcacaacgacguggagcucuacggccaguaccuggagcgccugaagcaguucgugucccaggagcucgucaaccuguga

SEQ ID NO: 26191 - RNA, 1278 nt, Artificial Sequence
  derived and/or modified sequence opt1 from ABHD2__Homo_sapiens__XP_005254890
augaacgccaugcuggagacccccgagcucccggccguguucgacggcgugaagcuggcggccguggccgccgugcuguacgucaucgugcgcugccucaaccugaagucccccaccgccccgcccgaccuguacuuccaggacuccgggcucagccgguuccugcugaaguccugcccccuccugacgaaggaguacaucccgccccugaucuggggcaagagcgggcacauccagaccgcgcucuacggcaagauggggcgcgugcggagcccccaccccuacggccaccgcaaguucaucaccaugagcgacggcgccaccuccacguucgaccuguucgagccccuggccgagcacugcgucggggacgacaucaccauggugaucugccccggcaucgccaaccacagcgagaagcaguacauccggaccuucguggacuacgcgcagaagaacggguaccgcugcgccguccucaaccaccugggcgcccugcccaacaucgagcucaccuccccgcggauguucacguacgggugcaccugggaguucggcgccauggugaacuacaucaagaagaccuacccccugacccagcugguggucgugggcuucagccucgggggcaacaucgugugcaaguaccugggggagacgcaggccaaccaggagaagguccugugcugcguguccgugugccagggcuacagcgcgcuccgcgcccaggagaccuucaugcagugggaccagugccggcgcuucuacaacuuccugauggccgacaacaugaagaagaucauccugucccaccggcaggcccucuucggcgaccacgucaagaagccccagagccuggaggacaccgaccugucccgccucuacaccgccacgagccugaugcagaucgacgacaacgugaugcggaaguuccacggguacaacucccugaaggaguacuacgaggaggagagcugcaugcgcuaccuccaccggaucuacgugccccugaugcuggucaacgcggccgacgacccgcucgugcacgagucccugcugaccauccccaagagccucagcgagaagcgcgagaacgugauguucguccugccccugcacggcgggcaccucggcuucuucgagggguccgugcuguuccccgagccgcugaccuggauggacaagcucgucguggaguacgccaacgccaucugccagugggagcggaacaagcugcagugcagcgacaccgagcaggucgaggccgaccuggaguga

SEQ ID NO: 26192 - RNA, 1050 nt, Artificial Sequence
  derived and/or modified sequence opt1 from ABHD5__Homo_sapiens__NP_057090
auggccgccgaggaggaggagguggacagcgcggacaccggcgagcgcuccggguggcugaccggcuggcuccccacguggugcccgaccagcaucucccaccugaaggaggccgaggagaagaugcugaagugcguccccugcaccuacaagaaggagcccgugcggaucagcaacgggaacaagaucuggacccucaaguucucccacaacaucagcaacaagacgccccuggugcugcuccacggcuucgggggcggccuggggcugugggcccucaacuucggcgaccugugcaccaaccgcccggucuacgccuucgaccugcucggguucggccgguccagccgcccccgguucgacuccgacgccgaggagguggagaaccaguucguggagagcaucgaggaguggcgcugcgcgcuggggcuggacaagaugauccuccugggccacaaccugggcggguuccucgccgccgccuacucccugaaguaccccagccgggucaaccaccugauccucguggagcccuggggcuucccggagcgccccgaccuggcggaccaggaccggcccauccccguguggauccgcgcccugggggccgcccucaccccguucaacccccuggccggccugcggaucgcgggccccuucgggcucucccugguccagcgccugcggcccgacuucaagcgcaaguacagcuccauguucgaggacgacaccgugacggaguacaucuaccacugcaacgugcagaccccgagcggcgagaccgccuucaagaacaugaccauccccuacgggugggccaagcggcccaugcuccagcgcaucggcaagaugcaccccgacaucccggucuccgugaucuucggggcccggagcugcaucgacggcaacuccggcacgagcauccagagccugcgcccccacuccuacgugaagaccaucgccauccugggggcgggccacuacgucuacgccgaccagcccgaggaguucaaccagaaggugaaggagaucugcgacaccguggacuga

SEQ ID NO: 26193 - RNA, 1014 nt, Artificial Sequence
  derived and/or modified sequence opt1 from ABHD6__Homo_sapiens__NP_065727
auggaccuggacguggucaacauguucgugaucgccggcgggacccucgccauccccauccuggcguucguggccagcuuccugcucuggccguccgcccugauccgcaucuacuacugguacuggcggcgcacccugggcaugcagguccgguacgugcaccacgaggacuaccaguucugcuacagcuuccgcgggcggcccggccacaagcccuccauccucaugcugcacggguucagcgcccacaaggacauguggcuguccguggucaaguuccuccccaagaaccugcaccuggugugcguggacaugccgggccacgagggcacgacccgcagcucccucgacgaccugagcaucgacgggcaggucaagcggauccaccaguucguggagugccugaagcucaacaagaagcccuuccaccuggugggcaccuccaugggcgggcaggucgccgggguguacgcggccuacuaccccagcgacguguccagccugugccucgucugccccgccggccugcaguacuccaccgacaaccaguucgugcagcgccugaaggagcuccagggcagcgccgcgguggagaagaucccgcugauccccuccacgcccgaggagaugagcgagaugcugcagcucugcuccuacguccgguucaaggugccccagcagauccugcaggggcugguggacguccgcaucccgcacaacaacuucuaccggaagcuguuccucgagaucgugagcgagaagucccgcuacagccugcaccagaacauggacaagaucaaggugcccacccagaucaucuggggcaagcaggaccagguccucgacgugagcggggccgacaugcuggccaaguccaucgccaacugccaggucgagcugcucgagaacugcggccacagcguggugauggagcggccccgcaagaccgccaagcugaucaucgacuuccuggcguccguccacaacaccgacaacaacaagaagcucgacuga

SEQ ID NO: 26194 - RNA, 1446 nt, Artificial Sequence
  derived and/or modified sequence opt1 from ABI1__Homo_sapiens__NP_001012768
auggccgagcugcagaugcuccuggaggaggagauccccagcggcaagcgcgcccugaucgaguccuaccagaaccucacccggguggcggacuacugcgagaacaacuacauccaggccaccgacaagcgcaaggcccuggaggagaccaaggccuacaccacccagagccuggccuccgucgcguaccagaucaacgcccucgccaacaacgugcugcagcugcucgacauccaggccagccagcugcggcgcauggaguccagcaucaaccacaucucccagaccguggacauccacaaggagaaggucgcgcggcgcgagaucgggauccugacgaccaacaagaacaccagccggacccacaagaucaucgcccccgccaacauggagcgccccgugcgguacauccgcaagcccaucgacuacacggugcucgacgacgucggccacggggugaaguggcugaaggccaagcacggcaacaaccagcccgcccggaccgggacccugucccgcaccaacccgcccacgcagaagccgcccagcccgcccauguccggccggggcacccucgggcgcaacacccccuacaagacccuggagcccgugaagccgcccacgguccccaacgacuacaugaccagccccgcgcggcugggcucccagcacagccccgggcgcaccgccucccucaaccagcggccccgcacccacagcggcuccagcgggggcuccggcagccgggagaacagcggguccagcuccaucggcauccccaucgccgugcccacgcccagcccgcccaccaucgggcccgccgcccccggcuccgcgcccggcagccaguacgggaccaugacccgccagaucucccggcacaacagcacgaccuccagcaccuccagcggcggguaccgccgcacccccuccgugacggcccaguucagcgcccagccccacgucaacggcgggccgcuguacucccagaacagcaucuccaucgcgcccccgcccccgcccaugccccagcugacgccccagaucccccucaccggcuucguggcccgggugcaggagaacaucgccgacagccccacgcccccgcccccgcccccgcccgacgacauccccauguucgacgacagcccgcccccgcccccgcccccgcccgucgacuacgaggacgaggaggccgccguggugcaguacaacgaccccuacgccgacggcgaccccgccugggcgcccaagaacuacaucgagaaggucguggccaucuacgacuacaccaaggacaaggacgacgagcuguccuucauggagggggccaucaucuacgugaucaagaagaacgacgacggcugguacgagggggucugcaaccgcgugaccggccuguuccccgggaacuacguggagagcaucaugcacuacaccgacuga

SEQ ID NO: 26195 - RNA, 1542 nt, Artificial Sequence
  derived and/or modified sequence opt1 from ABI2__Homo_sapiens__NP_001269854
auggccgagcugcagaugcuccuggaggaggagauccccggcgggcgccgggcccuguucgacagcuacaccaaccucgagcgcguggcggacuacugcgagaacaacuacauccaguccgccgacaagcagcgggcccuggaggagaccaaggccuacacgacccagagccuggccuccgucgcguaccucaucaacacccuggccaacaacgugcugcagaugcucgacauccaggccagccagcugcgccggauggaguccagcaucaaccacaucucccagaccguggacauccacaaggagaaggucgcccgccgggagaucggcauccugacgaccaacaagaacaccagccgcacccacaagaucaucgcgccggccaaccucgagcggcccgugcgcuacauccggaagcccaucgacuacacgauccuggacgacaucgggcacggcgugaaguggcugcuccgcuucaaggucuccacccagaacaugaagauggggggccugccccggaccaccccgcccacgcagaagccccccagcccgcccauguccggcaaggggacccugggccgccacagccccuaccggacccucgagcccgugcgcccgcccgugguccccaacgacuacgugcccuccccgacccggaacauggcccccagccagcagucccccgugcgcacggccagcgucaaccagcggaaccgcaccuacuccagcuccgggagcagcggcgggucccaccccagcucccggagcuccagccgcgagaacuccggcagcggcuccgugggggugccgaucgccguccccacccccagccccccguccguguuccccgcgcccgccggcagcgccgggacccccccgcugcccgccacguccgccagcgcgcccgccccgcuggugcccgccaccguccccuccagcaccgcccccgacgccgcggccggcggcgcccagacccucgccgacggguucacguccccgaccccccccguggugagcuccacccccccgaccggccaccccguccaguucuacagcaugaaccgccccgccagccggcacacgcccccgaccaucgggggcucccugcccuaccgccggccccccagcaucaccucccagaccagccugcagaaccagaugaacgggggcccguucuacucccagaaccccgugagcgacacgccccccccgcccccccccguggaggagccggucuucgacgaguccccccccccgcccccccccccggaggacuacgaggaggaggaggcggccguggucgaguacagcgaccccuacgccgaggaggacccccccugggccccgcgcuccuaccucgagaaggugguggcgaucuacgacuacaccaaggacaaggaggacgagcugagcuuccaggagggcgccaucaucuacgucaucaagaagaacgacgacgggugguacgagggcgugaugaacggggugaccggccuguuccccgggaacuacgucgaguccaucaugcacuacagcgaguga

SEQ ID NO: 26196 - RNA, 3228 nt, Artificial Sequence
  derived and/or modified sequence opt1 from ABI3BP__Homo_sapiens__NP_056244
augcgcggcgggaagugcaacaugcugagcucccucggcugccugcugcucugcgggagcaucacccuggcccugggcaacgcccagaagcuccccaaggggaagcggccgaaccugaaggugcacaucaacaccacguccgacagcauccugcucaaguuccugcgccccucccccaacgucaagcuggagggccuccugcugggcuacgggagcaacgugucccccaaccaguacuucccgcuccccgcggagggcaaguucaccgaggccaucguggacgccgagcccaaguaccugaucgucgugcggcccgccccgccgcccagccagaagaaguccugcagcgggaagacccgcucccggaagccccugcagcucguggucggcacccugacgcccagcuccguguuccugagcuggggguuccucaucaacccccaccacgacuggacccugcccucccacugccccaacgaccgcuucuacaccauccgguaccgcgagaaggacaaggagaagaaguggaucuuccagaucugcccggccaccgagacgaucguggagaaccugaagcccaacaccgucuacgaguucggcgugaaggacaacguggagggcgggaucuggagcaagaucuucaaccacaagaccgucgugggcuccaagaaggugaacgggaagauccagagcaccuacgaccaggaccacacgguccccgcguacgugccccggaagcucaucccgaucaccaucaucaagcaggucauccagaacgucacccacaaggacuccgccaagagccccgagaaggcgccccugggcggcgugauccuggugcaccucaucauccccgggcugaacgagaccacggucaagcugccggccagccucauguucgagaucuccgacgcccugaagacccagcuggccaagaacgagacccucgcccugcccgccgagagcaagacccccgagguggagaagaucuccgcccgccccacgaccgugaccccggagaccgucccccggagcacgaagcccaccaccuccagcgcgcuggacguguccgagaccacgcucgccagcuccgagaagccguggaucgugcccaccgccaagaucagcgaggacuccaaggugcugcagccccagaccgccaccuacgacguguucagcucccccacgaccagcgacgagccggagaucuccgacagcuacaccgccaccuccgaccgcauccuggacagcaucccgcccaagacgucccggacccucgagcagccccgcgcgacccuggcccccagcgagacccccuucgucccccagaagcuggagaucuucaccagccccgagaugcagccgacgacccccgcgccccagcagaccaccuccauccccagcacgccgaagcggcgcccccggcccaagcccccgcgcaccaagcccgagcggaccaccuccgccggcacgaucacccccaagaucagcaagucccccgagccgaccuggaccacgcccgcccccgggaagacccaguucaucagccucaagccgaagaucccccugucccccgaggugacccacaccaagcccgccccgaagcagacgccccgcgccccgcccaagcccaagaccagcccccggccccgcaucccccagacccagccggugcccaaggucccccagcgcgugaccgccaagcccaagacguccccgagccccgagguguccuacaccacccccgcccccaaggacguccugcucccgcacaagcccuaccccgaggugagccaguccgagcccgccccgcuggagacccggggcauccccuucauccccaugaucagccccuccccgagccaggaggagcugcagacgacccucgaggagaccgaccaguccacccaggagcccuucacgaccaagaucccccgcaccaccgagcuggcgaagacgacccaggccccgcaccgguucuacaccaccgugcgcccccggacgagcgacaagccccacauccgccccggggucaagcaggccccgcggcccagcggcgccgaccgcaacguguccguggacagcacccaccccaccaagaagcccggcacccggcgcccgccccugccgccccggcccacccacccccgccggaagccccugcccccgaacaacgucacggggaagcccggcuccgcggggaucaucagcuccggccccaucaccacgcccccgcuccgcagcacgccccggcccaccgggacgccccuggagcgcaucgagaccgacaucaagcagccgaccgugcccgccuccggcgaggagcuggagaacaucaccgacuucagcuccagccccacccgggagaccgacccccucggcaagccgcgcuucaaggggccccacgugcgguacauccagaagcccgacaacuccccgugcagcaucaccgacuccgucaagcgcuuccccaaggaggaggccaccgagggcaacgccaccagcccgccccagaacccgcccaccaaccugaccguggugacggucgaggggugccccuccuucgugauccuggacugggagaagccccucaacgacaccgugaccgaguacgaggucaucagccgcgagaacggcuccuucagcgggaagaacaaguccauccagaugaccaaccagacguucagcaccguggagaaccugaagcccaacaccagcuacgaguuccaggugaagcccaagaacccccugggcgagggccccgucuccaacaccguggccuucagcacggaguccgcggacccgcgggugagcgagcccgucuccgccgggcgcgacgccaucuggaccgagcggcccuucaacagcgacuccuacagcgagugcaagggcaagcaguacgugaagcgcaccugguacaagaaguucguggggguccagcucugcaacucccugcgguacaagaucuaccugagcgacucccucaccggcaaguucuacaacaucggcgaccagcgcgggcacggcgaggaccacugccaguucguggacagcuuccuggacgggcggacgggccagcagcugaccuccgaccagcuccccaucaaggagggguacuuccgcgccgugcggcaggagccgguccaguucggcgagaucggcgggcacacccagaucaacuacgugcagugguacgagugcggcaccacgauccccgggaagugguga

SEQ ID NO: 26197 - RNA, 1083 nt, Artificial Sequence
  derived and/or modified sequence opt1 from ABI3__Homo_sapiens__NP_001128658
auggccgagcugcagcagcuccaggaguucgagauccccaccggccgcgaggcccugcgggggaaccacagcgcgcugcuccgcguggccgacuacugcgaggacaacuacguccaggccaccgacaagcggaaggcccuggaggagacgauggccuucaccacccaggcgcuggccuccguggccuaccaggugggcaaccucgccgggcacacccugcgcaugcuggaccuccagggcgcggcccugcggcaggucgaggcccgcauggugaacaugcacauggagaagguggcccggcgcgagaucgggacgcuggccaccguccagcggcucccgcccggccagaaggugaucgcgcccgagaaccugcccccgcugacccccuacugccgccggccccucaacuucggcugccuggacgacaucgggcacggcaucaaggaccugagcacccagcucucccgcacggggacccugagccggaaguccaucaaggcccccgccaccccggccagcgccacccugggccgccccccccggauccccgagccggugcaccuccccgucgugcccgacgggcgccuguccgcggccagcuccgccagcucccuggccagcgccggcuccgcggagggcguggggggcgcccccacgccgaaggggcaggccgccccccccgcccccccgcuccccagcucccuggacccccccccgccccccgcggccgucgagguguuccagcggcccccgacccuggaggagcucagcccccccccgcccgacgaggagcugccccugccccucgaccugccgcccccccccccgcuggacggcgacgagcucggccugcccccccccccgcccggguucggccccgacgagcccuccugggugccggccagcuaccuggagaaggucgugacccucuaccccuacaccucccagaaggacaacgagcugagcuucagcgaggggacggugaucugcgucacccgccgguacuccgacggcuggugcgagggggugagcuccgagggcaccggcuucuuccccgggaacuacguggagcccagcugcuga

SEQ ID NO: 26198 - RNA, 3393 nt, Artificial Sequence
  derived and/or modified sequence opt1 from ABL1__Homo_sapiens__NP_005148
augcuggagaucugccucaagcuggugggcugcaagagcaagaaggggcuguccagcuccagcuccugcuaccucgaggaggcccugcagcgccccgucgccagcgacuucgagccgcagggccuguccgaggcggcccgguggaacagcaaggagaaccuccuggccgggcccuccgagaacgaccccaaccuguucguggcccucuacgacuucguggccagcggcgacaacacccuguccaucaccaagggggagaagcugcgcguccucggcuacaaccacaacggcgaguggugcgaggcgcagacgaagaacgggcagggcugggugcccagcaacuacaucaccccggugaacucccuggagaagcacagcugguaccacgggcccgucucccggaacgccgccgaguaccugcucagcuccggcaucaacgggagcuuccuggugcgcgaguccgagagcagccccggccagcgguccaucagccugcgcuacgagggccggguguaccacuaccgcaucaacaccgccuccgacgggaagcucuacgucagcuccgagagccgguucaacacccuggcggagcuggugcaccaccacuccacgguggccgacggccucaucaccacccugcacuaccccgccccgaagcgcaacaagcccaccgucuacggggugagccccaacuacgacaagugggagauggagcggacggacaucaccaugaagcacaagcugggcggcgggcaguacggcgagguguacgagggggucuggaagaaguacucccucaccguggccgugaagacccugaaggaggacacgauggaggucgaggaguuccugaaggaggccgcggugaugaaggagaucaagcaccccaaccucgugcagcugcugggcgucugcacccgcgagccgcccuucuacaucaucaccgaguucaugaccuacgggaaccuccuggacuaccugcgggagugcaaccgccaggaggugaacgccgugguccuccuguacauggccacgcagaucagcuccgccauggaguaccuggagaagaagaacuucauccaccgggaccucgccgcgcgcaacugccuggugggcgagaaccaccuggucaagguggccgacuucggccucagccggcugaugaccggggacaccuacaccgcccacgccggcgccaaguuccccaucaaguggacggcgcccgagucccuggccuacaacaaguucagcaucaaguccgacgugugggccuucgggguccuccugugggagaucgccaccuacggcaugagcccguaccccgggaucgaccugucccagguguacgagcuccuggagaaggacuaccgcauggagcggcccgagggcugccccgagaagguguacgagcugaugcgcgccugcuggcaguggaacccgagcgaccggcccuccuucgcggagauccaccaggccuucgagaccauguuccaggagagcagcaucuccgacgaggucgagaaggagcucggcaagcagggggugcgcggcgccgugagcacccugcugcaggcccccgagcugcccacgaagacccgcaccucccggcgcgcggccgagcaccgggacaccacggacgucccggagaugccccacagcaaggggcagggcgaguccgacccccucgaccacgagcccgccgugagcccgcugcugccccgcaaggagcgggggcccccggagggcggccucaacgaggacgagcgccugcugcccaaggacaagaagaccaaccucuucuccgcccugaucaagaagaagaagaagaccgcccccaccccgcccaagcggagcuccagcuuccgcgagauggacgggcagcccgagcggcgcggcgcgggggaggaggagggccgggacaucuccaacggcgcccuggccuucacgccccucgacaccgccgaccccgccaagagcccgaagcccuccaacggggcgggcgugcccaacggggcccugcgcgagagcggcggguccggcuuccggagcccccaccuguggaagaaguccagcacccucaccagcucccgccuggccacgggcgaggaggagggcggcgggagcuccagcaagcgguuccugcgcuccugcagcgccuccugcgucccgcacggggccaaggacaccgaguggcggagcgugacccucccccgcgaccugcaguccaccgggcggcaguucgacagcuccaccuucggcggccacaagagcgagaagcccgcgcugccccgcaagcgcgccggggagaaccgguccgaccaggugacgcgcggcaccgucaccccgccgccccggcucgugaagaagaacgaggaggccgccgacgagguguucaaggacaucauggagagcucccccgggagcuccccgcccaaccugacccccaagccccugcgccggcaggucacgguggcgccggccagcggccucccccacaaggaggaggccgggaagggcuccgcccugggcacccccgccgcggccgagccggugacccccaccagcaaggccgggagcggcgcccccgggggcacguccaaggggcccgccgaggagagccgcguccggcgccacaagcacuccagcgaguccccgggccgggacaagggcaagcugagccgccucaagcccgcgccgccgcccccgcccgccgccuccgccgggaaggccggcgggaagcccagccagucccccagccaggaggcggccggcgaggccgugcugggcgccaagaccaaggcgaccucccugguggacgccgucaacagcgacgccgccaagcccucccagcccggggagggccucaagaagcccgugcugcccgccacccccaagccccagagcgcgaagcccuccgggacgcccaucagccccgcccccgugcccuccacccugccgagcgccuccagcgcccucgccggcgaccagcccagcuccaccgcguucaucccccugaucagcacccgggucucccugcgcaagacgcggcagcccccggagcgcaucgccagcggggccaucaccaagggcguggugcucgacuccaccgaggcccugugccuggccaucagccggaacuccgagcagauggcgagccacuccgccguccucgaggccggcaagaaccuguacaccuucugcgugagcuacguggacuccauccagcagaugcgcaacaaguucgccuuccgggaggccaucaacaagcuggagaacaaccuccgcgagcugcagaucugccccgcgacggccgggagcggccccgccgccacccaggacuucuccaagcugcucagcuccgucaaggagaucagcgacaucgugcagcgguga

SEQ ID NO: 26199 - RNA, 3195 nt, Artificial Sequence
  derived and/or modified sequence opt1 from ABL2__Homo_sapiens__NP_001129472
auggugcugggcaccguccuccugcccccgaacagcuacgggcgcgaccaggacaccucccugugcugccucugcacggaggccagcgaguccgcccugcccgaccugaccgaccacuucgcgagcugcguggaggacggcuucgagggggacaagaccggcggguccagccccgaggcccuccaccggcccuacggcugcgacguggagccgcaggcccugaacgaggccauccgcugguccagcaaggagaaccugcucggcgccaccgaguccgaccccaaccuguucgucgcgcuguacgacuucguggccagcggggacaacacgcucuccaucaccaagggcgagaagcugcgggugcugggguacaaccagaacggcgaguggagcgagguccgcuccaagaacgggcagggcugggugcccagcaacuacaucacccccgugaacucccucgagaagcacagcugguaccacggcccggucucccggagcgccgccgaguaccugcuguccagccucaucaacgggagcuuccuggugcgcgaguccgagagcucccccggccagcugagcaucucccuccgguacgaggggcgcguguaccacuaccggaucaacaccacggcggacggcaaggucuacgugaccgccgagagccgcuucuccacccuggccgagcuggugcaccaccacagcaccgucgccgacggccucgugacgacccugcacuaccccgcccccaagugcaacaagccgaccguguacggggucucccccauccacgacaagugggagauggagcggaccgacaucacgaugaagcacaagcugggcgggggccaguacggggagguguacgugggcgucuggaagaaguacagccucaccguggcggugaagacccugaaggaggacaccauggaggucgaggaguuccugaaggaggccgccgugaugaaggagaucaagcaccccaaccucguccagcugcugggcgugugcacgcucgagcccccguucuacaucgugaccgaguacaugcccuacgggaaccugcuggacuaccuccgcgagugcaaccgggaggaggucaccgccguggugcugcuguacauggccacccagaucuccagcgcgauggaguaccucgagaagaagaacuucauccaccgcgaccuggccgcccggaacugccuggucggcgagaaccacguggugaaggucgccgacuucgggcucucccgccugaugacgggcgacaccuacaccgcccacgcgggggccaaguuccccaucaaguggaccgcccccgagagccuggccuacaacacguucuccaucaagagcgacgugugggccuucggcgugcuccugugggagaucgcgaccuacggcauguccccguaccccgggaucgaccugagccaggucuacgaccuccuggagaagggcuaccggauggagcagcccgaggggugcccgcccaagguguacgagcugaugcgcgccugcuggaaguggucccccgccgaccggcccagcuucgccgagacccaccaggcguucgagaccauguuccacgacagcuccaucagcgaggagguggccgaggagcugggccgcgccgccuccagcuccagcgucgugcccuaccucccgcggcugcccauccugcccuccaagacgcgcacccucaagaagcaggucgagaacaaggagaacaucgagggggcccaggacgcgaccgagaacagcgccuccagccuggccccgggcuucauccgcggcgcccaggccuccagcgggucccccgcgcugccccggaagcagcgcgacaagagccccuccagccuccuggaggacgccaaggagaccugcuucacgcgggaccgcaagggcggguucuucuccagcuucaugaagaagcggaacgccccgaccccgcccaagcgcagcuccagcuuccgggagauggagaaccagccccacaagaaguacgagcugaccggccuccccgagcaggaccgcauggccaugacccugccccggaacugccagcgcuccaagcugcagcucgagcggaccgugagcacguccagccagcccgaggagaacguggaccgcgccaacgacaugcugcccaagaaguccgaggagagcgcggccccgucccgggagcgccccaaggccaagcugcucccccggggcgccaccgcgcugccccugcgcaccccgagcggggaccucgccaucaccgagaaggacccgcccggcgugggggucgccggcguggccgccgcgcccaaggggaaggagaagaacggcggcgcccggcuggggauggccggcgugcccgaggacggggagcagcccggcuggcccucccccgccaaggccgcgccgguccugcccacgacccacaaccacaaggugcccgugcucaucagcccgacccugaagcacacccccgccgacguccagcugaucgggacggacucccagggcaacaaguucaagcuccugagcgagcaccaggugaccuccagcggcgacaaggaccgcccccggcgcgugaagcccaagugcgccccgcccccgccgcccgucaugcgccugcuccagcaccccuccaucugcagcgaccccaccgaggagcccaccgcccugacggccgggcaguccaccagcgagacccaggagggcgggaagaaggcggcccugggcgccgugcccaucagcgggaaggccggccggcccgugaugcccccgccccaggucccccuccccaccuccagcaucucccccgcgaagauggccaacggcacggccgggaccaagguggcccugcgcaagaccaagcaggccgcggagaagaucagcgccgacaagaucuccaaggaggcccugcucgagugcgccgaccugcugagcuccgcccucaccgagccggugcccaacagccagcuggucgacacgggccaccagcugcucgacuacugcuccggguacguggacugcaucccccagacccggaacaaguucgcguuccgcgaggccgugagcaagcuggagcugucccuccaggagcugcaggucagcuccgccgccgccggcgugcccgggaccaacccggugcugaacaaccuccugagcugcguccaggagaucuccgacguggugcagcgguga

SEQ ID NO: 26200 - RNA, 2157 nt, Artificial Sequence
  derived and/or modified sequence opt1 from ABLIM1__Homo_sapiens__NP_001003407
augcugaugacccucgagaugaccgagcugacggacccccaccacaccaugggcgacuacaagguggcccacccgcaggacccccaccaccccagcgagaagcccgucauccacugccacaagugcggggagccgugcaagggcgaggugcugcgcgugcagaccaagcacuuccacaucaagugcuucacgugcaaggucugcgggugcgaccucgcccagggcggguucuucaucaagaacggcgaguaccugugcacccuggacuaccagcggauguacggcacccgcugccacgggugcggcgaguucguggagggggagguggucaccgcgcucggcaagaccuaccaccccaacugcuucgccugcacgaucugcaagcggcccuucccgcccggggaccgcgugaccuucaacggccgggacugccugugccagcugugcgcccagcccauguccagcucccccaaggagaccaccuucagcuccaacugcgccggcugcgggcgcgacaucaagaacggccaggcccuccuggcgcuggacaagcaguggcaccucgggugcuucaagugcaagagcugcggcaaggugcugacgggcgaguacaucuccaaggacggggcccccuacugcgagaaggacuaccagggccuguucggggucaagugcgaggccugccaccaguucaucaccggcaaggugcucgaggccggggacaagcacuaccacccgagcugcgcgcggugcucccgcugcaaccagauguucaccgagggcgaggagauguaccugcagggcagcaccguguggcaccccgacugcaagcaguccacgaagaccgaggagaagcugcggcccacccgcaccagcuccgagagcaucuacucccggcccgggagcuccaucccgggcagccccgggcacacgaucuacgccaaggucgacaacgagauccucgacuacaaggaccuggccgccauccccaaggugaaggccaucuacgacaucgagcgccccgaccugaucaccuacgagccguucuacaccuccggcuacgacgacaagcaggagcggcagagccucggggagagcccccgcacccugucccccacgcccagcgcggagggcuaccaggacgugcgggaccgcaugauccaccgguccaccagccagggcuccaucaacagcccggucuacucccgccacagcuacacccccaccacgucccggagcccccagcacuuccaccgccccgggaacgagccguccagcggccggaacagcccccugcccuaccgcccggacucccgcccccucacccccaccuacgcccaggcccccaagcacuuccacgugccggaccaggggaucaacaucuaccggaagccgcccaucuacaagcagcacgccgcccuggcggcccaguccaagagcuccgaggacaucaucaaguucagcaaguuccccgccgcccaggcccccgaccccuccgagacccccaagaucgagacggaccacuggcccggcccgcccagcuucgcgguggucgggcccgacaugaagcgccggagcuccggccgcgaggaggacgacgaggagcugcuccggcgccggcagcugcaggaggagcagcugaugaagcucaacagcggccuggggcagcugauccucaaggaggagauggagaaggagucccgcgagcggagcucccugcuggccagccgcuacgacucccccaucaacagcgccucccacaucccgagcuccaagaccgccagccuccccggcuacgggcggaacggccugcaccgccccguguccaccgacuucgcccaguacaacagcuacggcgacguguccgggggcguccgggacuaccagacccugcccgacgggcacaugccggcgaugcgcauggaccggggcgugagcaugcccaacaugcucgagcccaagaucuuccccuacgagaugcugauggugacgaaccgcgggcggaacaagauccugcgcgaggucgaccggacccgccucgagcgccaccuggccccggagguguuccgggagaucuucggcauguccauccaggaguucgaccgccugccccucuggcggcgcaacgacaugaagaagaaggccaagcuguucuga

SEQ ID NO: 26201 - RNA, 1938 nt, Artificial Sequence
  derived and/or modified sequence opt1 from ABLIM2__Homo_sapiens__NP_001123555
augagcgccgugucccagccccaggccgcgccgagcccccuggagaagucccccagcaccgccauccucugcaacacgugcggcaacgucugcaagggggaggugcugcgcgugcaggacaaguacuuccacaucaagugcuucgucugcaaggccugcggcugcgaccuggccgagggcggguucuucgugcggcagggggaguacaucugcacccucgacuaccagcgccuguacggcacccggugcuucuccugcgaccaguucaucgagggcgagguggucagcgcccuggggaagaccuaccaccccgacugcuucgugugcgcggugugccgccucccguucccgcccggcgaccgggucaccuucaacgggaaggagugcaugugccagaagugcucccugcccgugagcgugggcuccagcgcccaccugucccaggggcuccgcagcugcggcggcugcgggacggagaucaagaacggccaggcccuggucgcccuggacaagcacuggcaccucgggugcuucaagugcaaguccugcggcaagcugcugaacgcggaguacaucagcaaggacggccuccccuacugcgaggccgacuaccacgccaaguucgggauccggugcgacuccugcgagaaguacaucaccggccgcgugcuggaggccggggagaagcacuaccaccccagcugcgcccugugcgugcggugcggccagauguucgcggagggggaggagauguaccuccagggcuccagcaucuggcaccccgccugccgccaggccgcccggaccgaggaccgcaacaaggagacccggacguccagcgagagcaucaucuccguccccgccagcuccaccagcggcuccccgagccgcgugaucuacgcgaagcucgggggcgagauccuggacuaccgggaccucgccgcccugcccaaguccaaggccaucuacgacaucgaccgccccgacaugaucagcuacucccccuacaucagccacuccgccggggaccggcagagcuacggcgagggggaccaggacgaccgcuccuacaagcagugccggaccagcuccccgagcuccaccggcagcgugucccugggccgcuacacgcccaccagccggagcccccagcacuacucccgccccgcggggaccgucagcgugggcaccuccagcugccucucccugagccagcacccgucccccacgagcguguuccgccaccacuacauccccuacuuccggggguccgagagcggccgcuccacccccagccuguccguccucagcgacuccaagccgccgcccagcaccuaccagcaggcgccccggcacuuccacgugcccgacaccggggugaaggacaacaucuaccgcaagccgcccaucuaccggcagcacgccgcccgccgguccgacggcgaggacggcagccuggaccaggacaaccgcaagcagaaguccagcuggcugaugcucaagggggacgccgacacgcggaccaacagccccgaccuggacacccagucccugagccacuccagcggcaccgaccgcgacccccuccagcggauggccggggacuccuuccacagccgcuuccccuacuccaagagcgacccccugccgggccacggcaagaacgggcuggaccagcggaacgccaaccucgcccccugcggcgccgaccccgacgcguccugggggaugcgcgaguacaagaucuaccccuacgacagccugaucgucacgaaccggauccgcgugaagcugccgaaggacgucgaccggacccgccucgagcggcaccugucccccgaggaguuccaggagguguucggcaugagcaucgaggaguucgaccgccuggcccucuggaagcgcaacgaccugaagaagaaggcccugcuguucuga
